United States Patent 9,328,346 (POLYCOMB-ASSOCIATED NON-CODING RNAS) - sequence listing, part 132

SEQ ID NO: 191633 - RNA, 1135929 nt, Homo sapiens
uuaaugaauuuucaggaagaugaugcucuaaucuuuauuaaguacauacuuaaaaaauuaaaaaagaaaacauacuugagaugucaagauuaaauguguuuauuuugaguuaguuagugaauacaaugguauauuagauaccagcacuccaagcuacaccuauguauuugccucuaacuuucacacguugucaguuuccuucccucuaauauuccaccacugggccuucuauuucuagcaaaaucaugguucaaauuaaaaagaaaaaaaaaugaaagcaagauuggucaccguauugugcuuccagugcccccagaaggauuuuaauugucucaaauagauguuuauuguuuucauuaaaggggggaaaaaaacaugaucacuaguaauggcacaacuagaagaggaaacagaaugcagauuaaaagaagcauuuuaggcuggacuaguuaauuuccccucaguuaaaaaucgacauaauaucacggauauagacuucaagguuaaauuguucaauucaugggccacacacuuaagcguauuggcuaguacauuuuugcacugaaacagaagcaauacaaguuuuauguucuaccauuacacuuccagauuuuucacuuaugcauauaccugccaaccuaaugauucuugcaugcauuagaguuugcuuuuguagaguuaaguuuauuuuccccaucccucccacucccauaaauauugcgccaaugcgaacucugugcccaauuuuaugagaauguugcaaaggacagcucugugccaccuuaguacaggaauguccugucuccuucccaggcuacagauggaucaguaguauugaucucaucucaucuuacaugcaaacagacacuguucccuuaauuuccccaugccagaggcauacgagcuggcagguaugcauacaaaaauggaauuaaaaagaaaaagaaagaaagaaaagaaagaaaaagcuuucuuguuaaaaccuaucguccuagaaggaauccauugcuuugaauucacuuaaagccuguacaggcgaaauguguuucuucugagaaccucgucgaacucgugucuggaauucuucaggcuuuucucucuucacaaggggcuucuucucuggagccuucaucuuccaagacacaacaggugaguugacagcugcugucccauagaccuucugguauuugguugaggccacauaggaugcuuucaccgugaggacaacagcauucaucagguuuuuagcugccuggauaagcgauguggcacuguccagcuagaguaggaaaagaaugagauacauguggguuaauggaggccccaaauucacaaaauggugauguacuuucacgguuaaaauaauguuuuccuugugcaaauaaauaguauugcugaaaaggagcaaauuaucacaaguuaagguuuuuaaaaucucaauacagcuaauggcaaagcccucaucuuagcagguaggaauuccaagguaacaaaaguuuuccaaaguagaacaucucauauuauuacauuaggguaauuagcaauggugacauuuacucaaauguuggacaagcauuuggcagacacuaaagaaaaaaaguuauaagggguuaccucucaauuuuauggcccaagaaauggaaguaucuaucuauaggcuauuucuguaucuugagcucaggguuggugaggauacagucauuuaggcagaagaacaauccauggguguucuugcuucuaugagguguuaauugagcuuggaguaucaauuuaacuauuaacagguccucaguauaccuccuauauaaauacugauacuuaugucaggaucucauagcauucagugagaccuucucauacaugcauuaaugaaauauucaguauuuacuaugugccaaauacuauuaugagaaauuuguauuuucccacuuagcucuuguuaacaacucuauaauauaggcauuaucgucaugcccuuuuagaaugagagagcugauacaugcagagguccaguaacuagcacagguuuuagucuuuaaagauacuacucaucuguacugucaccuuguuggauaggauggcuuuuaaaaaugccaagacaagucacaacuugagaauagguuuagaggcccaucaccagacuuuuaggccaggaauauuuuggguuaccuuuuuucugucuuuaaguaguuagugugguauguacuguauacuagaucauucaauaucuucuucaaccuucuugcuucacugccugcaucacagaugcugggguuaugucucaauguuauagcccaaccaauggaaguaccuauuuaucuauacacuauuucuauauccugagcucaggauuggugaggcucaaaaaugcauuuccuagacucuccaucagccaggagucuacaugugagcuagugaaagaaaagaauuaacagcugaacugcaaauaucauuccagccucagggauguuugagcauagucugaucuuucaucaaacuucuuguaacaucaacuaaugagauauaucaauuacaguuaacugaaggaagcaaagauguucuuaaguaugcuguuccuaguuggagagauuauuuguuguguagccuguaauucaugaacuucaugaacuguagcugcauuaagccuucugggggcuaggugacuaagaaaguguuuaaacugagagacuguagaucuuaugguucuuccaucugacgugacuggcauucacuuuagcuucguaucauuucuuauuaacaaaauaugucccacgcaguauugagguuaucagaaguuguaucuaacacaacugugauacuguuccuuuggcugcuuuuuguuccauaucccuuauuuaagcuaaauuaauguugcgcuguguuuuuaaaaaugucaaucaaaugagcucaauuuuuccaucaccagaaaagcuuguagucugaccauuggggaaaacaauggaagauguuuuauauaauugcuuugugaauuaacucaaccaaauggauggaguaacccacuuacuugaucacuucuauuaugccauacaaaaugcacguauaccaaaaucacugcugaaccccauacucuuucguuuauacagcccaaauuucuaaagauagcuaaggaaaagcaaacucuagguuauucauguuaacaggagagaagccaagcaugaauuaguggggugauucucaaagccuagucccugaggugcaacagcaucagcaucacccgggaaucuguuagaaaucgcauuuaucaggcccaauccaaaacuuacugaaucaaaaccuugcaaucuuuguuuuaacuagcuagccauccaggagguucugauacuugccaaaguuugagaaccacuggauuaaugaaaccuaaagacugucuugaugguuuacuuuauccagugauuucaggacuuccgucauacacaaguuugguaauaucauagccaguuaucucacaugaauuuuacuuuuucgucuuucccaucuuacccccagguagaaguguaaauaaugaaggacagagaugagacagcaaaauguugggaacaaucaggaacagauaagucacaguuucuuuagaagcuaaauaccuaacaccuuuggccaaugcacaguucucuguaagucugucagguuucaaaaaugaguaauguuaauucauaaaauuaguuaauucuaucgcaugcuaugaguaaauaaaggguaaaauaugacagggacguuucauugauuugcuuugggcaacagaauuaguagaaauagaacaagaugauauugcucuuguauuauuaaaugguccccaaagagugagucuugggagaauugagcugaucugaagagaagggauuacaaguaaauuuggagauuuuuaccacagauuccauuuucaaauagaugguguuuaauucugcagcaaaaauaugagagccugucucuucuucagaaccccuuugccuuucaaaccugaugcaggaauccuguaaauaaaccuaauacacuguuugagagugagauagcuuugaaauauaaagccaagaauuuuauucaagccaccugcuaaggcagaucuugaauuugcagcaagguaaagugaggaggugagagauccagccaacugaacuggaacaaauauuuccacaaacaauaagcccaauuuaaaguuaauacaaaauuugacuuuuaaaaaaaguugaauuuccaaagguuacauuuugcccuuuucuguagaugcacuuucaugauuuagaucauuaucagcacaaucacaauucuuuccaauuuaaaaauggguuucuuuaugccuuuccaagauggugccaaaacucuguuuuccaauuggcaagguuggcuaaaacuucacuuccuaaagaaaagauauuagaauaaagcugcauggcaacaguuuuuaaauaccaaguuuaggaacauuuauuuaacauaguugcauucucuuuugugacuuauuguaaugauggcguuuucaacaagauagguaagugaauacguauaaguuuucauaauaaucaaaauucagugagcacuuacuagacgccugacauugaguccuuuuaauugugugauuuaauuuucaaaaauucucgaaguaggaaugauuauuacuccccauuuaauaagugaggaaguugaagcuuagggagguaacguaaguuguugucccugcagucauuggcaaaguagggauuaggaccacuacuaucucucuccaaggcccacucaucugaaccccaccauggagcaauguucccccgaagcaucacuugaucucucaggucuuguuuuuuaguuauugccuauccaaaaugaacucuuuucuacuaaugaacaggcuggaagccuguccccuaaaccuggcaacauccuuuuaacaucauggcuaugucugauaagugcuucaucucucacaaucugugauucuuagucucauccucauagcccaaauccuugcugacuauagccucuggccucagguauguugcugcccagagcucagcccuuccuuguucuuccuggccuugagucacccuuauggaaauaaauagacacuggaaacugaucucugcuaauuugucuuggauuugcuccauuauucugaagcacauuuauacuaggcagggcucagcuacucuuauuagucaucuaauccuuuaccugguccagucuugcuaguuuuaaaauggccucaaaaaucaaccaccucucagcccuuccucaagcugaccugaauuacagugacaggccuuuucagcagaaagacauauccaucuuuuccugguuaagggccuuuuauauuccuauaggauaucccauuaaguuccuguaucuaaccuaagagaaacugcuuauuuucagcuaguuuaaaaacaagggcauacauuuaacaaauuagaccaugugcuguuuucugaacuaguucccugaguuucguuuauuucauucuaucucacaaccagcccugagacaaggcuugaccaauugagacuuagaagcauauagcuugcccauuaucacacugcuaacauguggugaagccaagauguaaacccaggccaucuaaccacugagcccaugaucuuaccauuccuccaugcuauuucccagagccauccagagcagaugaauccucagcccucaaaaucuaccaagaucugcuacacucauucucccuauuccaucccauagguaucugcugucccuaaccacaggaaauuagacuucugcuaauuauuaugauucucuuaaaacaucaaaauacuauguuuaaaagaaaacagauguuuccucccaucuugugcuauuacaguccaugaaaagcaaauaggggcaggagagcuguuuuauaggccuuucuauaggacauugucuuuuuuuccccugccucuauuccuacucuucuuaauaccacucaacuucuaaaagauuucuguucccuauacucuccucauuuuguguuuugaaugggcagaaagacuggagcaaagacuuaucugaauugugauucuuccauuuaucaauauuugugcagccuaauuccuuauaucaccaaagcugaagaacaucguaauaaguauuugaaaugacucuugcuacagcuuauguuaucaacugaauauuucugaaagccuauguccuuagcugcaugcuacuucauucaaacaggacuuaugcugcaacagguguucaguuucaacagaaacagaauucgacugcagaagucaaccacauucuuucaaaggaaagugcaacuacaccucuugaaauguugaauuaucacugacuuuuuauccuccagucuaucccuacauuuuuccaucuacacaucauccaaguauuucuucagacaccuacugaauacuuucugccaacuacugugcuuaaguguuggguauagaaacacaaauagacauaagcacugaaacacaagagcucacaauacaaugagaaaaauagacacaaacuaaagguuuuaacacuguaugacaguguuuuaguaggaugcgagaugcuaaaugaacaaaaggaauagcaauuuaccuugagucaaguagggauaggagaagggaaacagcuucauugugggcaugauaucuaaacacucuuuaauaagagguuguuggugacugaaugguuaacagugacgaggaaggacaauucucaaauaccuaacuaguccaacuuaguauacaucaaugcucucaaccuagauugcggaaauauaaaggauguugaagugcuacaaugcugaguauaacuuuggacauaccgaguuugagguguguauguuacaucuaggugauuuaucagagguccaguuguauuuaugggaguaaauauuaaaaaaaucauguuuugcuuauauugaucuucccaauuguuucauguagggugauguucugcauacuguagguguauaacauguuugauuuuguccuuucauauuccuuacuguuuuuacaaagauuaaauccauacacaaaaguucaauaaauuuaccaaaaaauuucucagaauaagaccuuuaaaaucaauauuaauauccuuuuaauaaucuaagauauuuuuaauaaucuaagauauaacgucaucaacaaguauuuuacuugaauagaaaauaaccuuccuugguuaaguagggaauaguuaaguaauuagcaaucuuuuacccuucagaauggugaacuuccugagguaagauagaaauaaaauaaaugcuauuuuguaacagcuugcuuuaaaaacaaauaauaguauugucaaaagugaaaaauaauauaaaacaaguaggggacacauugcagaugacaugacauaguaaaugucuuagaauguuaacuuguggaggccgggcauacgauuaaagaagagaauuaggauuugacuguguguucugaauucauauauuuacaauaugcauggagagagagaucaauuuucacauuguaugucuuuuuucaaaaaagcugaucaucuacuaacaaaaauuaaugacacauaaauggcaguucaugaaaauccaaaucacaaagcaaucugucauuggauuaaaaauaaugcaaaugucaugggaccgcuggcuaagcuaaauagaauaaaauaagccaaauccaucuggaaggugauuuugaaauaaaagaacugagguguuuacuuugauuacuucaaauggcuuagaaaugccuggaagaaggaaccaguuccauuugggccuugcuauuuuauuuucauuuuuguaagucagagccaauaacacuaaugaguuugauaaugcuaaaauauuucccuaaauauguguaaaguccacuuuagccuuuugcaauauuuuaaaaugggaauagcauagcuuuaacauauaagaacaagaacgauuuuaaggggguuguucuaaacauguucagaccuagaguagguuuucaggguaggaaauuuugaugggagaauuggcaauaaauugaaagcaaacaccucaaggaaacuggaaucuuuccacuggagcuggucauuuauuuauauuuaaacuguuaucucccucaaaggagucacauauugcuugcaaggaaaaaaaaauuuugcuacaagucagcuuugcuguuaaugaauuagagguuagaaacccagagcauuggagccuauuauccuccaagaagaacauuucauguuuuaaaaauccaugaggcuuugaagaccuauuugauguccuuagaaacugugacauguuugaaauaucuugaaauaccugcguacauuuuccagagucuauaucaauaacacuuuuuaaaaaccucuagaaaguccaggguaauaaauaacucaagcaaacaaagacauggugaaaagguucagccuaaucacaucuuuucccacuuaaguuaucucagaauguuuauauguucacagaaagacauuuccuugauagcaagcucucauuucuguguuggagucuacucacucuuucucaucaaacaaauucucauccauaguguccauggcaggcauuauuaaucacucaggcaccuugcuccuucagaaucugcuaaguagugugggaaaggaaacuuauuuaccucccaagagcagacauuuuaacaggguuguccaaaaaaacuugauucuguuuauggcacagauauaucauccauuguaucacgacuucuguauuugaauuguuugauuucuauuguuuguuagcuaucaaauauugucugauacugacuuuuuuguuuuuuuguuuuuuuuugagauguuaucucgcugucacccaggcuggagugcaguggcacaaucucggcucacugcaaccuccgccuaccggguucaagcgauucuccuaccucagccuccugaguagcugggauuacagaugugugccaccacgccuggcuaauuuguguauuuuuaguagagauggggguuucaccauguuggucaggcuggucuugaacuccugaccucaugaucugcccaccucgaccucccaaagugcuggaauuacaggcgugagccaccgcgcccggccgacaaauauuuuuaucuaaaggauguugcauuuaugcuuuuauuuccacagcugauuuuacagacauauugugcacuuuuuuguacuaauaccauauuaugaguugcuaauuaaugaaaucauuaaggagaagauuuaaguauuaacagaaaugcaaaacauuuuggggaugauuuuaaaucaggugauaaaaauugguugcauauuuuaacaaggaaggaugguguuagagguaaaagugaccaucacagauauguuguauuuauuguuaaaaacacagacacacacacacacacacacacacacaucaaggcugggcauggugguucaugccuauaaucccagcauuuuaggaggccgaggugggcggaucacuugaggucaggagaucgagaccagucuggccaacauggugaaaccccaucucuaccaaaaauacaaaaauuagccuggcgugguggcaggugccuguaaucccaacuacuggggaggcugaggcaggagaaucacuugaacccaggaggcggagguuguagugagcugagauggagccacugcacuccacccugggugacagaaacagacugugucucaaaacaaacaaaaccacauuaaaagaguuaauauuacaacacauacugaucccugauaagugaaauucugugcgauaacuccuaaagaguuucaaauuccauuugauaacaggaucuuguaaagcaaauauuuuacagcucuaaguaguggaucaauuacacagaaaagaggacaagaggucuguuaucuuuucuucagggcuuccuuaaguaaugccagagaaccagccagugcugaaggccaguugugaggaaaucuguauggaauggcucaagauuaaauuggcaaagaccuuggcaggaaggcacugcaggcugucaggcuaagaaaaaauucuccacagccuugcugaggaauuuaccacuuggcucuuugguaacuuucucaacuggacauauuuugugucuucauuuuuaauucauuuacauagguaguagugcuucauagucggccaguccacugauuaacugucuucauuugcauuuuuucaauuauggguaaguaaaccuuggggacgcccaugaaaucuuaauuauagucaacaaauuuccuaaauauggcuuagagccauuuuuuuucucaccaauaaaggugaaacaguuuuugcucaacccgaaacaaggcauucuuucuaacauggaaaucucaaagauaagugggaguacugacagguuggcccuuggaaaguucggaacagggccaccuguuuauccagguaguccccaccuucuuuuccuauacuuacucuuuccuugccuuccuuucagcacccucgcuuaucccaacccuucaggaucuccugccagagaccuccucuaaguuauugguuuccauguaacaaaaaaaucaugaggaauuaugcaacaaagagaagagccaaugggcuuucaggcaccccccccauaauugggaaauauucuugggcagacaguccuuaugucacaugaauacauaaggcauuaacuguugaucuugucucugauucugugcaucagcaugucuugaccacccaagguuuaugucucauaaauaauuaugcaaggagcuaagccuccuuuuugccuuaccgauaggagagccagcuagcagagcaucacuaccuuugaucccucuauuucuacccuucucccucccuaggugauaucaucaugaccagaagacaaauguaagaggaacaauuaucuaggaacccaugagaaauauguuuucauaaaauggaucaaagucacuaaaugaccccacccuuucugaacugccuaaccuuguaugaacaugguaucugcugcuaaguacugaaggccauuuaauaacuugcaaaauggcuccuacccuccagcaugcaaugcauaaucacugagagaaaaguagacuagaagagucaaaggcugcgguuugggugcagguugguggaguacuaugccuggaaaauuagcaaaaucugaagaucuggaacgauccuuccucauucuuucacuucucuucucaucuaagcccuaggagcuauguucuaauguggcauuauucauauguugggggaaguaaacacccaugcagccugugauccucuccucaucagguguauggaaauaacuagucaaaggcucuguugcuaccgagguccaggaugaggagagagcagagagauuccguucccagugaauguuugcugccucuccuugggaccccagccccuuuuguuccugugaucaccucuuccccaccucuuucuuccucuccugugcacucucugucacugguaauucauucuuacaugcauguuuucaucucuccuacugagggaaaccuggacucuagacuuaaagccugaguucaaaccuugacuggauggaucacuaacuacacgaucuugaacaaccacuaaacuuaccucuaccucauaaaaguucuuuaaaauuaaaaaugaaaauagcacuuucuaguauuauaaagcauuaaaugagauaaugccacugaaguugagugccuggcacaugguaagcccuuaauacaucucagcuuuuauuauuauuaugacccaucuuuccuuaaaucaccaggugaguccaaacauggucuuaaaaaauuuauguuucucuuuuccuacaucuucauccuucuuuuccuuucaaaguuucccccauucagcauuuuagauuuuuuuaaacucucuucuuacugaagcuaccaccaucuuggcuuggucucagugccugaauauuacaguuuuagggauaaggaauggagaaguucaugaggggaauaggaaaauaccaacacuuauguaucuuuucuagcacuacugaauccuuuagauggaauaaagggguagucaagacugagugcaagaaaacauaggaauuuuauguaaaaaugugacaccuaaaauaucuaagaacauuuaggacuugguaaggaauauugauaauagagagucaagguggcucuacuagaagguguaggaaaggcaaucuagccugggaagcugauguuuaaacauguaauuugggaagcaucaaaauaaauagucuauauaaaauauuuuauacgaccacuucaaggaccuuaaauuccccaaauuccagcuauucauuuugguuaagaauaucauuuauaaauaucucauauuaaaaaccaaaugguguuaccugguaaaggaugacaccaccuuaccucauucgauucucagguauacacuguuagaccccagcugagaucccucacuaccccuaaaagggagcccccuucuuguuuggaagugccuaccaaacacugaaggccaaaucucccaaagcucuguguuuaucuccuucaaaacacaaacacuuggguucccuagcacuguuuccuaaaucuuuaacuguauuuugcuacaaaguggguuauaaaugcauaauuuuuaaucuuuuauucggucuuaaaccacugaagccagcaccugccaucucuaacuaagacugaccuuaucucagcaucuaagucuaccaauaaauucccaguuucgaaucuacauauucuuuaggauuacuugaaaaucucauccaacuagcuuuccagaacauaaguacaacaaucuugcugccuuugguccugcucugcacacauuuacuaaccaaauaaaguagcaaauggcagguuauaugaaaagaccuuccaaagaacaaauccaagguuauugaaaaggacagugccugggcuaauggguguaaaagccaggaaaaggcaagaagauauauaucaaaaaaaaaaaaaaaaaaagcaaugggcauccuuaagacaacccauacuugucaauacucuaagcccuuucuagaaccaauaaaacaaggaugauuagugugugacacauuuacugccauuucuucauugguauccuuaacagauaugcccaaucaaucagguccuuuuuuccuacugauccuagccauggucucagcauucuucucaacacauagcucagucaaacacuagcaauugaugagaguuagcaaucaucauaaaaccauuuaccauauccagugugggccuucuaacuaacagaacugcacaggagagggcuaugauuugacucaugucaccugugcaaucauugcuccaauuaagaguauauuaauaucacuucuaccucuaauauaauuucuccucacauaauucauaacgaaugagcucuuaacuauagcacagaaaauugaaguaaaauguuagacacauauguagcuauauaaaauaauucacuacauuaaccuaaaauuucaacucuuuuuucauuacagaaauuagaauuaagaggaaaugcuaucaucauuuaagggcucauaagaggucuuuaguauaauaguuuaaaaaucaguaauuuuaacuaaauuaguuuuaaauuugagcagucgauccauggguuuuuaauaauugaacuuuuucugucuucuuuaaaauauuuuuugaguugacacagaauaaugcccuccaaaucauuuucuuuuuuccuggucacugcuuuuuccauugugagcuguaaauccaccacuaacauuaacacacauucaaauaauuuucaaaugauuacuguguacacgaucacagaugcagguagggguuuccuauuacuuuuaacaaugaguuguaaccauucuauuaucuaucuuccaucuaaauuauacuucagguucuugcaagaguuaucuucacaaagaccaccucuugacaugaagagaaugaucuaagcauccguaagccuuuucuuguagacuguucccaaccuuccagagacagugagagcucuaugauuaacuccacccuugccccuaaccugacccucgugcaugccucuucaucucaguuauuggcaacacaguucuucccaaugcuuugguuaaacacccagaaucuuaugcuauaccuguuuucuccaacucaacaucuaaucugccaucauguccugucagcaauauuuucaaaacauaucuauuacuugaucucuuuucaucuucuucacucuuauccacuuggccaacuucucagaaccucuuacuggcuuguuacaaaagcuuccccuaacuaguuuccuugcuucccacccuuuaccccguuuauucucaaauggaagcgagaacgauccuguuacaugaacucaauaucacuuaucuuaucaacaaccuugaguggcuucccaaucacagacugaguuaaauccaaaucuaucaaaauggucuucacauggggcccaauacuucugauuuugcucucauuaacucaauuccuaaauacugguuucuuguuuacugcucagaaagaccagucauguuugcaauguaaggccuuagcgcuuacuauuucuucugccuagaaaacucuuccccaccugagauaccuguaaggcuugcucccucacauccaucugaacuuuauccaaauaucagcaucuuggugaaaacuacccaagccauacuuuucaaauugcagcuccauuuccauccucaugccuuaauuugccauucuuucucuauuuuaauauucuuauauacucauauuuuuauguuucuuguucaccaccucccauuauaucccaaacaucuaaaacagugccuagcauaugaguccuccauaaauauuugccgagauguugaagcauuguaauuuuauggguggggaaauaggacgugaaaggcuuguccaaagacacaaagcuagggcacaaugccuaguucaguauccauucuuacuaccuauucauucuugcaaauacaugagauugucaggagaguaaaauuuggagaaauaaaagagaaaguaaacuucagccaaauugcaauacguaucuaugucuucuuccucuuacuguaccuugcauguaagcauuucaagaucagucuuugcucaaaagacagccacaauuuaaaaaccaucuccuccauuaauagcaccagcaucuaagaggcacagaauuauguuugcuagguauagugcuggugccuuaauaaauuaaucuucauaacauguacaaguugaauaccaucauugcugcuuuauauaugagaaaaccgaaauagagaaaaguuaacuuuuuuuggucuacuugaaggcucauaaaauucauuucuggguagaacaugcagucuucuuugaccaggcagaucuaccauaggcuuuuccugcccuaagucuuuauuccuggcuauugaugccauuuauguggagggaaacaugccuuaugauguguuuuaacuguucacaagcgugagucaugugacgaagcagucaugaggugaacuuccuuaagccauaaggggagaaaaguuguacaaacucccaaucuugccaucaggauucaccugagauaugaauuagucaaauugcagggaacaucaucuuccacuuuuucauuuucuugccagcagccaaaaaagcugucuacauguucacagaaaacuugauuaaauacaauuaaauacaacuucuaauucuccuuaucccuaaacguuauauaccacuuauuuaucaaaaaauuuaaaaacuuuuaaaacauaaucuuuuaaugugucaugcagcacacaccacgaaaugaugugaggcugauaauauaauuuauaagaaccuaauacauauuaccuguuaucaucuauaccaucugaaacaugcuauucccuguauuucuuguucaaccacuagucuacagagcacagagauaccagcaccauccuuacacugcacaaagcacaagauaauacauuagagaaacuggcucuaagucuuggcugucccacuuacuggcugugaaaguuuggacacucuguaaucucuuugaguuucuauuuauuuuuucaacuguaaaaggggguuaauaacaauauacuuuugugaguuauucugagguccaagugagaaaauaaaauacuuguuaaauuuuagagaagucugugacuauaaaagauuauuacaucaccucuggguaccuuugggaaguucuuuugggaucuucauuuuaauuuauuagaacuccucggugccucagucccagggucuuggcuccacaggagaggguauuccaacagaugaccagcauagcaugagggcaugauaagcccuagcaaaacaagagaaaaguacuucuaaaagaaguuuucuucuucuaccugaaguacucgugggguagccuaguuacgaucuuauuuuuuuccaguuacagagaauggucaggaaauacaguuuccaaacuauagaacacaggaaacaugcuuggggcccucaaauuuggcuuuggagugcagcacaaaaagacaaagaaauucaaccaaaaacugaagguagaccauucuuacaauaggagcugucagcucauugaugagccuguccuuggugauuccaccuuaaaucugguugccauuuauucuggaaucaaaucuuuaguuacuuauuuacugcauuguccuccaagacuguguguguguguguguguugggguggggggggucauguugccauagcuagauuucugagucuuuaugaauaaguagcuucuugcccaccuuuacugguaugcugguauguucuccacuaaggcuagaaccacauaaaucaugcugggauucgcuguacaaauggagauuauggauggucuguucugugaaggauucucuuauguuuccuuggugcaggcugccccugaacaucaauuauuuaucagucagguggucuuaugcaucaauuuaauaaucaauaaaaguugauuaguacuucucuauugguuaauauacuuuauuuuuuuuccagauucaaaacauauugacccucccaaccaauuagaucucuccuauaugcuacuaucacuuaauucucaacaacaacaacaacaaaaaguacuacaucacuuuaggcgcaucauucuacagauaggaaacugaggcuuagggaggaagaacuugcuagcuaauagacaauuaccagggauucaagcgcaugaccuguauccucagguauagugcauuuaucaauauaccacaguuccaacugccuuuaaauaaaagaugaaauaaagggcauuuaaggugguucuccuaauaagccaggauacuucuccauauaggugccugccagggcuuggccuaauuggaaccuucuagucuguuucuccuggagugaauguacuucagggaaaauucagcaaaagcgccaaaggguucccuucaaucuaaaacuggaaauaucaucucuuugguccaacaaagagccuccauggauggacaacauauugucuguucccuugcaacgaggcugaguuauacaagaaacuuucaaaacaacagauuaaaggaaucgaauccucagcggacuggaaaugcauaauaguguugcuaaaaaaaaaaaaaaaaaaauuagugguuucuuugaaagaaagccucaaguucaugcaauuggaaaacuucuuugaaaaaaaaguacuaccuuuaacuuccaauaagaugacaacuuuuaaccaaggaacaaagauaaacauuaaagggcuggagaugguaugauacaguaucuuguaccuacuaaaaaucaugcuuaauauuaagaugaaaguuuccucauggcacaauugcuaucuuagagucccugugaaucuagccuuugacaaaguuaaaucaccuccauauuuauuacaagauguaaagguugcaucauuauuccuuuaucugauacauuaaaaaaugccaggaaaaauucuucaauuauaccgaagguauaucuuugaaagaaagcaugauuucuguuacaucugaagucacugccuguuacaguucuccaauuuucuuuuaaaaaacgaaugcuaagccaugcaacuucuucagcuucuaccuacaacuugcuugguuugaagggcucacccagcacuaauuucaacauggcagaguuacucaucaucauaauauauauuaacaaacacagaagcaauuugaaucucaaggggauccuuagccuuauguucuuaacauuauuaaaaugauuauuuuaacuaucacuuuaguuuuuucuuauuuuuuaaaauguaguuacucauucucucaccauguaaaaauuuuauuuuaacuauuuauuuuuauuuauuuauuuuugagacggagucuugcuccguugccaggcuggaguguagcggcgcaaucucggcucacugcaaccuccaccucuuggguucaagcgauucuccugccucagucucccaaguagcugggauuacaggcaugccccaccaugcccagcuaauuuuuuuauuuuuaguagagacgggguuuuaccauguuggccaguauggucuugaucucuugaguuugugauccacccgccucggccucccaaagugcugggauuacaggcaugagcaaaaauuuuaaaauguacagagagacagagagacuagguaaauauguaaugacauaugaaaagguuuucuaaaaaagcgguaggaaaacaauuguuuuaacuucaauacucuuguuuguaaaaaguaagaagugaaagccauuuuaccuuguuuaaacuuuuauuucagacaauauuuucacugaaacccuuaauuaccguugggaauagaaauacauaagcucuaagacaggaagauuuggggauaaccaggcaaagagguagaucuagaccucuguacuuuguagaaagguuaugucuagaggauuacuguggugggcucucaggggccugacuuuuagagaaguguaccuccacccacugacaccuggcuggaaacgagguuggcagcuaaaucuggaacuaucuuaucugccaucuuccacccuuccagagggaagacuugaaaggcuccauuuaaagcaguauguuuauccuaggugaaaggucaagauuucaaccaguccuaugguucucaucuagggguaauuuugccacccacuccaggauacguucagcaaaguuuggagauguuugugauuaucacuacuggagaagaaaaguugcuacaggcaucuaguugggagaagccaaagauguucuuaaacauccuacaguggauaacuacaacaagcucccuauaguaaagaauuauccaaacgaggcuagacugaaccagccugaagaagcaaacccaguuuuccuagaaaagggacuaggaaagggauuaaacugucuggagaaauucucacuauagccuauagguuucucuuuccuccacuuccuagaccaguguuuuuuuaaaagugugauccaugaaucaucuguauccgaaagauuuaggaauaaaaugcagauuccugaucccuucucagagcugaguuucagaacuguggauuucaggaaucuccauuuugguuggcuacccaugagauucguuuuacagagugaaaugugacaaucacuguuucacuucuauugagguuauuccuuucuguauuuucaacuauccccucucugucggugauuccucaaggacucccagugacaaaagaaugcaaucuugaugacagcagagaccuugauucguugguugcucacugcuguuauguccagcaccuuccuugggguagacaugauauaagaaccggagggcaccaauauuauccaaaagacuauauagucuuuuguggggagagaagauaacaaaaaauaccuacucauuuauuuaguacaccuacauucuggacccugugcucaauguauggugcacaucaauaccauuaauccuaacaauaacucaaugaaguagauacuaauaucauuuucacuuuacagcugagaaaauggggcucagagaggugaggcaacuugcucaggucauauagccagcuacugaaagucagcauucaguucuuguuccacucaauggagggcauacacuugcaagaacugcaccccaagccuaacucuucccagugcuuuucagauuccucauaugauggggaucaucgugccacucaaagccuucauuggcagcuucuaucugccaguauaacucagcaagggaaggcuacugggaaacaaagcccucuaccucccagaaaagcugguaugcuguaggcaggaguuaccuaucuuaauucccuaaaaacuguagaaaaaaaagccuuuuaaacuguuugcggaacaacuaaauaugaguauugaguuucaaaaaacuacaaagaauagguuuuguauaagguguaagaauagguuuuguguaagguguaaggaagggauccaacuucagcuuucugcauaugguuagccaguuuucccaacacuauuuauuaauaaauaguguugggaaaacugguuguagaugugugguguuauuucugaggccucuguucuguuccauugguugauaucucugguuugguaccaguaccaugcuguuuuuguuacuguagccuuguaguaguuugaagucagguaacgugaugccuccagcuuuguucuuuuugcuuaggauugucuuggcuaugugggcucuuuuuugguuccacaugaaauuuaaaguguuuuuuuuuccaauucugugaagaaagucaaugguagcuugauggggauagcauugaaucuacaaacuaccuugggcaugauggccauuuucacaauauugauccuuccuauccaugagcauggaaugcuuuuccauuuguuuguguccucucuuguuuccuugagcagugguuuguaguucuccuugaagagguccuuuauaucccuugcaaguuguauugcuagguauuuuauucucuuuguagcaauugugaaugggaguucacucaugacuuggcucucuguuugucucuuauugguaaauaggaaugcuugcaauuuuugcacauugauuuuguacccugagacuuugcugaaguugcuuaucagcuuaaggagauuuggggcugagacgauggacuaaagacuuaaauguaggacuuaaaaaucauaaaaacccuagaggaaaaccuaggcaauaccauucaggacacaggcauggacaaagacuuuaugacuaaaacacaaaaagcaaaggcaacaaaagccaaaauagauaaaugggaucuaauuaaacuaaugaacuucugcacagcaaaggaaacuaucaucagagugaacaugcaaccuacaaaaugggagaaaauuuuugcaaucuauccaucugacaaagggcuaauauucagaaccuacaaagaacuuaaauuuacaagaagaaaaaaaccaucaaaaagugggcaaaggauaugaacagacacuucucaaaagaagacauuuaugcagccaacaaacauaugaaauaaugcucaucaucacugaucauuagagaaaugcaaaucaaagccacaaugagauaccaucucacaccaguuagaauggcgaucauuaaaaagucaggaaacaacagaugcuggagaggauguggagaaauaggaacgcuuuuacaauguugguggaacuauaaacuaauucaaccauuguggaagacaguguggcgauucuucaaggaucuagaacuagaaauaccauuugaccuagccaucccauuacuggguaaaugcccaaaggauuauaaaucauuuuacuauaaagacacacacacacacguauguuuauugcagcacuguucacaauagcaaagacuuggaaccaacccaaaugcccaucaaugauagaauggguuaagaaaauguggcacauauacaccauggaauacuaugcagccauaaacaaagaaugaguucauguccuuuacagggacaugguugaaguuggaaaccaucauucucagcaaacuaacacaagaacagaaaaccaaacaccgcacauucucaccauaagugggaguugaacaaugagaacacauggacacagggaagggaacaucacacacuggggccugucaggggguagggggcucggggagggauagcauuaggagaaauaucuaaaguagaugacagguugaugggugcagcaaaccaccauggcauauguauaccuauguaacaaaccuguacguucugcacauguaccccagaacuuaaagucuaauaauuaaaaaaaagaauagauuuugauuuccauuccccaaauucuugcuuacuucgaauugaaucuuauaaggguaauuuaauucuuauucuuagcauccugucuugguugcucaucuaauauucauuugcccuucucuuuauuuaguggcaucucaaucuuaaucagagcagcaaugugcugagcuaaaacauuguguuuaccagucucucuugcagcaaaccauauguauggugaugaaaguggaaacugaagaagggcagagggguggaaguuuccaggaagccuccuuagaggguacuaacauagcuaggaagcaccugguuuaacccucucaccucuucuuccuacaugaaaauuggaaagguggaacacuagcagucaucuuagaccaaaagaugaacuugagaauagaugggccauaaaguuaggaggugucaaaguccuugaugacucuguguucacucuacucucccugaacuacagacagauguauuccaugugagagagaaauaacucuaguuguauguuucaucauuuguaguugaaacuauauacaaauuuuuaauacaauagugggcauuaaauauuuaguagacuuaaguuaaaauauuucauauuuauauauaauuauauaacaauuugugugucauaaccuuugcauaagggggcaaaugaaaucaaccauguuacuuucaaauuucuuuuuacaauaaauuacuaauuugauucauucagcuuuuugggaaaaaauucuguagguuucuauggcauaaucuuuucuuaaaaaggguuuaauauaucugaaaauuuaacagaguaaauuauaaagaaauuaaguuaacuagaaaaauaauugcauuuaauuacuugauuuuuggccccaaauccuaguuaaacagugcauuucgaaaucuagcauuugaagucagaugcuuucacauagaaauaaaugaaugaaaguaugaaugacugauagacuucaaaaucaauuauugggacuuuuugggugugauaacucacuacaauggaagaaaggaugauaaagaagcuaauguguuaagcauagauuauguguucauuaugcagggaaccagggaaaaaaaugagcauucaaacauauucccuguuauaacuagcuuacagacuaguugagagaaauauaaugacauuuaagugucauacaaaaaaugacagaaagaguacaccaugcuguuggagaauaucaaagaagucuuccugaagcacuaguguguaccaaacacugacuuugugaccuccaggaaguuucugaacuccucugaaccucauuauucuaauauuuucaauggggaugauaguauuuccuccagagcacaauugaaaaaacauauuucauagugcauuuuaaaugcuucauacaaugccuggcacauacuaauccuucaguuuauguuaauguaacuguugauauuuugauauuuaccaugggcaauuaucccucugaguagcuauugcuauucuaauaaaaagcaaaagcccagggagguuaagaauguugcccaguuucaucaauuguacaagagaguugguuucuaaauucacaccuaauagcaauaucacucuuauaauuuuaacauuauuuaacuuauauucuucagaucuguaacaaucaaaaccacauagcuguugcuguucucugcuuggcauuuauuuagguaaaagaauaggccuugagguaaauaauuuugccuggaacaucuuuuuagaaccacccaagguuguauuugcuuuaguugguguaacaagggcaaugacagagccacagaucauuggcaagagauaucuguaagaacuaaaauuaacuacauauaucuauaucuagauaccuagauauagauacauauauccuuaggucgucaaccuuaguuuguucacuuaauggcaggcacugccuccuaccagucaacugauucuagaaagugacaguaucuauacccaagagaagacacugaaauuaacggcagaaaacaauuaaaaauaggguuccccaucaauccucgacuuccaaacaaagcuauucucaaauaaaaaaaauaaauacagaagauucuggcaaucuggaaaugauacguuguaugcaaagcaauuagggggcuaaauuagaaucaauccuuguugcugugaacuaagacucacuuucuucucaaccagggcucauuuucaugucucaguaaaauguaaaauuccuuucuaguaucucccucuccuuaggucuuuuaccacuucucuaacuuucuacacagauugauggguguaagguaacagcuguuguucacgaaaaaaagaaaaacaaacaacaaagaauuuagcacuuguaagugacuauugauuuaaacauacauaauuaacauuuucaacauagaccauauaggucauauacugcaugggcaugaaaguucgguucuuccagucaugaugagaaugcugacauacacguuuuuuuuccaaggaaguucacuuaauuaaagaagucaaauggcccuacaaaagaauaccauccccaaacaaauguuacucuggauuauugccccuaucucuuaucuuggcacaacuuggaagauguagaacaacuuagcuucaaucuucauuaacuccuuguauuggagcaugacaaagaaaaaugaaggauggucucuugaauguuuacaguuucuugucucacuuucaaggagauucaauagcaucacugauuauuuauauuuaauaaccaucuuucuuaguucucaugcuuaaccacaauuuaaaccaauuuucuugagaauaugcuuauacuacccuaaacuauuuuucccaaaaucuuuuaauaacaugauacuuuaauuuuuuacucugaaacugcuucuaacaacauagaaacagaaugagucaguucuguugccuugcagggauucuaaaacuuuggugugaaaaugaaucaccuguugugugcuggggagugggaugggguaguuaauuacagacuccaagaaccuacucccuaccauuccugauucaagaaguuuuugcaacauggcccaggaucgugcauuuuaguagucucccccaaaccccuugcuuagcuggcaugcagauaauccugaucauuuucaaugcuacucauuaaacucagcauggucagaagaauuucuuugauguccaacaccaaccucacaucuuuuacuuuucuccaucuuuccagcccucucugacauuuucagcuucaguuauccuggaauacuuauauaccucaauguuauggauguuucguuucuuuucugagauauuccucccucuccuuccaccuggaaaacuccuauucaguuaugugugaaggcucaaaaaaaauuacaccccuuuauccuuuucuacaaaaauggucacaauaugucuuuuaaaaugauuacuaucaucauaguuacuaguucacgugcuuguuuuccaugcuaauucuaugaaugcaucauacguagaacagggaauaucccauauuacauacucaaugaauuuguugaauuauagcucugacugaugcuuuauuucuaaaaugaccuccagagacacuuaggaggaagaaaggagaacaguugucauccucaucauuuuucucuugaaacaaacauaaucuaacuucugcuugaacuuuuuuuuuuuuuuuuuuuagaaacuagcgcuaguagucuugcuuuguuaaacuaccuuugaucauacuacuucaccauccccaaacagaaaaauuuagccuuugaaagugauuuccugagaaaacaaauucuagaagcuaauucugaugucacaauaggaaauuagaagccaugucacugggugaucuaaacugaguccuuguuuacuuacuaaguucuuauaaucugguaaaggggcuagguaacaaagcaguucuaaucguggaauuccagucuuuuagaauggccaagguaauaacuuggaagagacucgaauggcaagaaauacaaaaacaguuuucccuacgugaggcaaaauauccaccgcaaaucuucugcaagucuacagcaacagagaggcuuucaaauuaaguguucuucgucagugugaauaaaucauacccaaaucaauaaccuauucccaagaguauaugggaaggagacuugcauaaucauguucaguuuuacuuaguguuaaaaccuugucaauauuggcuguuaaaggauggagaaacugauguuauucuugcuuagugcccaaggaaauuguuugcuuuauaaagucaucuugguuacacggauucucauuagcugauggacauuuccaucaccaucugacguuucuaaaucuguuaaugauacccccaaaugaugaucucuuuccacuuuuaucacaauaccagaauaucuccaagcuagagucuuccucuuuccuuccucugccuguuauguauuucucuugcauaguuguggcugugagugaucauguggaguuuuguguaacugaccaaaugccugccugauuauaucuuuauaauuacucaauucacucacuugcugccuccuaaauucuuccaaagacauguaucuccucuaguacagucagcauaugauuuaggggaaagggguucagaaaaaguaugagguugaacuguaagcaauacauuuugauuuugacacaugucaugucugaacacaagauauaucuucagcuccauuuacaauucuguggucuugaagaccuggaacgcuucccuguccuuuuuauauacaauaacacaaacaucuaaaccguucuguucucagcuagcuaaaaguaucagcuuuuuauaagacuccccagugcaauccagcccacccaggccacagggauauuuauuuuggcacuuacuguauucacuuccaagucggcacuuggcacauguacagacuccucaaagagguugcacauuccucaaauucaggagcaaggcuuuacacuuuuuuaucccccauaguacauaguuccauacucaccaauucccuacuuaucaacccuuccaaaaccaccugggauuuccugcaauauuacauagguaauuuuaaacuuugaagccccaguaagaucagcuacaucuauuaccuaguaaauguuuuuuacauccccaauaauuagaauaacacaaagguauggaguuaaaacaugaaucggucuuccaaaaucauuauguagcuaccuaucauggauucugccucucuucagguaucaauuuauauauaacuuucuaagugguuuagauuuagcagauuaaucaaaugacguugucuauuuaaaagaaauggcucagccacaucuauuauuaaccaaauagcaguauaucagguaggcagcacauuuuaaaaccuuguuuaaacugaauguuuuuucuggauuuaauaauuguauguacaaaauaaaaacuguauuucaucaacuauucagucauuuucucauaaaccauuucuucaauaauauaccauaaaaccauagauuuuuagagcagggaugcauuagaauaucucuuuuugaucaucuaccaucauuuuacagaugagaaaaacugaggcccgagagaucuaaguaauuugcuuugaguuaccuaacaagucaagcgcagagauagaacuagcauagcaaguguucagaccccaaauuaaugcaaccuccacuccauuucacugucuccuuuagagcacaauauauguauguauuuuaaaauuaaacuuuuaauacauacgaaaugaauuuaaaaaacacugaacaucacuauaaaugaaacaugcacaugaagauaaauaagugcaugcacaaugcauuccaugauagacucucugaauuugcacaagcgcacaacacaaccguucuuaacucacgaaguuuaaagaugauugugucccaaggguuugaaaauaugagcauuucuuaccuggcagcuguaugagggguugauaaaagacauuaaaaacuugagcuaugauuagacaucagauuuuucugucacugaagguuugcuucuaccuggguuucaggggucuaguacuuuuaauggaagguaggucagagacuuaagagggauaaaccaacauauaagacucuggcauuauugcccacauugcaauauuaaguugccugcaggggacugucaucaaaaucuuccuauuggccaguuauggcccuaccuuucuuuaucaggccugaaaucuuuacuguuauagucacuuauuuagguuagaaaacuuagguaucaaauaacuucaaaacccauuccccagccccaggguacuaaagagggcaguaucagcuguagugcuuuuaaauauaaaaguguauaacuuugggggucagggauuuaugcauaacaaagaagccguugaugagacagaaaggacucuucauuuuuaaaccgaaaccaauucuccaacacaaauguucaucauggcuagccaaccagggauguauauuuaggaaaaaaaaaagggaugauacccucuuuauauauuuuauaauacucauaauccacaccaggaugcuuucaucccacccuaagaaaaaaacaggguuucacauucugguggucaaacccuucuaagaacacccacccuagugcuuugauaucccuuaaaaagucaaccaccuccaugaacucccuuuacccuuuuauacaaaagcuugcaucuugauaguuuuaauagguacccaggagagaacgaggaaagaaguggagaaaagugcccgcuccaguugaucuuuucuuucuaaauacuaaggcauauaaaagaacuaaucagcaauauauagaaacccaaaugaaacaauagcagcuuuucaugccucuuaacuagcaagagacccuaugaaacagcaucaggguuaggacgugcaacaacaaaaauggguaguaaaucuggcugugacaccuugaaauggcugugaccuuaaacuugcaggaguuguaacuuuuuucaaaaaaugaacauuuuagucacugcauuagaaagcuuuuauuuguuaacacccaaaguauuuguugauaauccucauguaucauccucaugcacauuuuaaccuccacaguuuuagaagggcccacugauucucauggcaaacaugaguaaaggauauuucaugacccugaaaucuuccaaacaaagaagaauacauccuucugacuacccuuccuuagugaagcucacaaagagacuauagaauggauucauuccacauaugccaugacuuucagucccaaugggaagaaagacugagaaauaaagaaauaaaaauaccuuuuucacuucucaaguuuagaccacaauugaagauauaucugugcuguggaauuucugacccacauaaagaauaaauaaguccuuugcccaaaguugguuaauauuaagaggccuucagugggcacauuuuuauuucccuaaaauccaauccccccugccuucagaauucaugauuacaaugaaagacauuagauuagaaagucaauuuacucaccauggaggaaucacugcuuccacucccgaucggagcucccucagcacagguugggagguggguagaaaguugacuagcccugcccccaucuaugacaucacaaucuaccucauaaaagguagugaaagugcucugaacuccugucugauuuccgagagauacagaaaagagagaaugagagagagagcaaaagaaaaaaaaaaaaaguacccuacuugggaagggauuagggaguggaagagggaauggguaauugggaaaaaagagguauaugaaggaauuacgugcugaaagagauauacauaugggcuuucuugacauuaagcggccuggccauuucgauuucucauuggcucuugaacagauaaaggaaccaugugggaggagaaugaagaugcacccugccuugucaggcacugaaugggacaacuauaguggggcucaaagggggugaauccccuauuuaaaguguugaagaucaccaagagagaaggcaagggcugcagcucuuaaagccuggaacgguauguggggaucccugaugucuuucuuggaaguuccaucgcccugcugugugaccuuccuuaagccuuuggccucugcacauccaaccucuguacaugguccucuacuaaggggauacuuaccucuuucauugggaucacugaaggacuaaugcauucauuguugcuacaauugcaacucuuuugacuguuccuuuuaacccaaggguggauugugugaggggcauaauuuaaaggauaagccaauaaccaaugcccuuuucuaccuuuagagucuuuucauaagauucuuucaauauaaaauguuacaaucuugacuuuuucugcguguaucaaauauacaacuaaaaggaguaguuagaguucaucuucagaacuguagaaaaaaucaaauggcaaguuuucugcaaucauaaaaaaaugcacugucacucucagaggucaaguuacaugacccagugaugccaacugaccaaaauguuuuugucauggacgauuucugcucuagucauagcuuuauuuaccaagucuaguuuucauagaaaaacaagaaaaggcaugagaauaguauguagaccacuaaaguauuuuuuuucaaugaaaauuuaggaguuuaaaauagaauacucaaaguuauugauuauggcaaaacaaaaguaacagacacuauugaagagcaggcacauccugaaaccauccacauaaaaggccuucaucugacuaguggaauacaugaaaagugaaaccaucucuuuccacagaaaaaaauuuaggaaaccuagacauucaaaacaauagcuugcaaauuauggcaucauaaauggcuaaaaaccaaagccuguuucuauauacagauaaacaaaaaucuuaauuugggauuuuucuguuuuaagccaauauaauucuauuucuaagcccaucauucuuagcguacuaaauacauaaguguauuacaauaauugcaauuuaaaauuaagcaaaauuggcagaugagagagcaguuugaaacacagaagcuacuaaauucaaacugauuauggauuuggcaacaucauguccauuuuucacuucaaaauaaauguuagagacauuuaaagaaugucuuuaaagaauuaaaguaaauagaaaagaaaaaaaagucuugcauauaaaaagauggguguuuugccuauauuugacuuuuucuguacuuaacagaagaggcaaugauacucugcauauauuuuccuugcuguaucauuuauuauuuuuauuuucaacaauucuaagucuaaauucaaauuauauauucaacagcuuuuuuugugugugagauuuugcaauuaauggcccuaugaaguuuuauuuucucuccacuuuuacauauuggaucauugacuaguuggcuuaucuuugauuuuuuauaacaaucucauuugguuuuauaaguuagggauuuucugauuuuucccauuguaggaaauaaauuagucacuuagcacaauuucucaguuuuaaaaauuauuacguauuagaaacuuacuuggaucaucucauaaaaaauuuaaaguucauuaagauuaaugaugcaauuguccauucuuccaauaaacaccuuaaguuuuuacuacccaauacagaugguacaauucucccagcauuaagauauuaaaauaaaaauggaguuaaacacuuuuaaaauauugaaauaaaacaaacugaacuuagauugucuauuggcauuucuuauaauugccuauugucucuuuggaaauggaaaaugacuucaggaacccaaugcaaaacuaggcugcaucaaaaggaugcagaguggugaacugugcugaccucuuaggugaauuuaguaugauugauugugauauuauaauaaugccuuuauauaugauauuaguuaaaauaauaaaacugccuuugauacaggaugcaaugccaggaucagauaauuuccaaaucucaggaucuagccucuugacauuuuucaugaaaacuaagcucuacuccaacuguagauuagcuguauacuucccaugauauuucagaaauggguaaguagcccuuuaagacaagauaugaaguguuugcaagauuucaguagucaagacuccauuauuauagucacgguaguaauuucauucugaccagacagauguagggcuggucucaaaucuuugagguuaauaaaaaguuguuuagcuucuuagcacaaaagauugagaaaagucagguggaauaacaugugcauuccaaaagaacaaucugcagaugcauucaucauggaagacaaggucaggcauuuuuuucauguaaguugaucaaaauguuauaauugaagagaaauaucucaauaagaggggcuccaauaaauguggauagcagcagauucaaauuggaaguucucggauaaagagauguuuugauuuuguuuuaugguagcgucucacauacagaaauuugggcugacaaacguacaugguucuuaaaagacgauguugaccauaacuucuccaggauauucucaguugcaaaagagauuugccaaagaaaauggaugaaagaggucaagagacagguuguuccgauuugacaggacaucuagccagaguuccagucaauuucauuaucagcaaggcaucugcacagaugaagguguucagagaaaacuaauaaaacaagauacaguauugaugauaaaagaaaagauuaaaagucugaauuaagaaagcuugccuucaagaaaauagaauuaggaugaaguauuugagauauauuuauagcccagaaggaaaauuacuauuuaagauagaguaagacaauguguuccgaugcaguaaaagaaaucugaacaaagaaacuccacauugcccauccggaaacuuucuuauuuguaagauacaugggccauaaaguggcacauauuucuuuucuaagggcugcacucaaagucauauuuuauaaaugauuuaacuuaggcuggaaaaagcacuugacaaaauaaucugcagggacagaauguagacaacaguaaguuaaacacacuuuuauuucuagcauauaguaaaccaagaaaacaacgaaugcacagaaauagccaucaacagauacucugcuauucuagcugaaaacccuauuucaguaagcugagaaacuaaauggaaaaaaaauaaacauagacuacacagucuaauaaaaacacaagggacagaaaaauuuauccuuuucaugaaaauuauuugguauuagagauaaagagacuuuaaauucccaacucagucaaaauauaucaccgugccuuuuacauaguagggaugcaauggaaauguugaauucagugaaugaaucagaaaauauucuuaugugaacaacaaauaaaugcagcucuuugaaucucugauuguuugccauuggaaauuagaaacgacuuauggaaacugauguauuuuaagaaaaauauuauugucaaaauguuaucaaauccaguacugaauaaaaaaauccugacucaguuuugcuauggauucuaucuuauuuuuaaccagcuaagguaauggaaagauguguaaaaucaaugacaaaauccccagauaaucuuuagcauaugauuucaauaucccuucucuuuugccuauucacauuauaucaccuuguucacauaucaacuuuuuucuucaacagacuucaguccaggaauuccugggguaagccccaguagaaacaagaaaaaaaaaaucacaaugcauuuaaguaaccaauucuaaauaaucuguuucuugacuagagcugagaacugaaaaauucaaguguuuacaggggcugaauuuacagacaccauuucuaaauaaaggucuucacucaacacuuuggcuucccauaauuauuugguucaauguaaggaaacauuacauugaacguauuuggauuugcucuuacagauccaaaacugguucaaaacuggggagaggguagcuuuuaagacacuucucaaagcaauaauaauuugaaacauuauuugaaguauuuuuaaauuauuuaaaaaaaaucuuggaaugaaaucagacuauucucauauaugaacaaguagucaaaauuaggauaugucuuauggggaagcuuuauaaaauaauacuucuuaaauagguuugucuggguuuuacacauaucccaagauacagucaucccuugguauccaugggggauugguucuaggacccuagcagauaccagaauucaaggaugcucaagucucugauauaaaauggcauaguauuuacaugaaaccuacacacauccuccuguauacuuuaaauccucuccagaucacuuauaccuauuaugaugcaaauguuacauaaauauuauauaaguacuacauuguguuuuaucuguacuauuuuuauugcuguauuguuacuuuuauuuuuuuccaaauauuuucaaucccagguugguugcauucucagauauagaacucacagauacagaaggccaacuguauaugcaaucaccuccccucauccagguaccucccauguguccaauuuccaaguuuucaaaaaguauuacugcuaauuggcuacuaaaucauucucagaauaucaacugaaaucuaaggcauuaauugauaauaaauuaaguugucaauuauuuaccuuucuucuuuuaauuagagcaucucaaaacuugaaaaaauucuaagacccaaaggaaugaaauuuuacugauugaaugacaaguaauggcacugauaucucaggggacacucuucuuaaagcuacuaacuccugcuguuacaagcaguaaugcccucaaacuaaaauagaaauuacucgucagcccacaaguuuaggugacacaaucaaauccauccacagaguaguagaucgaauuaaggucaauccaugucuccaguuaagguaagaagaguuauuugcuugauuugcauccuagcuuugccacaacacaguauguuuucuuauuuuaaaaugaguauauuggaacauaguauuucccuaugcauuaaacaauucaguuagauaaccaacugcuuuaauuccaucaaugaauaacugauuuuuuuuaauggccauaacugauuauauugguaaguuuagggugaccaucacagaaaauguaacugaagagucacuuucuauaguggagcaguauaccagacuccuucguacaagacugucugaauucagagaacagacacaggugcagugcaaaagacacaaagcuuucuaugaugcccagcacccaaagaaauuuuuacuuucucauuaaaauuccuauuaacuucccauuucuuccaaaaacaagucuugaauugguaaacugucacuuuuaacacucugggggaaugaauguucagugaaaaaaaccauagaaagguuauuucccucugagggugucuauaauuuggguugugcagaaaucaaugaccauucauacugguaugaauguaacuaaggaagacuuaaugcaggaaucagaauuuaaaugguuauaguuucacuaucaacagauuggggaauggauuuuggggaaaauauggaaucaugcaacaacucauuuuacuagcaaaguauaugcaaagaacuacugccauuuacucuguaaaagguaacuacucauuucauuugucacaauuucuccacuaugccuaacauccagauuuacaaucugaaguuuguuuuuaucuuacucucucuagguuuggacacugcaacuuuuccuacauaagggaagguccuuuaagcacggaaggucuggauaaaauuauuuugaacugcuaugaauuccuagaacaucuacccuuuuguucaaaugaaacacuaacaugcauuccaaacccaaauugaaauagcuagcacuuuagauuuuuuucauuacuguuacacuuugauccauggagaucaugaagaauugacuauagacaaaauagaagauauaaaaauuaagaaaaaaagguugcuuaauguacaggucuacacaauuagaugcaauucuuguuucaauggcuguuuuagcucauuacaaaauacuggcacuuuuuaaaaauaaaaggaacacaacgcucuucaaauacaauguaauucucaucucaacaaaccauauauauauuauuguacaaaauauaucccacauuuucuuuucccuaauuuguauuggaucagauaguuuauacuuaucaaucuuguucaguuccugaccacuucacuaagguuuauugaggguauaagaguaaauaucaaaucaauugugcucuguguuuguauguuuguaugcacauaugcaucuuugaauauaugacagugucagguagaguugauuugaauauuaucaguuuccaacauuuuuaggaauguauauuaccuauaucaugaauauucauguugauuguaauuagaguccaauuuuuuaaaauaaugugaaacgugggcaauaagaauuacuauaauugaccccucagucuccaaucuucucuuuaccaauucaaauccuaccagugucccaaguuaaacuugcucaccuugucaaaccucuccccuaaacccaauugagaggaauucagauuuggaaaagagauauuuaaauggcaaagaacaaaaguacauauuagggcaagcuucucaaucucucaggaauaggucaguaauccauucauucagcccaaggacuuaagcaacuagcauuccucaccuccaaacuugacucaaauauuuuguuaauacagagacauuuauauguaauaaaaucuauuaaaauuuguaccauuuuuguguacauuuggccauaaauuacauccugaacauugaauuccucaucaaaguaggguuauugcuguuauguucugacuucauuguuauaaugaagcuccuguuaucuuuuaacuuuaaaaaaacaguuuagguaggcuuuauuagguuuaucagaauguuugauauucaguaugcuaauuuaaaaguccuacauuaguauuucuaauauuguucagaaucauacgcucuguauaaaucuuuggguagcuaaaaaauauuaaaggucauggaaugauuuuuauuuuuccagauccauguauacaucuccauuuuuaacuuuaaaggugcugauuaaacccugugaaaccuagcaaacaaaaauuagucaaaaacaugauaauuaaauauacagguaauacccauauuaugauacuggaacauauuuguauucaaaauaguauuuacauacuaaaaaauauauggcuuaacuuuucucccauaagauaaugcugucacauuuaauggacauuacuugcacuaaacuaauucaagacauguuaucuuuaacuuucucuuucuuuuuucuuuucuucuaccuucuucuuuuaugccucuucucuucuacccuccccuccccuccuuaucuuucuuucugcuuucaauauucuuuuucucaaaaaagccuguaaacuggcuuaagaauucaagcaaacauuaaacuaagcaaauaaauaaagccaauuuauagacgguuuaaucuucugaaacucaguuuccucuacuuucacuuuaacaauucuaucauauuuuuucuuuuccauuacucccuuaguaaccggguuaagcugaauuggcucacaaaugcauuuucuacuuugagauuuaauaagaaugucacuuuuugguugagacagguuuaagccaaugacaaaaaaaaaaaccuaauugccagguaggaaaccaaugguauuucuuagauagcaguuguguggaugagcauacacagaaacacauccuggacugcuuuauuucuccagaucgccgucaugaugccuggagagcuuuuguauccauucuccuccgugaccuguugaauuaucuguccccaccucucaagccaaaagcagacacaagacaagaggccuuucucaguuuguauacauagaaucacauaaaacaaaaacacgcugacauaagacauaauugcgcauuuugcuuaacauauguucaucaugccagcauaagacuaaaaacguggcucucuguuuugacaucaaaaucauuuuucuuggcaaaauggaaauaauauguccaaaucucuucuguuuggguagagagguugacuucuaacaaauguaacuuuccugggggcuuucauauauuucagagaagccguggcuuugaaucccauguguauaaacacagggaaaaaagaaagaagauuuaaguauuucuuuuuugauuguacauuaaacuaugauggcuucuucugaaaaaaaacagcaacuuugccaugccacaugacagaauaaauggguguaauuuucuuggcaaaaucauugaaaauguguguguauggggucucacauucuugacucuuucagaacuuugaaagcagucauuuguggcuauuuugcacaguaagcauauucauuuuuuuucuccauuggccaucagugaaggagcaugaagaaaaagauggaggcagaauuggcaaagacagcagacuauagauguagguguggcaccaaacagcaaucaagcuuggaauaaaucaugaggaagccaagagcaggcccaugacagagcauauauagcaaauauuuauaaugcauuugccucagaauaauuaucaaguugaacaacauucuucuaaaagaagccuucucccaugcaaggauuuaugaacuuuaccaacaagacucaaagaagggaacaggcuucuugaugguguucccaaucucaaacaccucuauaaaagccaacagugcaagugauaaaagccagugaugguuuggacuacaucuaaaugagaaaaagacaauggaaaugaagcuuuggaggcagugacaaacaauggguacugagaggaugauggagagcggcucugcuaguaaaaauugcccagaugagguuguggagucugagauccacaaagaugcuuugcgcauccauguaaauaauaagauuggaaaguaacaaaugaaagcacacaaggcaagcugaacaaaaagcacucaguuccacaggggcuauauacagauggacaugaaagcugagugguaugggaaacuauaccaucaaggcugaagauaagaaaggcagcaaggaagaugcaaugauuugaucacuucuuggcgagagaaucuugguaauuaccagcuuggcagaaaggacacauugcaagacagauugcucuugguugcugaagaauguugaagcaggaucauuuuggaaaugcaaagaggugacugugcuuugggaagaggcacaaaauagccaauuuacugggcucuaggugggacugcaugaaacaggcuuuccagauggugucucuaugcaagccagaucaguucuuuucccagcuauguuuucugcaacucaaacaauaugggaacaaaaacaguuggguucaagaaugauuuguucacguguuuuuaccaaauggccaaacuucuaaauuuccaaaaauggcuucaggaagaccugagcuuugugacuagucugauuuucauaagguauucaccacgcugauaauauuacgugccugguaauuacucacuugaaaugguagcaucaucaugucugacugggaaaagaacuaaggugucagagccacauuucuggacuugcaaauaauuugcaacaaauggcacccuguguugagagaaagggguugagggaggagaagaagccaaggugaagaaccucaacacauauuuggaaaucuugccaagaaauugugauucuucuaaauauucauugaacuuauuucuaugcauuugauaaaaauggaccagauaauuauauuuucaugagaaaggaaacacugcagugauugagcaaagaauauauaauuguuaguguucgacaauuauguuaguuuuuggcaacagcacaucaaccuguauuaaauucaaacaucuucuggcuuucaaggguuacugauaaccuaguaugcauuggaaccugaugaaugaauuccuauuguuuucaucaucucuaacaugugaacacaauccacacauagagaggcuggcuccugaacagagaaugaaaauuacuaggacuaacaaaaggaaguagacucacaaugaguaaauauacaaaagccccaaauaauuacaauagucacagcuuggcaaugaguuuccagacuacaaaauuaguuuucuugugaagaauggagauuuuacaaggcuagaauaaacacaggguaauuggaaaaucaaauugcucuuugugaguuauuguaaggucuggaauaauggugauaacauuuauuuaaaaaaagcccucccuauaaaucacuguaguuugguguuuuuagcaguacuguugccaagaauguuugccuuggaagugcaacggugggaacuuuacauugugaagcccaaguccagcuuaccccugacacaaugagcucuccucccagauucugcacuucugccuucaccuugcugcagauauuaagcugauggcaauacaaggcaauucguugaagguaggcuaauaaauccugcuuacaugcugaaucaggacacuauaaaacauuaaaagagugaucuugauuaguaaguacucuucaguuucuaacauuuguuauagaaaagcugcaggaagaaaaguuuucagugucauauaccuuaauuacauucauuuaacuuaacuuuuucacagugcauuuuagaaaggccacagacuguaguuuagaaugguuggcucuacuuuaauaaaauuuuaucagaagaaaauugaagauauuccagaaaguuuuauugggacuucuauacauguuuaugaguauuuuuaccugcugucuucuaaacucuaaagaaaccuaaauauuuuacaguuuccuucaacuuucacuaugugaaauguuauuuuaaugcagaggaccaaaggaugcuaaaaguaaaucacuuuguguggcacucucugccaagcauaauggacaguuucaauccaguuaguugggggaagaaaaucaauuuguuuccuuuguucucuaauaaauguaucauucacuuauaaaaaaucuauuacacuuuuuggaauuuaauauuuaucaaaauguaagcaacauaauaaccugccuuuaaaugagagacugaaaugguucaugacuacuguaagaaaaacagauuugacagaauguaucugaagccagcugaaagaaguucauaagaguagcaacagaguccuuugauggacgcaccggagucaacucuggcuaaggaguuuggauuuucauuaugaccgaaguaggcggguguccaucaagcacacacagagcuuggcugaacacuucuagagacauugacaugacuccugaaaacauuucugaggcuucauugccaauggcuaccgaggaauugagaugccuacauauuucuuuugcuaucaaagguucagcuugagcuacuuccaggccauuuaauuguucuguaucaauuugguacuuguaaaggacauaaaaucaccagauccuuaauacuauaagaaauaaguaccuacagccacaacugaaguaucuuauuuagaaugagaggaugggagaaagacucugagcuaaguuucccucaagcucaagaaaggaaauucuuuuaucaauacuguaaagccagugauuacauauaaccaucuacugaauaaaugauaaagggauauuuuuuauauuuaacacuuaccauugugguauuuuuucacuaacugcauuuaucaagaaagaauuccacagagacuguuuuuagcuucuuacaaguacuucauacuguaauauuuauccuacuccagggacccauacacggaaagggauuaacuuuaaaaugauaucuccccagagggcugacaaggcuuuugauacaaauaccuugcagcaaauuaaacugaaaguucuaucucaauggaacaguaauuaaaaaugcaacaguccguaaaaaguuuauauggcaugcauaucucaaaucuuuauaaaauauuuuccggcaaaauaaauguaaccaauccaguccuugauaauacucauucuauucuauuauuuaaaccaaagcaguuaaaauacacauuuaaaaaggcauguugaaucaaggaaaauaacuccuaaaucauggaaauaggugcagaauuugauaacauuuuuuucugaagauuucuuuaucaaaaauugcaaguuauuucacagcuaaugacaauaauaaugccacaaagaggauuagguuuaaacuuaauccguuuauuuugagucacugugaaauaguagcauuuaaauacucugucacugaaucucaaaauaaauguauccugggggguguguguguguguguguguguguguguguguguguguguguguguuugauguguuuuucacauaucaacuguuuugaguuaugcuuuagguugcauaguugaaaauaaaagcccaaaaagguaaaaucaaaaacaaaagucacaaccaaaacuauugaacuugaagggccuaaagaugccgagaaauacuuuugaccauugagauuuaaaguguaaugaaacagccauucaaacuccgcucauuuucacucccaagaaguccuuccuaacaaauugguggauggccaauuucuggucacucuacacgucccaacucuucucaacaucugcagaaaaagaauguggccuuuucuaguugguaauuuuuuuguaugcauacuuucaaguaaauucauugucucuucccuccucuacaugaacuuucuggaauacuuauggaagucugucaaaaaaaacccucaguuuaugcugugaagccucaugguugauauugcccugaaauuaggcaauagcaauggguuaacacucaacaccuacaaauuguaagcaguucucaaauucucauaguacuugaguuaucucaaccaauaagcauuucuccaaaagucaaaaguuaaaaaaauuucuuggauuagccaucuuaaauguaaaauaaaauuaaaaugagaauucguugacucuugacucuuaagugcaauccugauaguaaaaucaugagggguuuuguuuguuuuguuuuuucagccuuuaaaggugugugaauuugguauugacuugaaugaaggauguuagagccugggaugcugaggcaguaaguauuuagaggagcaacccuuauauauaggaaugagggaggaaaacuacaauaagcaacacaaagacucaaaaaucaucagaucaucagagacuagagccauauauggagaaggaugcaauucucuuucaguaucuccagcuugcaucaauguacugcaguauacuaagcaaauucauguuaauauuuccauguagauaguagcauauauaauauuuuauuuccaaaacuuauauuuuaugauacaauccauccaaagugguucaaacuguaaaucacuauugcuuauagggauaacuguuaguuaccuggaaaagucuacuaccuaaagcacucuuaaaagaaauggaccauaauugcaacaaaacauuuagaacaggauuuuaaaguuccaauucaagccaaauaaaacgaaaaguauggaaauaaacauucaaggugagaacucuuuuaauguauauccuaguuugguuugaaagcauuaagagauacucugagaauuucauuuaucucugaugcuucugagucuggguuagaauaaagcugaaaucugaagguucuugaucauguggaauaaucccguuuaugguggagcauaaguuauuaugaagaauaucauuagagugagagccauauuaaauaagaaaaggugaaguucuaguuucuuauuucuacauuuaaaaacaugauguucucccagauucugcaaccuguuucugcccuuugaucuccaaaugccccugacuguccuacccccaguuuccauucuacuccugguagaguccgcgacaacuuuuuaaagaaaccaucaaaucaugacccaucacaucccuaaagcucugcuaauucaguucccugaccacaaggcagguugcucuuuucucuccuuuauucauucugucaggcaguuaaaaugugcaaccuaaauuuccugggggcaacagaaaauaaaaguaaagcaauaauaaauauauauuuuuuaaaugugauaagcaccaugaaguaaacaaaagagggcauuagguaggaaucucugaaaauauauuuaaaccaagagccuaacaaugaaaauuuaaaaaccugcuuuuccccccuucauuaugcaguauaguugccuuucugaauggggaagccugggacaauccgugacucuucaggggcugaugucuccuaaguaguauguucuucuuucucaaggaauuuuggucagaagccuuagcauucucuccugagcuaaaucuacguuugccacuagcacagugucaggagaggcagauaccaguguguaaaauaucagugauucuccccucugauucauucuucagaggcauuuuauagggugcauaaaacuaguuacaaaacccaagugcuaauuagugacuccacucagcaugugcccacccuucccucuucuauuaccugaucagccacagcacgagcuaauuuguccauucgagaaccugcuucggcaauuuucuuggcagcauuaaugacaucagauguauuuuucaaugggccuuugccucugaaacaacauauacaacauaauuagaaauccacuuaaugacgggaaagagaccaaccuaccauauccuuuguccaggagucuaguguuguauuuuauuuggcacuggccacauuagucgaauuuugaauauuuuccugcuuaacuccaguuucuauauuaguagucguuuuuggaaauauuuucccauauuuuuaugugcauguucacauuuuaucuuuuacauuaaguucuauauuucuaaacaauggccaguuauaaaagaucaucacaagagaaaugaaaauuuuauaguugcuuaccguguaccaaaagcuguuguacagacuaccucauucugacuuuauaacaacucuacaaaguagguaucaucacucccauuuagaaaauaaaaugagcccaaaaugaucuaguaacuuauccaagcuuauacaggucauaaguaaaaaauucaaaauuuuaagcagacucuagccaaaauaaaugcauaugcuuuaucuuccuacucauguccagcauauuuauauucuauuauuuaaauuuuaaguccaguuuggcacuuugagaagcaauuaucucuugcacauaacugggaacuguuuggccagaauuucagaguuuuguuggccugugggcuuccgauacugauuuaugaaagaacguacaaagcacugagugacaguaaauguuuuugugcuuccaaaccaucacccuaauauuuucauauaagguuugcaauuaggugaaguguuuaauauuauaugucuuuuaaauauuuauuauaagggaaauggaaauuaugcugcaucauaaaucuuuaaacaaaauauagcauguaauaacuuuucuuucccuuauugugagagguaaagaauaaauuauguuuaucauuuuuagcaucguuaauuaaccuggucucuuuaugugcauaaaaaucaauguguuuuuuaaggcuguaagauuacauuccuguaguuagaaauguggugagcuguacagaaaaacuauucagaagggauuuauucagaccguguaggguuauacagagagggcaaugauugcuauuguuacauaauaacauuuuauaaaauagaagacaaaaugucuuucaguaaacuaauguaaaugaaugauauuuuguuccauuucucuacuaacucaccuucuuggauuuuucuacauuagucaguauaaguaaaauauacuggguuucuauuaauguuuaaauacaaagacagacacacaacuuaagguauuucauuuuguuguagugacguuaacucuuccacaaaguaguuugauuuugcaguugcuacuuagauuuuaaaaugcagacaguaauuucacuugugaauuuuauguaauauggaugaguuaaacauucugugacaaucuguuugcuauucccuaacauauuuuuauuagcgcaaaauaaaugguuuuuauuuuuuaaggaacacuuggauacagaaucugucaauguuuaauaauauucucauuauugcauauuucuuuguaacuucuagaccuuagaaaaucuauuuucugauguuuacucugacacaauauuuguuguaacuucaucuuaacccauucaauaagacugcauucuguuugauucugcauugcuaacaauuguguauuucaagaauuucaaaggaucuuggaaaaugcuuccucaugaacguuccauaauaacuuccaccagcugauugauucugacaaaauguuccaaguuaaugaagaaugucuauauagauccugaaucugcuugaugcucaggcccccauauuguagacaaagaaugaaaagaagcaugucuuuuugauuacaccggagacuacaguucauagacuuacuaguauguuaggaaaaaaaaaguuugagacuuuagaauucauguuguagacucaauucaaauuacuggagucgcaacauggguaugaggguauauuucauaaaauuagagaccaaaauagaaguucugagaucaaauauuuucucauuuuccaguuggggaagcugaaaucuagggaggaagacaaaguaacaugcccaaaugacacugcuacgcacagagagaaacaggauggaagucuguguguccugaaucauaauuuaguacacuuuuuuucuaaauaugauucauucuuaacagcuaaaguaacgugcucagagaaaaacaaguagccuuaacuacauacauuaauacacacgaaguuacaaaaaacacuaacuaaauagauggcucaagaauucagaaagaagagguuggaaaaaaacuaauaaaauuacaaacagauauuaaugugucagaaaacaaaacacuagaaauuauggauaaauccuaaaacuagcucuaaaccaaaaagauauagaaaauauauuuagaacacuaucaagaaauaauaggagaaaaauauccaaaaguaaaaaagauaagacagcaauaaccuuagaaaacaaaaaaauguaucacaaagcugcuuucucaaauauauguaaguaaaugugaaaacagaugaaauaaguuucuaggagaauauaaauuaucaaaacagaccagaaaggagauucugaaaaaucaaaacagucugauuuccauggaagaaacaaaguugucagauagaacucaucaaaaaaaaaaaaaaagaaagaaagaaagaaaaaagucauuaaauccaggugguuucuuacaggaguuaacuaaaccuuuaaagagaagauaaucucaaugcuauuuaaacucuuccagaauaucagaaggaaaguaauuucauucaguuacauaauauugauauucccagaagcaacuaaaacaaaacuauuuaaagaugcucacuuaggugguacacacacacagacaaaaagaagaaaaaacccaaagaaaugacagaauugacaugagugcuggaguaggcuuauacauacgagaauuauuuguuagguuuuuaggaacugggcaagccaguugaaauguugggagcuugaaaucugccauaaugggaauauuuacuuccuggacaucagcaaaugcuacaaaguucagggcuuuuuccccuguagaccgucaucagaucuugaaaaagcucaagguaauaguuacaacuagucgagaauaaagguauugggacuuagaaaagguuuaugaagguuucuugagcugggugauaguuguacaaguuacuuuaauuaaagucguauacugacaggugccucacaccuguaaucccagcacuuugggaggcagaggcugguagaucacuugccaggggcucaagaccauccuauagucccagcuacucggaggcugaugugagagguuugcuugagcccagaaggaggcggaaaguggcauauuuauuuuucuguagauauguucagucguuuagacguuaaaauguauuuacuuuuucuugucaagcugaugguuauuaaaaaaauaauuuucauuucuguuaugacagaggagacugagucucuucaucauuuauugaucauuauuaaugauuuauauauuuucucugaguugucuuuucaaaucuuuugcauauguuucuauugacucuuucuaaauugcuuaucuaagcucuucagauauuuuggauucugaucuuuuguuauacugcaaauuacuccuagucuuggucuauauguuagguuucuuuuuuuuacaguuuuuaaaauauaaauuuuaauuuuauuguagucaaauguauucaucauuuacacuacuguuugugcuuuucauacauuccuuuaagaagcucuuccuuaucccaagguaauugaaaauauccuuccauuuuauucuaaaauuuuaaaguuuccuuuuuauauuuagauauuaaauccaccuacaguuuaugccuuuuguauagggugagauaggaaucacacucuuuauuuuuccaaccaguaaccaauugucccuggacaauacauugaaaaguuaauccuuucccgaacaauuuuauuuuuaaauuuuauucccuuuuaucuuuaaauucuguauaaguaaauguauuacuauaaaauauaaacacagaaugcaaaaauacccagaaaaauaacaugagaaaaauugucaacuaccaaauucuauugucuaaauauucauaaaaauuugaacuacuugggguggggggaguggggagggauagcauuaggagauauaccuaaugcuaaaugacgaguuaaugggugcagcacaccagcauggcacauguauacauauguaacuaaucggcacauugugcacguguacccuaaaaaguauaaaaauaaauaaacauuaaaaaaaauuuugaacuacuaaaaugcaguuaaagucauguguaaaauaaagaaaauuauuugaaucaucugggaaauccugaauaucucauauguguucugagcaugaugcaacacccuucuaagaaaguuucaaggcccagguuucuuuaaaugagcacaaaguuagugacaugacccaguuuccccacaucaugaacagaagagaagggaaauagaaaaaaaauaguugugccauuucuggagguaggggaccaaaguuacucauuuccuuuugcuuacauaacagauuguguggcugcccuuacugguagcugaagaauaacuguggaauaauaaccauaucuuuaaaagagaagaccuugaauuuggcuuauguagcaaggguagcauguucuuuuaaugcuaucaucgcauagguuucaaguggauucuaaagcuccuucagacauccgagugccuauagcaauuuuaacagaauuucuguaaugauguucauucuauaauucugcacuauccaauauggagucacuagccacauguaauuauagaacacuuaaaauauggcuaguguggcugaggaacuaaguuuaauuuuauuuaaguuugucuucuauuuuuaacuuuuuauuuugaaauauuacagauucuguggaaauucagagauauguauagaaauguccuauucacucuucucccagccuuucucauguuaauaucuuguaugacugcaguacaauagcaaaaccaggaaauugauaccgguaaaauccauagggaauauucaucuuucacuauuuuuuaugcacuuguguaaguauagcuucauguaacuacuacaauugagacacagaaccguacuauuaccacaaguuucucucauacuguuuauaccauuuaacccacuccuaacauauuccuaaucaugaaucucuucuccaccucuacaaguuuguuaugucaggaaugccauccaaauggaaucauacaguaugaaauauuugagauaacuguuuuucacucagcauaauuaucuaaagguuuauccaaaucauugcaugcauuuuuauugcugaguaguagucuguggcauagauguaacauaguuugcuuaaccauuuaaccauuugcccaaugaaggacauuugaguaguuuccagugugggacuauuacaaauaaaccugacguaauuguuuaugguauaggguuuggggugaauacaaguuuuuacgucucuggauaaaugucugagagcaaaauaucuggguccuguaguaaaucccuuuuuaguuuuuugagauucuuuuuuuuuuuauacuuuaaguucuacgcuaugugugcagaauguacagguuacauagcuuuauauguggcaugguaguuugcagcaccuaucaaccugucaucuagguuuuaagccccgcauguguuagguauuuguccuaaugcucuuccuucccuugcuccccaacccuugacaggccccaguguguguuguuccccucccuguguccauguguuuucauuguucaacuccuacuuaugagugagaacaugugguguuuuuuuguuccuuuguuaguuugcugagaaugauggcuuccagcuucauccaugucccugcaauuaauaugaucucauucuucuuuauggcuggauacuauuccaugguguauaugugcuagauuuucuuuauccagucuaucauugaugggcaucugaguugguuccaagucuaugcuauuguaaauagugcugcaauaaacauacauauaugcaagugucuuuguaguagaaugauuuauaauccuuuggguguauguccaguaaugguauuauuucugguucuagaucuuugaguaaucaccacacugucuuccacaaugguucaacuaauuuacacucccaccaacaguguaaaaacauuccuauuucaccacagccuugccagcaucuauuguuuccugacuuuuuaaugaucgccauucugacuggcaugagaugguaucucauugugguuuugaauugcauuucucuaaugaucagugaugaugagcuuuuuuuauguuuguuggccacauaaaugucuucuuuugacaagugucuguucauauccuuugcccacuuuuugaaggugguguuuuuuuucuuguaaauguguuuaaguuucuuguagauucuggauauuagacccuugccagauggguaauuuauaaaaaauuuaucccauucuguagguugccuguucacucugaugcuaguuucuuuugcuguggagaagcucuuuagauuaauucgaucccauuugucaauuuugguuuuuguuacaauugcuuuugguguuuuagucaugaagucuuugcccacgccuauguccugaaugguugugccuagguuuucuucuaggguuuuuguuuguuuguuuguuugguuuuggguuuuacauuuaagucuuuaguccacguugaguuaauuuuuguauaagguguaaggaagggguccaguuucaguuuucugcauauggcuagccaguuuucccaguacccauuuauuaaauagggaauccuuuccacauugcuuguuuuugucugguuugucaaagaucagaugguugucgaggccaauaucccugaugaacaucgaugcaaaaauccucaguuaaauacuggcaaacugaauccagcagcacaucaaaaagcuuauccaccaugaucaaguugaguucaucccugggaugcaagguugguucaacacaggcaaaucaauaaauguaauuaaucacauaaacagaaccagugacaaaaaccaugauuaucuuaauagaagcagaaaaggccuucgauaaaauucaacaucacuucauguugaaaacucuuaacaaacuaggcauugauggaacauaccucagaauagugagagcuauuuaugacaaacccauacccaauaucaaacugaaugggcaaaagcuggaaguauucccuuugaaaaccggacacaagacaaggaugcccuuucucaucacuccuauucaacauaguauuggaaguucuggccagggcaaucaggcaacaaaaagaaauaaaguguauucaaauagaaagaaaagaagucaaauugucucuguuugcagaugacaugauuguguacuuagaaaaaccccuuguuggccuggugcgguggcucaggccuguaaucccagcacuuugagaggccaaggugggcagaucacgaggucaggagaucaagaccauccuggcgaacacggugaagccccgucucuacuaaaaacacacaaaaaaauuagccgggcaugguggcgggcaccuguagucccagcuacucgggaggcugaggcaggagaauggcaugaacccgggagguggagcuugcagugagccgagaucacgccacugcacuccagccuuggcaacagagcgagacuccgucucaaaaaaaaaaaaaaaaaaaaaaaaaaaaaaaaaaaaaaaaaaaaaaaacaaccuugucucagcccaaaaaaacuccuuaagucgauaagcaacuucaguaaagucucaggaugcaaaaucaaugugcaaaaaucacaggcauuccuacacaucaacaauagacaagcagagagccaaaucaugagugaacuuccauucacaauuacuacaaagauaauaaaauaacuaggaauacaacuuauaaguaaugugaagaaccucuucuaugagaacuacaaaccacugcucaaggaaauaagagaggacacaaacaaauggaaaaacauuccaugcucauggauaggaagaaucaauacugugacaauggccacacugcccaaaguaauuuauagauucaaugcuauucccaucaagcuuccauugacuuucuucacagaauuagaaaaaaacuacuuuaaauuucaugugaaacaaaaaaagccuguauagccaagacgauccuaagcaaaaaggacaaagcuggaggcaucaugcuaccugacuucaaacuaaacuacaaagcuacaguaaccaaaacagcaugguacugguaccaaaacacacauauacaccaacagaacauaacagagaccucagaaauaccaccacagguuuuuagcuuuaaaaaaaacugucaaacaguguuucaguuuuauuucaucuuaaugaaaauuuuaaaacccacagcuuacuuuauucauacucaauggugaauaauaaaagcuuuaccucuaagaccaggaucaaagcaaggaugccugcucuugccacuccuauucaacauaguaccggaaaucccagccagugcaaucaggcaaguuaaagaacuaaaaggcauucaaauuggaaaggaagaagcaaaauuaucucuguuaacaggugacaugaucuuacauguagaaaaugcuuaagauucuuuaaaaaaaguccugguaaaacuaauaauugaauucaggcaaguugcaggauacaaaauguuucuagacacuaguaaauaaaaaaauccuaaaagaaaaugaagaaaauaacuccauuuagaacaguaucaaaaaaauaaaauguuuaggaauaagcuuaaccauggagucagaagacuugcaugcugaaaacuacaaaauauuguugaaauuacaaaaauaaauggaaagucauucaauaaauguggauuggaagacuuaauauuaagaugucaauacuacugaaagagaucuacagauucacuguaaucccuaucaaaacccaaaggcauuuuggccaaaauuuaaaaauccauccuaaaauucacauggacucucaaggcaacacaaauagccaaagcaaucuugaaaagaacaaaaauuggagaccucacaauuuuugauuuuaaaacuuacuauaaucaaaauagugucauacuggcauacagacagacauagagaccaauggaauagaauggaguucagaaauagauccuuauauauauauauaaggucaaaugauuuuccacaaagguacuaagauuuuugcuaagauuugggucuuggaaaagggcaguguuuucaauaaauggugcugguaaaacuggauuaucuacaugcaaaagcagcagcaguccucauguuauaccucauuuaaaaauuaacuaaaaauggaugaaagaccuaaccauaagaacuaaaguauaaaacucaaagaagaaaacacaggagaaaacuucaugacauuggauuugguaauaauuucuugcauaugacaccaaaaguauaagcaacaaaagaaaaaaaaagauguugaacuucaagauuaaaaacuugugugugucaaagaacacuaucaacaaauagugaaaaagaaaccaauaaaaugagagaaaauaguaauucuuuaucaggaauuuguaauuccugauaagaaauuaauauccggaauauaccaaggacuccuacaacucaacaacaaaaaagcaaacaaacaacccaacuaaaaaaugggcaaaagacuuggauagacauuguuccaaaggagauauacaaugccaauaagcauaggaaaguuguucaacauaauuaaucauuagggaaauacaaauuaaaaccaccaugagacaccacuucacauccauuaggauggcuacuaucaagaaaaaaacagaaaacaaguuuuggcaaggauguggagaaauuugaccauuguggaaaaauuugaacacuuguguauugcuggugggaauguaaaauggugcagccacugugaaaaauaauauugugauuccucaaacauuuaaaagaauuacuauaugauccugcaauuccacuucuggguauacacuuaaaagaaaugaaagcaggaacuuacauacuuauacacucauguacagugcagcauuauucauaauagccaaaagguggaagcaacccaagugcuuauuaagagaugaguggauaaagaaaaugugggugguacaugcauucaauggaacauuauuaaaccuuuaaaaggaaacgcauuugaguauaugcuacaauauaugcaugaacuuugaagacauuaugcuaaaugaaauaagccagucacaaaaggacaaauauugugugacucaacugaugugagauaccuguauuagucaaauucauagaaauggaaggcagauggggaguuuacauucaguaaguacagaguaucuguugaggaagaugaacauguucuggagauggagggugguaaugguugcacaacaguguaaauguacugaaugccauagaaauguacacuuacaaaggauugagaugguaaacuucaugauguauaccauaauagaaaaacaauuuaaguagucauauauggcuaguggcuacuguauuggacagcacaagucaaaaugagcuacagucauuuagauaaugugagguggggacugaaacaagaaacaaauagccaacagcaaaacaaacaaacaaacaaaaaaacaaaagaaaaaaaaaaucacauccaugaaagcgucagaaguuugagucuuccuauccguggaagacaauaucgacaagaagacuggccacguugguuguaucuccccauuuuaaaauugcgacccacagcccuuguguuuuccuaccuuagaccagauuuucuauuuuguggguuuguaaaagaugcuauggguaaucucauguucuuaaugcaggagcaaucauauugucccaucuggaguauguuuuuaguuuccuuggaaagagcaucaagucauauaauuaucucuacuuauauagauucuugaaaccuucucucuuuaggacauagguaauucugaugcaaaggucaguaucuggagucuuucccgugaaguggucacuccaaaaaagaaagucaaggaaaaguauuaccgcauuacugcugucacaucaccauuuaugaacuaauucacauuuauuuugugagaagguaauaaguacuaaggugaaaaaucuaugccucaguauauucugaguuaauauaguuaauauucaaaauucaaauucugaguuaauccaacguauuuuuuaugccuucucaauaccucuaacauguuaauaccaaaugugacucuccaaugagauauagcacauaaaaaggguauuugcaaauguaucgaaccauaaaagucacuuuucagaggcuucugaauauguuugggaaauuuuacuaaugagcugcauuucacuaaucagcugaagcaguaugaagacagcacaguagaacagcugagugaaucuggggaauuucgagaacucagguggaacugcagaaucacaaguugaacuauuccagguacuuuuuggaauagguuguaaggucagauguuaaacauguacaaaauuaggacagaagccuaaaggucaagaaagguaggccuuggagagcaaacacaaggauuuuuauuuugugaaaacaggaacuaacgaaacuuuuggugcaaaggaagcuggaugguugcccuucacugagcagauguggccuggaugaguagagaauuggaacugaaagaccaguaaagcgcucccuaagcugagguacugagcaugugaaguaagccagaaaaucaaguuugggaaauauagaaugauuauaugauuuuugagucuagugcucaguauuuuacagucaguuguacucugaaaguuuuuuuuucuuagucucaaaacuguugaagauuagaacuuaaguuugauucuaaaaacagcuuugcucuuugcuguacaauuaaacuugagcuguugcuaucugcacgccuuuuguuauugggacacaagacuagcaacaugcgauuucuuucugaaaaaugacaugaaaagaaaagcaugcauucacuccaugcaggauggugcuucugccauuguccaugagauggaagucaagaacugagugggaaaaagacaugaggccuaaucaguuuuaucuuccaugaagaaguuauuacacauauaaugaggcagaacccucccaauuuuaauaacaauggagugaauaucauugagauuacugaaucaaauuaaugaauuagcuagugauaagaauaaaacaacaagauaauaaaugccaggguauuguguacccacaugcccuuuacacauacacauuauggagaguggccaaguuucaauuccuaaucagcuacauccauucuuuaaauaagagaaaaugguacuuaagaauguuuagaguuauggagcuaaaauuauuccuccuugaaguggaauaugcaaguggaagggcaauaauaacaauguauaaggucaaauauagugaacuuaggugagaggccacaaagaaaggcacuagucagcugucuguuugcaaaaaaaaaaaaaaaaaaaaacaggcugugcagauggaggcagcaaugaagccucaacuuccuguguugcauuucaaacgcacagucuacucugguucuccagucauucauuacuauacuccucccuuugcccuaacaaaaagaacacaaaacgacucaucaugcagugggaaaaauuguaacuaguagcucccuagacauuucauuauuuaaaucagcauaaugauaugaaaucccuaugaaacugaagacaccuucuucucacuuuuaaaacuauacuuugacuaacagacaugugucuuauuuaacaccauguaacaagaccccucaaauauaucuuucauaacugugccuugaccacaguuauauaaucuagagaauuauaaaaugugcuccugaucaaaacuaguaacaugaccagagucauuauucacuuuacugagauuauuuguucaagugaugcuauuaauggacuggauaauaaccaucagguaaaguacuaauaaaauguugaaagcaagcaaauuaagucaucacaggccuugagaaacagugacugaggcugccauaaucgucugauuuguagaaguuucaggcugaaauaauggcucagacuuuuuuccugcuguuacgcuuugugaaauaaaugugugaaguccacaaagacuaaccaaauguacaaauaugaacuucuaaugaauacaaugacauuuaaaagucucaaagggcuccuucauaacaguaaaaucauuccacugaaguaaaaaaaacaauuuuaaaauauugggaaaaagggccaagcuaugucauuaguacauauuggccagaggcaaagggggugacgcagagauguuccauauuaaauuauaacuuauaaucaauucuagccuuuucucauuagaagcauucaacaaccauuaaaaaaaguugucacccaucagaugaugucuugacauucccauauaucuuacauuauuucaauaacaaaugccacguuaaaucauuaaaacaucuuugcauauguguguuuuccagaaaaaaaaacacuacaguaaaaccauaguuuauaucuguauaacagcauaauuuauacuugcauuaucucuuuggauuuuaaaacucucuucugaaguugauaagacaaguguuauuucaccauuucgcaaauagagaguaagagacuugcccccaaaucaccugauauucugacucaaaauucagggagguuccuacugaguuuugcucucccuugguuuguccuuuguguugaaagggcagagauaucaucuucuuuuaaagaagagaccaaaaugcaaugauagaaaagagcacuaacccuuguugaagaaaagucuccugacaaaauucugacuggucacuugauuugucaaagguacuagcucagagcuaaaggaaauaaaucuuauacaacuuuaauuucucugugaaaacaauggaaucuuagauuguuguaucugauucuuaauauguaagaauaaaaugugagcuuaaauuaaugcuagaucacaagcuaauauuacaacauacuauauguauacaugcgcgcgcgcgcacacacacacacacacacacacacacacacacacacacacacacagagguacauauuuuuccaaagguauauuaacaaaucauucacuuuaucuucagaauaauacuuaagcauauugcaaaauagcacagaccaaagaugagucacccgucccucgggguuugauuuuaugacugccuuaggguagauaauuauaacaacaauaauuacaacauugaaucuauucuccuugaccaaaaagauauaccuaucugcuaggaauuaagugcagaucauuuugacuuauacauguaaauuuauaauaccaccaccuugcguugguauauuuuaauuuuucagcaggcuuucacaugcuaauacacacugcuacacuucuggguuuaaugaaaaaaucuucagcucccuggcucugggccucaccuugugaagucugucauuuccaucaugaucauacacaucugcuuggccaguacaaugauaucauugccgcugucgucccauuuggccacuucugcauccagcuugcuuuucucuugauggaauaucuccaccugcucagcuauuuuugccuucuccuccugcgguaguugcgccaugauggccugcguggguuacagaaaaagcgugagugacggugacaaaggaaguacagaccguauguugacucugccuucugcggauggcagagccagacccugcaaaggcuuaugagcuacccugccauuccggaaagcacgucuuucuccauuccagggaggccacgagcacaggcugauaagcuccccaaaguccccgucccacucccauauaugaaaaauacagagauauccaaagcuacgugcgcacuggcaauaacagaacuucucugccgcuuugauggcauauguuuguucaaaagaagcuauucuugacaauuuuuauauuuggucucaggaaacuuuuaccagaugaaagaaugcaccucuuucaacacugaaaucuguucagagaagggaaaaaaagaaaaacggccuucugucgcuggaaaggauaggaauuuuaaacacuaucugagcauccaagugggggaggauggggcuacuuucuaugaguguaagugaaggugucuacagagagaugcccaacaaaaauccccugcccagggcacuccagggacggugugccuacucucagcccucccccaucuccuuuagggugguggcaugccugcggcuccuuguuaaagccuuugaguacguaggcagaaaaguuauaaugggauaaaggauaaaauuaggaagcauggguucauuuucaauaacugcuagguaagaaaauguagaaaaaggagaacugcagucuucuuauucauggauucuucauuugccaauuugccuacucucuaaaauauacuuguaaccccaaaaucaaggcuuguagcauuuucguggucauuugcaaaugugggcagagcagcaaaaaaauugaguugcgugacaugcacauucccagaugagguugaacaaggcaaugcucugccuuccuuuuucagcucucguacuguaaacaaguguacuuuuugcagucuauuuaaugcuacauuuuucauaucuuugugcuuuuuguuaguaacuuugcuguuuaaaauggcuccaagcauggugcugaagugcgucuaguguccccgagcacgagaaggcgggcaugugccuuauggagaaaacacauguguuaguuaagcuucaaucaggcaugaguuacagaguuauuggcugugaguucaauguuaaugaaucaaaaauauaaagugucuaaacagaaacacccauuaaacauaguuacuuauugaucaguugaagaaaaugucuugacuggcagcucugaggaaucuacugcuguauuuccccuaggaccaaugauuaaauauuugcuaauuaaauguucaugaugacuuuauagaacauaacuaucaggaguaaugagaaucaacuauauuuguuaaacaccauuuagguagcaagccccgaaugaaaugucugucaucaccguaucacauccucccaaaacuguaugcaaccugcuucacagacaggggaaugugaauagguacuuccaauuccccugcuucuaggaugcacauauuuuccauaagacagaccaagaggguacaguuugggggacugcaguuucugcaaugaacaaguaaaauaacacaagaaaaaugcuuccuaaauuauaaaucuucucccugugugagugaauaaauuuggaaggacuauaacuaaggucuaauagagguaucaggcaaugugagcucagaagaacuggguucaacaggggcucuguagcugacauggguuaagacuucacuguuacauggaucuaucguugaucucuucagauagaauaugggcauaguaaauaauuaccucaaaaggugauggugggcagcaaauuaaauaauauguguuuuuucaaauaaaaugaaaguaagcauguauagaauuaucauuaacauuauauuauaacugcugccauuaauuugccuuuccaacuaccccucuggcucauuucuuaguugcuauagggaaagggaugggcucggggucuaugcaacuaucuacaaauagaagauuguuaugauuccuuauguauauccacaaguacuggguacugugcugaggcuuauguaugucaaauaacaaucuacuuaaucauucugauacuauuacuauccccauuuuaauaauaauaucuaggccuagagaaauucauagaauuccuaauaucacacaauaggcucuaggaauaggauucaaacccaccugaacuaagaucauucuuaaccacucuacacaacuggaucaucaguugugccuggccaugcaacuuacccacuguccugggguccucaaccaaguggggcaagggucacugauaucacuagcacugcucgccacacugugcauccugguggaugccauagacaugaguugccuauggugucugauuugacuaaagguauccuugaacccguggcugcccagaugcuucuuacuaguagccacaucuacugacuuccauggauacauguauguggcuuuaaauagcauguguauguauguuuggauaugcguguguacguguaaauuuuaauccauauuuaaaaauccagacuuguaugaauacuauuaagauaucuaaaauacuauaucuugaaagauaaaguagcuuuaaaaacuguauuugaaaaggugcuugauauacaagaguuuauuguaagcucacauuugcaauguuguguucauagcaagacagcuauuccacuauauuugagauauguuugauuuacagaaauuauauaugcacuuuuuuccuuaacuauuccuuucugaugaccuauugcuguuuuugguuuauuguccuccucauacagaagagcgaaucaugcuuuacuuagaccucacagguccuaaaccagcaucauuuaaaacauucgcuaggugcuucucugaaaaagaauccguaaaacuaccagcagacucccagacucaauguucaauccccagaugaaaagcaaugcacauuucauugucccaacacaagguuaauuugugcacugaaaaguguauacuucucugucaacuauagcacuugcaucuccauaauacaauuuagcacuugaauauuaacugcuuugcuuugcucucuaauuaauuccuauuaaugcccuacugcuaacuucuuuauaugcuucccuaggguuuaggcugccauauccugcccagaguagaagcuuaauaaacaucuuuugacugcuuaaacauuuuuccacucacugcauuaacauaacucaagagaaguugccagaacggacacacacauucuaaggacacaauucugaagaaaaacuauccccuccaaugcaaguuugcaaaggaagauauuauuuugacucuaggggugcucgaccugcauaauacacuuaauggugugugacuugggugaaagcaucuuuccauuugcuucugcuuauguagcuaucaaugagcugaagucucuuccuaaauauucuuaaaaugcucuugcuuuuaaaaauucauaauugaccuuuucugaaacuggaauuuaaaaaaagguuaucuauaaacaguagaucacaaacugugaaauuugcaaguuaaucaaauuagaauucaacacaugaguuuuaauuaggucuuaucaauguaacucagcaguuugaaauguuaacacauuaaggccauucuagcuagaaaaaaauagaagccagcuacauugaaaucaaacucaauauaaaauacauaacaugcaauuguucauucccucaaacuaagggaacaugagaaaaauuaucuucauggccaagaggaaagggaacauaucagauuuuguuuguaugauaugauuacccaggacagguugaaguuucugcuuuucacaguagcaaagcacagcucuccaaauuguugaucugccugaugugggguuccaaauuagugguaucagagauauuaauccaaaaggauuccuucccccuaccccagagucccucccagccuuuccucugaaccaccaaccauuuuucggugauuguuauaaacuauaccuauuacacuaaaagugaaaaucacugauaaaaggaaacaaccauucagauagcacugaauccauucuucaauuuaaaucucaaggagauuuugauauaauuaucuuccaauuuccagagaaaaaaaugauuuuuaacgucuauggguccccaaacugacaaguguucauuucuuagccuagagcaagaggcuaacauuaaguuucaaguacaagaauguuuauaaauaacaauuaaagggacuaaaacucaaugugccuguuucuacuuacuugacuuuaaagcaguauaauaaguaguuaaggaguggguccuuugauucuuaccagucucuagcugugaagugaauuggaaaauugagguaguugucccauuaacucaaguaaaaacucucaugauugccugaaugauccaacucuuuuaggugaaauuauuuagucagccuucuaaugaaugauuagcucaagccacaagcaucaucaccauuaccaccaacuuaauuauuacauauuuauaugauaaauccugugauacauuuuaucauggaauucucccuacgaccuuaugugguagcauacgaggagaugaaguguggagagguuaagaaaguugccccaaagucacacagcuucacuaaguccauauuuaaaaucaggucugugugacuccaaauaauauauuguaucaccaagguuaagugccuagcaauugucacuaaccuauuuuaacuaugccagacuguggagaaacaguuuauauuaugucaugucuaggaucaaaggguaagaucaccuccauauuuuaucagaucaccaccauccauauugauucccauucauuccccccuccuaaaccgccccccgcccccuaucuccucucccucagaauguuguaggcaagcagcagauaugggcauauaaaggacauuuuugaaauacuuuaauuccagaauuugagagcaauguuggaugggguuacuaaaagcuuaucucccacucaaaccuucuuauagauuaauuuaccauuuuuagaaagggagacuuucucuaaaugugaacacaaaguaauaucauuaacaugggaggacuugcugcagggaagagcaaaugccucugucaaagacaaaguucgccuccuucaaaauuuggaccaacuuagcacacuuugcuggucaaaagucugaccaucuaucauuucagcaauucaaugcacccucuuauuuccaacuuaacagccauaauuccaugucucugauuugucaucauauaauuacaggcuaaaauaggcugacucaguaaguaaugcugucugcugcaacuuaaucguacagaccacaugauagaccucaaagucaaaugagcaagugcugaauuuguaggagugcucuguucuuacuaucuuggacccuguuuauaauucaugcugaaaaaaacucucagaaaagacacuagugugaagaaauaauagaugauaaagacaggagucuccaaauuguauuuccacccaucaucauugacuugaagucuaauguaaaugagacuagaauuagguucccaaugaaacagaaguauauugcgacucuauucuuccuuguaaaagugggacuguucaugccauuuugacaagauggugcuuauaaagcaagaugaguuguacaaccugucuuugucuuuaagaaaacuagucaguggauacuaggcuguauguauacugaguugcaguuagucaauuaaauugacuuugaauugcuucauguuuggaugaauuacucaaaauugcccuuugucagugacauaacaaugcugguuuuacuuaauucugaagaugaauugacuguuuaauucaucugacguuuugccaacacagagucaaaagauuuucaaguuacugaccuuuccaauuuucaacauuuuaggggggauuaaauagagucugcaaggaauuuuugaaauagggggcucuaugccaacuuuucuguugucccaccaucaugugaucggaaaggauuucucuuagaaaggaugauaauuaucacggucaucuuuaucgagcacuuacugaaugucuaauauugugccuauuauuuuacaaauauuaaguaauuaaaucuucauaagaauccuaucagguaacccuguuauucgcauuuuagagagaggucugaaacugaaaaaucaagcaacauguagcuuugagcaugguucuaaugcugcccuuuauaauucaaaaccaaaucugucugaaaucaaaggcuuugucuuuaauauucuuuaaccuucacaucccuccuauuaauguuuguuuauaucuuuugggucacuugauuguugagugagaauaucagggcauaaagcacauaagagaaacuggguuuuagacacaaagucuuucuugacuaaacaucucccucaaguccucuuuauuuuaaccucugauuauuuuucuuucauaauucuuaaggcagugugggcuuucuggcguuucccaauuucuauuuuaaauuaccuucucuuucucaaccucuugcuuucuauucauuaucuuuuauuuaaauaaaacuuaacaaagaaaauuagaauaucuaauucucaguuauacuauaaucugauuguuuuuacucuuuggaaacugagcccuuaaggggaggaaaauuucaucguccuaugcagucucuaaagauuucaucucuuaccaccggccuugauuacguacaccuacucucugggugauacagcaaaucagauugauccaaauuuaggaugcucuuuagaccaaaugcauuggugaacaguaucauggaguacucaaaugucaggcagagcugguacucucucuguugcuuccugauccuugccuuaaacuugaauauuucuaauuugucucuauuuuucuaucauauggcagacagaucuaggaauaccaccaugggaguagacaggcaucaugaggaaagaaaaaguucucuaucuaauggccuugaaccaauuucaaaagauacggucuuagauaucauagaacauaggccauuguauggagcaacagcccagcuauaaacaaaguagugcccugauuccucauuugucauugccucuuguguugacaagcuuggagacuucaggaagaacaauggugacugugccaaugcaaaauuugaguauuccaguguccccuaucagucuaucaucuaauucuaguacccaaacccaacaaaaucaauuauacacauaaaagcuugcugugaugugguugcuauguuuccagugauagcaaaagagaggaguuagaggaaucaggagcaguggugguuauuuucacuguguaaaaugugauuugcuauaaacaaccucagaugagagcacagauuucugacccaugaaucucugggguaccacgugucuggaguuuagaaauacccucaaaccauuuuaguaaacacggucccugugugccaagccaaagucuuagguguccacucacccgugcgcucugcccugcaaugagcuggucauccucagucugaacacuuguccugcuacgcacaucauaaucuuccugcucaaagucagaaucauccucuaguucuucuggggucuaaagacaaaaagauauaagucagcauacuuaaauugauaaucuucacccccauccacacacuucauugcaaaggcuaaauaucccccagcaaacagagcuuauagcauccuacauagcacccacacagcuaugugggugaguauuagccggaaugcagucagaaaaaucaagcugcccuaauuuacuuuaaaaaauauauuuuauuuauuauuuccucauacagguauaguaagucuaacuugcagugauaugcuaauuuuaagaaaaaugauaucuguguauuauuuccacccauccaaaucuauugaaagaaaagauccaucaacaacaaaauuuacaccuauacuucuauaaugccacuuuugcucuauaaacaaaaaaguugauuaucuccaggccaaaggcuagaccugauggaauaucugauuuggucacaaagccauaagguauaacgguuauaagcacaggcucuagagucaagacugccugaauaugagccccuaugugcucauaaauaaacuaucuuaccucucuuaguuugacuuccucuguaaauugagguugauaauaguagcuaccucuaugauugcugugaagauuaggcaauguauuaucuguauaguaucagacacagaguagguauuuuuuaaauguuugucaucauuauuacuuaggguuuguuguuuugagacagggucucacuguguagcccaggcuggagugcagcagugggaucuuggcucacuauaacuuccaccucccagguucaaguuauucuuguaccucagccacccaaguagcugggauuacagguguacaccaucaugcuuggcuaauuuuuguauuuuuuaguagagacaagguuucaccacguuggccaggcuggucuggaacuccuggccugaagugaucugcccgcauuggccucccaaauugcuaggauuacaagcaugagucacugugccuggcccaucauuauuauuaggauuuuuaaaucaauucauucaacaaaguuuaugaaaugaagcuacugauuaccacauacccauaaaggauuaaauaacuuuuacauauguauuaucaauuuagcucagaugagcacagugacauuagggaucauucucuauuuagagguaaguaauacaaggugcaaagaaguuaagccauuugccccauaucccuaaauuaguuaauaaagaaccagaaguuagaucuaaacacccaggugugucugacuccaaacauacuucucauuauuaguuuuuguuguaguuuauucacguuacaaauuuagcaagaacugaaguuauaaaauugcuuaaaaagaguagaguuagaucaagauccuuuccaaucuauaaagucagugauaaggaaaagauaagaaagaauccauaagcccaggaacaaaacaccuuuccaucuucaauggcaauaauaauagauaacugugcauuaagugcuuaccauguaugugucugucaacguuuuuucuaagugcuuuacaggcacuaacucacgcagguuucuuaacacucguaugauguagacauuauuuucuccauuuuccagguaggaaaacugaggcaugagacguuauagcuugcucuaaggcuuugcuaacucuaugagguuaaauucgaacgguaguaaggauggugcacaaaagugagugagugaaucagugugagauuagccugacaggugauggucuuccacagacugccucuuggcauacaguaggaccacauuccagggcuuugucuuucaaaagaaaagagcagaccacaaggaauaccgaugauguaguugcccauuccccauccaaaagggcacauuuuuauucugcugguuucuuuggcuaccacaguguaauuaaucaggugugguuauugaugaaggcuugagauuggucagacaggcauaaaaugggguccuucgugccaauagcacguuaugccuaguaauuuuccaagcuuuggcauaucacucuuguuuuuccuucucucucaccaucaaccuuauuaacauucacucagucaucuacagauguuuacuuucauaggaauauuaaaauaaggagagaagaaagagguuuuguucucauauuuuauuaacuaaagcagggcuacaguaggcagagcccaguucaaguaacugguuguauuuuuauuguggacagagacaauauucucugaucauuucucccucuuuugcaguguacugugggacaauuauagcaaguugguaaauucagcugacagaugagaugacaagauuacaagcgcuuuuugucauaaguucuugaaagagaaaaaguaaaucgaaaaaucucauucaacaaaaauaagcagaauaugacaguucuuauaguacugugcccaaacauuucagugaucugugcauucaguagaugagucaaugacaaacccaaccuggcagcauaaggcuaauaaugaugaguuuuuauucaagagacaauggcccaagaaccaaaauaaagaaaaacauuaaaaucaaaagagguauuaaccuggacgaggacucaggggaccugcauguuuugaccuaacucugccauucacaagcuauaugucuuuggcaagucacuuaguuucacuacuucugugucucccugcucauaaaacggagauuauaauugcuauaugcacuuucugccccacaggacuccuaagcuuagauguauaggaaaaugcuuuaggaaccauaaaaauuaacuaaauucauaaaugauggugauaauuacugugcuuaauaauaaaauauaacaccuaauaacaacaacagcaauaauaauggcaaucauuguuuaccacccacuaugggacaggcauucagcuaaagaauuugauccuuacaaaaaccuaaugaaauaaauguaaucaccauuuuauaggugugugaacaggcucagaacuguugaguauauuuuccaaagcaucacaccuagcaagugauggaggcgggcaacaaguugacgguuucagagcccaugauuuuaaccaucacaaauaccaccaggcaaauagaugagcuuaagcuauuuacauguaccuuaaacacgcaacaaacccauccagcccauccauauaaaaaguucugugcaugugcaguuugcuaauugcaugugagugugucuccuacucguggcauucuuuuuugaauuacacauuuuuaaaacuaugagugcuauuuuuuaguuggucaaagaccuccaugaauuaaaggaaacauggaaaauuacagagggucugcaaaugggcccaggaagauuacgcuucuaucauuagauaguguuacaggguaaaggaauaaauaaaauaaacaguucgcuguacuggaggauagagacugagggugaaaguucuaugugcucuuugggaaggcuuuuuucaauaaacagaaacuauuuaaagucuacuccuaguuucgugguuccacuauuuuauguuuuguuauggaagugggucauaucuguaaaauggcaccaaguauucagacuccagauucucuccuaaaagucuaugagauuaacuugugcccauuacaggggcccagggagaucauguggcuugaccagggucauaccacaugucaguugcaaaacaggacccguucaccugcugcuggugcucuauuccucugcaacagccucuauagagaaacaaagugagaaaguauugaaggauucagucauuucaccuggacaugugaguuguugaguaaauuuuacaaaugagucccggugaaaugacucugaauccuucaguauuuucucauuuuucauaaaauguaauaagaaccauugaaagaaacggcccaaauguguaugagaauuucacugggagaaggcugagaauauagguuggcaggagagcuugagagaugcaugagguaggauuucccaacagagcucaacaccacuggaaugggcugcagacuagaaaaucaaauuagagauccaaagguaaaaacaaaacaacaacaacaacaaaaugaaaaaacucccuagucaggagugauuggcgaccagcaagucuggccuggccuggauuauucuggagguuccuaacugaucuugcuucugcucuugccccauacauucuguucucaccagcauggccauggugguccuuuuaaggucuaagucagaucacacuauuccccugcucagaacccuccaguggcucccaacucauucaauaagguccuuaggucucuaggucaaguuccuggcuccaaccuuugcacuugacauuuccuccgccggaaacaugcuccaccugaguaccguuagggcuuauuucuucuuccuucucccaguaucuucucaaaugccacccagguaccuccuuucaugagauccaugcccaccagaagcucuauccccuuuaggauacuuugguuuucucuguggcauaauguuugacauuauauuuccuuguuuauucucugucuccuaccagaggaauagaaauccugugaggguagagacuuuugucugcuuuguucauccuguauucagggcaacuccaaaaguuuggacaucuaauaagcuuucagcaaauaaaugaauaaccaagacagaauuaccaauuuuuaaucauacugaacuauuucuaauuaauaaaacuagacaccuuaagaggccacguugauuaacauauuucauacagaauucaagagaugucuaugugcuacccuugaaauuuuaaaauaucuggcaaugcuccagggcaccuugauacacaguuugggagacgugaaguuaaacuguaaccuccgccucccagguucaagcaauucuccucccacagccucccaaguagcuaggauuacagaugcacgccaacaugccuggcugauuuuuguauuuuuuuuuuuuuuuuuuuuucaguagagacaggguuucaccauguuggccaggcuggucuuaaacucccgaccucaggugauccaccugccucggcucccccaaaaaacaauacauauuaaagaaggugucuuugaacacaaacucacauaaaacaagguuaaguauugaucaguugauaaaaguguggccagaagcucacaguaaccuaacccuguauuucuccuagaagcaaugauucaagauucacaaauuucguguucacagugaauuuguagaacacuaacuacuguaagaaaugaaaaaugacuauauguuggucugccagauuugcauauauauuuuuaagccacuuuguggggauaaucagaaaauuccuaugugccuaacagaucccaauggacaagccucaggaagaagcaaaaaaaaaaaaaaugguuucauggaagagggguagauugcuccaacagaaaagggagguccugacagcugaggcuggaauacaguaagaacaagcuuugucuacuucagaggguugccuggagcuggccucaagcacuuggauaccaacaucaccauuaaauauguauugacugccaagagacaagaugauaaagaauuugacccuucaggauccuuucuguauuguuuuugggaaaagaaaaaucuuucuuugcagccuuugggagggaaggagguauggucaaauguuuugggaaagaaacaauucuacuugucuuauuguuuaucuuccuuagcacaagggauuuuuuaaaguagacucaaucauuacauucagaaagaaaaccaagaaauuauuuaagugcaaaaugaagccauuugggugcugaauggagaaggauuuuaaaaauaacaauuuguacauacuguacauuucucuccuccuaaauuuuaaguggugugaaauccgucuaaucaaacuacuugaaaugucgagauagagaaaugacacuuuaugugacaaagauacgacauuuuaucuaaaauuguguguguguauguguguguguguguuacagcucaugaauuaguaagugaaugauggcuauaaacuuucucauccuccuaggugaaugguugugacaaacaugugaaggccagcaaagcagaaaaauggcaaaagagggaauauaucuugaggauuacagugggauuuaguaccaaaugcuuugaaaauacaauucucauggucuauuacuuuauuucacaaguuaguacaaaaaugaucuaauuucuuaugggccuaaaaggcugacuaucuuuccuugcccucucuuccaauucuuauaucucuuuucucugucccccucccauauuucuaggcaucucucucccucucuuacacacacauacacgcacacacacccagaaagaaagagagagaaagauuuaggcuccgugccaaacaaaacaccauagugugccacaaaaugauauuuuggauacauuugguuaaauaaauuuuuaaaauuauaauuaauuucaucuuuuugcuuuuguaguguguuuacuagaauauuuuaaguuacaaguguggauaccauucuacuggacagcaugcuuuugggauuagaacugcagaagccccaccucugcuucaaauauaauagcaauaaaugugcuuuugcauaugcaguauauuugaagaaauaaagauuauuauguggcuaauaaauauguuuggacauuacuaugcuaaacuguugguaagauaaggagaaaaaagucaucuuauaauggauuauacagcaguuaaauaaaaugagguuagcuagaugucuuaacagacauaugugaaugugccuugugggugaacaaaaaguugcaaaugaugcuguaugaguuuuuaaaucaacuacaauauauauuuucuaggccugugaauauauauauuaauuauuuagacaacauuuuggaagacacaccuaccuaacaacagaagucugaagaugggaagauaguggaguggguaauaagagguuugauguuaggcuauccagccuuauuuauaaugucugaauuauuuuuauacaaagagaauguaauuauguaucacuucauaguugcaugauaauaacuguuacuauuauguguuauuauaaacacuacuaugcuguguaaucuucauuucuuuccagcccauggucuucagauccugaugggaagaguguuagcaagagauacaaauggaaaauagcagggguaugccuaaagguuguaugaaacugaggaaguaaugcaugcaacaaguaggcaggguguugcccuucagaauauucagugcucacuugagcuuguugauauuacucaucccuucauaaguauaaagcucaccuugucugacuaauaaggagccaaacagcuuaccaaguuaaacucaguaauuacaaaauaaauaauaaauaagacaguuagcucuuuaguuuccuacuaggagaucugaccagcucugagcuacagaggccucacauacccugaucaucagcacagccuuucugaugucccgaacgccaucauacaccaggcgagaggcaucgaugaacucauucuccucaaacgguugaggaacguuggcacucagggcuucaauggcaaccucuacuuguucagcgaagcguggcaucacuggguuaaaaauaaaaagcagaggauuaggcaauuucucucucacuaccucuuauuccagcucuugggcgaaguggcagguccucgggcauucuaaaaguuaaguggagcaagacacucaucuguccaguuugaagugagcccaauuuaguagucuuuaugacaguuaccucaggagcagggaaaggaaacuuucccaauuguuauucuaugcauggugaugguuugcaaaagacaaaguuuuuaaaaccugcccacaguagugugguguagugugugaauauaguuuucauguuacccuaaccccaaacugaguugcauuucugcugguugcugcugguuacugguuacuguaaauccuuggccacguuuuaaccuguuucuuugucuauaaaauguaauaaaauucuacuucgugauucagugggaaaaugcaaaaaaguuuuggguggaaucuggcccuuuggaaguaucaauaaauauuuaacuaauaucggauguuacagucauagcuggugaguagcagaccuuaacccaaauggcuucacaaucaaauguggaugaaaugauacaacccuucccacuuuugucagaaaugcuggacuugagacaugggggaggggaggguggagcaagggaagauggggaaggaguguguaauagaaaagagggagacagacacgggacauuucagcagaauguccuauggaaagagaagaccaaugggcucaaagauaaaguguuccaucuuaccaggaccacccggaugugaaagagcauacguauauaaauuucuaaaaugcugacacuucguuauuuucacagggauccugcacacacccuagagauuaguggaaaguaaacucagcggagcgucuggaacaccuccacuaacuucuuaaaagaugcugcugauucacugauucucaaaaauuauaauucaauuuucucagcuuuuauccuguaacaaucaauuuguauaguaaaugaaagccaaaagcauauucguuuuauuuacaaggaugauaaaauagaaacaucauucaucuauuuccauuccugaacuuucaugccugauuccucuuuauacucacuuucauccucuguggauacuuuaauauccauuuuaaucccucugugagaaauucugcuaaauuacuuuacucuguagggucagaguauucaagauaaaacauuccuggaaaaauguauuucuaccaggaaaagacagacuuaaaaaaggagggggagacagcaggguuagaggaaaacugugugcccacacuuuaguagaaauuaccgaaaccacagcaugcauggggaaaucuccuucuauggaugaauuacuauaauugguucucuauauuacuugaauuuuucauuugggcuuuuaagcuauauuuagauaaaagaauuugggaaauauuaagcuguacugccacaaauaugaaucaaauaaaacuauauuucuaaaaaccacugcauuaaacucagacuauuugaguuauucguguugggaauaaacuuuuuuaaaugacucaauagugagcaugaaauuauuuuuguacauauuagaauuugagaauaaguaucuucuuaaauauaauuacaaguucccucuuucuuaaacugaguuauauuaaugccacuccacggugucuacguugccauaaguaugaccaucagugauguuauaguucuauguaauacuacaagggagcuuucagaggcauaaaacuguuuaucccuauggauauaacugauaaagaauuaguacuccuacauguauauaaaauaaauagacuaaucccacaaaucaauacggaaaaauauuaaaaauugacaaagaauuaguacacucaguucacagaaaagcaauccauauugcugauaaauacacaguaagacuucacccauaaucagagaaauaaugcaaacaaugagauguaauuucauacuuauaggcauagguaaacaaauuaaagcauaauaauauuaaucauauugagcaugcagacacaaugguacccuucuacuacagaugggagaacaaugguuacacaucauuucggcaagugcuuugacaaaaucuaguaaaauccacucccugugauuuggggcauucucuaggggcuuggccaaauauuaacuucuaaagaaaugcugauuaggagggguaaguaauuguacauuggagucacaaaaauguuuuugugucucuauaaccauagagacaguuguuuccugcuagguuauauauucaaagaguuaagaagaaaauuauacaaaaccugagaaugaaaauaauugcuuuaagggagcucugucuacaggcucuaccccagcccuauucugaauccuccaacucaggaaccacuuugauaugcuaacugcagauccacagacaguacaucugggugggauaaaacagacuuagggaugugagucaggggacagucaauauauuaaagugaauaagcccugaggucaaaguucgagugggaaaaacaauaucgugugaguaggaaaagaaacaucguuugugaaaaauuuuuaaauacacaaaugaaaacugugcauuauuuaaacauauacauuuguacauguucuuacauguucuaaaaggauauauaccacuuuaaauauaguaguuaccuuugagauggaaggagagacauuuguuuuauuagucuuuguucuuuuuguaucuuugaaucuuuucauaauucacauguuuaaaaagaaaucaaauuauucucaagguuguacuucuuauagaacugggcucugaaaaaauaaaguucuaucacauggcccacaacaugauagaaaccgaucugaacaauaucauuaagugaggaagucccucagacauuaugacugugaucaaacacuuaauauucugccuuaguaacugccaacuaagaaguugagugggaaaaugcccaccgcucagaccccaaccugcaugaacacaccucuauuugcaugaagaccuuucucgaauauaaaggggugaaaaagguuaugguguugcuuuguuuguggcaaggucacccugaggaagagauggggaggaggacaacguagaaggugacaugcuauuagguuggugcaaaaauaaaugcgguuuuugccaucucgcuaaaaccaccuccuggccugauacuucccgcaagggugagaggagaaagcuaaaaccuaaauggacuucauaggggaugcucugcaacucagaauacaucuaguaaugcugugacauacaguuuggagaagaggauucuauuugcaccagcauggcauacauuaucucucuagugagauuuggaugguaggauuuugguauaaacaacaguguuauugaccugggguugucagaaguggcagaaacaaugaauuuuuaugaagagauuggaacagaacuaccaucgaccuuucaaggaagaaaaaaacgauaggggagaggguacaaguucuuuauuuuuaaaauagaggcucagagugcaauugagccuuaauauuuaaaccaucuuauuauauucuuuggccaguaaaacauaaaacucgaacucauucaauucauuauauuuacuguaacugacaagacaucuauuuuuuuccuuaccauaagucaguguuuuucugggucugaccccuaagaaacucuuucucugagaccaauccuaagcacaguucaauauuuauuuagggauuggucaacugcuacuguucuuuaaucaccaauaccucugcucuccacauugcugcucuucgcucauucggucuuauccuauucugccuuuaagagugaugaggcugggcacgguggcucacacguguaauuccagcacuuugggaagccaagguggguggaucaccugaggucuggaguucaagaauagccugggcaacauggugaaaccccaccucuacuaaaaauacaaaacauagccaggcaugguggcaggugccuguaaucccagcuacucgagaggcugaggcaugagaaucgcuugaacccaggaggcagagguugcagugaaccaagaucgcaccacugaacuucagccugggcaacagagcgagacuccgucucaaaacagaaagagugaugagacauaaaaacaaaaguuuauagaacaaugacccaucuugacagaaccuaagauguuagguugacuauuaauuuuucuaauacuuugguaaugucuaaaaaaucuaggccaggcgccuuggcucaugccuguaaucccagcacuuugggaggccgaggaggguggaucacgaggucaggagaucgagaccauccuggguaacacagugaaaccccgucucuacuaaaaauacaaaaaauuagcugggugugguggcgggugccuguagucccagcuacuugggaggcugaggcaggagaauggcaugaaucugggaggcagagcuugcagugagccgagguggugccacugcacuccagccugggcaacagagcaagacuccaucucaaaaaaaaaaaaaaaaaaaaaaaaaaaccuaaauaccccaaaaguaauacugagacagaaaaaguuucaaacuuccucaaauaugaugcugcuucugccucucacuaauuaggacaaaacgcagcauugccuuugugaugcacacauuguguauuaacagaguuuuugauauaggaauauaaauagaagcuucuuucugcuuucugaauuacauccaaaaacuguaggcaccacuuuacaguuauuuaucagaaaugcugauuuguucuuaauagcuuaugucugaaagggugaucaaauucagagauaaacuuuugaauucuagcuauauuucuguaugcagcgcacacacuaggccacaaaacgaugauaucccuaggaguaaugaaaucagaguuaaguaugcauauaaaaaucaaggucgcaucauucuaguguugaucgagauccuaaaccagaggugagaaaguucuggaauaaauucuccugagagacgucagggaugaaguuucagaacacagggugagucaguuaaaugaaugagaaguuguguuaaauauucaaauaggacugcugacaacccaaagggcaaaaugcaaggucaaccaaagguagcagagaugaagagucagguaaccucgcuacccucagguauauaaaagguccuuaccccugcuuuaaguauuccaaugauucccuauacuacagagaacuauaaaaccucuuuaucaagaaacaaacacaaaaagcaucuauuaucugccuauaugguucuugugucuuucugucucaccccuuauuaccacauauucucaaauguuccaguuagacagacuuuaacuucaauaucuccaaauaugaaauggacccacagcaacauauccaugaaugauuuauuuucucauacugaaauguacauacucgucuuuggcccaggugaacuccuacucaaucuucaaucuccaguguagaacuaauugccauugugaagccuucuuuaauccucagaacccaaaguagacaguucucuacaauucucuguaauuuuauagcauccuaaucucacacacacacacacacacacacacacacacgcacaccauuauagcacucaguauacuguauuaggcuaguucaucgguauuucuguaugucaacuguuucacauaugaaucgccuucaggcagagaccaucucugcuucauucuuugcauuuaaacccuuguccugcuucuagcacagacaaucuauccaguuggguagagaaggauaagaaguaaaagaauaggacaggaauaaauggggaaaauuaagaugaagaacuccuuugucauccaguauuucacggacaaagugaguagcaucacauuucacauaacaagucucucuuuuucugcccaucauuuagcauugguucaguaauuuuauuaaaaaguaucacgagucauuuaacaagugauuagugggcauucuggguuuggucuguagggaccuuucagaaaccugagcucaggauucuuucaggacucugcuucuucagaaggagcaucaccauugagcaagaaagauucauaauucuauucucaacuaguucgccaaggccagucaagcacaucugcaugcacaggggucacccaacuguggugaugcagucauccaacacacucugaguguguuucuugcacaaauuuuauuauggagcauagagaaaagaaaauagacaaagccccuguucgagagagauaaacaguuuaguaacuguuaacauaaaauaaaaaaaagagcauugaaaggaaucuaaaaauaacauaaaauaucacgacagggauggaauugcagcuaauuccugugcaggaauuaguacaauauccuccccccaucacagacagucacugagccucuacuguaacaguuggaauucgguaaagauuagggaaaaaucagaguaauuggagccagaaaauauuaauuuggaggaucacuguggggccauuccaguguccccuauaccagguaagugauguuugauguuauuucuacagguaaaguauucuuucccaaaaaugguuccugucagacacugcuaagggauuauucaggaggcccccuaauuagaugacagaagagaggaaaaaaggguaaaagagagugugauaucaacuacuggggcccuaaaguugcccaaaggggacucugacuggcaucuauaaggcacggggugugccuugacaauuccacacauccaugaagcauaaucaguuguaagaagaccgagucugaaguuccaauucacagucaauguagaaguagaaacuaccccaaacugaagccauaacacaucucucccuuuaguuccacuuaagaacagaugacaaaucauagaagcuggccaccauuuuauauuagugauuuuaguaacgaaugucaugaucauaaauuaauagaaggucuuuaaguauucccccaauucaccccuacacgggggacuuuaaaaauccucagcucagaaucuuuuuagagauguuugggugggagcauuaccuacuaggcaaauggaucuauacgucuacuucgcaaauagugacuauuucauuuccauauguauuuauaggugugugccuucccuaggagguacgaggauggcuggaaucucauuaaagcccuuggcuaaggguucguacacuguucagagcuuucacuuccaccccuaauuuuacacacaugcacucgaaucuugguuaugacuucugacaccacaggcuaaagagcuucuucaauuaauguucgaaucucuaaaccuaagucaaauagaauuuuuccugaugaugccauuaguuuuuuauucccuuuggcaugcacacugaucuuugaauuauguaccagcuuugucuauguaccauucccugacucuuaucuguucucuuugacuccaacccacuucuccaaucaccuugaaugaaucuaggcccuuccuucuccacgaucuagcucuguuauuccucuguccccuccuguccacauacuguauggcuucauauugccucaguggaucuuuugugcucuaaaugccacugcacaagguaauagggcuauuauaccagcauuugaauauguccuuauuaaguccauguugugggauuuguccacacacccuaggacuguuuuauccaguuaugccauucauuacccuuauggucucuccuauccucauguauuugcaaauauguaugugugacagaugccucugagagggcccccagugauuccucuucuccugguauucaugccuuuguguaauccccucaaccuugaaugugagcuggaacuaguaauucacuucuaaccaacagaauauggcaaaaaaagaugggaugccacuucugaaaugaaaaaugaugcuggcuucuguuuucuuacuaucuugguuacuuaacucugauggaagacaguugccauguuguaagcugcucuaaagaaaagcccacguggcaaguuaaauuugcggguaauuuguuacacagaaauauauaacuaauguaguaugcuaugccauaaguaaaacuaucaguaaaaauagcuaugcccuaaguaaaaauauugguaaaaaacuagcuagcaggacacaugaaaauuucuguuuaauuguagcaacgaugcuugaucuacguuucaagcauauuuauugguuccaggaaaauguguaaaugaaucuugauauuuaauuuuacacguuauuaaaccaauuuaagccucaguuuacucaguauaaaacagaaauaaugaucauugcccuucaggguuuacauaaagaucagaaauacauucaacaaguuuauuacuaaauuuuauaugcaaaucuaagcaguacucuaggcaccgggaaucgggaaucgagugguaaauaacacaaauacauuaugcuuuggaggcacuuacaaacaaguaggaugcaugucagaugauuaccacacugccuagcacaugaaagagccauaguaaaugcuucuuggggcugucuucacaccaugacuuucugcauuuacccaugcacacacuguuucuaccaggcaaaaucaccuagucucuuuuggaaagaacuuggagguacaaccacacgauucaccauggaaaaaaaaaaaaggugagcauaaugggacacagcacaccaauuagugcugaaucugaaaaccgggaaguugguacaauuuguuuugcaaacugagcuuccccaguucuaugcccuucucuccccucagcagccccguaucauccuggugacaguguugcauuuuuaauaaggaauuuccugugaaauaaucugcccucaggacaagauuugauaaacuugcuccuagaacuuugcuuuuuaucuugcuugccaagaaggccaauguuaaacaugguguuccauuaugaccuccccagauccaugaggaaagaaagucuuugaaagccuuuaccaacaaaguaguaacuuccagaaaauaaaaacaaaacaauucaaacucagcuugccuagcccaguagaaacacaguuucuacucagccacccaguuucauccaauauucucuugaaacuauuuccuuucuaucucauauuuacaccacuuuaauuauuuaauuuacaucacuugauugaauuuaaaucuuaagugucuucaaaugcuuuuuuaaaauguagcagaggcaauguagaaauaaaccuuacauacuuucucuaaauuucaaucuuccucugccuagaccaaugauauacuagcuucucuucugucuugagacaucagguucgaaguugaaaauuggaauccaggagcaagaacaacaguacccuggcuuaaucugcucccuauuugcugcuauuugucagcuguuucuaccucuccagacaacuaucaucaucuuggccagucccaauucuuccugcauacauucuuggacuuucuuucauccgagucaaucaucuguuaccucugugggaguuucuaaaggcugccauuuccauaaauucauguugggaaaauuauaaauguauauuucaaacauaaaucaaauuuaaguuccagaaggcaauacauaacccaugagaugaauuguuugauaaaagaugaagaaggacugccuagaaggaggggguaaaaaaaaaaaaaaaaacucucuaaauuccauucacgacaacuacccuaaaagaaucagggagcauccaucugcucuugucuagacacaaauuccuuuuccugaggaaagaaaaugcuugcuuggaaaguuuucuucuauuuuaaaauaagcauuucaaaaauaaucacaaaugguuuauaacuuaaaaggauggcacauuuaauucugaaacuuaaggaacgaauaaaguauugagcaugagcaugaugccuuauuuagcuuaguguuugucaaaaccuagcuuaauaaauacagucuaauuuggcaucugugauguuuaaauacuuagauugcauuaagauguaauaaagugcuugcuaaaaauuuauugcacauaacuuaaaagauucuuaucuugaucauuaaguaugcgauuuaaggaggguuuaaucccccagaauaagguaacugugucauuauguuacucauuuauauuaaugacaucuuugaguuucaacucuuaguuaaagcugcagguaauggagagguagacucagaucuuaagagguuaaaauuuaacaaaaacaugcaaaaagucaauacauacacacaugccucagguacuaagauggacagaagacagauauaaacacuaggacagauauaaacguaaguagaaaaguggguaacaaggaguaugaaauacuuggcaguauaugguagguuccaaaugaguaacacagauaauaagaguaacagguacaccgaagagugggcuucucuggucugguuagaaaggggacuucacugacaaggaagaaaucagguagaauuagaggaaagguaaaauacagaaaggcaaaccaggagccaagugggaugggcucaugccuguaaucccagcauuuugggagacugagguggggagaaucacaugaggcuaggaguuggagaccacucuagccaguauagcaagaccugucucuacaaaacaaauuuaaaauuuggcaaggaggucaucuggagacuacucuggccauauacaguacuucuguuguucuuuuguucaccuguuauuucaggcccuccggcuacaugcaaagguucccauuuuuucauuaccaaaacuauuucuggaauacuccaaggauguaccacaugugcuuccaaaugaguggcuguuagcauauucuuccucugauucaaacaccuaucacugauguggcaguuuccccuccgucagagaaucugggugacaggacauuacuacagccucaguugugcacaauuaaagcauccagaccaccaauuccaguggacaccagcacugacucugcuagacacaauauguaggccccuaauuuacuacacugccauuaccacagaugcuggucucugauguccuugaagugacaaagaagcacauguacucuccaguucccaggauucugaauccaugaagaacuggagauucaugucuuucuuuuuuuuuuuuuugguuguacuuugacaaacaggcacuagagaagugcuguuuguucugcugugucaccccaaauuuauggccuauacacacaugcaguugugaaucuuccuauguuuaccguacccuaucuccaccuucacguuaaggguuuuauuguuagaauaaaauuuuguaucuuacuuucucuuccuguguuauauaauuuaccuuuuuugaaaauaaauggaacauguuauacauacuuuuuccaccucauuuuuuaaccuaaaaauauagucagagauuguauaguuauuccccauucuguuuuauagcugcauacuacuccacugugugauuagaccauaauuuauucaaccagugcccuaaagcuagauauuuguguuguuucuagccuacagucuuguaauaaauaaucuugugcauacguuuuuauauuuuuugccaguacaucugaagaacagauuuuuaaaagugagauugcuuuccaaauguuaaauauguucuguugacagaagaugucaaauuuccuccauuuugcacaucuacaagcaaaauauaagaugacuuuuccuaauccuuaacagaguauauauauuauagaacuuuuggauuuuugccauucugauggguaaugguuucucagcguaguuuuuaauuugcauuuaucuuaugagagaguucaagcaacuuuucuuuugaggaggaaucauuuacauuucuauauuguaagcuaucugguuauggucguauuuucugaggugguucuucagccucuuaugcugagagagcugaccaugucugaauugugggagaacacaucauucacaaacacaccaguguauaggaaauauuuucauguuucugcauggucaacccugucugaaugaaaauacugguaaccugguucaaagguuaacaguccuaagauagugaaauaaccuggagagagauuuauagacagcuucuccagauauguuuacauuucaaaagagggauaaaacuaggaaccaugcauuuauauuccaaaaguuuuuaaccacuuggcuaccuccuggacagaauuuguuuacauaaaaaacguggccaggcgcgguggcucaugccuguaaucccagcacuuugagaggccgagguaggcagauuaccugaggucagggguuugagaucagccuggccaacauggugaaaccccaucucuacugaaaauacaaaaaaaaaaaaaaaaaaaauuagccaggcgugguggcgaccgccuguaaucacagcuacuugggaagcugaggcaauagaaucacuugaacccaggaggcagagguugcagugagcagagacugccauugcacuccagccugggcaacaagaacaaaacuucaucucaaaaaaagagagaggaaguguuucuuuccugcccucaggaggagcaccaauuucuaaauaagcuccuagauucauaauggugugguuccccaccuguagcacagaccuccacuguaugugcagaauccaucugcccucaucacauugcuccaagagcgggaauggaacaugggaaacugacaugcuuacugugcaaaguaacguuuguuuucugagccccaaaaccuugcauuugcuuuuaggaaaaauuauacagaucuucaaaaacuuaucagauuucuacaauacuuagaguauauagguuuuagucauauaaaaaagacauugagacaaauuauacguuaucuauuuaagggcucuuuacuggaugaggcuucuuucucauucuuccuacacuuccgacuuaaaauuagucaugccgaaguaacuuagacuguggauaguccuuccuaucucuaauacuuaauaguuugucuucccaauaagcugccccuaccaccuccuucugacaucaaucucauacuccagucccccauauuccagccagagagauaggcaggucacucagaccuguccaaucauaaaacucuauuccacuagcaacagaaaucaguccaacugaaggaagcauaggccagaaagccaaucagaugauuucccauugauacacagaaauuggucuugagcugcaaaccugaggcugcugguagacauauuuucuacagaaaaaaaagacaaaguguaaaguucucauuuuugguauucauuuaaucaauacuuacguauuaaauguguuacugaaaacaccauucuaggcuguggguaccuauagaaacacuugccucuaaaaacagacaauccuguuguaagcagucauuuacacugaagaggacauaccauacuaaaugucaaaagacuaauaguuuucuguggucuccaacugagacuagagcuauauuuuaaaggugaaucucaauaaacagauguaaagcaggaggaggaggagaugaagaacguugcagggaggacagagggagcagcauggauauguuuugccuggagaauaaugaaggcccucguccagauggugcagaggguuuauacaggggacucaugggcaauaauugcuuaugccaagugcagucaccaggaagccagaaacagugaugcauauauuacgcaauuaauaccgacccauucuugaaugacaaaacauugggcaauacaggaaaaaacccaagucccagaggcacuaacugauuuguuuaaggucacaguuaguugguagcagucaaauaacaguucuucugaauccuaaccuuggauucauucuacugcauuguccuggcccaaauguacccucucaauaagauuuccaguuuggaugcuuuguauuuguugguccuuuuauacuuucuaagcaaaaauauauagaaauguuguaaaacgaaaaaccuucccauucguauaaaacuuuagguuauagagcauggaaguaaaaauuauaccaucugcuuggcccacguauuuuccaaaauaauggaauuuuaaucucugcauacagagugcuccauaacauagaacccuuuuuaaaauaugcuuuuuucuuuuuuuuuuuuuuuuuuggucuauuguuuccucugaagaaaaaauaucuggcagaaucucacagaucuuuuaaccuagucacgcucacauggccacaaacuugagucagcuaucaaauuuacaaaaaugacauuucaauauaauccauucagugaagaaugagcuacuguauguguguguauauauauauauaaauaugauaucgcugaaugugcuuucaccccuccucagccuccugcagcaacccaacuuuguaaacgagaucuaugaagaugggucuggucaagcguguacuuacuacuaagcuguuuggcaauuuguuauaauucagguuuuauugaagagcccaucaaauaugccauguaaguauuuaaugggucugcuguagauccaauuuauuguguuuucaucagccuagauuguuuuauagaaaaugaacagguaaauuuguacauaaugcuacccuauaauucuuagcauacuaauaaucuacaaaauuuucuuaaauuuaauucagcauucauaucaagacaagaagcacucuuaagcaaagcacugucuuuacuaaggaaagaaaauaauucauggaaaauaaaccacagauguguuaucacucuuugggcaccucucaauuuuccagccacucagcgagggcagccaagugguaaagugggagucucccuacagugaccuacccaugcagccauucaucugucuacacagggguuugccuguguguaaacaccuucagcagcaacauccaguucagucaaggcuguuugauuauucugcccuuuuacagauucuucuuuguaauauacucccaaccccacucccuuuucacuauguccacaguacaugggcuccaaucuguccuguuugaacuugucccuauuuuggguuauuucuuuacuuuagggcaguaaugcucagugcacauuauuuugcccaccaggacccacuuccuucaaggauaucuggcaaugucuagagacaucuuggugguuacaacuuggcauguagaagaaagagaugcuacaaacauuuagcagguggaguccagggaugcuucuaagcaucccauaauggacaaaacaguccccagaacucuccccaagaaacaacuguucagaccaaagugucaacaguacagagguugagcaugucugacucaaggucuugaaucuaauggcacagaauuuuuuaaaaauaaaauaucaaacaaaaaaaucaaugggcagaaccuaguagguguggcaacaacaacaacaacaaaaaccaugacauuuugucuucuuucuccucaucuuuccucuuggcauuuuucccuuuuuucccacuaccacccucucucacccuacaauguacucucaugacaaaauuugauagauucacauagaaaaguggccaauucaacauggcucuaaaauuguuuaagucagaaacaaaacuaagcaaaagguagauaauuuggcaucagggacaugcacaggguuucuauuuugaggacauauaucuuaugucuccuuagcacagacauacaaugacauuagaaguaaaucacuuuagacaacauauauauauacacacacacacacacacacacauauauacacacacacacacaccaacaaaacuuuguacaaccauaauuacagaacugauccuguggucauccucaaacuccacgugucuacuuuaugcaagcacauuccccagcaauucucauuagcagucagugaguuaauagcugaaguuuuuuucuuucauuucuuuggcaaccucucuaguuauucacaaaauaguaacauuauuccuguuucagaaagagaagaacaauuggggacaaauaccaaagaaauuguauaccuuuguauucuagcucuuaguccacugacacccacuuuuccuugacacuuauuccuauauuuucaauuaaaguuauauauaagcugucuauuucagucucugccugguuacuuuccuaguuaacuucaauaaauccugaaaaguagaauuuaaauguccugcucaucuaccguauucaauuaggaauuggauaugggcaucaaaauaagaaaggugccuuuaguuaagcccccagagugcucaaucauugcaagccaggauaaaaauuguaaaaacucagaacaaguaagagcaaaaaucuugauuagcaacaacaauccaggaugaacgacuauuuguuuuuuuaaaaguagaaaaaucaaccagaacauuauuuacauaucaagacuuugggugaaaauuauguuaaaauauuacaaucaacuaagcaauuguccuugccuuuagauuuugaccuaguaaguggcacuccuguugucaaagcaguccaagauacaauaagaaaaaguucuaaaaugucauuugaacagugccugaguuaucuguggguagaaagucacaugaaaauuggcaauaugcucuguaucuuucaucugccacaaguguccuucccaccagucaugagugggcaggaacugaguccugucucuaggucuucaacacuucucugguauuauuuaucuagugacagacccaggugaguguuacucugucagauaucucacaugaagcugagacuuuguacaagaauagagcugaugggcugggaacuguaagccacagaaaugugagauggucucccuaaagguuacuaaugaaaaaguccuuaauuuggagaauuagggaaaaaaauaccuuuuuauaacucuuccaagugaggaaagaaauacuguauggcuugcuuuguguugcucaauugaaugcaaagggcaagcuuaugugaaagaaagcagugcugacucucagcuaauucaaaugcagucauaucuugucauuauuuuuguuauuaugucuaagucuaagucuguaaggauguuccaagggcaacagucucuagaugugcucuuuauaacaugauaccacacuauucuguuucugcuuauauuuuaaagagaaugaccaauaccuguguuuauguauuguguuuuacuugcuauuccaggcuaacaaauaccuacagaacucuuuguaaauaaucuuuuccccauaaaaagcaacauauuucuaccaacacaucucaucaugcagaacuuggaacauggcuauaucugaccuuucagagauggcuauuuuaaaaaugccugguggcauccaaagcucauaggcaaaccuaugaaggucccccuuaggguuugaggggagaggcccuucugugcauauauaugcaccaauucauuauucauuaacaaccuuauccaauguggacuuacauucucuuuuucuauucccuaguuuccucucauuccuuggacuauauaucuuaucucauauauauaaaucaaggccugaggaagccaaaagacauuggucaagaggggagaacuacuaaaaacaggccagucuuauauauucuccagaguuguagauuguucuaauucaguggaagcauuuuuuuuuaccccaaugcaucugcaagcucugacaagcucccauaaguaaccauaccugaccauagcagugaguccugugagcagccacaugccccugaagaagggcauguaaagcuuuccuagaaagaaagggaauaugcugaaagccuaacucuuugucagcagccaccaccuuucuuugagcacgucauauccacucacuaucuaaaaccuuuaugcuuuccacuggcugguucagaguucuuccuuaagguccuauccucucaagcaauaaaugaagaaaagguuaaauuacagauuccaaguucuuaucacaucugcacuauuuucuaaccuugugaccucauuccagucucuuagccaauucaaaccauaauuuucucaagucauaaaauuaucucauccauaauuggagauaauuaaguaagcagaaaaauuuuauuguuugugagaaucaaaugaucuauaugaaaaguauaaagaaauauaugcaugcaaagcaguacaacugucauucuccuaauauuauucaaauucaaacucaaaaaacaaagagaacacucaaguauuccacccauuccacaauuaugugcaauuuagaagcauaaaggccuacagaaaucaaugaaacagauuuauucaguuauagaaacuaaucaaggcauuaacauuuuggccagacccaauacccaugcuuaccuguuucagaaagcaauuuuguagcuuccaacaccuucucaguauaaaccccagcuucauaguucuccaucucagcauugaugauguguaugacucgagcugcccggccccugauggccccugcaguccgguccagaguguccacaucgcccucuuggagggcuaucacacacuuguucacauccuccaagaugugauuuucuauggagaggacacauacacauuuagaugacuuuacauaacucagaacuuaaccaauuaaaauugauucaacucucaugagcccuugccuuggacacaucucaaugcaugccuaauaauacuaaaauuguauguaaaggacauaguuuauaauuacaacagugguucucaaaccugagcaucagccagagggcugguagcaucacauagaucgcuaggugccacuccuagaguuuccaauucaguaagucugggguagagcccaagaaauugaguuucugucaaguucccaggugaugcuaaugccacugguuugaagacaacauucugaggaccacugacuuaaagaauaucccuuccuuuguuuugaaguuugauacuuacacacgacagggccuuuuagaaguuguagcagccaacaugaagucaaucugaccaaguauaaauguccauaaauaaaaccagagucaaagcuuuggacacauguuucuuuaaucauguuuucauuacgaaaacauuugaggaaaaauaaauaucacgcaguuggucuuuuaaaauuaugucaugcacacgguauaugcaaugggaaaacugauuaggugaagacgaucaguuucccacaauuaaaauacaauccagucuuguggcugguucccucagauuauagucaagaucugcauaacuuucauaugauugcccaaaguagaaaucaagcaggcauagaggggaggcuucacucucuaauggcauagagaaaacacauuauuuauucccuugcaguuuuaacaaguguguaauuuuguauuuuucauguccagugugagaucuguaauucuauuccuugugcauucuuuagaagcagaauucuaaggaaauguucaaaaaguuuagugcucuuuguaaauaagcugaacacacacauacaugcacacacaccaacuaauaaacugcauguuuuuauucccuuaaaauucauauguuaaaauucuaacucccaaagggguaguauuaagaggugcagacuuuaggaggugauuguguuaugagggcagaaucuuaaggaauggaauuaguguccuuauaaaagagaccucagagaucccucccucuuucuacccucuuucuauccucuuccuaucaagguuccagugagaagacuaugagaaagcagaguccuuugucuuggacuucccagccuccagaaccaugagacauaaauuucuauugauuauaagcaacacaguuuacaguauucuccaaaacacaccaagacaugaacacauaaaaauaugugcuuuugauaaauauauuuuuaaagucuuaaguaaccuguuaauauuuuaaaauuauaacugccaaauccaaccaauaguucauaaauaguuaaaauaaaauauuaccucuuuaagaagcuuuuagggcuaguucugauuuuaaauuuccuaaagaaagaaagagaguauccagcaaauccuagucuccacuaccgaucuccccuacuuuuacuaaauuaagcacuuagaaagaaaauuuauauuuuuaggacacaggauagaaaauugcaaguuauaacugacuuuucauaaagaacauccauuuugaccucauacagugugauuucuucacucaaaccauuauaaauugcugauuucuacauucuccauuucuuuaauuucaacuauaaauuagaauagaaaaauaaugaaacguuuaaauuuuaguauuucgauuucuaaaacucacaaaaaguaguacuucccaaaucaugacauuuucuugagacaugacauuuuaaugaaaacaugauuaaacaugugaacacaguauauaccuaaaaggacaucugagagaaauguuuacucaaaugaauauugacagagaauucuaaauguaaaacuuugauuaaaagaagcuucucuuucuguccuguagaauuucuuaagacaauuaaaauguguccuggcccuugagaguaaguaacuagaaaaggauuugugucaaaaucacacauccggcugcuauuuucuuuguauaacaguaauacaagaauggacaaaguuucagugcagaguuuagaaacgguacuuuggaguugagaaaaaaauagugagacgucuguuaauuauauuagauacuaauccuucuggaguuaauaaguuuguuuuuaaauucuaagaaacccauucaugacccaauauguuaaaaugaaaacguauuuuuaauaggacuauccaaaaguagaaauaugcaacuaauuuaagaggcaagaaauauguuuuuauagguauuauuauaccuauuuaaaauaaaccagcacaggcuagaaauccauaacaaaaacauugcuauuaauuacucaaaucaucagcaaaucuguuacauagucagguuaauaauguuguacaaaguauuaguuuuauaauuuacuaauugacuaauuuuauuuuauuuuauuuuauuuuuuuuuuugagacggagucucccucugucgcccaggcuggagugcagugacgcaaucccagcucaccacaaccucagucugccaaguucaggagauucuccugccucagccucccaaguagaugggauuacaggcaugcaccaucacaccuggauuuuuuuuuuuuuuugucuuuuuaguaaagacaggguuucaccauguuggucaagcugcucuugaacuccugaccucaaaugaucugccugccuuggccucccaaagugcugggauuacaggcaugacccacuaggcccggccuaauugacuaauuuuuauaaauaaauuuuuaaaauuuuaagauauagucaugcaacauaaaucauuucagucaauaacagaccacauacuuaaagguagucccauaagauuaugucauauuuuuaccguacuuuuaaaauauuuauacauguuuagauacacaaaacuuacuauuguauuccaauugcuuacaguauucaguacaguaacgugcuguacaaguuuguagccuaagaguaauagguuauaccauguaguguagguaugcaguaagcaauaccaucuagguguguaaauacaguaugugauguucacacagugaugaaauugcccaacgaugcauuucccagaacauaugccugucgucaagcaacauauaauuacaguuuacucaguguuuuucaaccuucuccaauucaggucccuuuuuaugaaaaaaugagucacaguuucuucaugauaguaguuauauugauggauggcagacauguaaaagcuacuacgguucagaauguuuucaaauagauuuguacuuuauuaaaaacaaucuacaggcaugucuuguuuuauuguguaucacagauugguggguuuuuuuuucuucccccccaaauacaaauugaagguuuguugcaacucugcgucaagcaagucuguuggugccauuguuccaacagcaugugcucauuuccugucucuguaugacaguuuugcaauuguugcaauauuucaaaauuuuuucauuaucguuuugaugaucugugaucagugaucuuugucacuauugcaauuguuuuggggcaucaggaaccauguucacuuaagaaggcaaacaauaaaugucgggcguguuccgccugcuccaccaagacggccguuugccaucucucucccucuucucaagcuucuuauucccugagacgcaacaauauuaaaauuaggccuauuaacaacccuacaaugaccuuuaaguauucaagugaaaggaagggucacacauuucucacuugaaaucaaaagcuagaaaugauuaagcuuagugaggaagacaugucacaagucaagagaggccaaacagccaacuuguaaguacaagaaaaaguucuugaaagaaauuaaaagugcuacuccaaugaacacccagauaagaaaaugaagcagccuuauugcuaauauggagaaaguuugaguggucuaaauagaagaucauaucggccacagcauuccuuuaagccaaagcccaaucuugaccaagauccuaaugcucuuuaauucuaugaaggcugagagagguaaggaagcugcagaagaaaagcuggaagcuagcagagguugguucaugauguuuaagaaagaagucaucuccauaacauaaaagugcaagguaaaccagcaagugcugauguagauagaaccugugccaaguuauccuaaagaucuagcuaagaucauugauuaagggggcaaacaaguuuucaauguugacaagacagccuucuacuggaagacggugccauuuacaacuuucauagcuggcuucaaaggacaggcugagucucuuauuaguggcuaauacaguugauuuuuagguugaaccaaaugcucauuuaccacuuugaaaaucccagggcccuaagaguuaugcuaaaucuacucugccugugcucuauaaauggaacaacgaagacugaagacagcacaucuguuuauagcaugguuuacugaauauuucaaguccacucuugaaaccuacuguucagaauaaaaauaauucuuuucaaaauguuauugcucauugaaaaugcaccuggucacccaagagcucugauggagauauacacagagauuaauagugcuuuccugcuugcuaacacaucuauucugcagcagauguaucaaggagucauuuugacuuucaagucuuauuauuuagaaaauucacuuuuuaaggcuauagcugcaauagauagugauucuccugauggaucugggcaaaguaaauuaaaggccuucuggaaagaauucgccauccuaguugccacuaagaacauccaugauugauucaccggagaaagucaaaauaucaacauuaacaggaguuuggaaaaaguugaucccaacccucauagucgacuuugaaggguucaagacuucaguggaggaagaaagugcuuaucuaguggaaauagcaagagaacuagaauuagaaguggagccuaaagaugugacugaaucugcaaugucaugaucaaacuucauggaugaggaauugcuuauguaugagcaaagcggcuucuugagauguaaucuaucccuagcuaugauagugugaacauuguugaaaugacaacaaaggauuuaaaauauuauauaaauguagugcauaaagcagcagcagaguuugagaggacugacuccaauuugaaagaaguucuacuguggauaaagugcugucaaacagcaucucacaugcuacagagaaucuuuuguaaaggaauagucaaucaacgcaucaaacuucauuguuaucuuacuucaagaaauugccacagccacgccauccuucaggaaccacacaggaaccaccacucugaucaacaucaaggaaacccccccuaccaucaaagagauuauggcuggcugaaggcucagaaugaucuuuagcauuuuuuagaaaugaaguauuucuaaauaaagguauguacaguuuuuaaacauaauccuacugcacaguuaauggacuacacugcacuguaaacauaacuuauaugcacugggaaucaaaaaagauuuguaugauucaccuuauugcaauuggcauuuuacugcaguaguuggaacagaaccagcaauacguucgagguuugccuguguuuggaaaaaagccauaccuguuuacauagacaugaacaugaacuuuuuggucagaagaccauacuugguguauauauggauuuuugaacccccuguaauaacuuccucacccccauacccugugccuucaggucuaggacuuaacaguuaguaagcacgcuaaucuaguauauaucaaggagggcagucaauuauuuaaaggcagaauacacacuucauucacauuugcauuccugacaguggccuauaggcagcaggcaaucaaaagacagacacugaaugaacaugcccauugagaaggggcgaucaauuacacacuuuuauucugagguguuuugaagagaaagaauucaugaaguaaagagagagaggaauguugcaacuagaaaggaaaagagaugaaaauaguaauaaaaggcaaaaguauccuagagauuauuccauugcugugaaaaacugcaauguuuggguggcacacucuaauaucaagugugguauuuaaacaugucaugaaacauuugauugcaacauauuuuauuguaaacuuccuuauauuuggcaacauuacuauuuuagaaaugauauaauuuuguuaugaaaaaaaaucagugaugaccaaacuauuugacuguuguaaaccauaaggcuacagauucaaagcaauaaaguucacggugaauuuuuaaaagaaaauaaacuuaagacuguagaguuaaaaaaaaauaggaaaaguuaaaaagcaaaacucuugggcauuaugagaucaaguuaauagcuuuuucagaucuuagcuuccuacuacuuugugagccaaauccaagaauuaaacugucacaugauuaaugccaagaugcuuauuuuaaaauacuauuaaaaauuguagguuuuccaaagugggaaaaaguuugacuguuaucacacagucauuucacuuuuuuaugugcauaggccacaucuuaaaauugguuuugcuccuguaauguuaauagcuagcaucauugcuccccaaacuuguugcauuucauauggacaaauuuaauaucagauacagaaguuaggguagcauuaaaaaaacuacaaucuuuuaaaaacaaagaucuguuuuuauuguuuuuuaaauagaguuuccugaccaaagagauauuccccuaagaagaaacugauacauaaaauaucauuaaugccacuucaaaauaucucuugggccaaacuugcaguuuacuuauguaaauguuuggcuguagcucagagagaagaugagaaguaguuucccuagcuauugggcuguguccacagccuaccagcaggacagagugggcuguaucauuauuugucaaaccccgucugcggaaaggugccugcugccucugauugucaacuccaaaggcaugcuccagcaggcccugccaagcuggcucucugacagcgccuguucauuuuccugccauggcaugccguggcacuuguaccacugggguuggacugcacaguguuaucagcagaagcaaaagccuuuucuuguugcugguaauaaugagaugcacaaaggaaugacaaggagaaaagggagcaaagaggcagggcucgggggaggaaaauuagcaaaagcuuuguccuauugaaaaagucugagauaagaccuccucaccuugcuuguccccacccucagaaauguuuaugcaugcauuuaaagaauagguuggaaaaguuguaaguucuaaaaugauuccucucugaaaaaggcaauguauagguauuuccuauugauuugaagguagaaggggaugcagaagauuuccaggggcugucaggauggcugugugaucugaggcugguuggaaagggcuccuauuuggagcaccauaguuauccuggaaaaaaacugaccauauacuauaaagauuaguaucaguggccaccuuucuauuccccaucaaccaaauuacgaacauaccuaucuaagcaauuuccaaauaccuuaugagagauucauuuuguggagguaucuuuuacaagauuaggacucagcuaucagcaaagcaaaaaauaaaaauaaaaaagcagaaaugggcugggcgcgauggcucacgccuguaauaccagcacuuugggagaccaaggcgggcggaucaccugagguccggaguuugagaccagccugaccaacacggagaaaccccgucucuacuaccacaaauacaaaauuagccgggcauaguggcucacgccuguaaucccagcuacucuggaggcugaggcgggaaaacagcuugaauccgggaggcggaaguugcuaugagucaagaucgcgccauugcacuccagccugggcaacaagagugaaacuccaucucaaaaaaaaaaaaaaaagcagaagugacaauauauugaguucuuuuaucagcuaagcucuagauauggugauauuuaaaugaauaguugcuuucacaagucaucaaaaacaaagaccuugggaauaaaaaacaagacagguuucugaaagggauuagagauuggaaugagaaugccagaggugggaaagggaagcugaaaugaaagcagcaagcaccaaaggaaauuuccuuucuaucuugacauauugagaauuauagaguuucugaaaagaggaugaucuggauuuuaauaccaucucugccaaguuaccuacccucucaaugacuuaguuuucuuaaaacaaaaccuagaauuaguaguaccuauuuuauagaauuuugaugagaauuaaaucaagcagcagagaguaagguaaauucuagucacaggccgcauguuacaucaauguucccaucugccuuggcuugccccaucauugaaaagcuggauuuuugauuauccaucaaaucuacagauuugacuacacaguucucagacaagccccagugggaauuuauuauguuucuuccggaaaagaaaagacugcaacuagaaacauuuucuaaacaugacagccccccucagaaaucacuuccacacuguugcagucagagguccugucugccugguucccaccaacagugaugcaaugucucccucagcccucagucagccaagaaccagcaggucaucagggcuaguacugccugagucaguaggugugaguuccacacaccuguguagaaucaacaccuggccaauuugaauuuccaagggucagcuggcucuuuuaacaccucacaaagaaggcugauguuuccagugaccuccuccucacagagauucuuccaggugaacugggccaaauaaguuaggucaaaagcauuuggaaaaauguccauuugcuggcugguagacaaaucuugaaauggacuccacgaguccuguuaaaggucagacugucucugcaguuauucaugucuacuagcauccuccagucuggcuucauuuacaaagaagaaaguuauaauuucaagugaugagcaguucuauuuucuuucacucgcuuccuucuacaaccucauagacaagugcucaaagccuugauagcuaccaagucccugcuaagggguaaguucuguggcugauaucucuaccuguguuaucacaaaccuucacuuguuggaaaaaaaacaaaacaaaacaaaacuuaacauagccaaauuggaguaacugaucaccuauuuuuaagacauaaacuguguagauuaaugaaucccauauucccuggcccuuuuuuacaugagugauucagauacaucaaaggccauccugcuuuauaaacuccaaacacuaaaaaggaauauaagccaccuuaaauaauguauuccuuuuuaaugccuugacuccgugucuugaaauaacauaaacaccgaagcaucuaagaggguguuauaaucacauuugcagagaugaucaaaaaagcucaaagaucuaaggagugcgccugaaacacagauccaugacauuugcgagacauuccuuaucucguucaguuacccuccuccagcugccuuguaagggaccuguuugugaugauuaccugagacagagaggaagucauccacugaggugaugucauccacggccucugucaacacucggaccugcuucucccacuggucuuugaagacguccauguuauccugagcaacuuugcucuguggccgggcagccagugucagagcggcauugaugaccuauuuguuggaaacaauccagggacaugaugaccacacacuucaaaagaggaauaagccggucaaagaccauguuaaaaccaugcacccuguacguucuacagauaaguggguucuugguguucagaaggacaaucaaacacauaaaagauaaaggagauuuucaacuaccauuaauuuuuguuugcuucuuuuuaagacauaauaguuugccucggguuucaaaaaguauuuacuggacaagucucaugacuuagcacagauacagcagaaaugcaacucuugcuuuccacaugugcaaguuuaugauuuagcugccgagacaagguaaauagauauggaacauuuaaaucacaacccaaaacaaauagaacaaagucaacaggaguggagaguauaguggcacaaucccagcucccugcagccucgaacuccugagccccagcaauccucucaccucagacuccccaguaaacugggacuacaggaaugcccccaccacacccagcuaguuuauuuuuuuguagagauggagucucacuauguugcccaggcuggccuugaaccccuggccucaaucaauccucccacuucagccucccagagcacugggauuauaggugugagccaccaugccuggccaagcugccaugguaauucugaagagacugguaugguuuauucuuucugagaaagguagaacuugaaacagcucauaaaugaugaguagccuuuuucagcaagaggaaauagagaaggaaaaggaggggcacaagggcuggaguggagaaggucacugacaggcuuuugaaacaaagugaaugaggcuuaccuggggacacaggcugucaaucuggguggcugccauccgaacuaauuucaccccuucuucauuguuggagauggaacaggccaaauuggcaaccuguauugaagaggauuuuagugaauauuagguuggggcaaagggaaaguauacuguugcuccgccuuggaccuucucuggcagaugucucuuccaggagaauucuuucagaaauaagauaaggguacccuggccuucauguagaaccaacuaguacuacuucuuaugcuaauuuaggcauuucugucagaaaaggcauuucacgacucucaagcauauacaagguuguguuuuaacaggguuuuaugaacuguuuuuucuuaugaacugccuugauccgccuacacucucuggagccuccuaagacucaacaucaaaaugcaaaacccugugaucucggccauaucaguacucaguucugacccuguagaguugagugagaagaaugcuacaggcaauuauuugggcuugagagacucauaguaagcugacaauuauggugcccugcccccaaaauacccgaucugccugaaaauuuuaguccacuaauagccaacucaaauauuauuagaggccagcuguuaugagcaauguaacaaaaaggcucguagcauucaauacacaauggcggaauauauaguaaauuacaaugugcagaucuaguauaaagacauucaaauuugauggccuccuuguuuucuggcaccuuccauuuucaaagccaacaguuuuuuuuuucccccuccuugguuccuggcccaaauuugaaugucuucuuuuccccucuuccuugguuccuggccccuuccgucuucaaacaguuggcucugaagauggauggggccaggaaccaaggagggaaggggaagcaagacauucaaauuugauuuuuaggaacacuaugcuaccccaaacagcuggacugaauucaaguucccaggucaagggggucaacuuguuguuauuccuucucuugaaggagaguugguaauucaaggugagauugauuagccaaggucaacagccacaaagccaccaucaaaagaccaaucagucccaucaggcugguaucaagacaacacaagaauggggauaugaaaagucaaagaagaggagaaggacagcaagggguaggagcuauggagcaaacagaacaagugauuagcagacagaaucccuggagucuuguggccgccugccuuuuugguauccugcuuauguuuagucuccaaaacugggcugcucuccucccauuccugaaugcccuaggauuuuagaauguaccacccaugcuuauaguuccuaaugugaaagaaaccuuaggcaguaugacauagugagaagaguacaggccuggagaucaggaaguucaaccacugggcaucuuuauaagucacuucacauuuuagauugcugcuuccuuaucagcaacaugagauggguugagggugauagaauacuuuuaaagauuacuucaauaaaccauuaguguaaagaauaggguuuuggaguuuuuaagggagaaagaggaugcauuauagcuauuucagugagaaaauguacuaggagaaauuaugacaagugaauucaaacauuaccauuuaauuucuuauaguuuauaguuuaccuuugauuuucauuauuuuacuuaguuuucaaaauaagugugaaaagacauaugccucauuaggaccauucacagauacugcaugccaugggcaggaagguucuuagauguggggcaggaaccaacgaugcaggucucuuaacuucaauuucuuuguuauaucauaaugucuucucuccacauuuuuauucaucuuuguuacaucuguauucuauauucugguucauuuuacaauccaagugccugacucagugcaugacacagaauugguguuuuguacauguuuauuuaauaaauuaaacaauagcuuguaaacuuaguguaacuuauuguagacaguaauuuggaauacacaauggauaaauggugcccucaaaaauacaguugagcuucacccuuaauuuggcaagacaaauguucaccuucuagcagauguuaaccaauguuaugguguuaaccaaugguuccuacauucugaucugugguacgaguccagaaugcagcuuccccuguccaaaguggcaugugggggggggaaaaaaucaggauaguggagaaucuucuagaaagauauauguauuuaaaguucuaccuuuuaauauucaauuaaauuuuuccuauaucugcuuuugaacaaccucucauucuaugaaauagugauaauuuuagaugauggcuguuuuugccccguaccaucccugcuugcugugcaaaagacuugagaucacacuuuugcaaacagugaauaauugcuagaguuuagcacaacaauaugaaaacuuaaaaaugccccaagaaucagguaauuauuugcauuucuguaaaaagcauaagaaaauaccaacacgcuuaaugaaauaauggauccagaccaagucaucagugguuaacauuaaaaaaagaaagagugacaaccagagaucauguguuucuugacugagugacauaccacuguccaugaaauauucuugccaaaaaaagaaaaggucagccauuuaggaucaauuuucaauuuacagaaaauucaagaggaaaagaaacauguaaaauaaaaguacauacaugcaaucauaaaaauccugaugguuaaaaacugcuggaaaaaagacauagaucucauuuguguccugaauagaaaaaacaaacuauaauauauauauacacauaaauauguaaauaaauaaguaaauaagacuacauuuaugaaaccaucaaggaaauuuaaauauuaacuagacauuugaugauacugaggaguuauuauuauuuuaaagcaugcuaaugguacuuuuuuuuuaaaaagaaucuauagcuuuuagagcuauauaaucaagauguuuauugaugaacugauguuuggaauuugcuucacaauuaucugggguuggggaaauggguagaaauguagaaaaaacaagauucgccauuaguuuauaauuguugaagcugagugacaguguaugaugguucauuacacauucuuuacuuugggauaugcuuagcauuuuccauauuaaaaaacauuuagaaaaaaaguagcagccacaaaguauuauaucaacagcucuggaaaacacuuucuugcaucugugcgugucuccagggagcacaguguaagcuagggaaaccugagugugguuuggaguugagacuugcagacaguagaggguaccuaccugagcacaaaugaagagugcuguaacuggacucugucagucacagcauagcuccccagaucgcagagcuucccacuuaugcugacugcgagucaccuggcagaagucgacccugugggacuuagagcucagaagagcuggacucuaacagaaggaaacgcuaacuaguaacuuccacauagugaaaauaaacuuuucuuuguguaucuuuugaacuguuuucucaucuuuuguuuaaauuaaacucuauuauuccuuaggccuaacuccucacccaacagaaucuuaguagggggaaaccaagcuagcaaugcuuggcaaaaauaaagagcuggcaccucuugauaguccuccaguuauuuauucucuuuaauuguacugauccauaaauccuaaagucuggcagccuauacucugcaacguacuccugcuauuuaauuccacuuaaaacccagaauuucauucaccuuguauuuucuuuggaaacauucugaaaauauuuccaauaugaugcuaaggauuucaguaucuucagaggcaggcuuacauauuuuaaguuggucaugggcucuauccaaaucccuaccuucccuuuuuucuuuuggcuugucuuucucugcuucucacuggacccaauggcccaguggugacuaucaacuugguuuuauauauuuugauuucuagaauuucaucagcaaaugauccuuagcuucauagcuugaggcaguccccaaucaauaauguagcuugggccagaugcaguggcucacgccuauaaucccagcaauuugggaggcugaggcuccuaauaagccaggaguugaagaccagccugggaaauguggcaaaacuucauuucuacuaaaaauacaaaaaauagccagggugugguggcacacaccuguaauccaaaauacucaggaggcugaagcaggagaaucgcuugagaccgggaagcgcaguuugcagugagcugagaucacaccacugcacuguggccugggugacagagagagacuccaucuccaaaaaagaaaaaaauaauauagcuugaaaugccagcuaacaccucaaccucaaaaacaucaguccaagauaacuauacacaguagguaucucaaaauugauuuuuuuuuuuuuuugagauggagucucauucugcugcccaggcuggagugcagcagcaagaucucagcucacuguaaccuccaccucccagguucaagugauucuccugucucagccucaccaguagcugggguuacaggcacccaacacuacgccuggcuaauuuuuguauuuuuaguagagaugggguuucaccaugcuagccaggcuggucucgaacuccuagccucaagugauccacuugccucggccucccaaagugcuaggauuacaggcaugagccaccacaccugccaguaucugauaauugauuucaacaaccuguucuuuaacuagauaucuguuacaacaucagaaacugugguaaaguaaauguccuauuuuuucaaagcuaauauuuucuccuacauggucaguuucucaugauaaagggugauaaggggaaguauggaggaggaaaggaaugguggacuggaauuacuagacacuugaaaagauuaaugugagugaaaaagcagacaauauaucaucaauacauugcaaccccaaagauguugaacaauacaauuaaaucugauagaauuuugaaacuugcuugaugcaaccaagcaggaaauguuuaugggauauacuugcucaacugggccccgccucugccuucuccacucuugaauuauuuacaacuuaacugaagccacaagauuuaaucgccuuccuggaagcuuagaaaacaauaaagcauuucauuaaguauuaaauuuugagcaauuuagauugaucugggauuucugaaaguggaauaggucaugacuauaggugguagagcucguuggugaucuaauuguacuaaauaccuaccaaucuguuagaaaggaaagcucuccuucuuaacuucugagagcauaauggaucuggggaaguaaaagcugagaagacuaggccagucuuucucugacuuaguaccuuaaaaccaguuaucuugagggaaaggaggaagcuuagcagccaucauuaaauugugugcugcugaccccaaaaacuuuaggauuacagaaaaagaagagaccagugcugcuaaguggaaucaguaaacauaucauggagagguaaacuauccauccugcaagauuuauuuuacgauugccuguuuagcacuacuuucuagaugcucaaugaauauaacuuuuuuuuuuuuuuuggcucuucugggcacacuuuguaaguacaugaauacuuaacauuaacaauaucauuagcagaacuagaaagaacaacaacaacaacaacaaaaaaaaaaaagcaaggagagccuaugccuauuuuuugaagaaaguaacuuaacuccauuaauugaauuuguauuacaauuggcaucuauccuguaacucuuuaauaaucaccucaggaagccaaaagcagagugacaauauuccugauaagacaguuaaaaauugacaaaaauaacucaggaggcugagguacaagaauugcuugaacugaggagguggagguuacagugagccgagaucgcuccacuccacucuggucugggcaacagagugaaacugcaucucaaaaaacaaacauaugcaucccucauaaaaauacauugugacccaaucgcuacaaagauaauaaaauaauaccuaggaauacaauuuucaagggaugugaaggacuucuucaaggagaacuacaaaccacugcucaaggaaauaagagagaacacaaacaaauggaaaaacaguccaugcucguggacaggaagaaucaguaucgugaaaauugccauacugcccaaaguaacuuauagauucaaugcuauucccauuaagcuaccauucacuuucuuugcagaauuagaaaaaacuacuuuaaauuucauguggaaacaaaaaagagccuguauagccaagacaauccuaagcaaaaagaacaaagcuggaggcaucaggcuaccugacuucaaacuguacuacaagguuacaguaaccaaaacagcauggugcugguaccaaaacacacauauagaccaauggaacagaacagagaccucagaaauaacaccacaugccuauaaccaucugaucuuugacaaaccugacaaaaacaugcaauggggaaaggauuccccauuuaauaaauggugcugggaaaauuggcuagucauaugcagaaaacagaaacuggaccccuuccuuacaccuuauacaaaaauuaacucaagauggauuaaagacuuaaauguaaaacccaaaaccauaaaaacccuagaagaaaaccuaggcaauaccauucaggacauaggcaugggcaaaggcuucacgacuaaaaaacagcaaaagcaauaguaacaaaagccaaaauugacaaauuggaucuaaucaaacuaaagagcuucugcacaacaaaauaaacuagcaucagagugaacaggcaaccuaaagaaugagagaaaauuuuugcaaucuacccaucugacaaagaucuaauuuccagaaucuacaaggaacuuaaauuuacaagaaaaaaacaacccuaucaaaaagugggcaagggauaugaacagagacuucucaaaagaugacauuuaugcggccaacaaacauaugaaaaaaagcucaucaucacuggucauuagagaaaugcaaauuaaaaccacagugagauaucaucuuaugccaguuagaauggcgaucauuaaaaagucaggaaacagggcgggugugguggcucaugcuuguaaucccagcacuuugggaggccgaguugaguggauuaucugaggucgggaguucgagaacagccugaccaacauggagaaaccccaccucuacuaaaaauacuaaauuagccaggugugguggcacaugccuguaaucccagcuacucaggaggcugaggcaggagaguugcuugaaaccagcaggcagagguugcagugagcugagaucaugccauugcacuccagccugggcaacaaaaguaaaaccccguuucaaaaaaaaaaaaaagucaggaaacaacagaugcuugcgaggcuguggagaaaaggaacgcuuuuacacuguuggugggaguguaauuaguucaaccauuguggaagacaguguggcuauuccucaaggaucuagaaccagaaauaucauuugacucagcaauuccauuacuggguauauacccaaaggauuauaaaucauucuacuauaaagacacaugcacacauauguuuaaugcagcacuauuuacaauagcaaaggcauaguaccaaccaaauguccaucaauuauagacuugauaaggaaaauauggcacauauacaccacagaauacuaugcagccauaaaaaagaauggguucauguucuuuucagggacauggaugaagcugaaagccaucauucucagcaaacuaacacaggaacagaaaaccaaacacugcauguucucacucauaagugggaguugaacaaugacaacacauggacacagggagggggaacaacacacacuggggccugucagggggugggaugcaaggggagggaaagcauuaggacaaauaccuaaugcauguggggcuuaaaaccuagaugauggguugaugggugcagcaaaccaccauggcacauguauaccuauguaacaagccugcacauucugcacacguaucccagaaguuaaaguaaaauguauagugaccauuuaaaaaggcaagauguuuuuuaaucacacaaagaaaaccccacacagcucacagaucuugauaaacuacaucguggcuguacaauucaguuuuguguggacaccgccacagaaaagcagcucugucucaaaagagccacagucuuguuugaacacucacaagaaaagccaaaaugccuggaaggcugagcuucaauuagacauuaaaaaccucugcuaauaaaguauuuaggcauuuaacuccaacgugauaugaaguacaucagaaaaaugagaacauuuucccuuuuucuggccucggaaaucaaauuacauuuuuuaauauuugugauucuguucuguuugaaacaccagcaaauauucacugcauucaacucccaaacacugaaucauuucauuaauuuuuacagcuucagguaucauauugguguuuuaagaacacacuauugaaauaaagcagaauagcaauucgaagguccauaaagcacuugcuccucauguuaauauuucaucaucacuguaaauuugagaauaaaaugaauuuauuuaaauaaauucaaggggaauuacuugaauuuauagucagucauguggccauauaaaaccacagagaggaugguggcacagauuucacgcaaaacauuuuucucuaaaacuaucaucacaaugaaaagugcugcggucuccaucugaagguuuauucauuuaucugugcugauguaauuaguacacacgaagauguuaacauauaugccuaucuucuagagaaccacaagguuccuacagaacaugacuccuauaauacagauggaguuucacaauucaauaacaguggaaaugauaaaccucccugaaaccuuugagaggcaagacagaagcagcugguagaaaaacaggcucagccuucgaugaucagcuuccaggaagaugggcauaggaauaggcuaaauggccaccaucaaaauuggacuugaggagagucaagucuggcugcccagaagaauauuguaggaguugucucgcuuuccugcugagguauuauggaaucauuuuaaaaugagcagcuacacacuggcauaaguuuaucagccugauuaacagucacugcaguucuacaggauagaggaaacuuaaacagcagggauaauuugaucagggaaggaugcucaguggaugucagcagcugggggcuuaaguacacugggggacaggaggaaguggaaucacuuuuucuugccucuguuuuaaaugaccucuauaaggcaucuggcacucuuggucauucuauauaguuuaauuuuaaaaaucauaauugguaagaccuggccuuugcagucaagcagcccaggguuuauguucugacucuuauucucaccagcugggugagacguguugcaucucugagccucaauugugucucaguuauaaaauauaaauauaaaauauuacaauguugcaauaagagauuaguuaacccagcacccaguaaugacuugacaaauguuaccgccauaagaugcaauuuauugaaaggucacuauaaaagugaaaauauauuugaaugacauuauccaaucauugaucacucauucaauaaauauugagugccuauauaugacagacauggaagauacaaguaaaauauuacuuaugcccuagaugagcuuauauuuuggugggaagacagaauuuagcaaaguaaugcauuaaaaguuuauauugugaugaguuuuacaaaagaaacaaggggaagacaaugauaaaaaccgaagggagcucuaugugaucacuugcguaguuuaccccuuaguuuuguauaaaguuacaauucucaaguuauaauucuuuuugucacugcuuauuucaacccguuagaucccaaauauuuuauagauuuuauauacacuucuaaccaauauuuuuuaauuauugaauaagauucccuaauguuguugccucauuguuugguaaauuaauuccuugcugucaugcauuuaggggagucuccaauguuugcuauuaccaaaaacaaaguaauacacaucuuuaggcaucuaguuuuugcuccugucggaagugaaauuucugcaucaggaaaauuguuauggcacuuguuuaccugugaccauaguccuugcugaaaggucccuggaauaagugaauugccaauuuuccagugcuaccagcauugcaucccauauuccucaacacuguuucuucuugacuucuccaccaacauaucauccgaauguccuucuaacuauucguucuauaaaccacaagugcaaaucaggauugcucaaguagccacuucacauuuucccagcuagacugaauucuugcaggacagaaucccuacuuuaccccuccacacauaucugggaucacaguugcugaauuccaauuuuuugaauuuacuaacucccacaaacucucuucauguuguauagaagaccacucaauuugucauaacuuagucauacauaggagggcacucaguucuaugaucuagaauuaggaggaaguauaacuuuucuguaucaguuaaucaaauaaguuuaucaucaaauuagcauacaccagcuaauaucaagugaaccuuauacaacauccugccacaugguacaacgaagaaauuuguucauggucccaccaggcauuguacccuugacuacaguuauacaucuauaaaaacacaaaucugcauuuucuagagcucuucugggaugaagagcagcucuuuugccuguguucuuagggauacacacaccacuagcaaaugcuguuugcaugccucugcccaaauuaaagugaucagucugcccuggugacuuuaauguagguaaucaccagcucacauucaugaacaaauugaugugcccgcuucauagcugaaucacucagcauaaaucuaugcccuucauauauaaaaaccucaguggcuuaaaauaauacaauaaagcaucaccuaaugccuucuugaugcuggcucaucaauaaugugugguuaugugaaaaggauaggagaggcuuaucaugucuuaccuuaaaccaugccgggaauguaaugcccuuuuaauuacuaaaggcaucaggggauuuuguuuucuccaucuuuacauggaggaacuaaaaccuugcaacucuccacuauuacuuaguuuucagcaucucauguaaguaaaugaaaucucaacuuauuuccagugaauacaacauguugaccuucauauaugugggcugcauauuagcaggaugaaaacuccaggauccaucucuggcaaugcaggagggcugcacugaaccauccggugcuugacauuuaacggaagccaaggaacguuuccagaaugaagauccagaugaauaaguaagugcagcuauucucuaaaaccuggucuccuacauuuccagaugacaaguggaaguguggagucaaggccauauccacaaugcaggaugaaucuaaccauccuaaccaauauuggaucugugacuacagcccgcuucacacagaauaaggaaaacagucaggaguccccaguuuaugucccacauugccuucuuuuuuuugcggaggggaugccuccgccaauuaaacuagcaaucuuccaagguucaauucaaaauccacguguugcugaaggcaucccauucacacaaccaguagaaauagaucucuuccaaacaccuucaggcuuacuggcugugcuacccauugcaacuuaccacauacuauugccuuauccauuauuuauuauauggauggaggauaccuacacacggaauuagauguauaaaucaaagauacacacauagcuaucauguaucuucaacuaaauuuccacaucuuugaggauaaugguuguauuuuuauuuucauccuuguggcucccauggcuccccguucaagaccuuguaaacaguagcuauaaacguaguuccaaggcagccucccugucaugggugcuuucuuaccuccugcucccaucugcccuuaccucugggguacagcucuuucuuaucgcuguugguuuaccuagaaaaagaugcuaauugauuaaucaaaguaacuauucacuaaggucauauuuucuucuccuagguaauauaacaccuuaaucuaauuaagauguuccugagcccuuucgagcuuuaaaaaaaacacacacacaaaccaaacaguaguuccuucuaauccaugggaaauaccuuccaagaaccucagcagauaccugaaaccacaaauaguaccaagcccuauauacauaauguauuuuccugaacaugcauaccuacgauaaaguuuaauuuguaaccugggaacaguaagagauugacaauaacuaguaauaaaauagaacaauuguaaaaauaucccagcauuauuacucuugcacuuuggagccauuauuaaguaaaauaaggguuaauugaacauaagcacugggauaccucuacagcagaucuaauaaccaagaaggauacuaagugacgaaggggcacauagccucuacagugcauaugcuggacaaaggaggauugacauucaggguggauggagcuagagggugcaagauuucauuaugcuauucagaauggcacucaauuuaaaauguaugaguuauuucugaaauuuuccauuuaauauuuucagaccacugguaacugaaacuccagaaagcaaaacuauggauaaggggggacuaccauauacuguugaaauuucaggcuccccaggcaggcuuuuggggaaauacauaaggacaaggaguuuuuuccuuaaacucugucaacccuaucuaaaaguucuuuggucuuuucuuccucugaccaccuguuucuauaaauaaagucauauuggaacacaucuuuacccuuuuauacauauugccuaugacugcuuuugcaugacaauggcagauuuggguaguugugacagagaccauaugacccacaagccaagaucucuuacuaucccuuuacagaagaagauugccaacccccaguuuagaugaaaacuuggugagauuuaaccauuuaauuuuuucagaccugucaaauaugccaaagcaucgucauagcaggaaaugagagaaguaucaacuuauaguauuuaugacacaaguaaaaucaaaguuaaguggaucgaggagaagcacagguucuuaaagaauaaaaauaugugccccucccaggucuccuuaaagcacaaaguucuggggccagaaaacaaacaaacaaauaaaaaaccaggaggagauaggcauggagcagaagacccagaaggaccucuaggauauucuccaccaucccaaacauugacaaaagaaguuugcaggugaacagagaagcaauucugagucaguacugccaucuggcuuaccucucaauguagcaccaucaacaaccucuuccugaaacuggaggaucacucuagaggccucucuaaccaagaggccaauugugcagccuuucaucuguggccguauccuucuuggauauccacuuccuuaucacuuacugcuccauuccuggcuuuagcagucuguauggguagcccaagacaaagcccuagaguauaucuaauagaagguacuaguccucauuggccccuugguaaacaccuggucuggccacugcaaugguuacugcccgaaggagaaguccugggaaccugugucacaacuccagaggguuccuaaguaaaucacagcaaugggaauaugggguaggggagacaaccugacugcuguccuugaccgcaccagggaacugacuaaagaaaugaccuuugaaccaacucauuccccuuaacagcucccucccugcccucagaaccuguaaccccugccuccuauuaccugcauugccucauggacucuuuccaagcucaaccccucaaaccuguucacuccaucuuaccugagcucuagugccaccucuucuuuucuuucagaucuuuauugcauuuucccccauguucucucaugaaguuuuaauucucuccuuaguguauaaguucaagcuucuuugggugcaaagcacagcucccuuuuuccaugcuuuuccccugggagcaaucccauccauucccagaccaggugguaggccagaucccucagucaucagagagggaaaaaaucaaagaguucuccauaucugcugucuuaggcucauuaaacagugcuaucgaaaccauccaaguauugcagcaccaucucugauacucucaaauccuccucccacguggucaggcucaucccaguucugcuuucuuuauaugacuucauacucugguuccugacaccugcuucaaguucuccucugcuuaauaccacuuaugaacaacguuuccuggcuaucuaaugucacuaacccaucaggaaggucuccccacuuucaucauaccugcaacuauuaguuucuuccugucuguguccugcaaaacacauacacagucugacaaggccuccugguuuucauugauaaccagugcucucacaagucucucccgagcuggaagcucccuuguugagugcccuacaacucuuccuuuuaugggccacaaacugcuacugagggcugcaauugcaacagcuccuugcucagcucugaaaucuaauauuuccaugaugcucagaaagcagggcagagcagugccgggggugggcaggaggguuauuucacgucaccugggguuauuucacgcccucucagaaagggcucugccacauggagucccuuuuuuuccaaggugaccuucgaguaaccacugcugccuuguugggcagcagaugcaucccucacaguccagagccauggucaguaguggaccacagaugcauuugcuuucaccuucaggcucucaggagaccauggcuagcucuagaugaaaggcgcagcugcacuuucagaaguguacacaaaccccgagccaaaguuaugcuuguaaccaacacccguaggagcaggccaagccccauggugcccuucaaaugugccucaccuuagcaacucucuacaagugaaauguuuuacucucauccucaguaggucauuuuuaccccccucgcugaaucagucugggugaauggccagucugaccuuucaaucugcuacgugaaauaaagcuuaaguugguguucugacuaauaguaccagagagaagcaagcaaugaaauucuauguaacuugcuucuguuuaguuuugugcucuagaggcuggcuguuucguuauuuaaccccaggcuguugccucaaauaggcucugcaaucuuuugugggauccaaguuuagcaagcauacucauugugugaacaccaauaauauuuuucaggugcaccuagagaaagggagagaacaaaagagggcuauaaaacuauuuggaggucuucaucaauguaagugcuuaguuaaauaagcaauaauugcaauuauuguuuuagcauucccugaagacagaaaauuuaacuuucaaaugucuuaauaccuauuauuucacaacagauuauguacacauagauauacuuuuccauugguauuuaguuauaaacuaugaguaacaaucuaugucuaugggccaaauauagccaguggcucguuuuuguaugguuuuaaagcuaagaaugguuuuacacuuauaaagggcgguuaaaacaccuacauacagaaaaaucugugagacuccauguggccuacaaaucugaaaauaguuacuauucuuaccaauaaaaguuggcugaccccaaaguaugaugguauaccuauaaaaacuacucugguguuugucugccugcccaccaggacaugaguugccccagaugcuccaaucccagcaaucuuugccacugaucaaggaagccaucucugcucguauuucccaaguuccuuucugguuguguucuucaaagagaaggaucuuuuuauuucucaucucuuaauacuuguuuauuuauguuuacauaaccccuaugucaccauucauuauuccaccagauacagcuuuuccaaaagucuaaucuguccucagggacugaagagcuacaaaguuugagaauguuccaaagaauauguuagagacucacgaagaaucaguguaaaaacaugucagaggcagcagcccuccaaucugggcaaaaacucccaaagggucuacuuugaagaaaaaagcccucucuggaaugaguaauuuauuuuuauuuuuauuuauuuauuuauuuauuuuuuugguggggguugcaccuucuaugugguagaacccaugagauucaugaucaugccugaaguguggaguugggcucacauuucagugugagacaguuuggacggcagcuuugguacccagagcauuguccacaggccaguagcaagggcaauaccugggggcuuguuagaaauguauggcuaagggcugggcacgguggcucacgccuguaaucccagcacuuugggaggcugaggcaggcagaucacgagaucaggagaucaagaccauccugacuaacacggugaaaccccaucccuacuaaaaauacaaaaaauuagccaggcaugguggugagugccuguagucccagcuacucaggaggcugaggcaggagaauugcuugaaccccaggaggcagagguugcagugagccaagaucacgccacuguacuccagccuaggcgacugagcgagacuccaucucaaaacaaacgaacaaacaacaacaacaaaaauacagcuaagguugagaaccacugaucuauuccaaacaaacucucauuuccuuucucaugugccccacaucuccauccauuuaccaagaagaauugauucuauaagaaaauuuucccuuggucaugcagcuaauuugcugcaaaauggagaccaaguuacaagcuuccauauuucuguuauucauaaauuuggaugcacacugaaaaugucugagaaauauuaaagauauugaugccugggacccacacucauaaauucugauguacucgcccuuguguauggacaagacgugggcauuuuaagccucuccagcuaauccuaauaugcagcccugguggagaacugucucccuauuugaaauuucauuuaaauuuacuuuaaauucaguuagaguauuuccagguaaaugagugccucuuucucuucuaaggcauuggucuggguccaucagcuuugcuuucuccuuuauagaggccaaccagggagaggccucagagauguccucucucucccaaugacucccaacuuugccccaucauaagaaucaccuggugugcuugcuaaaccuacauuucaccagaagauucugauuccagagcucugcaaugggccugacaauuccuguuucuaaaagacuccccagcugccacuuaagauaaagcagauuucagguaaaacugaucuaacacaaguccagcagcaucagcaucaccugggaacuuaucaggcaugcgaauucucaggccucaccccggauacacagaaaucagaaacuauggggguggggcccagucaucuguguuuuuagcccuucugguggcuccaaagcaugcucaagucugagacucacaggccuaccacaaacgcuucacuuuuugacaaauagugcccuguuuucuaaaguccagccaacaggaauucccccauacuacacuugcuuugcuuucuuuuuaaaaaauuauccucaugucaucacuucuuacaacucuaugaaagugaguuaucugagaauuuuuucugacacuuuuaauuagaaaguccuaauuacuaucaucuuucaugaauauucuggguaagagugagaccuuguguuuugacacaaaaagcacauucuccugagcacucaggguggugccaucaacugugucauagugcucaaauuuuuuccccugaaaugcagacauguccauagacaauuuguacaaugaccauauucuacuaccucccaaauuucaaaaaauguuagaagggugacaaaaggauuuuuuuuaaaacuccauaguucuugcaggauucuuagagaaguuugcauucaaggaaauccuggauaccuaugcagugcuuaagguacuuucaaaaguucuaauauuauuuuauucaauucucacagcaccugaaaugacgcaagaguuggaaugugugaguuuuaacugugcaaacacuuuuuuauaagcucuaucuuuuuuuguuuuauccucagaacaccacacgaagaagguacugucauuaucauucccauuuuauagaugagaaaauugaggcacagagaggcccggcacaguggcucacgucuguaaucccagcacuuugggaggcugaugugggcggaucaccugaggucaggaguuugagaccagccuggccaacauggugaaaccccaucucuacuaaaaauacaaaaauuagccaggcguggugacgcacaucuguaaucucaggacuuugggaggcugaggugggcggaucacaaggucaggaguucgagaccagccuggccaacauggcgaaacuccaucucuacuaaaaauacaaaaauuagccagauguggugaugcacgccuguaauccuagcuacucaggaggcugaggcaugagaaucccuugaacccgggaggcggagguuucagugagcugagaucgcaccacugcacuccagccuaggugacagagccagacucugucucaaaaaaagaaaagaaaaagaaaaucgaggcacagagaaguucaguagauuuacugaggucauaccagaguaaggagaaaaugcagguuugaacuauaguggccuaacuucaaagcacauucuagagaucccuauaugaugcucauuuauugcucaccacaaacauuaaacagauuuuuuuauuuuucagaugaauaaccagaagcuaagagaguauuagguuggugcaaaaguaacugugguuuuugacauuacuuucaauggcaaaaaaugaaauuacuuuugaaccaaccuaauagcuugcccagaucauacagcuaauaaguggcagagccaauguuugaaccuggagucuguuugcaggucccaggcacacguauugcaccuuaugcaauccugccagcgcguaagguagucauuauccuuacagaucauggagcaccaaugaggcagcuuuucaacuucaaguuacagucacucucuuaagaggggcuuaggaaaagcugacaugaugagugugaucaaggccccuccagaaaaacccuagcauaaaauacauuuuccaagggacaggcuacgauaggagagaaaacaaaagcaaacauuugauauugaggguagagagcagaugggugagggggaaauuggaaagucaggcuuagcugaauucaggguuuuuguuguuguuuguuuuuuugccugaggccaguccugcuccugagaguuacccagauacaagccaaaucagauucagagucgcugaacuugaccagaguaguuauuucucccuuacuucacagucacuggggagggcaucaccaacacagaaggggaaauccagaucauucagauugaaagaggccccaaagacuuccgggaccugcccuaugagacuccagcugccaggcaaggauucucucuugagcacacugagcccauccaaccaggcaggagagggguccugagacuguguguguuggggaggcaggguagcaaaaauugcuauuaaaaaaaaaaaacucuagcugugcaauccugccccagcacaaacaggaacuaccagaggaggaaagagugagaagacauugcuugucuucugcuucauucacucacucaccacauuuaauuaaucaccacauaagcuucuggaagucauacaaaaaaaaaaguguauacugcucagugaugggugcaccaaaaucucacaaaucacuacuaaagaacuuacucauguaaccaaauaccaccuguuccccaaaaaccuauguaaauaaaaacuuaaaaguaugagguggggguggcaagggggagacaucuaaugagauaauacagaccauaaaagagcgaaugaagucaaauacaaacgugcuacaguagagaucuaugcuugucagagugggaccaccaaguggguggagagcauuuuuuugugugugagagagcauguaugagggcaguuguuuaggaaaagcuucaaagauacacaggucccuaggcuuacaacaaggcagacccuaagauggggaaggagguaauggcaaaaauuaggggcuaguggcauagggagacuauucuagggaagaagaaagaaugugagccauggccaaagagacugggguauuuggagauuggcaaguaguucaacgugacuagucugcaagaggggagucagcagaaaauauggcugggauggaagucagcaccaaagauguuauaacaacuuucaccuguaggcaaugggcagaacuuuaagcaggugagugaccacugggcaaaugucaccuaaagagcacuugcacaccuguuuggaagaugaaucagaagaaaaugagaaagagcagguaggcggagucagauucuucugaaaaggaaagcguacacccacuauuauauauucaagguaagagaacaaggaauguggaggaggauauacaagauacuaucuuaugagguaccucuucuaaccccuaauuuacagaugagaacacuuggaggugaaguacaucuccccugaucaccuaaauggucagguucagagccaggaauauucaauggucugucucccaaaccagugcuccucccacugugccacagucccucuccccagcuauuucccugcaggacaucuccugaaggccugucauccccaucagcagcuaugcuuuugucaggacuacacaggcagguaugacaacuccucagcgccaagagcaaaaagucuuaugcuaugcuuuugcuuauaugauucacccuucuaccucugccuauccuaaggucaaagucaugccucacaucaucuaggaagccuuccucaaccaauuuccccuaaguauggcaacguaaucuucccuuacucugaaaucuuaccacauuaguguaaagaauuuguaucaagauugguuauauuaaaacguuguccucugugaagacuugccuuccccauuaucaacuuuucaaagucagggaccaucuccugccucuucuguauuaaccuuagcaugaaauauacugagaacacaacagacgccagccccuccugugugcaagcugcuggcugcauguccauguaccacuuacacccuuacaacaggggagccgagcucgcuguagagcccagccccaucauucacucaggacugcaauagaaaagaccccaugguggcauaaauacuguuauuuagguuuaauaucagcaguaggaauugucguagccuaucuuccucuuuccaucuaccuuauaacuuucucuucacgcaggccuaacauuaucaccaaaucacuaacauuuuccuccuuuugcuucucuuuccagugccccagucauucauacggaguuucuucucucaauuuacagcucauagacaucuuuuuuuauucuaugaaaaguugccucucuccaugcaccgggaccgacuucauauuuacucagccuuuguugcauuuacaacuucacuuuccuuucugcucacccauguauuugaauucugcucucccacugaggcugcuugacauguucaagauugcuacaagugguuuuuuucauuaaauaaauguuuuccucuaauacacagguauggcaccuauucaauacuuccuuguuagaugaucucauucacccugacccuauuuucauuacuggguugaaaauacacaacucauuaucccagacucuggcuucucacucuuaccuuuauguaauuuucugaguugguugauagcuccaauugagcagugcacaaucaccccaaaugcaugaauuccacaaaacauaugcaccacaggaccccgucuucuccugcucagugucacuaucagcuaaugacauauuguauuagucuauucucacgcugcuacaaagacauaccugagacuggguaauuuauaaagaaaagagguuuaaucagcucaugguuuugcaggcuguacgggccucugcuucuggggagaccucagggaacucaccaucacggaggaaggugagggggaaagcaagccgucuucacguggcuggcaagaagugggggcugggugcuacauacuuaaacaagcagcacuaaggggaugguacuaaaccauccccaugauccaaucaccucccaccaggccccuucuucaacacuggggauuacaauucaacaugagauuugggcggggacaaaaaucuccaggauagaaaacuaagauuccuacucggcaauuaaagucccgucaccuuuaacagcaagauaucuccaaccgcuuuauuccuaaccccuucaaugcaacggucacaguucaaauguuuaucaacacacauucuaauuauugaaauuaaaugcaaucuauuuucuacaguaucugaaguccuccacugucugaccccaacuuggaucuccaacuuuauugcucaaacacaucacagcucccauccucuugcuacagaagacugcagcacucauuaagacucucuuuugaggauccuugagaacagcugaggcucacacuaacuaccaaucacccugacagagcugacucucucugcaaaugaguagagcuccaugaaaacuguuuccgaauauggacuuuggacaugaccuuuguucagaaccagagaaugcacaacacacuuaagagaaacacaggauccagguuggccuuguggggagcuucuagaaagaaauauggacagauaaccugauuuagauauguaacuguuagguugagaaaccacuuggggcuguauauucuuaaagugacuucauuuuuugaucucccucucuucauuuaaguuacuccuugaggcuaauucuuucucuaccuaugacuuuucugcuucuucugaaguaaugcaguuuugauuuaguuauuuaguguguuaauuuccuacugcuacuguuaaaaauuacaacuuuaauggcuucagacaucacaaaauuuaucuuacauuucugaaggucagaagauugaaauggggcucgccgggcuaaaaucaaggugucagcagugcuauauucuuuuccggaggcuccaggagagaauucguucccuugucuucucccacuccuagaggcugcccccauuggcuccuagcuccuuuuuaucuccaagacuaacaacggcuagugaagucuuucucuccuugcaucacucuaacucuccugccucccucuuucacauauaaagacccuugugauuacauugggcccaccuggauaaauccaggcucauguccugaccuuaaauucagcugauuaguaaaucuuaauuccauuugcaaccuuaauuccccuuugccacaugaaguaacauauucauggguuccagggauuaggaugugagcaacuguggggggaucagggagcaaugauucuacauagaguuccauguaagaguuaaaacuugcauuuuguuuggaaauaaagacucccaucuccuucccuguauggggcuuuggugaguauagcagguacgaggaggcacucaguuucucuuuuguucuuccacuugguagccucaaauccuguucccucaacuuacuaacuggucuccaggguuagguagaggaagggagaaaagaauggggaaauuggaacaucuuugcucacuacacagggacgcggccccagcacaagggcugucagggcuucgugggugcucacagcuggcuuucucaucagugauuuguuucucucacugagggccagugcaucucauccucauucaccugguaccccugccucagccccuggccauguaguaauaccucaauauuucuacugagguuuauccacucuccaaacagcccucuugaacaggaccuuggaucauuccacaccaaaccucucaacucacagaaaauaccacucuuuuuuacugacaaacucuggcaguguaggccaauccuaaugcagccagcuuuucaccgaaucaauguggaagcaggugcagccggcuucuugcucuuuagagucucucaguacaauacccccaaaauuaguauguggaaacccuaauuccaaugugaugauauuuagagguggagcccuugggggcuaauuaagucaugagaguggagucuucaugaaugggaauagugccuuuauaagcagaaacuacagagcaaacuagcuuucuuucugcaaggugaggauacaguaaggaguuagccaccugcaacuccggaaaaaggcccucaucagaacccgaccaugcuagcaccaugaucuuggacuuccagccuccagaacugugagaaacacauuucuguuguuuaggacuuccaguguaugcuauuuuguuauaauaccugaaccgacaagggcccucagccugaaguaaacccuauuucucuguguuccccgcuggcaggucgggaauuuuuccaguucucuccuugcacuucuaucaaggccuauuuccuuuugauaaugaaaaggggauggcacaggccaccaacagcuuucuccaaaaaugugucccaucuaguauaugcuuauugaucccuuuaugucucuagugugggugaguauauucagaguucauucaccaucuuuuagccagcugcuuagaaacacacacccucuuggucucacaccucacuuuggaaagugacucagcugaaauuucuauuuuaacagcauuccuggaggaggagggaugaggaaaucagggaaacacaggggguguuccacucuguggggugaaaggaaagaggcuucuaagcaacaguggaucaaugaugugaccccaucuuagaaagaugaaggacaaugcaccauguggugaaggugugacaggcgugaccagucuccugaugugguccacugcauguuguuccagaggauggucucuggugucacuuccccaaagugaggacaccuggccauuaugggucugcaucugaugagcagcugagccucuuaggacuuaguuauuucaauaaguucaguagagcuauucccaaacuacugugcuaugggcuauuucagcaggaaaguaaagauacuagcauguaguuguccucuacaaucuaagggaaauauuaccaaacagaaaagucagccuuugaauaaauauaaaaauuucuaggacguggaauucagaggaggucagaauagaucaggucaaggaauuaguucugaccuauuauucucuauugcucagagcugugcccaggcacaugcuggggaguaacaaugcuguugccaauauuuaugcaauauggaagcauuuuuaagugacucaugaugugaaaacuagaaggggguguagagagcauccaaauggaaaccuagagugugauuuuuuuucaaagaugcucucucuguucauuagugaccaaaccagauuucaaaaccaggcacccuaaguaccaguccaaugaucuugucacuuuuucggucuggauuuggcaaugcguuucuguguuuuauuguuucaucagcacaaagcacaauccaugauaguguucaaaaaaugcuucuaggacuucacaaugcuaaucuguuuuccuacagcauuuuccuuuuggcuuucucagcuacauuuuucuaucucagaugcuccuugauuuuauaauauaaaucacacauacauacacacacacguacacacacacacaaaagagaaagagagguguuuauucuuguauucccuuaucaaaucaagcuccagguguuucauauuuuucacugccccaugaaaacuuacuaauuguggauucccuucuucuaagcaaugccagauuucaaaaaaaaaucccauuuauguguuaguaaguaaauuaucuuacccucuuaauuauccagggguggaagugaacagaaaccaggaaaagaaaaugcacagauaagucuauuacaaucagauacuagguuuagauuugguuccuugagagcuaaggcaaaaaggcaaauaaugggcuauagaguuuuuuaaaaaauauuuuuaacaaaaagaagcuuacagauuccuucaggaaucaaauuuuuccuaaaacuaauucacauuuacucauauaaauagucaagaauauuugagaaucuaguagcaaaaaacacauuaaguguguuuuuaugguauauacaacaugccauucauauaauaauuauugaugagaugaauagugaucacuaagaacccgacacugcagaccagcugaagacugaguaucacaggcaaccaggaagcagagccaaccaaauuccagguuuaggcagaaacucaacagaauauaacuucugugcauuucaacaugucuaauauccaugauguauauguuggggcagggguaucauccaucauccucuauccauaaagacaagaaggacauggaauguucuuggacaguuggagacgucccaguguaauaaccaaaaucugugcuucuguggguguaggaagaaggggagaacuugacagauuggggaaaugauguuccaauaccagaagaccagacugauccaauuauuccauuauaacauuccacauccacuagagaucaucagcucacucugcuuuuaacuaaauaauauuucaucauuuacuuaacugaauaugaaaaauaugcuugaagaaucaccucaauaauccauugagauuucaaauugucaaaucacagaucaaauucaaagcuuuuaauauaaaugucuuugagugaaggacagcauuuccagcuaucugcagucuaauggcaagucuggugucuugccuuggagcaaaugcuugcauuuacugcccgucaccugaagguguuuuacuuguaaucccuagaaauagcauacuuuagggaugugaauucuggcaaauaucugguuagugugauccauacugacaagccaauguuuucaauacacucugaucauaaaaugaguuuccuggaucaguaaaguaaucaugcagaccaaguuuaggcaacaaacaguaaaauaaauauuguccagaaaaugacucaguguugaugcaaugcaaaaagccuccaauguuauuaaaacgauuugggguuauguggcccaaaacuuguccugagcaccauuuuguggcaggauuccccaauauuacucucggcucuagacauucucucuacaaguuccucaaugaacacuuccuugacaucacccauccccuaggaauguuccuugccuggcaaaagguauacaguuacacaagauuaauagacgccuguaagugguccugucauccuuuaacucaaaggaguaacuccuacagauaaggucaaggacuggggccagcagaacagugcacagcugggccccagggcaacuuacauacuuccuccauggcagcagcagaccacugugauuacagacaaggcaaauucuuggugggaagagugaaagcaaggcacccuuugcagugccccugagcaaauccauccgugguccccaccuuccccaaucauuacaaguuaacugcuccuuuuccuccugauacugcugaugggaaaugagccuccagggcugacagccaaaaauuaauuugaucgauuuauuuuguguuccauguuuugggugcaaaugcuuuccuccacccugauggagcacacuuaugcucucccauuugcagaaaacaaauuuauagugccuaacugaauucuuucgcugaaggucagaaacaaauguucccauccaucucuuuuuaccuuucugugcagcaccaaguugccuuccuucuucauuucagacaaacaggaggauuguuuucuggggagggguggggugagagaaagcaauuggaacuuagaaguuucuaccaaaaacaaaacuuaacuuaccccucaugagaggaaugaagcaaagaaauaaaaaucucuucugauuucacauggaagagaaaacuucaguuaugccuuaacucaaguaaaaagaacaccauuagguaaggacuauuaauuuaccguuguuagaaaaguggaaucuggcacuuaauuugucuguauuucuugcucacuugagaccaaauucuguccuuggcagguaacuuccaaagacuacagagagaacuaaacauagaugaucaggacugugaaugguuaauccuguuuucucaggguauaaacuaacucugcauuaagaugaauaguuuucagguguugcuuaacacuaaaaaaguucacauguuccugagaaagaaaaguugauauucucagccccugccacgugcuuaaccauguuugaaaaaugaccuccuccccucagccagaguuaaucuuggaccuauuugaggugcuuugaggaccagauggggagcauuaauggggagaggcagagcuguguagggugagacaaguaggaagcucauuugcagccagucacccuggccugcacagguacccagcugaggcaaaacgguaaggaccgcauggaaaucacauagcuucugcggcuuuuauguaaauagcauccuacauauggguaacaaacaccauucuguuaucuuccaucucucugcuucugcccugagaaaaaaacccaauguugcuuagauauucauggcaugagguggccaaaggcaagaugcauauuagccaaucagcucagucuggacacaaaggcuuuccugagcacauccccuuccugccccagagauguuaagcuuggguggcuucacacacucugccucagggagauauguucugcauaaugaaucccacuguuguccguaaugagaaggaggucaucuauacacuugaccugaaaggaguagagaaagagagagagaagagacagaauagugugaaagagagguggauaaggaaaaacacacccagaccuuagcaaaaaccaucaaaacugguuccuuugaucuggauuugggcaaguuuuugucccaucuguaaggaugaaacagacaugcaauucagugauacugaggcuuuugccauucauauggaaucugaagccucaauugauuucggcugaagccaccagaccuuggccaucauccccuucugcuuuauuuuccacaaagcagagcaagaaguaaauuaggucuucaguuucuauguuucuuuacaaaucugagcucauguggugaauaauaaaaaacacauuucaaauuuaaagaauauguaacaaaaguuucuuuuaagcauuagagagggaugaaugccuucucauucuaaugcagcucaagagaauaagaucccaaugucagccucuggcaacugaaauaaucaauuucuagcaaaauaaagaggcaauaauaucuuugaggucucaaaaaguuaucuaagacccagguacuccuucuugagucucagcuuuagcuucugagucagaaauacuauuaugucauucugagcuauccaagggaauaaaagagaagauugugaaaauccuucuucuguucucucccauuagcaauuaauuuaucaucuuaucuuuuuuucauaugggaagcccugagacacagaaagagaaauuuccaucaaagaagaacagagcugggcauucucuuggugauggugggucaguugacagaauucaauuccaagaaaaaaauccuauuugaaacucaugagaaugguccugaaaaugagcaguuuccaagggggaaaaaaaaaaaaaagaugggcaauucaccuagaaauuguugguaccauaagauccauuucuuauguuugaaggcuuuuagucacccuaagaaugugugcugcaaaucucccugcaaaaggagaaaucaaaggacuugacacacuccucuucauagaggaagaaggcagagaaauucuagacagacagggguaggucccugaugaaaccgcaccuucaagccaaaaagccuaaaaccugcggcccaaagugagaacuucuaucccugugugcccucucucuccugauugguucuuuuugaauaaugucuuuuuaucaaucaaauguugccuuuuccaaaacuaccuacagcuugucccaccccccauccugugccuauaaagaucccagacucagucagcagggagacagaagcggcuugacuggagagaggugacuugacuucagagggacggcuggacuuuggaggagagauggcuuaacuuuggagaagagcuggccagagacggccugacuucaaggaaguuuaccugccugccuggucaccucucccacuccccucucuucugagagccuuuuccaucacuaaauaaaauuccccacaucuaacauccuucaaggguccaugugaccucauucuucuuggacaccagacaagagcuugggacuuaccgaguguggguacccagaaaaggcugucacacuggccguuugcacucauugguagaaggcggccaccacacaggacaaggcaaggggcccacugagaugauaacaccccacuguccacgaacagaggagcuaagagagcauuguaacaugcccucugggacuucagaggucgcaggcacccaaccugggugcugccagggggccugcacagagccugcuccuucuggcacccaaaguggacagcuggauccuguacuugcucacucaugcacucccuccuucaagagguugagcacggcuggccaaguaaucagagcacccccaucgcaaguccaacaaagggguugagaaaaacuccugcaucacccucaauaaaccagguuaccuaacacagugagugccuaaacaggacagauauauaaaaucuaguuaggaaaucaaucuaaaucaacaaaauaaauaaaaauaaagauuaugagaaagagagacguucaaaucaaaugguaaaugauugcugagaaaaagaaugugauucaggagaagaaaggaaaagacuuuguaugguagaaaaguuauaaagaaauuauagauacugaagaagaaauauccaucuauuaugcagagggaagaauccagaaaauagagaaaacccugguacuauccuaugguaucacuaguucugcuaagaucuaacucuccucuucuuucacagcaaguagaguugcauuuucuccucucuugcaguuggaugggauuaugagacuaguucugccuaacaauuugggaagauaaauuaugcguguuacuccuuugcuaaaauugagacccuccagacuaugcguuccaucuaucaugugacaagaaagauggagaugauggcaucaagauuuuggaagguguuuuguuacugcagcauaaccuaauuuauccugacugauaugcaaccacacauucaauaaaagaaauacaaagcuauauaguggccacagauucucucuugaggaaagugaagaaaaccguaccuaaaacugauaugguauccaauaagaguguuugucuucuuguaguauacaccugaggugguacagagaaucugucaagaaagugcucacacacauuugcuaaagcccagcuaaacaacuguuauuucuugaaaaauaaagaaagaaacuggggcuguaucuuuagacuuuggccuggaggaaaaaacugaaggaagggaagaagccaggugguauuguuuuuucucuguucuuuacauuuauguuccugaaagaggagcuaaugggaucuuaauaguuaugcauaugaauuaauguguaggaccccccucugguguggaccauguagaaccuaguuucugguaucaggaccacaggaucuugcaaagcaaaggaugugucuuuagcacaccaagagaggagcacuuguggguauacucucuuguguaagcaagggagcuacaacacaaaauguuaagggaaagagaagaugccccaaaauagcucaaaucuauauauucugcauagaggaaaucaguuguagcauagauauuucauuuucaaagggacaaaaauugauucuugguggaugccaaaaaagcuuaaagauuacaacggcccuccaaaaggccauagugcauaaauagauaugcaguauaucugugguauuaacauuauauauaagaggugauuacggggaaagaauguuuuaaaaagacuccuuaaggggacagugaugaaaaaaauacuaaaaaacacugacauaggugaacaaauguagugauucuuggagggaaaacaaacaaacaaaaaaaaagaauuuaaaaauauuuauagccauauauauuuuccaaaauagaaaauguauauauaauaaaccaggucacucuaaaaugcuauccagaauuaaagacaauuuuaaacguuaaccugagucuugguaaccaugagccucuucuuucaucuucuauacacggcccagaagcucaucagagaaggcccaucccauuuucucucauucaaacuauuugcagcaacauagucugaacguuuaucuuuuaaaccuacacagccagagucucagccauggaauuauuaccauuuuccuuugaaguuuuauuuuuauaucugcuuuugugaacuacccagcacauaagguuccaugcccuauauuccuuuucuuugcuauuaugaacuucaagaaguuaugggcauauuuuuccaagacuauuuauuuguauauuuuuaaaacaucuacauuaucuaacagaugagaauuaaauccagagcaaaagucaccauuaugguuucccauauacuuuuuuuuuuuuuuuuuuuuuuuuuugagacagaguguugcucuguugcccaggcuggagugcaguggugugaucucggcucacugcaaccuuuaccuccuggguucaagcgauucuccugccacagccucccaaguagcugggauuacaggugcccaccacuaugcccagcuaauuuuuguauuuuuaguagagacgggguucaccauguuggucaggcuggucuugaacuccugaccucaguuuaucugcccaccuuggcugcccaaagugcugggauuacaggcauaagccaccacgccuggcccuccuacauacuuuuaacgaagugauuuuguaaaaucauucuagacuauaggagaugcucuacuucuaaaagauacagauauguaguugguauauggaaaagcagaaauauccuaucacuauuaaauuugaccuuggacacaauucuguaauuuuuaguaguauuacaguacucuauucucuaccagauuauguaaacuauagaaaauaagugacuucgaaucuccuuuuaauuuucacucagauauuuuuaguaugucccuauuuugagauucaaggauuuugacaaugauauauauuuugucaauauacaaugccaccaccucauguaauaaaauagucuuggcccaccaauguguuaagaaagcaguaagaguaccaucuguuuuaagaggcacucccuacacugggauagaaguuguauaagauacaacaagcauguuugaacucaccuauaaccaugacagacaaugcuaacaaucccaacgucuugcucacaguaccuagagguagccucacaguuguuuuggauaaaggcuucaaaccguaacacugauguugauagacaagguaaaaauuauccuggaaaaauaucucuaauaucuuuccaucucuaaaacucucauuaugcuuuugaauuuuuuacaauuuugccuuagguugacccaaguagaugcauacugaggauucacauauaguucagcaggcauaaaaagguagggaugaauauagcaggaauuuauuagucuacuucccagagaaugacuggauacccaaagcaaaaacuuuggcucucuaaaguugcucacaauucuuugcaauuguuuuguaaguugccaccaaagccuucccuucccugagagaugauauuaaagugcaaguacccugggaagggcaauacagugucucuuugcuaacaaagauaaauaacaaagagcagagucauuacugugagugaacgugauaaaaacauauaaacaagaaucuucugcuauggauacagagaaugaauguggaacaagggguagaggacacacgugaccauuuagcagaagucagucuauuccaggauuauagauucuacuguuuuauuuuauaacucucacgucacaaggauccuauauucuuucccugaaaccuaaaaguuauaccuuuucagguuucuugccugaaaauugauuuacuuucaauggcaaaugccacuauaacaaaugaucaucaauaaauugcagagaauaugaccaauuuuuucagcauauauucaaaagcaaaaacuaaagccaauacauucucuugagagaugacccaggaaaccauuggcauguaugauauaucaaggugaagcuauggugauuguugagcugggucuugaagaaugaaugggaagacuucaucagauguauuuagaaucugacaggcaggucagcaaggguggaauacaaggugcaagauggucucaguuaagacgggugucagauaaucaauaaggagacuucacguaacaguauauuucaaaugaaagaugaugaggucugaagcaagagggcacauagagaaggaaguagcuucaugagauaaucagaaggacaucucuacagguaguaaucaucaacauaaugaacucuguaugguguuuugugggguugguuuggugauaaaaaucaaugagcgacuaggcagacuaaaaaaguuuaaguauaccaaggaacucauuuuugaaaguuaacagggagauacugaauucauaagcuaaauguuguuuuauuaaauaucuguuguaugccauaaacuauacuaacugcugcaggcuacuaaaauuaauagaacauaggcauugcccuauagaggggcagaaguauaugcaggucaacaaacauaauaaaggauuagguacaaugagaguagaacagaggaagcuguuauuucuguccugagaauuucuccagggggaauacugcuucucaagccugaauaucuauggcccuuuaaccaauguaaugcgacaguggagugaagaauggaucugaggacaggagcccugcguuccaguccaagcucuauuaccuuauaacuaauguguggagacaaggacuguccaauuugguucagcauguacuguagguuaccugccaauaagcuagcuaggacugaugacaaccauuaucucagcagagggggaccacaucuucccugggugauagaagggcccuggguuccuccuucucucauugguaguacugugcugaacuuggcuucccaaguacccacggaccccaagguuuucaggugccaaacagcuggcauuuccuagcacacucuuagacagaagacauccaaguucagucugccuuuuuucugagcucaauauguuagauaacccuacagaaggccauuuucacacuuauaccauaagagcaucagcaggacaauuucuuguccguagaguauuacuucaugguguaucagcauuguccuggccucaguguaccucucuuagggauaaugagggauuaggggacugaaaagcuccucuugcugaaccuuggcugguaaauguuccuguuaaacccagaccgcugcaccuuucaaaaccaagcaacaugcagcaaaucacuugccuucccugagccucaaguuucugcaucuguagaaugaagaaaauaaagaacuucaccacacacuucacaagguaguaauaaaaauucaaagaguacuuuguaaauugaaauguguuauacccacgugagggguuauuuuuaucacagaagagugaacagccuccugagcacagacucugcuuuuggcaccuaaaccuucuguuuaccacacauugcugcuugguuugauccacagauaauuagagguagaucagaugcauccaugcaaugauauggaaaaaauaacaaagauaaaaaugaauaucaaauaaacgaaaaagaagaagaauaaaaugaggaugugucacccauguacauauugaaucacuagucugggccaagauuccuagccugcaaagucgaggggagaccaugucagaugcacaccugccagaaauaguaggaaagaagcauauuccucagggaauuccucagggaacauggcuucauggagggaacucuguaugaggaggucagugguuuccuucacuacauaaacacaaucaacacaaucucaaauuuguuuuuuuuuuuuuuugcauaaaucccauagcacaguucaaggaaauuuauuccauaaaggaccuagcacacauggucugauaagaguugauccagagauaaaauauagacuagagagaguccauauguuguaggguaaagcuacggauuccuuaaaaaacaacaagaacaacaauaacuuuaagauacacuuguuugucauauuuuuugagacagucuggcucuguuguccaggcuggaguacaaugugagaucugggcuaacugaaaccucuaccuccuggguucaagcuauucuugugccucagccucuugaguagcugggauuacaggugugugucaccacgccuggcuaauuuuuuaaaauuauuauuauuuuuaguagagagaggguuucaccauauuacccaggcugguguugaacuccuggccucaagugauuguuccauuccuuuccucagccucccaaagugcuagaauuacgggcaugagccacuguguccagccccacuuguuuauucuuuagaaagcuucuggaaaguacccgucucacauuuaaccagcaaguguaaaaguugggaguuaacuuagauaucaucuagugccaacccaauuuaaugaaagcaaaacugaggccauccaauaggaaaugucuuuucuaaaguggcaaaggcuucauugcuaggacugaucccaggucugggccucuccaggaugcagugaagugccugucuugccaaaucugagcaaucacagugcuuaacgucccuacacaggacucaaugcucauuaaucacccaucaaugccaguugagucugccuaccuugacagccaucuauuugacucaaauuuguuuccaucuucauaacccuuagcccaaagauggaagcacucaguggaugcuuaguaaugccugcauaauagauugagcaugguaauauuauacauugagcauuuucuauugcaauuuagagacccagucuaagugcuaaauucgagucuuauuccuuaguuccugacagugagcaagccaacugggggacaauaaugacauuuccuacaaaauagauuaugugaauaccaaagccaagagauauuucauaauaaaauuucagccacaauaaagaaaaaauuagcacuuuuaccuucacuucauagucauagguuaaagguauuacacaaauauaaaauuaaaagauuaguaaaugugucauagauuuuucucuugaaacaucgagguuaauuuagcaggcagaguaguuuuacauuaugagaacucaaauauagguaagaaaaccaaacuauguggggagcauuucacuuuucauauaacuaguagccaccauauacuacucucaaaaaaaguaaaagggauaaauaaaagaguugccuaggugaugaugguggugguagugguaaagagucauuggcuguuaagauacauccgucgcuugcuaaguacuuuacauguauuuccacauuuaauucguacugcaacccuaugagguacauacuauuguuaucuacauuuacagaugaggagacuagggaacgaaaugguuaaauugccaugguacccuaacaaguaucugauucaggauuccaacucuuggaguuugucugagaaaugcaaguuucagggcuaaacucuuucaucacaauaaucacuaacguauacugaacaccuaagaugugccaaauacucuuuagugcuuuuccguguauuaauaggugugaucuuugcaauacuaguauucucaccccuaucuuacagagaaggaaguuugcaaaggucacauaggcaguucuuaaagagucacacuggggcagucuggcuucuauagucauuuuauaaguggcaugcucuauuccuucccaugaagggaaaacaaguacagaagcugugcuuuaacucuuguccaucccucccacgcuagaccugcuuaugacuuccucauugcuagccugaauuacuucaacagccuccucacuggccuccugccuucagaguugucccacuuaaucuauuuccuccacacagcauuuaagauagacucuaauaagaacccaccugaaaagcaguucuaucuuuaacucugcccugacuaaaacccuucaguuguuugccacugcccacagcaaacuccuuuaaacugcccaauuuaaauuccuuuaaauugcccaacaagccauugugaccuauguagaccuuauucccucuuugaccugaccucccuuacacucccuuucucacuuccccacaggucagccuccaacagcucugaauuguuugaagucccccacuaacauuauuuuuugccugcccagccuuguuuucucaccggucuuccuguguggaaccuauuuccccacgaccaccuuccauuuuaucucacuucuaccaaucguuuaacgagucagcccaagugcugccuccuccaggaagccuccucgacuccucuaaccaguaacuguuacuaacaguugucugauuccauuggucauucaaguagucaugcagcccacuaguaaccacugaugcuuccacgcuaacuuccucagaaaauagcucaugcacuguaucuguaaaucaugcugagucuuuugaagacucuuuguuuccaaagaguuuucagguguaugcuaauaauaaacugaagcugauguuguuguaacuuuuuugggaauacgugacaucuaguaaaaacuaaacagaacuauaaauugccuagcugaugaaaauucuccacauaucccuugaggcugccuuacagaucuuuuauaacuggaucaaacagcugcagcuuucucaaaaaagguauagcacuuacaguuaacuuuuuaacuaacuuuaauagcaagaauagcuaaagaaagcaagcaccuggaaauuuucauauccaaguauauuuguggggaaggaagugaguuaacaagguaucugcaaaguugagcuauugcauguuauauagaaaauggaaauguacaugaggcuuacuggacguugggaacaacuugaaaugucuuucuccauauuggaaguauacauaugcccacuguuguggaacuuuagauaucaccccuaauucauguuccccuucauccaccacacugcugauauaaaccauagccuucaauguaagaaagacauaggcuuucaguuuugagaaaaguggacaauuguugauaugcaugaucucaauuuacgcuaauggcacacauacguuaagaggccaauggcagacuuaaagaauauguaaauuaauuagguuuuaauuauuuuaaaauuagauaagaucuugacacaauguacguuaguuacucgcuccaaguuacuugcuccccugaugugagaagagaaaugccuuuaggcaaaccaagagauaagccgagcccuggggugggagcuuuacguaaauuaucaagaacacuuucuuccugacuuugacaauccaaauucuaccugcuuucagaugccaauucaaacuucaugucaucaggaaauuugagccaacccugauguucccuuuauuuauuuauucauuuauucauucauucauucuuauucuccaaugugaacauaugaugcucccuuuuuagcuuggggcuaaggcuuaaucuucugcuuagccauuagccuccguaaggcaugccaccaaggcaagccaugagaaaggacccagugcucugcuggguguaugugugggacaucuaggagcgccagcaccugcaguucaucgucccaauaaagaaguucugagcugcuucaugaccucguauuucuuaaaagggaaaauaucuuuccugacuggaacccuuaagccaauacaacuaacagagugcaggugguucuugaaaggugagccacaggccacguguuuaaaaagcugguauucauuaugaauugacccuaggucaggcagugaugaagaacuuuuguguauaccuccauugaaucuccaucacaauccccggagcuaaguaugauuacaauuccauuuuacugguaaggcguaaaggagaccuagagagaguuccccacccaaggcccuucagguuccaugugguagagucuguauuugaagccagaaagacuguccuugcucucucuggcuucauucauguuguagacaaaauucuaagaccaccccaagguucccgcacucugguguacauucccuguauaauccccuccccuagaguauggaaaggauucaugaauacuacgggauugucauucccauguugagguuacuaaucaauuuacuuuggucaagcaaaagagaugauccugggagagcccagccuuaucuauggagcccuuucaaaagauggucaagcauuaaagucaugcucuccuaauaaauuaaaaaacucgcucuacaguggagagaaccauguggcaaggaacaucgggugggaacaaagaguagccccuggcuaacggcuggcaagaaagugaaaauauccauucuauaaucucaagauacugaauucugccaacaaccacaggagcuuggaagaaaacacugaacuucucaaaggaauaaaaacuggcuaacaccuugauuuaacccuggugaggcccugggcagacaaccuaacuaaaccaugcucagaauucugacccauacaaacuuugagauaauacauuuuauguuguuuuaggccaccaaauuuauaguaauuugagcuguaguaauuucugcaaaaaauagcaauggaaaaugaauaccauucccuuaacuuuccuuccauccaguucuaacccagcuccugaaccuuggcucagcauucucuuuucaguucagccccuuccacuuggccuugcagacuauuuccuagacuccaaacuuggcuuggaagcucagggcucuguucagccacuaucugguucuuucuccagcuucccugauccucuuuccaggcucuggacccaaacugacacugaccuguuuggccagagcuucccuuuuuuacgggacauuccaagcuugaaacacaugaucgggugcaggacuuucuaaacaauauuaaucaagcuccauaauaaaggcccaucagaaacuuaaagcacugaauuaggucucuaagagccauuaaaaguuuguuuguuuuucaagagggaauuuggcacagagcugcaaaaagaagaaagggguauagauuugauuuugggcuccccaucucccacuucauacgaauuagguccaguugguauauuucacagcaagauuuuuuucaaaacagaggcuauaaugcuaauaaaugaauaaaagucuggcaaccauuguugucauagaaguguaguugcuagcauugucuacugugugauugugcggaaaacaucuaagcuauguaagcuucaguccauucuucucugaaauuaauaggugggacaaaaugaucucuaaagcucccuccagcaauaauauccuaugauugaaagauuucuaaagccuaacguuuugcaauugguagaauuucuuucuuuuauuuuuauuuaugguuuuuuuuuugagacaggucuugcuuugucauauagguuggagugcaguggcaccaucauggcugagugcagccuccaccucccagacucaagcaauccuccuaucacagccuccuuaguagcugggacuacaguugcaugccuccaugccuugcaaauuuguaaaaaaauuuuuguagaaacaaggaggucuuguuauguugcuuacacuggucucaaauuccugggcucaacuuaucuuccagccucagccucccaaagugcugggauuacaggcauaagccuccaugcccugccacaauugguggaaucucuugauuugaaagaagcuugagcuaaugaaugacucgggaagaagguucucaccccagccaagaccaaggagggccauguuuuuccaucuggcuaccugggucccagaagggccauuugucuucuuuuaaaaaccacgaggguacacauggaggguuuuggcugagagaugcagaggguagccuggauccugaccaaaugaugagcugccugacagccugcugaccacuaacugccagauaccuuaggaucagggaaugcaguagagaaaguaaaaccagcuuugaggaagaggaaagaacacaaaauaauaauuguaggucaggagcuuaauuuggaaaaaaugaaaauaaaagcagugcuuucuuguaauuugucuuugucuuuagacuuccuugaagaauuuucuuucaagggugugugaaaagagggccugcauugugggcaggcugagugggcaggugcaucugcagagaggacucugggaagaaaaaggacuuucuguuuccacaaauaagcauaccauaaguauuucucuguugccaggaaucauuugaaauuagguuaaaucccauuauuuugcagagaaguaagcuugaaaauuaaaaucuuccuggaggagaaaagucaaaaacaaagauuuaaaugacuuauggugaaaaaguuccaaauauuaaauuuuauagaaagcagaugugugugaggaggagcacugcugauuuaauguguauauauuuagggauggugcuauuuacucuaggccagguuuuucuauuugcuggcauauagcaggguuaggauucaauccuaggccucucugacuccacagccauguuuuccuuucuacuacuauuccaaaggaccccagaauagaguguguuauaacaaacuuggagaguuuuacagaaaccaaccucugacaaaauuuuccaaucuugaguucagcauuucagugcacugaacaguacugguaccccaugcaacucccuguagauuccuuuccaagcaugguguguucaucacccaccuuccauauacuuaguaccugcaccccuuuaaggauggauggucucuuguaaguuaugcuccagagcaccuuuugggauagaucugaguucagguaaaagcaaaccuuugcuuggcuuuccccgcauauccaauuuugcuucccccacucccuuagggguuccuccugaacgcacauucauaauaaauccuuugcacccaaaucuuucacugagcacuguuucaugaugaacccaagauacaacuucauaagagaauuuuaaagguaugauauggcagcuuccuuguuauuuuaccuuauuuaaugaauuucucuuccauggauucuuuaaggaguuucuaaccccaguucauauuguuuauguucuugagcugguagagaacuaaagcaguucucuaaccaugucuuucaaugugucacacuuaauucuaaagcaaaugucuaagggauuuguuaguaauacaaugucagcuuuucucauuucaguuaucuguucaaaagaauauggcucuaucuuucagaagaaaagaguuacggugauauauuuuugauugugcaggcucaaguuauucucuuucugagauggugaaagcauucugacugcuucacauaaugggucauauacuggccuaagcaaucaaguguauaagggauauaaucauuaagauguaauugauccuuguaucggcauuaugccaaauaaagcagaaauugcaaucuuuggaccuauucaguuuuccauuaaguagaagacuaaagugaaauagagagaugugauauuuaacaagaauuccugucuggcucaagagauucauuacauuugaauucaucuuagaaauaaggaaucaaagugaaccugaccaaguauauagacauucacuccucuuaccuguaaaucaaucaaucaauaagaagaaaaacugcaucuaaccuuguuagaaaaugagccuucuggaggagagauaauaagcuugaagcuuuaaugaaaaauagcuuauuaaaauaaacgaaacaaauaaaaauguauauugcaaaacaaaguuccugaagucuauagggcugccacauugcacaacuugaggcaauuuucugugcaccucuacccaguacacacugaaucuaggacccuuuguacauucugucagcaagagggggagggagagagaaaguggggaaaaggaaguauaaggcacaauugcaaaaagcugucuucaaaaguuugaauguauuccgcugcacacuacucuccaaucucugaacgacagauaauuuuucaauguccucuuucucucuggaucauugagguauuauguaaagaaauucaaauuggguacuggaucauccauuaaugcuuggcaaaugacaggcacucaacugauguuuguugggucgaugaauauauggaugaagaaauggauggacagauagauggguaggcggauggguggauggaugaaugaaugaauggauggauaauagauggauggguaaaugaaugaaugaauaaauggaugguggaucauggcagggagcuguuaaaagaaguagcaggaggaagaguuuugagaacaaaacaaaaagaguaaacuuuuauucugcauuuuugcggaucccauucucacauagcuucugucuuuuugaucucugcacgcuuucuuuuuuauauauuaaaaaguaucuacuuauuuauucuucugggcugcauaauauggcuaaaugcuaugauuuguaagcacacgcuucuauuuuggaaaagguuuaaucauauuccauucuucuacuacauaaacauuuuuugcauuuggauuuuuuguauaauaaguauuuaagacuuacauggcaaggauuugugugcuuuuaacaaucuaaagcugaauuccuuuuauguuuuaaccuuuuuuuuuuuuuuuguagaacguuucaaacauacacaaaaguaaaaagaaaagcauagugaauccccauguagccaucuugcaguuucaauaucaacauuuugcuaaucuuauuuuuuauucuuuugagauggagucucacguugucacccaggcuggaguguaguggcaugaucucggcucacugcagccucugccucgcagguucaagcaauucuccugccucagucuccccaguagcugggauuacauguacucaccaccacgccugccugauuuuuguauuuuuaacagacaggguuuugcuguguuggccaggcuggucucgaacuccugaccucagaugauccuuccaccucagccucccaaagugcugggauuacaggcaugaaccaccauaccuggccaugcuaauuuuguuuuaauuagcuauagcuccuuuaaaaaaaaaaaauucaggccaaugacacuauaaagcaaccacacaaacaagucugcacucuuucuaaucaaacaugcuuucaagagaggaacugauaaacucauucccaugaaaauaugaacauuuuuaaaaacuugaauaauguacaaacaaagcagaaucuugagcauacauccacuaaguucacugcagcauagauacagcacaucaccagggggcaccauucacauagaauaacaugagagcuguacgccuucagaauuauaaaauaugguggcuugguuuauauaacaguuugagaaauaccagguaacuccuuucucggcuuacuuccauuuuuauaggggccagaggaaucauuacauaaauauggaauauuggccaucaauaaagggacagaguagggaaauauuauggagacagcccuuccuaacgcucuugaaaaauugccccacauagacuugucucaaucuacgaacagggcaauugagaaaucacguuacuuacugcuugauagacaccuuuauuuuaagugcaucuggguuaugugugagugcaaacugacugccuugaaugauugggaggauauuauuuuaugcugugaauuuaucuaccucacagagcuguaaauauagcuccauaagucagaagccaauuaauaaaaacccgacuauuuagcaagaaaaggguuacauauucaaauccagcacccccaaauauaucagggauguugugaaaaacaugaauucaaacauauuaagaaaucgguaaaaauguuuuccaauuuaagagagagauggggcauggaaugcugaaaugcuggcaggaaugccaggguggccuuugugaugcccguuuaucugagcaagauacacuuggguggaaaaacaauaugaaauuuuuacuggaugaucuuuucuucuuccccuaagcauauaaaaggcaucuucauguauucacucuaaauaagcaauaugcugaaagggcccuuuagaauguacauuugggagaaaggugggggcagcauggaaauaaaggaacauucaagaucaagguauucuuugguagggaaauacauaggagauugcaauuggccuuaagaaaaucauuauaaggacacauaaaagaagugugaaacaauaggcuuucagucagucacaggugauuacacaaaguaauugcuccacgaaaucaguaauagcucagcuaggcucaucuagaaagucauguaggccauggccauguccagcuauaaaggggcucccacugguuuugugaaagucugugauaaugggaggcggagaagucuuuugugaguuacuugaacaaaaacaacuuggggugugguugugcacagagugguuuuuuugguuguuguuuguuuguuguuuauuaacuaagagacuugauacccugcuccuggaaauuggaauuguauucauuuuuuauuguugcauaacaaauaaauagaaauauagggacuuauagcaacccacguuuauuaucucacaguuuccaugguuaggaguucagcauagaguaggugggcuuugggaacaggguuucaugaggcugaaauuaaggugucagccauggucugaucucaucugaggccccuuccaagcucacugguuguuggcagaauucaguuccuugcaguuauaggacgaagcuucccacuuucuugcuggcaguccaucaagucccaugcucaguauuuagaggcuucccacuguuccuuccccugugaccuucuccacacauaccaguuggcuccuuuaaggccaggaggagaguuucucucugucaguuaagauggaguuuaauauaauguaacauaaacaagucagugacuaucccaucauauucaugaguccugccaacaccaauggaaggcauuaugcaggguguguagaacaggggacagaaaucuugggggcuaucugagaagucggcuuaccaucagcaguacaguauguagaagacuacucaucuucugcaauagggaauucuacgugauauucccaugagcauagucaaagaguuuaguguuuaguguaggucuuaagaaaggaggaauauagacuucuucaagccuauucucuuugagaauucuggagcuaggaaggaacuagcuucuugccuuucuaacccaggcauggguacauuucuuucccuugcacuagccacucagaacuguggccucugguauuucagaaaaucagacucaaaagggaauuuucauacuguccucaacacccuugugccucacacaauggcacugugguuuggcauuccugcugugagcucauaugauaguaaaauaaaaagaguuugaaaaacuaaguuuaagauauacugaaaauuaaugaaucaaacucaagcacaugcucagauaucuuuucuucagcaaaacuuuucgggcucuacuucaaaggaaaaauaaaugcaaaugcuccuccuucauccucaacacaaccaucuccccacccucaaauucuuucaggcgcuucguucaugcuucuccugagucacauauugcuuuaaaaggcaucguguugaugaugaauuggugagucauaaacaugggggauuaauaguccuuuaaauuuaguagcaguucaaaaauaaaaguggaaagcacuaauuuuucaagucuuaaaauguccaggauauaaagagaauuuuaaaagcagucaucuuucuccuuaugaaugcaacgauuauaaauucaauuguuugagcaaauauaacaauuacaaacucccuagcagcaaugcaagucaugaagcacuaauauaauaagaaucaucaugcaagaagaauaaaauuacaguaguuacuaaguaucgggugcuuacccuguaccacaugaucacagccauuguuuuucaucuuuacccugaccagaaaaaugguuuuauccagaaaacaaauaaacaaaaaaaaaacuguccuaagucauacuaagucauauagcuagcuagcuaguggcagagcuuggauuuaaacucagauuuaauuccaagucacguuccucucauuaugugguaaugcagucacuugguuuauaauuuacagguucuaagauaaaaaaaaaaaaaaaaaaagacagugaagaagacuaauacuuaauuagugccuuguauuugccaggcauuauauguguauaacacauuacacccggcucuucacauuuagaacaaugcacagagccagcccauagaagagaaauuugucuauaucccuacauuaguuuccuggggcugucguaacaaaguaccacgcacuagguggcuuaaaacaacagaaauguauugucuuacaguucuagagggaagaaguccacaaucaagcuaucaucagaacuauguucucuccgaaaccuauaggagaguccuuucuugccucuucugugccucuggugguuugcccagcaauguuugguauuccuugacuugcagcugugucacucuaaucucuauuuucauuaucacacagccuucucccuaugugucucugucuucaaauggccaccuuuuuuuuuuuuuuuuuuuuuuuuuuuugagacagagucuugcucugccgcccaggcuggagugcaguggcauaaucucggcucacugaaaccuccgucucccgggcucaagcuauuccccugccucagccucccaaguagccgggauuacaggcaucugccaccaugcccggcuaauuuuuguauuuuuuaguagagaugggguuucagcauguuggccaggcuggucucgaacuccugaccucagguaaucugcccaccucagccucccaaagugcugugauuauaggcgugagccaaccgugccuggccagaauggccaucuuuuuauaaggacaccagccauacugcuuuaagggcccaaccuacuccaguaugaccucaucuuaauuacaucuccaaugacccuauuuccaaaugaggucauaguaugagguacuggggguuaauacuucaauauuucucucuuucuuccuuuucuuuuuuuggugguugggggagguaaagauucaaccuaaaauagcccacauaaucuuaucuucuacaguuguuucuuuuuccaagucgaaagcgcuuuaagagacagaagagaguuuaguuggugaaugucagacaaauaaggagagaacuagaauccaaagggcagguagauucucaaggcacagugagaaacacaggaaacccucauaagcuggggaaggacaguuguuuguauuaauaggaacuugaauuuguaaaaggacccagcuguagugauacagguucaggagcuggcucccugaguggugagguaauaucuuagaauuuugagguuauuaacuaucuuuaaagucauccuggcaaaccaacuauccuaugaguaaacuuuuucuacaguauccccaacaggucaucauuuggcuacuucugggucauuccuggugccaaacaucacguagaaccaggagccaccacaguucaugcugcagauugagaacaauauuucuuugauaauauuuuuggucaaaaagagacacucuaggggaaauuugggaauucaauggaaaauuacgccauaucugauucugacuccuugggaacuauuuugcaaaucugaauuuguuuauucuuugcauuugccuuggaacugguuguaauaccucaccaguuuccucauuaaugaguuaaguaagauuuuuaacacauacuuacuuuuauucuaugagucauaaauuugccuuuuauuagaaauuaucuuuuaacaccacagagacauaagacauacuuaauaugagcuaaacugucccuucgucuagcuuuucuguaagcaguucuaacuaaaucaugcagaauaauucuaaucucuuuuccacaucaugacccaauaaauauuugaaaauagcacuccuaacuccucuucugcccccuaagucuucuccacacaagaauccucuguucuauuuuuuuugaauuaagagaaaaaaaaaucuauguauagucccccccaccaugcaucuaauacuagguuauuauaaaaagucauuaaaaacaucaccugucaucagggacagccacuguuacucuuuucaugaauguauuuggaaucuguuucccauucauauuugucuguucuuuaguccacagccaucacagcuuuccugggguggacugugugcuuccuguccagugacuuugccuuuucuuuucaguuaguaucauugcaggcacuuucaguucaacucucuguaaaaauuauuguuuauuacuguccuaguuuuccaaaauacacuccuuauguuuaagacucucccagacauuuuucucucaauaauuucccacuuuccaaugccuccuuuauuacggaguuugauuaauuuaauacaacccuccuguucuaguccuaucagggcaaaauagaauaggucuaagacucccuacuguguuucuccucccagaaguaacacuccuuucucacgcagaccacuuauccacuuauccaaccuucauucagcugcuacguacguaccauuccacuguuuacaaaggugaaaauuauaguguagaaaccacuucuuugaacacucucucagaucauauaacuuuuuaaauagccauguuauacuuugacucauuugacuuuuucaguguuucaaaaccacccaaauguccuuuacaaguucaucagccuauucuuucagcagcuacucugugauuacagcaugccauguucuguguuggaaaccaagaacacaaauguguauaaaauuauuuagcuaguggagaggacagauaugcaaacagacaguaaauuagauguccuuucuaaggaaaaauuaggcuacaaacagaccuccuuaguccaagugauucccauaagauaauaauuaggaacccaaauggauucacuaaggacucaaaaaaguccacuuauuaauccuuuguagaauucugcuagugaguguccaucuuccaagcccauuggcugggaaguccaucuucccauuuuauaaauucaggaaguguuauugagucuuccaggacuacacaugccuuccacaauuauucaaagaucaccaacuucuauucuccauguucucuggguacccuggguuguauuuagagaggguucccagagaaaccagagacgcugaucaccguggcaacauuugcacuuagaaaaugaaacauguguauugaugaaaauaaauuacaaagccucucuggaggccacagacaauucuuucuccuucuuaccaagcugaaaugggcccggucacugggccacacagauucacacuaauuuagccccacauaaaauuagcaugcauucuguaccgugcucugugucuuauuaaaaucccuaucaccacugccugcauauuuauguuuuuccucccagaaguaacacuccuuucucaugaagaccacuuauccacuuauccaaccuucuuucagcugcuauguaccauuccacuguuuacagaggugaaaauuauggucucugccuccaagaagccaauaaccuacugagagagaaagacaaggaaacuaucaaaugaaauucggggucccacauuuuagaacugaaguccgccaagggaauuaugggagugguaugaaggauaacucaaacagaagauuaaaaaaagaacuaguaagaaaagaaaaccaacuuccacucugauucugaaaggaaaaaccagcacaaggcugguagggcaaagcauuccagccagaggaaacagcaugugcccagucacagaagggcaagaguauggcgccauaaggacugcaggccacugaauauuagaggaaucuacaagauagggaagcugugggcaacuaagggaggacaaagaaaagacagaagcuaggccaucaaaggcucuguaugucaaguugagaaguuuuauuuuuccuugauguaaaugaggagucaaaaaggguuuuagagagaauuguguuucagaaagccauuucgaguaacaguauggauauuagacugaaguagcaugaauguguauaagggauagugacaaauuucaaaauacuauggacugucccaucuguaugaguccauucucaugcugcuauuaagaaaugccagaaacuggguaauuuauacagaaaagagguugaauuggcugauggcucugcagguuguacaggaagcauggcuggggaguccucaggaaacuuauagucaugacggaaggcaaagggaagcaagcaugucuuacaugucaggagcaggaggaagagagaaagugggaaggugcuacacacuuuuaaacaaccagaucucgugagaauacacucaauaucacaagaacagcaagggugaaauccacccccaugauccaaucaccuccuaccaggcccugccucuaacacugaggauuauaauucaacaugagauuuggguggggacacaaauccacaccauaucaccaucuaauuccauucccagacaaaaaauagugugaggaccugagguucaauaucauggcugucuguuugcccaccucucuccucacuucccauggacgguggauacccccaccagguggcucuggaauaaucuagaauugauacuggaguauacggguuggcucugaacacaggcaacaaaaccagauccugcagugucaggaaaaaagagcaagaccaacucacagucggaagugagaucaaacuucugaguccucuaagaugacaaugugucaugugaacagagacauuuuugagggugaaaggggagcuuugaguaauuaugcaaguacaacagguauaaaccagaacucucccaggcaaauugaauggcuucuuaaccacagcaucucauaguugcucaauaaaaugcccuggaaagcuaauugccucuuauuucucuccuuugucuuccuccaaccagauauuuuaauuuucccuuguuacauccuccaacaguuuucugauauaucccuucugaauuauauuagcaaaagucauuggauuguaacuaaagaaccauaaauccuaccuucauuuuucagaugacaaaauucaacucaauaacuagucuaacuacacauggaacaguaaaaauuaaaaccguugucuaucugucuucaaagacggugaucaugccguucucccaccuugggcuggaguuaggucugcaaguagcagccauggaucaagggaauaggggccauucacgucacuauacaagacaacugggaugcucacguguaauuccuccuuuaccauuuaaagucugcucugaagccaucaaacugggacugauaaacaaucaguuugccucgcugcuguguuucuuaaccuaagguaugcccagaccucaggguuaugcuggcaguauggcaggucacagaggaacugcauauuuguucaaugacuuaaaacaguuuguguacccugaaauaaacauaccuaucuagugguauagaaugcagaacugacauaauauuuuaagauaaagcacuagacuucagaaacaauuuaucaaauuaguaacuugaggccaugccccuagauucccagaauauacauucuuucuccucuaucuuuaauggcaguucauacgaaaagauggcaucugcauuuuaacauaaaaccaaauaaauauauuucuaguauuggaauuuggggagagggcauaacacaaagauguagugcucacuucucugacaaaucagguuagcagcaagaaaaaaauugucagcgaccaauuauuuugugggagaaaacauucuguccuuuaaaaaaaucaugacuuuuuuucuuagauauuauuuagaaaauguacuauagguaaaucuuuacaccacuguccaaagcagcacaaaucagugguuacugugaauuaucuaaaacugagcucagcaaacugcagcccgcuguuuaaaucuggcccaaggccuguuuuuguauaaucccacagacaaagaguaguuuuauguuuuugaauaguuaaaaaaaaucuaaagaguaguauuuugugacacaugaaaauuauaugaaaucugaauuucaauguccucaaauaaaguuauuuuagcacagcuacaaucauucauucgcacuuugucuguuucuccuuuugaacuaaaaugacagaguugagaaccuguguuagagaccagaaacuguaugggccacaaauccuaaaauauuuacuaucuggugcuuuaccgggggggggguggggggggaaggaaaaaaaaaugccaacucugaaucuaaauuuuuagauuagaaauuuaauuacuuucaaauaauuuacacaauuuauccacggucuaaugugaugaaaauauaagaaugauuuguaauugacauucuaauuuacaucucuagauaugguuacuguucaagagucugagagcagcugguucacucaaauaaggagaaagcauuucauguauugauauucauauaacuguuuugcuuaguaauuuuugacagguauuguaaagguuaacuuuaacucaggucugauucauaucccuuuuccauccccucggaccuguuuccugucacuuggaaugaguuaugauucacuucucggaagauuucaggacccgugugaccucaccaugagucuccucuuauauuuuauauccuauuucacugccagagcaaggcucuagguugaauucucacacugucuuuccacaaucagcaugucugaacauuaaaauaaaauucauuuccaugagaauacaucuugaacugaugcuacuaggaaguaaguuuacaaccaagaagaagaacuguggugucugccacagagauaguuuuauuuccuccuagauagaacccaguucuauuaaaauauucaaaacacauucaaaaaccaaccuaccaacauucacuuuucagaaacaagaagugaaguauuaauuucaauaucagaacacccuuauauaacauggacucuuaacaaucaccaugccauuauuuugauuuccagcaaccugaggcuaauauguucaggaugaucuacugaaaaagaaagaaccuagaauacauuaucagcagugcauuuauaagguagcuuguguuuuuauuuuuuucucagucucaguauaccagaucuuagaauuuaaugaugguuuaucuuuuuuugauugccaaucauuaaaaugaacugauuuuuacuuucuuuucaaagacuuucaucaaaugcugcuuauaaacccccuggauuauaucccuuuuccuuaagaaagcaguaauuuuaagccucauugugaacaugauuuaaaagauuucuacgggaaauguaugaaaaagaccugcagaaauguccaucucagagacuuauaacuugcugaaugcugucaccucauucaaaugggaaaucugaccagcauaaaaucaccagguacauguuacaaagguacaugcaaagacagaaguaaaugcaguucucugggguccaggacuccaaaccuuauaaccaacucugcauaaaugcccuucaaagaaauccaaaaccaaaacaugcauccaacaaagaaaacuaauaauguaccaugcugugugugugugugggcacacguguguauauguguaugugcaugcacguguguaugagagagugauggugaauuggauuccucauuccuacuuuuauuccacuaagaaaugugaauuuaaugguugauuuauucugaauuccuuguauccaucuuuggcaggcauuuguacaaauacaaccugggacuuaguucuaugacuauaaagugggauuuauuuaguuaucuggggucaguggacauguaacaugcuuuuauaaacugauauugagcaaggaagaaacuguauuagaauggaaacugaauaacaacaagcugaacucagagguggcuaucucaggcuccuguucauuuuguuuguccaaguaggaaauagcauugauuuuaacucuuugccuagccugaacuucacaauggauguuagacacagaguuacagcuuauggagagaagguuuuuuuucucuuaggguuuuaauguauuuuauaaaauugauggcaucuguccuauaaugauccccaaaagaccguaguaaaguugagggacuuagggaauuuucccuacccaaauagaagugcuagugaacagacauauacccuauuaaccaggccaggugggaaaaaaaacaaaaauaaauauaaccaaacaaaaaaauauaaucaguuuugguaaauuuaugaauuuaugaaaugaguaggcuucaagaacagaaucucaauuuauaauccugcgcuguauccauaggagguaaaaccaucuucuguuggcucauuuuuuuaaccauuauccaaaaacuaauucacucaucaaaagaggaucacugcuauuuuuauucggaaacucgaaaauugcaaauaagguauaggauuccaaauacuugcuuuagccauugaaacugggauauucaaauaauuuccuuagcuuuaaaacaauacaagucaucagaaauaaaaagaucuacaaauuuaaucauucacaaaguaagaacuucuauacaaugaaaauuagcacaacuaaaauuggaggaggucaauggucacagaaaaaauauaucaaaaguaacacauuugugucuguuauacagggaaccacucuaggguagaugaaagagccuuaguuuggcgucuaagagacacaggucauagugaagauuaaaucauacaaugcauggagauaaguuucuuuuaggauucauaugaaaaacaucaauagucaaaagagguuuacauaaauuauacuauugauaugguuuggcgguguccccacugaaaucucaccuugaacuguaguucccauaauccccaugugucaugggaaagacccagugggagguaauugaaucaugggggcaguuaucuccaugccauucucgugauaguaaaugaguucucaugaggacugaugguuuuauaaggggcuuuuccccuuuugcuuggcacuucuucuugccaccaugugaagaaggacauuucugcuucccuuucugccaugauuauaaguuuucugaggccuccccagcccugcagaacugugagucaauuaaaccucuuugcuuuauaacuacccagucuucagcaguucuuuauagcagcaugagaauggacuacuacaacuauacagacuuaauugauuaaaauugugcacuuuuuuuuuuuuuuuuuuugagacagaguauugcucugucgcccaggcuggagugcaguggugugaccucagcucacugcaaccucugccuccuggguucaagcgauucuccugacucagccuccugaguagcugggauuacaggugugcaccaccacgcccggcuaauuuuuguauuuuuaguagagacgggguuugguaaaggucacgcuggucuggaacuccugaccuccugauccacccgccucgaccucccaaagugcugggauuacaggcaugagccaccacgcucggcccaaguuuugcacuuuuuaaaagcaauaugucagagcuacaugugcagauaugaaaagauauccaaaaugccuuguuacauaaaacuaaacaagcacuacacacaaugugggauccgggaucugaaaaaggacauuaguagaugagcugauggaauacaaauaaaguaugaaauuuauugaauaguaguaauguacaacuguuaacuucucagcauugguguaaggucauauauaaaauguuaacauuagaggaaguuggacaaaggguaaauaggaucucucugcauuauuuuaccagucuaaaaucauuucaaaauaaaaaagcucaugaaaaaacugauuccaaaauaguacagacaaaauguacccaaaaauuaauagaauguaaguauauacauaagaaaauuuucuggaaauguaagaacuaaauucuucagggugguuacaucaguauuggagaugaaaucgcagugagccuucucucauuuuauuuauuuuuuucucauuauugaauuuuuaauaaugaacauguacuacuuauauaaucagaauuauauaguauuacaaauguguuuccaugguuauuaugguuucuauuuacuggagaauacuauaucucaaagaagucacaggguuugugaauagugaaacaaaacaagauuugaacacaagcccuaauugcagagccugaacuauuagucacuaugugauauugccuuuggaaccugagcuuucugggacaaggaugguauuuuauuuauggccauauuccccacacuaucuagugcagcacuuagcauguccuaagcaauugauaugugucuaucaacugcaauugaauuccaguaugaacauucuguuucuaacacaaauguaauagacuuuccauuuauaagagcauaacuauguacagcugauuucuaauaugcuucuugauugcacuuaggaacaaaugcaucuuuacagagucugaggguguaauuaggagcuggaaaaagaauggaaccaaauucaacaugaauaaugucacacaaaugcaaaaaaaaaauauggugaaaucaaaagcuagacuccuaaagcuuaacuugcuuugcaaaauaccaucaugaagcucaagauaaaacaccauuaaaacaauacucaaaaccacugcuguaaguaauagagagugauugaauguaccuuggcugauguauguuuaaauugcuucauccaaaucugugaaacuagaaagugcccuggcuggacuuuuuugugauucuguuguuguuauuguuguuuguuuuguuuuccaauuauuguuuucaguucacugguuaaggaaucaaaauguuucaauuuuuuaauaaaaaauauuuauuaaaacuaaagguuaaaaccuugcuuccauucuuguucuacugaaacacauauggauuuugucacaauauaauggcauuugaaaucugaaaaaauguuauuccuuaaauggacugucugaccuuuucauucauuauuccauucacaaguuguuuaacagguugucaggcuggauguccucauuccaggcuccagggugaauacaacuugaccacuaaauaaaaucccaaauuguuaggaaugcaaaugaacagagagguucggagaaacccuguauggaguuaucagaaaaguaauucuuggaauagucaauguaagaguaaagguauuuuuuuuccuuccuggcacagggaugcugauuauauuuggcucaaaaggaugaaugaugucacuuaacuuccaaaaacaaauauucugaucaaaguuuccuagaauauuucacagaaguuaguuugacaguggaugaaaauaagaguagaauuuauauacacauucuuugccugauuuaaaggacuugggaaaacacccacaaacaacacacacguacacuuacaaacuauucugcaaaacaaaugaguaaagcauuuuuaagauucauucauagacccauuauuauuauuauuguuauuauuauuauuuaagacggagucucgcucugucacacaggcuggaaugcaguggcacagucucggcucacugcaagcuccaccucccagguucacgccauucuccugccucagccucccgaguagcugggacuacaggugcccaccaccuugcccggcuaauuuuuuguauuuucaguagagacaagguuucaccgugguagccaggauggucucgaucuccggaccuagugauccgcccgccuuggccucccaaagugcugggauuacaggugugagucacugcgcccagccagacccauuauuuuguuuaacaaaaacuuucugccuuugaauuauaaguauguacauuaucacagaaugaguuccauguuuauuauuugguaucaaaacaaugauagcuguccuacagcaauuucucagguuugcauuccuuucuuggaaacugcuccccuucucccucccauucaugugcuauagacuaggacaaaggcuauuuccuguuccauaugcaucagagguuuguuuacauauuucaaucauauuccuuuuucgccgaacagccaaugagccaaguauuauuacuauuauuaauuuuaagacacuagacacuguuuucagucccauucugcccauauucacuuauucaacagcucucuaaugcacacacacuauguaucggguacaugcccacauauaccucuuuaacugcucuuuguggaacaucugcuacaugucuggauuaucauagguacguguuauaaaucaguaucacaaaucuugcuuuaaauguauugaccacaagcgcauucagaauuccacacauaagugagcauacuuuaaauuaaaaaaauuaaaaaaccaauguuugguuuucuauauauuucuuggugguucccaauacuuuggugguacuuuauuucuaacucauaauggacuaaugucauuagugaacauucuucaaugacucuuuuuauacagcauaacugacagcccaaagaacaucaucucauaauaauuuguauucuuuuuccuucaagcagcuacuucacauuuacccaugaugaaguucauuuauugccuuacaaauccuugcaagguuuucucuucauuaguuuuugucugcuuggcaccaagcuacacuguacagcccugcacaggucuuuaaaagacugaagucucacuauucauucuucagcacagaguacuuuuucagauguuaaauaaaacauccaugacucaauuuaucaaaucacagaauuuccuauuuaucccaauacuuuguuuucugaacugaaaccaacucaccacucauuuaaaauaaguuuuugguaaagaguugugucuuccaccauucuccuuaguucauauauggacuuauuuguaaauucaaaauauucuguagauaagauucuccauuucaaagucucuguuuacuugcaccccucuuccaagacaggaacucugacuuuacauuucaaugcccaacacagugccugguacauaguaggauugaaugaguugaauuaaauacauugaaucauguaauuaaaaucucacauucagugcagaccugaucaucuuugaugcacaauaaauaaucuacuuuuauuaaauauauacauauguaaauauauauauauauauauaaaacaacaacaugacucuagauggacaaaaagagacugcaaaucaucugauuaaaagauauaaaaugcugaaggauaagaauagaaacauguacacuuuuucugguguacuagaugggaaugaaagaaagaagggagagggaaacagacuugaaaacugauauaucauuuuaggauggcuguaggaaaugaacaaaagguacaaaauguucacuacuucuagagcucagcuaugcuacucucucagagacacuaauacuauuguacagccauauaucaguuugcaaaagcaugccugguccucagccucagugagccaaaaugagauagcuuucaggaacaaggagugaaagaggaagaaagauaagaucuacuaaaaaguguucacaaaaucaaguucuuccaggagcagagccagggcaagacagguaguguaaaugaaggaagugggccugaauuucuggaaggcaccagggaauggugaguauuguggagaacaagaaagcaaguucuuguucugaagcgggcacaacuauuguugcuguggaggaagacagauggguguuaccagaucuuugcauguuuuucagauaucagauugcauauuuguauguaaaaaaucuccugauuuuuaaauguuggcaacuaguagaaaauaugaacaucauggagauugacacuguggaaucaaaaaauaauacaccuucuagcuuaauuuggccaguagcucccuguuacauuagcaaccauuucucuagaugaagggucagcaagcuauggcccuuggauuaaagcuagccugcugccucuuuuuguaaauacaguuuucuuggaacacagccauucucauucauuuaccuauugucuauaguugcuuucacauuacaauggcaaaguugagcaguugugacagacuguccgucucauaacgccuaaaaugaucacaauaggcccuuuccagaaagcuagcugaccccugcucuaaauauuccuuuuucagccaccaccuaccaguaccaggaacuguacuccuguaauuaccacgcaugucaagagacccuuuaaaaguuagaguuuccuuauuggagggauuacaugaagcucacacucagccacuuagguuucaagguguucccagaugaaaauucuggcccagauucaugucugacagacuuuugggaggaggaggaggaggauuggaucaccagauuaaucaaagucuguugccuuuauuucuaaagacuauuacaugacugaaguaauuaaauuaaauuaaauuaaauuaaauuaaauuaagaccuugggaaauacaauucuaagucuuaacauuuugcauauguuguuaaauguccaugauucauagcaaaugagaucuauuuacuggaaguaaucuccccgauauggccaucuaaacuugguucuccaucagauauauucuugggaaauuacaauuguuuuuuccaacaaguagacacuuguuuaccuucuagguuuguggaaggcaugaaguccuuuauaguaucauuuuuuuucuuauuuaauauuuacugucauauauguuugcaugauuaaaaggaggcauuaaaccuugguucuuaauuauaauccgugauccauagaggcugcaaagcaaaagcucaacaaguuuguaguccuuaauaauagacgacugcuuuguuucuaucugaaagaugauguucccuguacuaagaagcagaauaagacgaaaaacucugagguccuuugacuggugaggguccaauaagaaggucagguuuaacauccuucuaguguuagaccaaucuguuuaccaagcgauuguaccacuuguuaagaagcauaauuuccucugauuagguacuucuguuaaaacaaacauuauucauacuaauaauaccugucauguauuaagccuuuaccgugcaccaaacacuuuuaaguuccugacugaauuaucuaauuaguucccuuaacaacaacccuaugaagcagguacuauuauuaucaccauuuuacaaacgaggaacuugggaaugggguguuaagucaauguauacaauaccccaaagaaaugagaacagacauauuuguaccacgacuccucugccauuagacacuuaaacaugauuugaguauaaggaagcacaaaauaauagagauuacuuucacagcuaaacuucucucuugcacuaauuuagccaccagaguuacugucauucuugcagguuucuggcauauaauuuggcauuuuaccucaaccaagguauauuaguaaugaaaaggaauguccagguaaccaaauguggcucaguuuucaacuaauuaguagcuuggauggacauugcauuuugcaaaacucagaaguggcucaaaagaugcuuagguuuagagcuagaaaauacauuucacucaccuguucacccaccugaacguaaaugaauuccuuggugugggauuccuaggagucauuuauuuaucgcaacuaucuuauuaaagugcuuuccuacacauuuauuucucuagguauaaaagccaugucagggaaaaauagaggguccuuuuagacacauuuggcaaaugagaaaacuagcauauagaggugauaagugaauggcuugcugucaugugauaauuagcguaaaagcuugcaaagggaagcucagacuucuaccuccaaucaacagagcauccuaauuuuagguaggaaagguucugaauuauuaaagacaucucacauaagcccuggauugaaaauucaagaugccaauuuaagauuacaaaauuuuacaucaauagguucaggucgcacaauaggccuaguuuucucacaagcaacgauacuuacaucucauagacuggggcaagucugcaaacuuaccaguccuacuccaugaugagauaaacauaggaauuggguguaaagauuuggaaacucuuacaggaauauuagacacuaauuucaugucuguuaaaucuaauuuuuaaaauuggggcuuuuauuuuauaggucugaaaaaaauaccauucaucuagauuuuauaauaaauuuuaaaauuaucuuuuuuuacauuuuaaaaauaaaacacugugccuucucaccucugguagaugaaaagcauugaguuagagcucuuuguccaauuccauguaggaaaaugcauaaaauuuuucauuuugucaacuuuuaaaacuuuaauuugugggaaaaauaaauuauaaauuauauuaacaugcaaauaauggguaagguuuacauuuuauuuuuuauugggcauaugaucaauuaaauuagaaaacugcuggucuagaaaauuauguaaggaaaaguagugaaaauguuacaucuauuucuaaaaccauauagaaguaaaaggaaggguuaguaaaauaagucuagauaucuuccuuaagugcuacuuacauacauucauaauguuguauauggaaccaagcuuucuccaaaguugacaaaagaaugaaauuauucaagcuuugcaucugaaaguggccacuuaaauuauuuaaaugaccuuuccaauguggacuccaauuuccuaucacaauaucugugauuaaaauguuuucaauaaaucaguuuuguauaauaauuagaggacaucccuuucuagugacuaaguuacauuuuaguuaucuacagaugagaauuuaccuuuuuuuagggcaguacauuucagcuuuguagauaucuuuuagaaagcuuuccuccauaucugccuauuuauaguuuccaccuguugauccaagagcccuacaaaaauaagcagagcuaaguguaacccaucuuauauauaaaagcccucuaaaaacuugaaagcagccauuaggucuuuccuuugucuucacuucaucaugcuauacaucccauuccuuuaacuguuccccauaggguuugucaaccuuggaauuauugacauuuuaggucagaugauucucuguugcuggaggcuguccugcgcacuauaggauauuuagcagcacccuagucuuuacccacuagacaccaguagcaucucuuccuuuucaucaccauguccggcagccaaaaaugucucagaacguugccaaaugucccuagacauugccagcugucccccaaggagcuaaaaucucugaucgagaacaacuguuccaagauacucuaagaguugguuauaauaaaauggauccuaauaaugaucagaggaaaaaaacuguuaauaaauaaaaauuuaaaaauacuuauauguguuuuuacuuaggaauauauguaaccaagaaggugagagaucucuacaaugagaaccacaaaauauugaugaaagaaauuauagaugacacaaaaaaauuaaaaaaaaaacccaugcucauggauuggaagaaucaauacuguuauaauggccauacugcccaaagcaaucuacagauucaauguaauuccucucaccaaugccaguuuucacagaauuagaacaaaaauccuaaaauuaauaugguacuaagaaaaaacccaaauagccaaagaaaugcuaagcaaaaagaacaaaucuggaagcaucacaguaucaccuaauuacgucaaauuauuacaaggcuauaguaaccaaaacagcuugauacuaguauaaaggagacacauagaccaaugaaacagaauaaagaacccagaaauagagccaaauaccuacaaucaguugauccuuaacaaagcauacaagaacauacccuggagaaagaacacucuauucaacaaauagugcugggaaaauaacuggauagccacauggaaaagaaucugucaccguuuacaaaaauuaacucaagauguguuaaagacuuaaguuuaagaccugaaacuguaaaaauucuaggagaaaaccuaugaaaaacucuucuggucauuggccuaggcaaagaauuuaugacuaagaccccaaaagaaaauguaacaaaaacgaaaagaaauaaaugggacuuaaacuaaaaagcuuccgcacagcaaaagaaauaaucaacagauaaaaagaccaccuauagaaugggagaaaauauuugcaaauuaugccgccaccaaaggacuaguauccagaaucuacaaggacagaucagcgagaaaauaaaccaauaacaaauaaucccauuuaaaaugugggcaaaugacauacacagacauuuuucaaagaagauauacaaaugggcaauaaacauauaaaaaaugcucaaugucacuaaucaucuggaaaaugcuaauuaaaacuauagugagacaccaccuuaccccagccagaauggucauuauuaaaaagucaaaaaaccacaggucuuggggcagaugcagucaaagggaaugcuuauacacuguugaugagaaaguaaauuaguacgaccucuaaggaaaauaguauggagauuucucaaagaccuaaaaguagaucuacuauucaauccagcaaucccacuacuggauaucuacccaaagggggguaaaaaguccuuauaucaaaaaauaccugcauguguauguuuaucacagcacaauucacaauugcaaagauauggaauuaaccuaagugcccaugaacugaugagugaauaaagaaaaugugagauacacacacacacacacacacacacacacacacacauucacaccauggaauacuacucagccauaagaaagaauaaaauaaugucuuuugcagaaacuuggguggaccuggagggcauuauccuagauaaagugaugcagaagcagaaaaucaaauaccacauguucucauuuauaaaugggagcugagcuauggggaugcaaaggcauauagaguaguauaacgaauggagacucagaaugggaaaggaugggugggaggugagggaugaaaaauuaccuaguggguacaauguacacuauucuggagauagguacacuaaaagcccagauuuugccgcuacauaauucauccuuauaaugaaaaaugacuuguacccauaaaucuauugauuuuuuuaaagaaaauauuucccaaauuaaaauuuauuucuauuuaccaggaacagacuagaaagcaaucaguuaguauugacuguuauuacaaccacuuaagauaaucagaaucaaaaacaaguguucauuuuucaaagccuguuuuucuccuacguaguaugcuucuguguauguaugugugcguguguauguguaccacauagguacaaauguauucuauuccuuaucagugccaccacaucugcacauuccuguucugaaaucuccauacugagacugauuaucuauaaacucuaggccagucauuuuacaaauccaacccaauauacucuaaauaguaauuauucuaccaaaacaaagaacuucuguuaugcaugagaaaugcaugauuuuugcuuuuuugccugguaguaaaaggccucuuuacucuaaaauuaacagauaaucaucucucuccuaugaauccugauaacauggccacugcuaucaagcaauuuucuucuucaacaggcacaagucauaaguccacccucugaaacuaagcaggugaacaacauguaauuagcuguauuucauccuuggagggcauucuauuuuucauuccaugaugcccccuucauucccaaagagacugcuccuuaugucugaggccagaaagcaagagaggggaggagcauugugguguugucaguaaacccgucugugagcuugccugccugguugucgucugaguuucacuucuuauaaauagaaaaaauguaaagaacugagccaagggagaaaauacauuuaauaauucuuaaaccccucaauacacauaaauaauuuaguuguaaaacaauugccugggaaaaaugcuuuuuuugcuucuugaugcuauguuacuucugucacuuuguuuucugagaauugacugauugucaaacacugaguuaaaguccaguuuccuacaacuaguguaucaaauuauuuuuccaccuuuuccccuggagaaguaaguugaaaaagagaaaauuuggcaguuacgugaagcucaucugccauuugggucuuaaggagugugcaaaauauguuuucaacaaaaucuguccuaauugacaugaacaugagagaguguccccgagagccaaaaagcuccagcccgacuucucagauaucucuacacauuuguuuugccuccuugggggugaaucagacaucaucuguggucauggguucagcuaauuaaaggacauaggugcuauucucaagaaugacauuuagcucaguucucucaaggcaaguaauguaaaaaaauaaagagauaagugacaauugacauauccucagugccaggagaucuggugacugggugaaccuugagaagggcacacaagggcaaauccaucugugcccuaacauuauugcucuagucgauaggaacaugaccccagauugccagaauugauuuuuuuuuuaagaaaagcacaagccauuauuuuuuucuuuuagaauaugcuaaauguuuaacuauuuguaauaaauucuguuuuuucuuuccccuucauuccauauguggcaauauucuguguacuguaaucauuuccucaacaggccuuauaugauacacagacuggcaguuugagaccucucuaggaagauuugacuguuaguaaauuagaacauuauuuuaugauuaaggcagcucuucaaaugcauaugugaacaaagucaucaugucaaagaauaguagacccugaaauaagucccaaaacaccuaaucucccaccuccacuucacaugauuucauagguguuuggugacagaauagcagauuuccugaugcccacacaagggauauuuauaucucaucacuugaccucauauuuguaguugagagcuccaguccuuuacuuaucaaaauaaguaaauaaauaaauguccauuacucuuuucuuaauaaauuaaaaauaucuuuaugagcuccuuauuuugcaccaccucucaacuucuuuguuaaaucagcaguuauuagcacauguguauuacauggaccaacagauuuacccucaaaaauaaaggggaaaaaaugccaaaauauaaaacccaguaugcucuaauccuuguuaacucaacauacaaugacacaauuuacacuuuccaguggagggauacuguuggccacuucaucauuggcacacguacuuauuauuaacaccgaagaaugugugaaugagaucguuaaguuauuugaagaaacauuuaucauauuuuuuggaaaagggugcugaugacuguacagcaucaucucuaaaaauggcaaacagaaaaauuaacauguugaguaaaaaucacccaacucacagacaccucauuugcuuaggugucuauaucucugagaucugggccugugagauaauuuuuuuggucuuaagaaugacuauuuugcuaagucaucuuggguuugaccuuccgaugaauggcaaaccaugugcucuucaauucuccauccccagggaagaaugcuacaaauaaucucaauauucaauuuccuugcuuuuguccuuguauucaaaaauucuaccacgguuuuauuucuguuugcaaauuuaauuuccugucaacacuuccaaguagcuaucuaaccagccugucuucuguugauauuuacccuaauaacagagaauucauggcuccacaggaaauuucaauaaaaagcaccgaggaaggcccuuugguuugucauucagucauuaucuagauaauaaaaagacuuugcauuuuauugguuugauaggaaaugguucaauuuaugguaggaaaauguagguauguaacaguauaagcuauguuggaaugggaaggcaauacugaaauuuaccucuugccuucuaaaccaggaacugcccaauucugguuuuguuguugcuguuguuguuuuggggaugagaugggauaugguggggguggauccucacacacaggaguaggcuguggauauggacacccaccuccauucucuccuuaaacucuucuuugcuggcaguguagcaccaugaggaagaucuuaaggcucagggcaaagcagcaaaaucuccagugccaacaaaagccaaccaugucacuuggugucugcagucuguuugaauaguguuuccacaaaaaauaugcuuucucauucuucucucaaaauauaugguucuucugauguaccuucuuauuuuuuacuguuguuaaaacauagauuuuuaaaaauaggucucuaccauuaagaaacaaaaacuguuuugguaaaugacaacugccuuggccucagcgucaggaagcaagagugaauuguaaagacugcagagaacugaucauccaaggggcagcugugccugcauugaagcuguguguggcugggcaggaauguaagacagaugguuuuggaaagagaagccagggauucaaauguuuauacauaaacucugauuuuuaauguuagcucaaguuuuaaaaaauccuaugauggccagaaacuacacaaagacaaaaaacaaacacacaucugugagcagccagucagggacccccaggcuagaaaaauuaaaggcccuuuacugcagcaucaaaucuauucucuagagauauuuuugaucacucaggauguacaagcacccaugaucguaagacugaauauuuuucuguuguuggggagcaauaauggagauugagaaaguuuaguaaaauguaaacugacugcugagcaaacucaggcaugccagagucuggagcuuucacuggugagguggguuccaaugaguacagcauuuauaaccucuucaaaauguccagacuuucauuuuagcaugaauugcuuaagugccuguauuuuauaaaacauauuacagagguuguauauuuucauuuuaggaaaauuagaauauauagguaaugaccaaguagaaacucuaaaucacccauuaucuaggcacacaaagaaaaucgacauuuuagaaaaagcccuucaugauaguuuuguuuucuuacaaauacuagcuuuuauuuuguauucuguuucguaacucacuuugcaacgugccagcagcugagggcaccauagccugaccccuguagccuuuggcuccucuguuccuuccacuuggaaugaucuggcuuccagcucaaucgcugaggagccugaggccuggggagucuggggucauuaucaccaguccacaccgaaugcccuuacucucaucagaacugaccuucccuagcuucagauaaggaugcaggugcuucuuaccuuuaguuguucucaaauaguacuguccuuaaauucucuuuucuuaaacuguaagcaaaaguuguacauauugacuuggugacugugugaugccuuuaagggguccagcagacaagugggcacaguagguaccuaauacauuucacugacaagcugaacgagaaggugggauggggcgaggcagaccucauccucuccuagcccuuugacacguguaaugacaauaacuggaggccuguucacuaaaauaauaaaccagugauacccucccuguucuacgggagaaugugucaaccagucuccuuccugcuuagcccacaagccuuguuuaauucugucuugugcuugacuggcccugcauaggcuccaucucuccccacccuagaucaagaaaaaugggccuucuugggucccagucuuuucuugggcauucaacccucaacacaguuccuuccuccuccaagaguugugggaauccaaccccgugaauguacaugaaaaucugguaccuaauggacacaaacuuuauuucauucagucaaaagcuaaacuaaauugggaaagcauccuuccuuucagguaauuuaguauugcauguucagaguuugcuuccauggcuccagccuaugggugccaagauaccaucuucccacuauaauugcuucagguagaaugugcugcaggauucagaaugaguaauguggcaccuucuccacgaccucccuccaagucagucuucacugggaguagguugacuguaagagauuaccauuuauucaucagccauggcuagauacaugcagucugugaaauauaguccuuuuggugccacugagcugccaggaucaccauaaucauccuaucccuaggcucucauaguaacucucuugccuuccauuugccucccugcaagccccacccuuaucugcagguccucuagacuucuaguucugcauauuuucuaaccuuuuuuuuuuuugagauggagucucgcucugucacccaggcuggagugcaguggagcaaucacugcaaccucugccucccagauucaaguaauuuucccugccucagccucccgaguagcugggauuacaggcaugugccaugacacccagcuaauuuuuguauuuuuaguagagaugggguuucgccacauuggccaggcuggucuugaacuccugaccucacaugauccacucaccucggccuccuaaacgcugugauuacaggcaugggccacuacgcccggccaccuucuuuaugcauuuuuuuuuuaacaaacuugaggacaaaggaccacuuucccgccaacagacaaacaaaaaaccucuacuguuacucacccuuccuuuuuuauccuuacauuaugguauaucgaaguaaauaagcaaucaacauuuaaaaauuccucauagucuaggacugcaacaacuggcuccuaugaggucauaucccauggccauauccaugaguuaaacuggaaauuagguaaaccuuuguuuuaauaccacucuccagugauaauugccucuucuugguuccuuccucagucccugcucccuggcuccugccucuaaacagaaugaaucucuccagauauuuuuaguagagacugugccuccuuuaccuuuggaucacuggcuccuacaguaggguuaaaaacauacgccaugcuuaauaaccauauauuggauaauaaauaacaggauaauaaaugaguacagcuuuucuucacaaacaaagguaagaguuccagucuuuaagauuuagcaaacgcuaccuuaugagaaggaagauaucuuaucguggaagcacccuggcuuucucauggauaagaacaaucaccaucgucucuugccugaauucuuacaaagggcccccuacucagucuuccugcuuccguucuuccaaagauuucugacaugggagucagaaugaccuuuuagaaauauaaaucauacugugcuuaaggccuccauggcuucccacugcaauuaggauaauauaccaacccccuaucaugggcugcuugcaaggaccuuuaugaucuggcucugcacaucacuccaaguuaugucccaccucauagccuuuccacauguugucuucugggcuggaaaccccccuccacuccagucuugcauggcugccuccucucccuucaggacuuugcuuaaaugucacuugcuuagagagacccaacuggaguagcucaucucaaugaaacucuucuccccuuuuuuaucugucuccagacacaguugcuuaggugcaugacuuuaucacuauuauuucaugauuuuaucacaaucagaaaaucuuuauuaauuggucuucuuacuccuaucuucuguaugcuuucucuauuccucagguuucaagaaguaggaagcacauccgucuuggacagcaucuccucaguauccauacacacagccuagcgcacaguagguauucaaugaauguuugguaaaugaaugaaugaaguaauacugacaacugcccuucuuucuaaccucauuggcaaguucaguccaguauagagcaagacccuggccaggaggagagcuggguguaggggacacugcuguuuuccgcaggcuuacucaugacauuuuugggacauagaacaaaaauccaaauuuggaauucaaauuuggaugacucugaugccuugaaauucuguacuggcaugugaaggcagggggccagcugaccuguggcucccaaauccuuaucuggcccuuuaucuccuuuccauccccagcccuguguugcccuauaagggggcaacuccaaccucuucccaacagcugcccuuugaccacugcuuugccaagaaguauguucaacagcagcucaaucugccucaagagaaagugguagacaaagugguaggcaagagaucuaagaaggucccagaauuagaucuagacuauuugucagggauuucugaguagucuaugucuaaauggcacuggaugugggcucugaaugagcaugcucccuuggccccaaugcuucucucccccgcacggguaaaggaaugcugaaggagggcuggagcagaguccucugaaugagagaggcucaguagaggagccacccuugcccaugucuuaggguuauauugcuauugccccauucuaaaaagugggaccuuuucaagguauauugacauggccauugcaagaacaugaugaaaaaauauuuugaagccaaaaauaagauagugagauacuuagagaaguuagugauaggaugaccucccuuuugcuuaaagguuccccaccaaccaaugucauaagccccuugccuaccaccuacuuccucaucacugcacaccagccccuagccuagacuauaccccccauaagguaccaacaugucuaugcccaucccaaagguccaacagacagacauacuaaacucugcaaugaaauccaaccccugaccuuauuagccaaucucaggggcaccuagaagccaacuuccuauuuguggcuugucagucuuucaguguucagcaagaaagcuacuaguaccuaaugucuacuagcuacuagugucuacucuccagaagcugcucuauccaacuuguggauuagugucagauaucaccaaccaaauucaguaaacuccguaauaucugagcugacuuuuuucccagcuggaaaagucugucuaucuuucaggcaacugauauucagcagccuccaaccugccagaaacacggcuuuccaucagucacacugggagacacaagucuguuuaucaaacaauuaucaauuacuuggagguucuggcuguucaggcauauaaugaacuucuuggguauuuguuucuaugauauuucuaagacagaauagaugucagugcagucucaagauguuagcaaaaugaccaaaaccucagacccuaagaaaagaaagaggaaaggacuuucucagagguaaauugagggggaaaaccaaaacucugugccacaguaagaccccuauaagccgucacaccaccaccacacaaacagcaaaucuuccugaucucaccugcaccuucagcaccuucaacaccuccguccugccuccugacaccugcuucaggauccaaguuacugaauggcagagcugaaaaauuuagcuuucauuugguucaagcccucuguuauuuggauaauaaaaaaggcucagaaaaaaauaagguacuuuucuuggggcaaaauucaucauccuccuccaucaugauuaaagcugcuaaguuuuaacugaucacuuacuagugagcaggcccuguguuaggcacuugauaaucaucaucucaaugugauauugaauucugcgucuacagaaauggguacuaauauuaaaaauagcacaugauggccgggcacaguggcucacaccuguaaucccagcacuuugggaggccaggguggguggaucacaaggucaggaguucaagaccagccuggccaauauggcgaaaccccgucucuacuaaaaauacaaaaauuagccaggcaugguggcaggcgccuguagucccagcuacucaggaggcugaggcaggagaaucacuugaaccgggagguggagguugcagugagccgagauugcaccacugcucucuagccugggugacagagccaggcuccaucucaaaaaaaauaaauaaauaaauaaaugaaaaauagcacaugacgcaauaacauccaucucuguagccuguguucaaacuuuccacugcacacagcuagcuccacguuuauaaacauaaauaauacuguauuaaacauggcuuuugcugcuuuugguuuuucaaauaggguccaaauuuuagcacuguguggguauuaaauuguauuuaguuuauuuuacuguauucagaagacuucgcccugauaacucuuggcuuuuucaaaagccaauccugccuucaaaacacaaauauauggguacagagaauauccaaaagaauaggccacagguucuuccagcaauuccucacaagauacucuaaggacacugguagcaacagaauaaugaucaggaaaaguguaaauccuuccaugaaaaaucgaacacuuauuugaauaaauauauucuauuauguuuguaucuuaguuuguuggggcugcuauaaccaaacacuauaggguaauuuauaaacaacagaaauuuauugcuugcaauucuagaggcugggaaguccagggucaagaugccagcagauucagugucuggugaggacucacucuugcuauauuuucacauggcagaaggggcaaacaagcucccucagguuucuuuauaaggauacuaaucccauucauaagaacuccauccucaugacuuaaucaccuccaaaagcccccauauuauuaauacuauuacauugggaauuagguuucaacacaugcauuuugggaagacauaaacauucagacugugcaguuuguuaaaaaagaaaaaaagaaagaaaugucaagucagcauugcauuguaguguuaacucauagauguuaggaaacucuuguuuucguagaaauaauggaucucacgagugcccuagaucauuaaagugaaguuuugggguuuuuugcaacuuuuauuuugaacuaauuauggucucacagaagugcaaaaauaguacaaagaaguuucauguacuaaccacguaucuuccccuaguagugucuuauaacagacugguacauuauugaaagccacaaauuaaugcagguacaaugcagucaauuaguguagagacuuuauuugauuuucacuaguuucugcauauauucuuuuuuccuuaucuuucuuauuuucucucuccuuuuugguagucugucuuugugcaugaaggauggagguacuuuuagagugaggaagcgcguggcaugugaaguaagccuaagucugaaucauagcucuaccacuuucuuaaugugggacuuacaaccucuuugagacuuuuuaucucucccugaaagacauuucuuuauguuaagguauuuggaaggcauuaauaaggcuaugaguaaacauggcaugccuaaucacagguaaaccuccuuggcuaaacugaugcuucaugauaucuagucuauccuauccauuggcuuggagauacaaugacauguagcuuacacguaccugguacagcccaugaaauucacuuacuugaaagauauuuacugaugauuuauuagaacaaugcaagguaucuauuauaccaaauguagcccucuuguuaucuaaaauaugcuguuccuuggggaaccccaaauuuauaaucuuauuuucauugaacucuuugauggaaauccuguuggggccuaagcaagauagcaugaaacagaaacaauaacccagcugaacucacagacaaaugcuaugggaacugugagaacuuuucauguaucaaucaaauguaguuuuuccaucuguuugugaacauugcaaauugaaguaagauuuuuuuuugaagaaauauguggacaaaacaagucuucauuuugaaaaagguuucuuuuuuuugcaaaaauauugucuacaacauuuuuuauuaagaggcuccucuaguaaguuuuaaauuauuugguauguuaaagaaaugugcuuugccaaguuuuaccuggaaagucauccauaacuguccagaaacacauacauaaugcacauuuacuuauuucauuagugucauucauucauaaaaucaaggaaagaagaaaugaaaagcuagaaugacacaaucucuguauucuuggugcugcuugagaaacaggcacgcuuuugcaucaguacaucuccuuuuuucucugagcauuuuauuuggguagaaagcucucuguaaaucacuucaauaaagacuaaauaacucccuccagcaggauucagauuucuauuacuuuauacgcuagaaugccgaugaguuuuccaaaucaauaucacaacagaaauguggcaauuacaauauaaguuacagaggaagaacauauaacaaguugcuuucucauucuauucuuggaagaaaaggucaggcaggaauaacaaaggaagaaaacacauauggaagcagaagaguugcagauaacuuguggccccucaugcugacgauuaaaacacagcacuaaauaaccaacuaugugagacacacuauuauuucauauuagaagaaugccuacuucauuuuuagaugaaaaaaauaaaaaccaucacaccauacugaaacagaauauaaaauucaggaaaacauuagugaaagcuugggcuuacgaaacaaauaaaugaagagcucauucuaacugcaucauaaaaugaaaauuaagugauaaaauugaaauucuuugguuucacaucuuuucuagucccuuauuuaaaagaaauaaagaagaaguuaggauaaaauagagggagggcuagggcgagggcaaaugacuucuuuuuuuguuuguuuucuuccuagaauuggccuucuugaugggcugcuuugauuucuaaaugcaccagcaucgcagaaagcuuuggagcaccuccaaaaggaguggaagaaacccucuguggccuucuucaagcauuccaagauacucaaagaaauaccuguuccuggcaacaugugccaaguucuuucagucugcaguaauuuacguuguugucacccagucuuccauuuguaaugguucuguaacugcaaaaaugguaggagggaaguacaccaauaaacacugacuacauagucauuaagcuuggacaauggaauaaauauaauucauaauuuggggaauuauucacaagcacauauguauuaagaccauaccccuugaucacaaaaugcauauauuuacuugacauucauggagccuaucauguguuucacuguaauuggagcaggagguugaaaagauuaauucaccaguacuuauagagagccuaccugauuguaagcagcaggguucaauacugaacaagucauggcaagauucccugcuggagaauaugaauaacucaaaacccuugcuuuugaguagcucucaucccaauggagcagggugaaugaagacgcauaucuuuugacaaauaauuaaaauacugugaaauuaguauuuaugaggguuuaugccaugaaucucagagaaagaaacaaaaccaucagaguagcugagagcaaagacucuggaaccagaaugccugaauuuuaacaccagcugugccacuuacuagcccgcugaacaauggcuaaguuaauuaacuugucugugccucagauucuucaccugugguaugagauuuguacuaguaccuuccucauguguuuaaauaaacuaaugcuuauaaaguccuuaaaacagugucuggaauauaggaaauuuacauaaacaaggucucgucccaaagugauauaggaacauugugcaugccagaguggguaugcaaguugggggaggcauuagagaaaaagaaaaaaacuuaaugacaaagugaaacuuccuagcuaauauugaauuuucagccauuauuacagacaccauuaggacagaauuuccugauacuacucauucuaccuauuuuuaaguccagaucugcuuguucccuuuuuacugugagaaaaccucacugaagcacaaagaacuuugguagaaaugauucaaccaucagggcaggaggaacucuaaguaaaagagagcuaauuaaaacaucugaccacaacucaaauuuguccauuucauugcaugaaucaguuuuaacccaaugucugauaccccauagaaaaccugguaccaugaugaaaagcucaagaacccguaaauuauuuggaauuaacaucacugucaaaacagauuauuggaucuccauuauauugaagacaguucuuucuucugguucaugcaggacagauagaacauucuuucucacaguucaggcuggagcugcugggauaagaucaacuagaauuccaagagggcugcagugaugcuuggaggcuggcagagagagggagagaaggcaucaaugcugggucaaggacagaccaauaagaguaaaccuguugguuuagaaagaaggaaaaauaugaaagagguucacagaaucaugaaggggagauaaaggaagaggcagaagaugaaaaaggagaauagggcuucauuccugaaaccucaguccaugagcuacaagucccuaaaaguaugacuccacgaccauuagcacuuugagacaguggguaaaacaaugaauucuagcuccucugcguacagcaaugugccuuggggcaagccauuuauccuuuagccaaacugccuagaaaauauauacuagauaaauguuuauuuucuuccaucuuucugagcuugguuuauugacuguaaaauagcaauaugaagaucuacuucacaggacuauuaauguaaucaaauucaauaauguauuggaaaugcuucaucacaagcuucauaggguggaaucagaacucauuccucuuguuaccccaaauccugaguauccacccguggagacuguugauuuugaaagcagccugaacaugaaaacucccaaacauucuaaggaaauccauccuaauaacuccacacagaaugagaauaaagaaaaauaagauuuaaccagagccgaaugauucuuucccugugcuccauaacccuucuaaggaucugcaaucccuaccucaauuaaucuaggcauuucaacuacuugaaaaacuaccaauacauuaaaauguacaaaguacuaccuuaaugaacaaaggaaguuagacguagugcuggcgacuauuaagggggguguucuauuuuuauuuuccucugcucacaugucuauguuacuggauaaagaagugaagaaaacaaggacuuaaaaggaacagaagauaaaacaacaguuaaagaaccaugugagaugauaaauggagcaggggauuugucagacaguauuuagcaagccacaguaugaaaagauuuucagaaaaaggucagagauggaggcauaaacagucaaguaagcaucgcaucacagcgccaacuccuagggagucagguaaaagacgagaaaggcugagaggguuggaaacaggaaccauagaaucuggaauaaucagugugccgacuaaguagggaggaaaaauagacuaaugauuucagagcagagguuaaacacugcacuagaaaauaagcuauaaaagaucaacgagaagcuagaguggagaggguagggauagggaauucauaacaagguggaacugggacuccaagacaagaaagaaaccgaauagagaagacaccguugaggauaacacccaaagagugcguagacuaauuccuggaugcuugcaaaccauguccuagugucuuuucgaccaggaaugcugcucucaagauuaauagugacucuuuaggcugagaagugaugacccagcagcucuuuauucgucaaaaaaaaaaaaaaaaaaaaagaaagaaagaaagaaggaaaggaagggagagaaaaaugagauacauaagagagauagaaaauuguaccuagaugaaaucagcauaaauggaaaacccaaauguuuaauccagucaugauuauugcccaaaauugaaugaguaaaugaugcugccuacaacagauauaacucaagaaacagaggcuuaaaaaagaauuaaaaugaccaauaucuauacaaccucaaacucaaucaguauacccuagauagagacucuauuugcugcuuucaagucuucccguauaaagcaguauguuuccaggaaaaaaauaaauaaauuugaagccagaaguuucuaaguucaaauuuuagcuuggccauauaccaucaucaacagacuuagaaaagcaacuucaguagccugagacucauuuucuucaacaaccagacaaaauuaaccugugcagagucccaccucccgagguuguuaucauaaugccaugagaucuuguuuuuaaaagugccuagaauacagcaggaguucaauuaaaaguguucauucccuagacuucuaaggcaaggcccaaggcacuguacauaaucaaaguaaguuaacugacuuuuaaauaacaaugaaaacaucaccaaaccuuuuauugcccagugaaugaugucuugcaaagcagauccccagggggcugagcacaaagcccacucaaccugcccuugcugacaacuugcauagcuggagcuccccuucuagaaaugcuguaggagccuggggcauauaucuuugauuauccacaaaaguggaaaauaucauucuucugagggaggauauacuucuggaaaaagucgacauuauuugguuccaagucuagcaauaagaucuagcugaaguguggccacaaagcagugagacugauuuucuccugugacucauaaucuaguucaaaagacuuuuuuuuuuuaaguuucggauccuagcaagauaaaagcaccaguacaugaacauaacaguauaaggacauuuauugcaccacugaauguagagacaaaauaauugcauguauauugucaaacaaacagaaacauucaaugacacuaguuaaggcaugauaaggcagacuuuauuuaggaccuuugcaauaguuauaggaacccuagcaaugggaauuugcaguugggggucagugugagcugguggggagacggcuucauucugaauacagcaugggcagcggcaauuuauagcuaaggaguagggaggugagggaggucaguggaugaaaaauuacuacgagguaacaucagggauaaugggaacuccaacauaacaggauucuuguaaacaacgggccagggugaucagacaucaugucaggcaugggggaggauaaggaacuucaucagacaaggagggugaucagauauugagggugggugguucuuacuaaacugacuuaacaggauucuuuguuaaaacuggauuuuacaaggaaaugcacaaaugggaguaggaaaagauuuaggagccuggcuaaaguuagguaaagcaaagaaucuuugucagaaucaguaguggaaugacagaaaaauucaugcuguaucucuaucauuaaagauuauguagcuaucuaaaagaagcgguuagaaagucuucucccaaauuguguuccuggaacgguagagucaacauugccugggaauguguuauaaaugugauauugacaaaaaauuauugggcuccaccccagauauacugaaucagaaacuugggggaugagauccaacaaucuguauuuuggcaaguccuccaggugauucugaugcaugcuaaaguuugagaaccauugaguuagaaggauauccuccauuuaucuagaaugggaauguacaagauauuuuaaauaagaaaagcaaguugcaaaccaauagggaagacuuacaguugaauuaaauugugugcaugugugugacuguguguguuguguaaaauacaagaugugguaggguauuuguaagauucauaaaaugaauacaacuaaugacagcuggggugaggguagauggacagggugugauagggagggaaagaagaagcgggagaaagagggaaauauaccuugcauauaguacauaaagggauaaguuuacuaacugcuucuccagcuuuuucuuaaagccuaugucacauucuuuuugaauaucuuacuuuucuuugaguguuacaguuucuuuuucuucaggauucuuuguguuaagaucuaaaaagcacuggaguaugugcauaagaaaugaacaagauauaggcaugcuuaauaugugcuauaauucuccaaagaccaugcaaaugucugcuagcuaaaugacugucacucaagauuaggaacaaccuaugucaguuucuacaguuccaagcaaagaaaggcuauggauugagagcaguuuuccagcaggaccugugcacaaaggcaauuuuuuuucuucuacgaacaaaauauaaagaaguaaacuauccuccuuaauggggucauaucugacuuauguauagagucuuaagaguuuaaauuucaggagcauuaguaacuuauuuucagagcccugacauuuucuuaaguaucugagaagucaggggauuucccaaauaaacgcuggguaaaggaaauuauuuugagucucagugccccccacagguuuaucugaccugccaggaaauugaacacuaugagaaugccccaagucucugccaguccagcagucucucacacacuggcccaccuaugcuuacaccaagccuacaaagaccugaguacccuggcaggggaauugaguggcuuuuaugggaauccaaacaauguggcugagggaugucggcacaucaucuccaagacagauuuugaugguaggaaaaggagaugauugucagaaguacagaauagcaggaggaaaaggaagcaaaaucaaguguaugucugugugggguguccugggacagauugguauguuccagguuaggaauuggagcacugaucaaggcaaugaggggaggcugccacuuucaacagacucccuuaacucuucaucuuuugacaaggcauuuuuucccuggcuucugccugggcccauguuaucugugcaaucaccuuaagauaagcaggauaagaaaacugcccuuuucuugcugaauucaaaaauguacauggugccuuuauuauuucagauaugaauaucuuaugaauagcuuuuaaccucaaugucaaggugaacugugguccuucuggucuucuacguccucucaucagcaccucagcaggucaacuuguauagugguuuuuagccuggaggcacauuaaaagcacguagggagcuuuucuaaugugaaugccaaacuccucccagaccaauuaaauucauggaucacugaguaggaauaccuucuaagaaaugcauccuuaggugguuucaucauuguguaaacaugauagcguguacuuacacaaaccuagaugauguauccuacuacgugccuaggcuauacgguauagccuauuguuccuagguuauaaaccuguaaagcauguuacucuauugaauacuguaggcaguuguagcacaauggugaguauuuguguaucuaagcguaucuaaacauagaaaaguuaccaguaaaaauaugguauaaaauauuuuuuuaauuguacaucuguauagggcagcuucauuauaauuuuaugggaccacaauuguguacaucuauucuagacugaaauguccuuauguagcccaugacuauacaucaaaguuguugggagguagaagagagggggcugaucauuuauaauuguuuaagucucuauaaguuaauaauauaaacccaggauagacaaccacugaacuagcuguuaucuaagcugcuagagggaagauuagagcuuuuggugugugguugaacaagcugaacuucaagguccuuuccaaacaggagaagggucagugauuuucagaaagcagucugcuaaaaaaaugauuuuucacaaauaacaguggaaaggauuuuucaagguuaaagagaaagguguuugcaaaaugaauuggaaaauugaacuugcuaucuagguauuuccaaccagccaaacacaaauauaaauacguauuuuguaguaugucaauagucuacauauuuuagggaaucuuaauuuguuauuuuuuaacauaaauuuauuuacuugucagggauccagaaaauuaaccauauuauuugacacacagaagcacagucuacuucuucuuugaauaacugaauaaauuagguuuuaguaguccacaucugauuaauacacaauaggucauauuaacuacaaaauacaucacuauaugaauaauugaaacauccaaguuuuuuauauagucccucaguucuaacagagguaacuuaucaacugaccuaaauagaauuacucuaaauauuucuaaaaaaaaaucgaagguuuauuuauuucuucaaagacuucaaaggaaguuagacaaaauguacaacuuauuucuauagcugcuguuaguuaagucucuuggcaccuacacaaggauugaaaaauagauacuccuucuugcccuccucaucugcagccuaacuucagcucuagaaggaagcagcaagggugaaggaaggcacuagaggauagucuguucgaugaacuaaaauuucaaggaagucauuuuucacauguucaaaagugaaucaucucuuucgaucuccucugcaggagacaagggaguuggaagggugucugacuuuuaaacaagagaaaaaaaacaaaaucuuagaaagcagaaauacuaacugagggaaacaaggaggaggagcauuaaaaucccugaaagaauaaaauaaauuuuagagcaucaguauaugaagguucauucucaagagaaaagagaaugaagagaaaugugaacccaucccucaauauaguguuuacucuaaaucuacuaugugcugagucugagaagagauacaaagaugaguuuggaaagaauucuaggagcaaauacaauggaucuuacgaagccuaguaaggaguuuguauauuuuuacaucaguaauauuaauauuaauaauauagacaguguauuguauacuuauuaugugucagcauuauacuaaaaaaacuuuccaugaacauuuuucuuucuuuuuuuacugauacauaauaauuguacauauuuaugagguacaguauguuaucucaauacauguuauuucaauauauauaauguauaacgaucagucgggcacagugacucacgccuguaaucucagcaguuugggaggccaaggcgggcagaaaaccugaggucaggaguuugaaaccagccuugccaacacggcgaaaucccaucucuacuaaagauacaaaaauuaacugggugcgguggugggcaccuguaaucccagcuacucgggaggcugaggcagaagaaucacuugaacccgggaggcagagguugcagugagucgagaucaccgccugggugacagagcgagacucuguccaaaaaaaaacauguaaaauuaaaaaaaaauguauaaugaucaaaucagggcaaugggcauaucaaucaccucaaacaguuaucauucuuucguguugaaaacauuccaaauacuuucuucaagcuauuuugaaauaugcaacaaauuauuguuaacuauagucaccccacugugcuaucaagcgcuagaacuuauuccuucuaccuaacuguauuuuuguaccuguuaaccaaccucucuuuauucccugcuuccuccaaucuucccugccucugauaaccaccuucuacucgaccuccaugugcauguaccuuuucucaucuaauucccucaggugcccaauaagguaucuauuaugcuucccauuuuauagcuaaggaaacugaaacucgaaguguauaaguaccugucuaaggccauguagcuaaaaugcauugccuggguuuucaaugugggccuaacuugcacgaagccuugagcccuuaaacacuaacugcauuuaauuaguuguaaaacacugagaaacccaaagacaauuguaugguggugacauaaucuuugagaacucauacaagcuacauuccaguugaaugucaugcaaaguggccuugcucugggaucucacuaucccgccugcucccuccgcguccaauagcaccccaguccacccaaauguacugagacuacaucaguugcaguauugcuggugauuccuggaauggcagcagggcugcacaacacacagaagccacagcaauaccagaucauccaaagugcaggggauaccaaugugcaggggauauuaaaguggccacacagaaagaagaggcuuccaagaaaagcaaguaacuuuuuauuacacauaggagcauuggucuacaacccggguacuccaugucaccaauagcucagguguccagcuucuggcuuaguaauagagaccaguaacugaaggagaugcauucagcacaucccacauccggcuccaggcauuaggagccauaucuucaacucaaaauccucacagacuugaguaaaauuaugguacaaauaaggaaaguaacuucucacuggcaagcauugaacaguaaaagggacauuuuguuuuagagccauagugugacuaaguuuaguuccaaacuucucuuuccagccaugugaccuuccucaggugacauaaccacucugugucucagguaaucacaggcuuguuucgaagauuaaauggaucagugcacugagaacaaaauuaugcucauaauaugcauccagacacaccauuccuccuccccucaucugacauucugcugguagagacucccugcucaaugguaagcaauggcacuggccuucucuuagaaucuccuuuuaaaacucaaaggucgcacggacagcacacauuagucaccaccaucuuggugugaauuaauuuaucauauuauuuucuucacuuuaaugaggagaggauuugugagaguacacuccucuccagaaagauguggaagaggaaugaagguacaaaagauaaggugaugaaggcaugaaacacaaauuuccacuaacucgcaacuucacggagaccuaaugccguggagacccuaaugucagucucacauuccucuccucuacucaugcccacaaaaaagaaacaaaaagaaucuugcuaaaucugcuucuguuucccucacuuuggcuccacaaaguccugccuucucaacccuccugauagagagaugaccuuuauacaagcccauucaaccuggcaauuacuagcuggguaacaguuucucuuuaugucuuucuuccugccucugcccaguggcucuacgccagacuuaugugacaagcuuucuuucuugacauaggccuacugacuauaucauggcacuuuaaaaauuucauuuauagguacaaaaaggcugcuucauaaaccccugacaccucauuaccccaaccuaaccauuugccauuuguuugccagcccugacagucaguaagcugaaacagggcgaucacuaaucuggaagaaagggacuugucuuuugguccaaguucugcugucaugagggaugcagccuccgcauaucaucucccuuuucagagccucuggcuccucaauugugaaaagaagggacugagcucugauucucugauaugauuucacagcuuccuuguuuuccuucugaccuuuggcucugggccuuccccgggcuagcccaucaucagagagggaagcacugacugcccgccugccaaucugugcucaggccaaagauucugcugggaggcugacaaugaucaaaugcccagggcuggcccugugccauaugucagcucaacacgcugucugagaggcugcagauggagaccuggggagaccaagugugccgcaugcugcccggcagaacuaauaagcaagacccagugcccaggguacuugcccuccgucagccucacugaguucugcucauccaucuccuuaucucccuggcagaaccuaagaauucaaucucugagcugaauagagcuuuuuaaaaaucuaacauuugaacacguucaaggacaagggauucaugaauaguaguauuaaauggcugauuaucaccaacagccaggcacauauugucucuuuggggauggacuacaguuuucccuguucuacacauggggaagguacagagcaguuugcgaagugcuaagucccaccaugacagucugaacccagaacucccgaggugaacucugcaucguacugcuuccagggaccuuccauaacagcauauuuucccuuuaaaggaaagcucuuccugcaaugagacaaaaaucuaucuuucuauaguguuccucucagccccuccuuuucucuuauuugauccuuuccagacauagauaaagaugcucaauacaaucaauuguaauacuuuaagauaaagaauaauuagagcagauaagaguaaacuaugucgcuuugccuuuguucucagacagccucccuugauaguuggaauggggcucgaaauguuuuucuuucucccucuuugcccuuucuuuuauucuuuucuuuuuuuuucuuuuucucaagcaucauguuaauauaagccagagcuuugacaauugugcagcuaauuucuaaaugauugaaauaauuuauuguuauuucagucaaggagaguuccuacagcagcuaggacagcugguaaugguacccauagaauggguauuuauucaucacacaaaaagcuugacauucaguggaaauuaccaucaagaaaaacacggggguggagaauagaaacguaucuuuugauuuacagucaggucaaaggacaaaaucauucugauugaaacuacauuguguuauauaacccugucuguccucacauucuccuaugcaacuuuguuuugugagaccuugugaucccccgcaaacagauauauguucuguaguguuuccuauuuaagcacguugcuagcucaauuaugguuucucucuucugucuuguuuuucuguuuuauuuuguuuguuuuuuuaacagcuuucguggagcuaaacagaauuacgugagcgaaucacacacauggagaaaucacuaaccaugaagcuguugcuaaagccagcagagaauauccauuuugaaugcaccauauuagagucuauccacccacuugcuuccauagugaaguucaguaccaguaacacaaacagaugugcuguucuuagacugacacucuuaacacauuacuuuuccauuguguucuuccaggguuagggugggggugggugcuuagucagccccuaucccuaccaaccuuggccaugcccaaccauggccaguaaugaccaguacucagccugcucaaccuugcacagacccugagcaaggcaaagcuagaugacgguguguuaggagauuugauuucaccaguguugaaauggaaauccacgugaugcucccaugcuugcucuaugcuuggauuuagcucccaaaguacccucaggaacaucagguagcagccccuuaacaaauucccacuggguguggccagucugucucuuuggccuucaaagaggucccaggcugucagguucaaccccagcuauaccuggccuagaaggcaccccagccuuucauccuacucucucccaccauaacuuggccaacuaacucugaaauuuuugccucauuccaucagauaccuuuccaaaaaccugggaggucuugcuguaucccaagaauaaaucuccuugaucuaaaugauagaucuuaucauacugcagggauaccagcuaaccaagguucauuaauuucagcaucccuucuaucucaaauugaaucuucucuagucaaagcugauaguuugaauauuucacccuuuccuagauuucuuuuuaucuaagcugguuuuccccaacccaaccugcaagaagcccccaaugccaccagcauccuuucuucucccuuguaagcuccaugcauuugugaggaugccagccagcaucaggggcuugccauauggcucagaaucuggucaguuugucagcggcguuagaacaccgacagcugcccagaggaccucucccauuuuggcaaucagccccaugagaccugacugauuuaggaaacagauggaauuuuauggaccauuggguuaaaaacuauugggcacacagccgacuagaauacagccacgugucuguaaaugcaucagaagcagggaucacaucuguguuacucauccauguuuaugguaccuagcacaaugccugucaaauaggagacacaaagaauauuuguugauugaauaaauggauggaugaacugagauccacaguauaucacaacagcuguaaacaggcucugaaguuaaauaaaccuagcugugaauccugauugcauuauguacuagguucaugaccacagguaagaaauguaacagguucagcugccucaucuguaaaaugaaaauaauaguauuuauaaauaucuugugguaugguugcuagguucuugguauagugccagggacaaaagaaccaaauauagcuuaaauauuguuauaauuagucaucuauuuaauaugcuuugauauauaacuagccucauguucuggauuuagggauuuuuuucuauguccaaauucuauuuuugcccuccucuuuaugcuuaucuuaaaccuauucuaguauaugcugauuuaaauauauguaaaaaucuuuuuuuuccgauaaaaaauaaauguuggacugagaaacugacaucagcaugaaggaaucuguaauucuugaauguuggauuguaauaacuucugauuuuggcuauauuuuccuuaauucccaaauaagacucaaacauuuccucauccccccaaaauuaaauaaaauauuuuacucaaaucauauuugaauuauugccugaucuaagagaacaaaucuaaauuaaaggguugacccauauauuacauaucaaguccugaugcagugauucucacaacugucucuugacaugaagcuaggucuaguccaaugaaaacauggaagcaucugcuauaggaugugcacaugaggccaggggucaguguauuagucugcucucacacugcuauaaagaacuccuugagauuagguaauuuauaaagguuuaauugacuuacaguuccacagggcuggggaggccucaggaaacuuaccaucauggcagaaggggaaacaaauaugcccuucuucacaugguggcaaaaaggagaagugccaagcaaagggggaaaagcuccuuauaaaaccaucagaucucaugaaaacucacucacuaucaugagaauggcaugaggguaacugcccucaugauucaauaaccucccaguggguccuucccaggagacauggggauuaugggaaauacaauucaaaaugagauuuggguggggacacagccaaaccguaucagucaguauuauaagacaugacucuuaaucaccuacacaccguggcacaaaaucacaugggagggggagaaggccacacaaaggauaaugcaccagauauuuucagagaaagguaaguguauguauauauuucuuccaaaaugagacagggaaaaguacuuuuuuuuuuuaaacaaugacaccuuaauggucaggagguuauuaaugaagacuugguuaagacaaacagacaaaaagacuaugaaauagaaauagaauuguuccucucaaguuccacugcugaaaauuaccauccaacccugugauucuauugauuugccugcacuauaucaaauuuuaaucaccauaaaccauagacuaauacaguucugccaucaacaagugcucuuagaagaagacuuugauuacuuuggacaccucugaaaaucuuuuaagacugucuagcuuggaaacuggagauucaaggaagcaucugaaugucccuccuuugguuuuguaaaaaaggagguaucauauucugcuuuuuuaaaguuaggacuuucagaagagacacuaacacaagaaaaaagauagacuuggagggguaagguaagcaacuccagacaaggguaauuacuacaagaauuccuugagaagaaaugacaaauccacuuuuguucccuggguuaaauuacaacagguuaacuuuaugcucucagcacaucuuuguccuuuagaagauguucucuggauguucccaaaacacaaagccuaaccagauaaaaccagcauguucuaaacuggcugaacaaccauacuaguuguucaagauguaauaaaugguccuuuaaaaaggaaaaaaaaaaagcuauuaugguuacaacaaggaaauuugcauacuuugucucauacagggauuuacaaugcccauaagcuuauuguagacccaggauacuccuauaauuaugaaaaauguuucuuuaauuugacuuaauccagaguuuucuauggaauaucuauuaacaucuuaagaacuaguguucuguaaaucaagguuugugacauguuggguuaaauauuauuguuucugugacuaauuucuuuggacauuccuaacaucauagcuuugcauuaagagaagaggagauauguauaaaccaaugcacaccuugaauaaucaauuuauucuucaaauuuuccaggaaauucaaccacaaucacguuauuucacagaucaugucaagaauauagucaacucucauuucucauucuacuguguagaacaacaguaaauacuuuaaaaagcauaauuuaccacuugcagacccagauuaaacugacacccuuguacuuggcuacacaccaagcacauagugugagcuacagaaaggcacauggcccccagaaccuagugacccuggauuuuguauuuauaguucugucacugauuaguucuguguuaagcuuucugaaacucacauccuuauugaucacuggauaauuccacagccauucuaauguauggaguucuaagaaacuacaaguuuugaauucaaagguacuaaguuggcuuaaaaucuuaaauguuccugccuuacagaacauguagucagaggcucuguuuuaacauguaccaagaggaggauccauuaaaaaucauuuuaaguauagaaaguuauuugaaaacagagaaggagacacaaggaaagccagaggcaacccuagcuauauuacaggugguuuuugguuuguucuuucuaacuuaucuacauuuucuaauguuuuugcaaugaacagauauuacugcuacaauaacaaaauagaccaagaaguguauuuuauuuaguguauuuauuuauuuauuuauuuauuuauuuauuuauuuaauuuuagagaccagggucuugcucugucauccaggcuggagugcaguggcaugauugaucauagcucacuacaaccucaaacucuugggcucaacugauccuccugccucggccucucagaguccuaggauuacaggccuaaaccacugcaccuggccuauuuuugcuucuuggucuucugauaucuuaagcaggcugcuacugauuguggguagcuaaucaaacauuucagacuacguguacaaacccauaucaucaaugucgggauacauaggacuaugccuuagaaagcaugaccccuagcaucagcucuacagguagcuaaccaaauauauggcagaaauuugagugugaaugccuuaagaauugccuuucaaauuaauggaggaaaagauagagaaaaaggaggaaaggaaggagagcuggggaaaugaaggcaauaucgcugcccugucaagccaccauuucaccauuauuauuuagguuccagguuuucugaagacccugcuaacauacaggcuccugggauacaugauauuuuaucagcuccuugccuacuaagagcauaacccuguaaaaaaucaguccuaagauauucaggguauaaauaaauaaauaaaugcuaacaagaaaggagacuuaugcaaauagugcagcugguguucugagcccuggcuguacauuaguaucaccuggaggacuucaaauuagugacacccaggccccagcccagacugaaugagcaucucuaggggugagacccaggcuuggaguuuuugaaguuccucagguaaugcuaauguguagucaggauucagaaacacacaggcuaggcgaaacaaaggaaucaaaguaaauccuacugacuuuucaauuuugcugaaugcuccucagaaacaaaaacaguuuaauuuuuuugaacuauuugaagauuuugagauugucgcuaagagugaaacggagaacauauuaaauucacccuuauugcuaagcaucacccuaaaauacccacuccucccuugcuuaguaaauccaggcugcugaaugaaaugguugucuuucuuuaguaagugaagacaaucugggauuucacaaaggaucugaggacaaagauggagaaggcgucagugauugggccaaauuagaaaagagcccagggccuuccuggaaagguguuauuaaagcaagaaucugauaccaguuacuuuguuguaauuggacuccuuccagaacuaagugcaguaauaaaggcucugauuuguugaguuuaguuaucggagacuuuaccacaaauauucgggagaacauucuauuguuacauugcuaucugucuaguucuucuuucaaaaagguaaggaugaaaagauuaguuucacccuggcccucuccuuggaagaaugagcaagcuucugcguucuuucucagccauaccucaucuucaucccuaaauaugcccuccacccucccaccuuccacauaaguuaacagcacauuuggauuucuaagggugaacuaaagaaaauucccacccauguguuuguuugaaagguuggguacaucaagggauuauuaaacggaaguuaucccagcgugggagaaggaugaagggaagggccugacuggggaagaacagugggauuucccaagauaagaggaaggaaaggaggaauaauuccacuaggagcuuuucccccacuaggcuuaauaaacauucuccucuugcagcaggaaguaucagagcaucugugcauacaggacauucuguuauaaccuaugcacaauuuuguaugaauggaguggcugcucacacacaggccuagaguaagagaaauaacacaacaaccccauaccaagaagcuugcuucuagacuuccauaagacgccagaucuuuuggaaaguggccagcuauaauuauauaccuuauaaauauaaaaacaagugauauucuugcuccugaguuucauggaccaaauguacgcccauuacacauauuacccaaaagauuugcaaugguaaaaguaauagauugaaggcauuggaaaaaaauguacuacagcagaaaaacuacaucagagaaucucuagcucuugcagaagaaaaucuggacuacuaaucauucccuucuaaaauauuccacuauguuacaauaaaaaugacaccaagcacagugauaagaucaccauuuaacugaaguaacacuuaaguucuaccuauuuuuggcaaugucuuugauuuugauagugaacauauucaugguggucauaauucucaucaaauuuauggggaaaaaagcuggagaguuuggagugcacguuaagaaauguuggugcaaucagaauacauuugccuucuuuuuuuaacaagcaaaauccaucuuuuuccucaaaaaaacccuaaggagaaaauuauuuucugcugaaaaaauuuuauuuucaccaaaaaauaggaauaaagaugaaaugaaaauuuauacugacaggccuuuaguuuucuacacuacuagauuuuuuccuuaauaggagucuguacugcuuuaagaauuuccaaaaauuaauuuucucaaguucacaacccaacuuguugaaacguccuguugaaaaggguuuuaagucugggugacauccuuucugaagugucuucuuccucccuuuuuaaaaaagccuuacaugauuuuuuuuuccagaacacaauuuggaaagcuuccaaggauaucaaagaaaacuagaagcuaaagagaaugcuuaaguaucaaauaugaaaacaaggaauucaugcgauguuuuguaaucaccucuaugugggauauucaguggagaacagacuuaaaagauuauauucuagcauauagucuaucacuugaauagaucaauguaauaagcaggucgagugugcacauaacacaaucuauuuucuucaagauaguguguuucuaugugugguaucugaguugguugcaucauacucaucuggauagcuuuauaaacaugcaagccuaaaccuuaccuggggcauaaugaauuagucucucuugaguggaggaagcugggaacaugcauucuacaaacuucccaagucacucauaggagcucuggagucagaaaaauccugugcuaagugcauuaagaauucuuaacagagucaagaaugcccuuacaaggcugcuauggcaacaguccacacuuauuuuuaauuaaccuuugccucuaccaccauacauuuauugaacacauuaugcaggaacaauuaccagagucuugccauguauccagucauacauaaugccaauguaugaggcaggcacugacaauacuccccauuuuacagguaaggaagcccaggcauagaaaugcugagugauucacccaaugcuacacauccuauaagagacgaagccaggcuuugaaacuagggcaccugaucuugacggcuacaugcuuagccagcucacuucauaaucccaaguaaauaaaaaauaaaggauuaaauccacaauuauuuguucccaaggccacugucuuucuacuaugcauguaaggucaagguugacacugacuauagcaacaaugucagugcuucucaaaguaggggucccuagacugugucagaaucaccagaguuaggagcuuguuaaaaaucaaauuuguugguucuaaugcagaccacuacaccaaguuuuugguggacagaagacuaaauaucugcauuuuacuauguuccccuuggugacucuuauacacaggaaaguuugagaaccauauuaggcaaacauaaauuuaaagcagcaauauuaagcuugcaaauaacggggccgagcacaguggcacacaccuguaaugucagcauuuugagggaauaaggugguggaucacuugagcucaggaguuagagaccagccuggacaacacggaaaaaccccaucacuacaaaaaauacaaaacuuagccaggcaugguggugcacaccuagagucccagccacucgggaggcugaggugggaaaaucgcuugagccugggaggucgaggcugcagugagcuaugauugggccacugcacuccagcccggaugacaggacagcacucugucucaaaaaaauaaauaaauaaauaaaaauuaaaaacaaacaaacaaacaaaaaaacacaaagagacaaacauaaaaccuaaacuugcagauaaugagguucauggccuaaauuagaauuaagacaagguuaagacagugguucccaagugaucuucucaaauugugaacuuaagagaacuugaggugauuuauccccaggggcacugggcaacguguggauauauuuuugguugucauaacuggguggaugcuacugguaucuagugaggagaggccagggaugcugcuaaacagcuuagccugcuugggcugccauaacaagugucauacuacagucuggguggcuuaaacaacagaacuuuauuuucucccaguucuagaggcuggagguccagggugcaagcaugguuggguucuggugaggguccucucaaucauuuccauggcagucuucuugcuauguccucacaagguagagagaaaauaaacucucuccugucucuuccuauaaggacgcuaaucacaucauaggugccccacccucaugaccucaucuaaaccuuauuaucucccaaaggcucuaucuccauguaugaucaugcugggggcuaaaacuucaacauaugaauuagaugggagcgggguacaauucagcccuaucaacaucccacaauucauaggacaguccccaggagaaaggguuaucuggccuaaaaugucaauggugcugauauugagaaacugcagauuaagguauuaggaaggaaaacaguccucucuccaaccuuuccucaguagcagccuccucuugguagggauaauuuuuuauauugucuucccuaccuaucauucccaccauuguucuaauauuuaugccuagcagaaguagucuccuuucauauaaacaaauucuacugguucuucauggccuaauuaauacuucuaaaagccucuugugaaugcagugcucccauccuuauugcccuugaucuaaaauucaguuuuacuagaagauuggaugacguggaauccaaaaauuuagagcugaacucagagcccauuugaucuaucccaauauuuucucacagggaaaacugacauucagagaggcuaugggagaguagaaagugcacaggauuuugacucagaucagaguuugaacuaagcuuugucucuuaccaaauagcagaccuuacaaaauuuuaaccuauucaugucaugauuuuaaccuauucaugucucccuaacccacuuuacaaggcauuaguggggauguauaaaaaugcauaugugaugugccccauuuggucucuagggcacaggaaauauauaacacaagucuggucucuuuucugucccagagauuuucaaaggcuugucugaaauauuaaaugaaugauaucucauacuuaaugugucguaaauauaaugcuagccaaguuuuaacuuuaagcucuugacaagcguuugaguugggcacuauuauuaacuucuuuuauacagaugagaaaaauugaugagagguauaggauucucucaagguuucacugcuaauuaacgacagugccuuauuuuauagcucugagagcccaauuccagggcauucuacacuuaaccacacacuauacuacucaaccgacugugacaagaccacagaucuccugauuccaguuaaguguucuuucuauuaggccaugaauguuagcuuugucucccccaaggaaauguuaaaugguaaaagcagaggucaucucuugugcuuauucuguuuccccuucaaugcugagcucauagacagugcucaauaaauauuugcgauugacugauaagagaaaagaaauaaauagcagccugaaaaauggauuuccuugcugugucaguuugaauuaauacuauuauggguugaaaaucacaccuuguucuccauucuaaagcuggccuaccuaaguggggugaagaagagcuguuuuacuuccaucauugucuuacaaucuuauaaaagcaagcgaugcuucccugagucaaugcuaaagaacagcauuuguguucacccaggcccaaggcacgauuaagugaacuuugguuccacaggaaggcugccuuuauucaguuugguuguuaauaccucaggccuacaaauucaucuuuccaccaauugcagauccuaaaggaagguuuaaaaaggugaaggaaaaagcaugagcuucaguuccuuauugcaggccccucucacugcuagacucugguggguauuuaggagaugcaugggagaaacagaaaggaaaauucuugacuccagucagagcuaaggucccuuuguuuucugcucugagcugucuggagauuaauuaauaagagaaaagaagacgaggaugauggcaacaaugaugggagccuuagucuagggcuuucucugaggcugcucauucugguguuuuguuuggcaggggaagugguuuaaauauuuaaauucauucaauuauucucuugucuuccagaagaggggaagguauuaguaucuccauuuaacauacaggaaacagagagggguaaaaaagacagagacgguauauuaauggccuaaaauucuaucacccaguggaucauccucuugcucaagccauggcauugggaaggcaugguagcuccuuggaaacagaaguggugcguguauuaaggaacaaaagcaagauggagccagguuccacugaggaugggggucacugcauguguguugaaagggcaugagaugugagcacuugcuaaguggcucauggcugguuuggaguaaucaguuuuuagacuaugguccugcguuccuggcagugaauucucuagaagguccagauggcugggcaauacaacuaagaagacacuggucuauugcuccugccuucugggcaacccuggagcagaacacaucaauuaacugggagcuuugagaauagacucaugaaugcccacugaccacaucaccauacugccucaaaaggguggccuaaaggggaaucacuuagaaaggcugagcuugagauaugggcuaaucaguggaggagaaucacaaggauggcccaugugaagaccugcugauauagaaaaauaaaugaggaguugucauaugugugaaccuguuacaagaauauacaaacuuauuuugcaggcuacuaguccucuuagagccaguccucugcaagugcagaaagaugcagaagaaggauagugccaccugcccauggaggacugccugaaagacuggugucucccuuuuguucuggcuucugccuuuugaccuaggaaaauggcucaccucggcaugucuugcuccucagugcuacugacugaguuccccaccucuugccucuucugaaucaggccuucgagaacaucaugaccucuccuauuuuaccuaaucuuugggcucaacuuauuucuugugugaccuuugacaucuccuuggccuccccauucugucuccauuucuuuacuaaacacauugcuugccuaacauauuauauuuucagaccuuucuacacucaugagcucuucucagaagcuauagaaccuaauaucuuggaguugcaaaacagaagucacggagaucaaaaaacaaugguguugccugugguauaagaauuauaauuuuuaaaauuuccucuguggaagauaaggcugcuuuuauauauuuuuuugcaacccaacaugagcuucugagaaaaaugacuucauuauaaaaggauauugaguauacugucaacaaaacuaacaacaaaacugucauauguugaccuuaaacugcaucucuucaacuucaaaucguugcacaaauugguccugcccuacuccuuccugaaaaaugaagaacuacacaagaggaaucaaauauccagucugaacagcaaaaggacaccucaucaaauagcaaaaagcaacuucaccaauaauuuuuuuugaagucucaggguagacagaaaccucaaaauuuuacccacugcgugaaucccuacacaguucacaaauauccuggcucuuucuccuuccacccaccauguaggauuuacuuccacaaguacuugaacguaauucuauccagguaaacuuucuuuaguccauggauguuaggggaagcaugugccauuuuccaaugaaagcuuuagaagcuagugcauguuuggccacauuguuugccucagccacaaauacuggcauauuccagauaguggccgcuucaucagucuugcagagaggaugguggagagaaaccggugcuuccaaguaacccugggacucucaauggaaaguuaugaagaaaaauuaagucuaugcuaucuuaagccauugagggucaggguugucuauuacaagauuacuuagucuauucugccccacuuacuuggaauaauuucagaucaugggguggaauuuuaugucacaggauaaagaaucccccuaagagaugucaaauaugcuuucauagcauuuagaucacaaauucccguaaugccuuuuuuucacugcucaacugaacaccugauucucccuauaaaguucuaucuuccuucuuuauccuucaucaacuuuauccaguaaggagcuggaucugcaaugaucuauaacaaagccuguaaggaacauucuuagggacaaacagaagucuaacuucgucucaaugugugagcaguccuaugcccaaauaugcagaugggcaucuuagaaggcauacugauuagcccaugauagccaagaacucagcagaaacaccauuuacuuauuuaauucuaagauuuucuuaaaacuguggaacucauuuguccuaaaaagguauugcaauuuucugcuuaccaagacucaagguagacuacuccuaguucacauugucauuuuuuuuuagaaguccaggccaauguccauuguucuuucuaaucaccccaugguuguuaagauuucugagcaaauacuugcaggucuuuugggugauuaugcuauaaccaauaaacagguggcagagagacagugagcaaauuacuaaacaccaaaaucaauccuuuccagacuuugcuuaaaugcuacuuucucaauauaaccucuucugaccacccuacuuaaaacugugacccuauaugucagccucccuuacugcucuacuuuuccuguuuccauagcacuugucaucuucuauuacauaaguuauauauuuauuuugucuauuguuuauuaucugccuucuauaauuagaauuaagcuccccaagaguagagaucucuguuuuguucauugacacaucucacauauucagaauacuauuggcacauaguagaugcucaguuaauuuggacucuagacucaugucuguuaccaacugcuaaugucacauuucuuagaaaagaaacuugccuuagcuuccucacugagguguuccaaggaccaaguauauauugaggaaaguguuuucaaauaauauaaaaccauacaauacaaacguauaaaaauaccuuauaagauaaggccuggcgugguggcucaugccuguaaucccagcauuucgggaggccaaggcaggcagauucccugaggccaggaauucaagaccagcccggccaacguggcaaaaccucuucucuacuaaaaaaauacaaaaauuagccagguguggugguuugcgccuguaaucccagcuacucaggaggcugagacaggagaauugcuugaacccaggaggcagagguugcagugagcugagaucacgccacugcacuccagccugcagccugggagacagagugagacucugucucaaaaacaaaacaaaacaaaaaaaccuuauaaacacuagauguuauugucaagugcagcuauaaccaaugcuucauuuauucauauaaccgccaacuuuuuugcaaauauccuaacauuaaaaugcagcaggggaagugagaaauaaauugaugaugaauuuuucccgacggucuuugucgacaggguaaauugcuguauguaauagaugaccuggcuguaguugaugcagcaggcaaaagacccgaaaguagucaaaaaauuauuuagacuggggaaagucuagcucauaauuacgugauauauucaauaucauuauuguccucacuucccacuccuacuuuauuuacucauauaauuuucagugaauauuuuauuaucaaaaagagaaagggauuuuaaaaauagcuauucccucagcagcaguggcaacaggcugcuucagagaauggcagcugcucaggcuaggaaaugaaauuucucagacagagcauaaaaaggaguggucgauguaauacucauccuucauucucuaugagcccuuuuagcaaacaaggucuccugugauuuuucacauccuggaggggaaugcuauagacuuuggugaauaaaucacagcagagggaaaaccuugcacaacucugcauccacuaccuaaaggaacagauggaaugaggaguaucacuaguuggaucucgacucacugcaacagccuggaccagacucuagaguucaaggaacucccugaugaagucagguuuauuuuauguaauacaauugaaaaguuugaagauauuuuuaaauaaggugaaagaaucuguaucagaaacaaaauaauuagugaugaccuagaccaucauaaaauucaucucuggggugugcaauaauuggcauaaauaaugaguaaaaauuaaauguaaagccuucaaaacaaaugaaaguauuucugcuucccuucucucaaaaacaaaacaaaacaaaacaaaaaaacuaacaaacaaacggaaaaaaaaaaacauuuggcaucguuaugggugaaauuguguucucccagaauucauauguugaagcccuaacuccauaauuguauuaggagauagggucuuuaaacaggugauuaaguucaaaggagcuaugaggaugggcccuaauccaaucugauuuguguccuuauaaaagaaaaacuggacgcaggaggagacucuagggaugugcgagcauagaggaaagaccaugcgagggcgccgugagauggcaucuguaagccaagagaggccucaggagaaaccaaacuugcugacacuuuggucuuggaucccuuguuuccagagccaugagaaaaucaacuucuguuguuuaagccacucaguguguguuguuuuguuuguuuguuuguuuguuugagacagaguuuugcucuuguugcccagucuggagugcaauggcugcaaugcagcccagucucggcugacugcaacuucugccucccagguucaagagauucuccugccucagccucccaaguagcugggauuaaggcacccaccacuaugcccagcuaauuuuuguauuuuucguagagaagggauuuuaccaaguuggucaggcuggucucgaacuccugaccucaggugaucugccugucuuggccucccaaagugccgggauuacaggcgaaagccacugcacccggucagugugugguauguuuuaauggcagcucuagcaaaugaauacuguaccuauacuuuagaacuguccauauuuuaccaaauagcuuuagaacuaaugccagaaagaacaauaacugccaacaaaauaaauaauuagacucgguaaauaagcauugacucaauaguaauuaugcauuucuggauugccuuugacaggaucacuuggaagcuaaugguauuuagcaagcugacuaccaugacauaugacaauguauccauuuuuugacauuaaaaaauaauaaaguugauccaaaguaaucaccuuucacuuuuaucauguuaaacccuuguuuuccauaaccaaauuuuacuuagaaaugucuagaauucaagccucccccaucccuaaggccugaucuuauaaacuggaauuuccuaaaguauguuucucagugacuaaguacguugcgaaucuccaaaaaguggcugucuuaguguguucaggcagcuauagcaaaauaucuuagccuggguaauuuaucaacgacagaaauuuauggcucacaguuccacaggcugcaaaguccaagaucaagggaccagcagauucagugcccagugagggccuuuuccucauagauggugccuucuaaguguccucacagaaggugccuaagagacaaggcagccucuuuuauaagggcauuaauaucauuuaugaggaugaagcccucauuacccagucacuuccuaaaagccccaccucuuaauacuaucacucugggaauuagguuucaacauaagaauuuugaggagugcuauugucugacuguuuuucucuccaaaauuuacauauugaaauccaauccucaaaguggagguauuaagaggugaggucuuugggaggcgaggagguccugaagguggaguccuugugaaugggauuggugcgcuuauaaaagaggacugacagagcuuguuugccucuuccaucauaugaggagacagcaagaagccuccaucuuugaagcagagagcaagcccucaccagacacuaaaucugcuggugccucgaucuuggaccucccagccucuggaacugugagcaauaaguuucuucuguuuauaaauugcccagucuaagguauuuuguuccagcaccaugaauagaccaaaacagagggucacaaacauugagaccauagcagcggcuguagcaugaggagauucccacauauauauguauuugaacccaugcuuccccaaacccccguuguuguuucccccaccaccccccagagcaucucaugagaagauauucuggaaaauguuucuuaugccagagcuucacaaacuugaacauuacagaaaugaccugugaauccuguuaaaaugcagacccaagagucuauauuuccaacaagcucccagguaagaccaaugcugccugggggcacacauagaacaaugagaccuuuugcuuucuguaaccagcaugcucaugcccuggguagcagugucugucccuugauauacuugaacacacucaucugcaaacacugaccugccuucagagguugggagcgaagccacuaaugucgaugaccgugacucuagggauaaacaugaucuuccugccucuguauauuguccucacuuuggauggggcuuauuuacuacagcacaugguuuccaguaacugcuuagaaauauccugcauucuuacuaucuuuucauuuaaaaaauuaagcaggagaucacuaggcagagaauugggagagaaauuccuggcucaauguauugcaggaguuaaggcucagagguagcaagugugcaauaugucagggcacuauggaaagaugcuaacuguaugaaagauuuauuuuccuuucuuaaaagggauuaauggaaaguaaaacuaaagguagauugaucauaggccuauccagagaauuccaacaagaauuuaacccucagcuauuaagcgcuuauggaguaugaacuauguccgcucugugguugcauuuaauaacugguccucaacuuuaugggugauaugaauggaaugggccuugccaucuuccagugucuucuuuauacacaucuucuccagcauauucucuaccuaccuguuccuguccucuuucauuagaggcuuauuuuaagcuagcugccuuaguuaaaaagaaaucagugggagaauccuaauuagguauuacuauuugaacaacaguaaaauguccccuucuggaaguaguuucagaauacuagggcaucuuuuuaaauagugagauuauaagcagcaguaagaucacagagaaaaaaaaaauugugacaagagguuuuuaccaaauuacuguggggagagaaacuguugagaauuuugaguaaugguaauuucagagauaaauucaguuaagaaacaaaccuucaccuauuucuuguguuaucugcugacugcauucauaucaaauaauguguguuccaaaugaacugauguagguauagggcacugagugugcauaugcauauuuauuuaaagauuauagagaagugauucucaaccagggaugauuuugucccccaggaaauaucuggaucauuuuugguuguugcaauuagagggaagugcuccuggcuucuaguggguagaggccagagaugcuacuaaacauccuauaacacacaagacaacccuucacaacaaagaauuaucaggacuaaaaugucaguagugaggagguugagaaacccugauacacaauaaucuuauuuuacuccuuaaguacuuugauuuccauaaucucuacccaaggaaaaaaaacucauucaaaguagaggaaaugaggccgggccaguuagcaucucuccauagugcccugacauauugcacacuugcuaccugugagccuuaacuccugcaauacauugagccaggaauuucuuucccaauucucugccuagugaucuccugcuuaauuuuuuaaaugaguguuaguauucuaacacuuugggaggcuaaggugggcagaucacuugaccccaggaguuccagaccagccuaggcaucauggcaaaacccugucucuacaaaaaacacaacaaauuagccaugcagucccagcuacccagaagggaucaccugagcccagaaggucaaugcugcagugagccaugaucaugccacaccacuguauguuagccugagugacagggugaaacccuggcucaaaaaaaaaaaaaaaaaaaaaaagagacacagaaagaaagacagacaacaaugacaacaaucgaaguagcgaucaucagcuccuucgaagucaugaucaucaagcauaguuuuccagaaugaaaagcaauuaaaaguacaccaccagaauagcuacaaguacauuaaguuucugcaaaauuauacauguuuuugaacaaaacagaacauucacugcuuugaaaguuguuguagaagcgauaaguagaaaauuaugagcaacuacaugaaaaugaaaaccucucuucauuucuaagacaacuugucauggaaauugucauuucacgcuaaaguucuccaagauaggcuaaagaaauauuagcuuugaugcuuuucguuguggauguacacuuggacucuaucaggcaagaaaaucacuugcacacaugucauuaguauuuuuugaccgugagaaacucuucagaauucugaggcagucauuuauuaacaguauuugagcaaaagccuuucuuccacaauucuaguuaagcaauugggacaaagguugaauuguuuucaucuugagaaaaguaauuguuacucucaaauuuccaggcaaaaaucaaaccaagagaauucauuggacaucagcaguuuuuccccugaaaacuaucaggagaaauaauggucaauaauauaaccuauauuuguagcaaggcacuagaaucuacaagcauauagaauaaccguuugaaagguuucuggugacaggaggaccauggggagaaauaagaaaggucagacagagucugugaagucagugagagaggaaaaugguccucaaggcaaaauucaagggcagaaaaacaagaguuuaacuuaugaauuagagcugcaucaggaagagcugugagcagaggcaaccagguucccugcuuucccuuucuuuucccacuuuccuccaacauaugaacucuccagucuuccuuguucugcuugucugaacuuuugacccugcggcgacagccugaaucucuccuccugcacuguaucuagcuguauuccccguguccucugcaagaauggggcccgcuuuaauuccuuauugccccauuauuuguguguuuggcuuuggcuuuuucagcugugaaccuuaccuggagggguaugauucacccuccacaguggucacugagauggcgggguucccaccugagccccuuccccagacggggaugaggcuaagacguuggccagccaggauggacacaaacaccuggcuggcaugguguuuacagaauaggcacaggaaaagugugccaauuuggauguaaauugcaaauuagguuuuuuuaagcucuacguaacagagauacuugaagucaccuacuugaaaagacuugacuuuuugagauacuugauuguggggaugaaaacagccucuuuagcugaguguuguguugggauaggucccaucacaggcuauuuuuaguuugcaaaacuauugauccauaaaguacucuacugccccacugccguuaacauucuccaagucuccagucucugugcagaaacugucaugacauuuuacagaaaagcugagcaccuuuucucauacaggcagccugaaauccauuuuuaaagauacauuacaggcuuuaccauccaacuaccuuguauucuaaaauuaaguuauaaaccacucuuuucaaaaaaaaaauuaaguaauaaaauaauaagaaaauguguguggguaagggaaggugauagagcucaugugucuuggauuccccuccuaucaacuugguaagagaaucauuugguugggauacuuuacagauuuggaagggcagguuuguucuuuugaucuuccaagaaaagguuuagaaaagauaaauaaugaggguccuauuguuuuaagagaaaaaauaacaaucugucagucuaaguaaguaacuauauuuugguggccaccgguauuaugugaaaauauugacucaauucccaggcaccuuggaugugugauauucacacuuuguggcagcuccagaaugucuaaauaggagcagccaaaggcagcaaucuggugggaagugguaguggggaaauuuucaaaaggugcauuuguauuacaaacaguauuuacuuagauuuuuacauuaaggucaauuaaaacaucaauuuuuuccccaaaagaugcucauguuguauuuuacauaugauuaaaaaaaucuguucuuuagaucaaagaacauguguaugugucuaacacacauacucgcacauacuggaguggcuuugagggacagagaauguuucuggagacuggaaaaggaugugcuaauaagcaaaacgauguuauucaagggccugguguacuguaagcaaaaaauacacucuagaauuuaaagauugagugugaaaaaagaauguaaaauaucuaguaauuuuuauauuaauuucauguugaaguaauauuuugguuauacuguguuaaauauauuauuaaaacuaaaaaauaaaaagaaugccacaccaccugccaacccugggcacuguggccacucacaauuacuggcuuuuaccaacaggcacuaaugugccuacagaaaaagaaaaagaaaaaaaaaaccaaaaaguugaagcuuuuaauuuuuauaaaccgauggucucaguuaauaacagaaugucauuuagcuaagguguagguuuugguaugugacaggcacagaccuauauucccucuuuggcuucuacuuacauaaugaccaagcugauuaagaguuauucaaaccuguguuucagacaucggaucagucacagaccuaaguuaugggaguacaauaaggagugauggguuccauauugccgaucaguucacgauuuagaacagcucaacuaccagcuguacuccaagcuucaguuccuuguucaccugagugugaggccaccugggaaaccacuguaaugacauguuuuccuuguaacccacaaauucaagauucaaccacaaaugcacccuagaacaugucuucccuuuuccuagaaucugaaauugggaaagguccugagaauuguaaaauaucaaagauaggcggcaccuaaauagugacaagccagaugcaaaaucugagggucagaggauuaaagugaucuguccacacacacagcaguagggguaaaucauuacacaucaaagaaacuccagucaucagguccaaaggacccaauguugucuguuaagguaaggguugaaaguacauacccacugagccuugggcaggcuuugugaaguugaacuccaccuccuucuaaaacuaacggagucaaagaaaccugaaaacucauuuuugguucuaaaaagcaaugucccaauacacaaucccucuccaacuauggcuucaggcuggcuagaaggcuuugugacauuaaaaaucccucagaguuagaagaaauugaacuucuaacaucgaagaauuuuuuuccugggcaauuaaaacacuucuugcucuuacauaccacaucauuuuuacugggggugacuuuuuuauuuuugcauugaaggugucugaucuuaacaauauaagguuauaacuuuucugagguagcugcauaauauauacacaccuuucaacaguugcagaaaacacaaaauacaagagaaaacauacauauauauguauauacauacaugcagagaauagacacucccuacuuagaugaugaaacaccaaaacuaauuaguauaacaaaagaccaaauauuuucuaccugucugcagaagcaacaugaaauguaaccuucuaaugucuaauguggcaacacuacuauuaaaguccagaugccaguuuccugggaaucuuucuaauccaucacaccacucuuccucaacuuuggagaguauacuaagcaauauuaccaguaugcuggcuuaugauuuuauuauggugaggguaggcagguaaggaauguacaagguuaauauuuauaaauaugaaucuauacagguagagcaagcauauggaacaggagaaagaacauggaccccagggaacuugaauucauuugguucugucacucauccaucaucuagugacuuuggucaggcuacuuuuaguuuccuugagccucagguuucucaucugcaaaauuaugauauuaacuauuaaagcacuuccuuagaggauuagaagagauaaugugugaacauuaccaugguaucuagcauagggaacaagcuaaguguugauucucuuucuccuccuuagguagggacaacauaguuaauugcccucuauuuucuggauauuucuuuguaaggguacuuaauucaccuauuggaauauaauuuggagguuuacauacgguaugguuaguuuuuaucuaaaugucagugaaaaauuacagagacaaaauugagggcuggguauaaagauuuuguauuuuauuuagauauuugaguccauuggaagguuuucauggaaacuaauaguugguuucucuuacauaugaaaaaaauugauuucauaaucauggcucuacgcuuuauaguuugccuaugguauaaauauugaaauguuaccugguaguauuuacauuaugugcauaguuaauucaagcacugcaacagaccuuugacauaaaaauacuaaauguccuuggacuccaccaacuugcaagcaagcuugaaagucugcggcauuuaguaauuugaacagauaugaacgaugcaaacugugcaggugaagacucgugaagcuggugggugagcuuaguucacugcccaauaucaguaccugaaagcaguuugcaugaucuguuccacuaguauauaagaauucuucugcaguaauauguauuacuuucaggguaugugcaguaaaauaaagcuguucucuaaaaugugauuucagagauaugaaauuuaaugccuauacaauuacgccaacaucagcagcuaacauuuuuaaacaauuacuuuggggacagaaacuguacuaaauaauuacaugaaggaucagacuuuaggcuguacagauaccuugaauaagagccugggggcaguguggcacaguggcuaagaauguggucucuggagucugggauacucgggcuuaugcauggauucugccucuuucuagcuaugugacauugggucaauuauuaaacuucuuaaaaccucagguuucucaucuguaauuugaaguaaaaaauaauggcuacuucauaagguugucagaagcauuaaauaagguuauaaauaguuaauuuuaaaacccuagcuuuauaucuaaauaguuauuaagagucuaagggggggccuugaacuuuucugcaaugcuuuauuguguauuauagaaaaccuuacaaaauaugguaggguuuaagaauuggggaauucuuaaauuacggaggagaauaguacuggaauauauacuucuuaaaugacaaaauuuacuguaaguuuaacauaagugagcugaacaaaauagcucuuauagaguauuauuauuuacagaauugcuauggcucaauugauuagagaaacuucaguaacucaguuguaguucaaauauuauuagcuguauugaggaaggcagcaaggagaaaaagggguaugaaaauauuggguuugucuuaaaaaaaugcauggagguccaauuccaucaauguaguuuuuuguuguuguuuuguuuuguuuuugagauagcgucucacucugucacccaggcugaagugcaguggcaugaucaucaucaauauaguuguugaugcaauuuuucuagauuuucuuuuuaguucaugguuugaaacaaggcccuggaacauacaaaacucuuacauuuauuuaaacccaggacauuuguguagggguuuuaggaccacaucuaucagacaacugaagccagagccaacugagaaacagucugggauuguaggcuauguuuuauuaaaguuucaacugauuaugucacugcagcuuaucaaaauauggauucaucccagacucuucucugucucacacaucccaacauccaauaucucagcucaaccuucaaaauacaggaaaauugagccgcaucuucccacugaccuugccucucuucuagucauaguacuaaucacuugcuggacuauugcaauaucauuggacauauucuucuuucuuugcuuuuuauuacucuauauuuuccaucaagcagcacugugaacuuuuaaaaauggaagucagauuaugucaugccuuuguucaaaaccuuccaaugaacucaauaucugaguaaacuacaaaaucuuuauacccagcucucaauuuaaucucuguaauuuuuccucucauucucggcuccagucacacuggucucuuuguuuucuaccaaacuugcaaagcacacugcugcccuggggucuuuggacuuguuuuuuucacagucuggaauguucuuccacucccuucacaucuccauuuaauagucaucuuagaagggaagacuuucccgaccucacaugcccuccuccuucauucuuuaucauccuacucuguuuaauuuugugcuacagcacauaguucugccuuacauaguauacacuuaccucucccuuucuuaucuuucccaagagaaugcaugucccaugagagcaggaacuuccucugauuuguucaugguuauguugccagcaacuagaccagcaucagcacaugggccucucaggaaauauugcugaaugcagcauugugcaaggggaaggauuaauugagaagagcaauuuacucaagggugaaaggaaggcacucuggugcugaacugauggaugaucacauuagugauucugaguauuaggguuugacucugacuuccaagcccugaauuuccaguagauacagcuucucauccuucauggggcacugcuaucaggaguaacuaagucaagaagaugaagcaaagaauugagauucccuugucuaacucaucauugcuauggcuucagugcuguacuuuacuuugucagauagagccagcucccucucucacauccacuagcugaggaugagaacccaaagcaugcuugucaggcagaggacaggaaaggaaugauaguggaguuagggacacaacuuugggagccucuugagagaguuaauucaacucagggagccucguagcaaacagcagguguuuucuacuugguacaaauaguauuucuucacauuaguucuucacagauuugaaauuucuucuugguaauaaauuagacaauuaaaaaaguacaaugccucuuuacugcugaucuccaaggugaccuuuaggauccuacaacugugcuauagaaauauauucccucaggggcccaaaagcuggcaacaucacuggcuacauuuauuauuuuauucucuuuuaagcaccaucucuuucuugaauaccugcuauaugcuaggugcuuggcuaggagcuggguuguaguuaggauucaauuagaccugaucucuuuccuaaaggaauugguaaacuaagcagaagaacuagcauacaguuguagagcugaaugguuacaauccuaaaguaaaagggaugucaugaagugaaagacguaaggaacugaucccaccuggggccaugauauucaggcugaaagcugaacaaugccuagaaacuagaggaaaggauagaguggggaaugcaucaggaaacaaacaacacaagcauaggucuaggaugggagggaguaugacacauuuaacaagcaaaagauggcaaguguggcugauuccuuguugggggugguggaggaaggaggggacaggacggugagccugaagacugaagagaaggucaaauccugaaagccacguaagcuucuuuacaauguuggucuuuaaccugauaagaagaggaagucucugaauggccucaggcagggaaauuauaugauuuuauuugcauuauuagaaauucacucugacugcucugugcagaagggacuguagagggccaggcagauaaaagaggccuguggggaggccacugcaguugccugcacaauagaauguguggcuugcacucaggugugcaugguagagaugggaggagaagggaaagcaggcagguugacugagcaggcaagcaauggaaggaauaaaacaaguucagaggcccaaaauagcuauguugaucuugcaucucauuuucaagauuagcuuuuauuuucauuguggcgaugcauauuuuguacccaaauuacacccacuccaccccagcccugaccgaacugcuuugcugcugaguugccauaauuuguauuccauuucuccagaaggcuuagacgugagguaccacagguguuucuggaucagcucggcauacccucagggucggccccacccugaaguccuuagcuaaucuuuagaagggcaugauucugaagaugagaggaaauuacuaauaauuauuuuaucuaguucuacagaugauacuuccuauagugacuuuacaucauaguugaccuguuaaauucuaaucaacacaccccaguggaaguuuccccaaauuuuauuaaauguuuuaaauauuguggagaaaacaacaacaacaacaacaaaagcuucucaaaauuucacuuguuaaagcaauuaugagaacccauauuauuuuuccuaugaacauuuuacuaauauuuuauauauacuaaaacuguccuugcugaggacuuuucuaagguucucaaguucuguagguuguaaaagggcccaaucacuucauagacucuauuuuuaugaaugucaaacuuggaaaaaauggcacacaaauacaagggaaaaaaaacccauaaaauagauagcaaacugaauauacuaucauuaaacucaagaaaaauguugaaggacuaaaaccaucaucacugauucauagauugauuauuucacauauuuaugaaugauucuuaugugauuaauggaaauguagagauucaucagagguuuucaaacagagaucaaaggcgcccugggaaggauuggaagguugugcuuaauggggagaagaggcauuaagugagggaauuguaggaaguagaccuccaagcuuguuauuucaguucagucagaacuguuuuuauugauuuauucauuuauuuuuuugagguauguaagucgcaaaauuuccacuggauaaaaagaugucugacuaaaaauacuaacaacaaaaacaacaacaacaaaacaccauaaacuuaucuaaaugagcccucucaggaauuugcgcuucuugacaugacggaguagccuacaagagacccacuugccugcugagaaccacuagaaauacacaauaaaagcaauuugcuugaaagcaaaggagagcugccaaagaugucaaaacuuaaacuacaucaaaaagagaggcucauugaggggagccuaaccuuccgccugucacuccagucacccucgccgggauuugcuaauucuuaguguugaaggagaaucugagaagucagaaagaaggucgcugcugagaggaagagaauuccuuggaguuuucagcaaucucauagggcugaggaggcagaaaauggagcugagcacagccccgcugaggcagccaacuuggacuuaagaucccauagagaagagagguucaaagaagcgagcuuggagcuucauccccaguuuuuccccaaggcguuugacagucaguuaaguugcaaauagcaacaggcaagaagcaaauugagaccauccaaaaagcaaggcaaagcaaacucagucucgugguguuaaaaaacaaaaauugggguuugugauuucacaaauaaggugacacaucugauccucaguuggccacccuggaagauuauucuucaggacuguggugaaagaaggguaagcuaaacuuuagaagugcuacaaccuagguucaagucacuuugaucuuugauuguaaugaaauggucugccucucugcugcccaacagaaaauagggugaauccucucuggaaggagaacacauuauccagacccucuauaucuguccacacacauguuugccauucaauccaauaucacccagcauaucaaaaaacacaaucacaagaaaaauuaauaaaaacagacaagcaauaaagucugucuccauuuucaaagccucauagagucccauaauaguucacuuaaacaugucuaaauucaauaauaugaaacauggcacauuccagucaucagucagacaauaagggugaacuguaaugaacagugcuagucuauuuugaauguuugcugggccgggcacgguggcucacgccuguaaucccagcacuuugggaggccaaggagggcagaucacaaagucaggaguuugagaccagccuggccaacauagugaaaccccgucucuacuaaaaauacaaaaauuagcugggccugcuggcgggugccuguaauccaagcuacuugggaggcugaggcaggagaauugcuggaacccgggagguggagguugcagugagcagagauugcgccacugcacuccagcccaggcgacagugcgagacuccaucucaaaaaaaaaaagaacguuugcugacaguuuuuaagucaguccuacccuucccccauuucccuuuuguccccaaaaugggcaaacugauaagaggggccaccuuuuuauugcuauugggaaauacaaaccacucaaauccuggcugucacauagaaauccugaucccagccacaugcccuaacaugauaaaaacuaaacccacuuauucuucucuuuguuugaaccauuaugaacuggcaugguugccugcucugcugucccugaagucccauuacaugagcaauaaaccugucuggacccucuugguggguguguugcaucaucaauauuaacaucccaguggauuuuggauguguugggggcugccaucuguggagccgccccaaaacaaaaacaaaauugauccaaacauuggaguucuuugacuuaggcuuuugaaauaacugugauuaauauuuuuuuaaaggagaugaccugauaauaaauuuuacuagagaauuggagucccuuuaaaaaagaaucaacuagaaauuuaaaaaaaaauugaacucaauauauaaguuuugaguauauuggacccacauggauaagugaacuuaaaauuagagcaguagaaaauaaccagacuuaagcauagauuagagggaaauuuauauccuuaaaugaguacagcacuaaaauaagaaaggcaagaaauuaaugacaugauuauccauuccaauaaguuagaaaagaagaaguaaguuuuacuggaagaaagcaggaaaaaaccaaaaagaacuauaaagagagcagagauaaauaaaauagaauacaaacaaaucuauaaagcugaaagcuuauuuuuaaaauugauaaacuaucugcaaaacuaaucaaggaaaaaagagagcauacuaauuagcuaaaugaggaguggggaaaaaagaaaccguacugcagauccuuauacaucuaacaaaaaauacaaauguauuauggacaauuuuaugccaguaaauuagaaaauuaaaugacaaauuccuagaaggcaaauuaacaaaacugaccuuaaaagaaauuuaaaaaaauuaaauagucauaugauuuuaaaccuuuccacacucacauuguuuuaucagugaauucuaccaaacauuuaaaaaauaaaugaggcucaucuuauacauucacuuccaaaaaauagaaggaagaaaaaauuuucaauucauuuuuuaagggaaagcauaacuuugauaucaauuccucugaaagagaauaaaggagacgagaaaaucaucucaacaucugcagagaaagcauuugauacaauucuauaguuauucauaguuuuuuaaaaguauuuuggcaaauggguacuagaacuagcuugaccuaauuaaaguaucugaaagaaacauagagcaagcaauauaauuaaugggaaagaacugaaauuuccccacugagauccagaaaucacaaaaauauuuaucaccacaauauuguacuguagguccuagcuaguacuauaaugcaaggaaaaaaaaaaaaacaaacuauaaguauugggaaagaagaaauacacuuauaugguuuggcuguguuccuauucaaucucaccuugagucguaauaaucuucaugugucaaggguggugccagguggagauaacugaaucguggaggugguuuuccccauacuguucuccugguagugaauaagucucaugagaucugaugguuuuauaaaggggacuuccccuguacaaguucucuugccugcugccauguaagaugugucuuuccucuuccuuugccuuccgccacgauugugaggccuccccacauauguguaacugugagucaauuaaacuucuuucauuuauaaauuacccagucuugcauaugauaugucuuuauuagcagcaugagaacagacuaauacaacagucauaauuugcaggcacaugacuauguacauagaaaauccaaaaggaaauuaucaaaauuuuagaauuaguaacugaauuuaucaaguucaauggauauaaaaucaauauacaaaccgacuuuuucauauuacagacacagaaacuaagaaaggugcccauauccacacacuuuucaaaacuagaaaaaggcuaacacucagcucggugguucaaguuuggguuuuuuuuuuuuuuuuuuguauauaugcaaacuuguagauuucaguuacucccuagucacacagaggccagaccacacacuagccccuguaucuccuaggcaucaagacauuaaaaugcugcuggccacagugaccauccaugggaaaugaagggaauaccugauggaggcaaagugcaguuuucugaaauguggagcugcaaguaaucuaagcuuucagcuugucacaaguugaggaucaagaaucacauguagugaacagauuuaccuacaauggaaccuaaagacagaauaaggggagaggguggauguguccagcgccugucacaggagaaaggagaaugaguggaaaaagcugggucuuuggccccagucucauauuuacacaagauguuaaguuugaaauucaaauauguccugcaaaugaaguaaaggcacuaauaggacugaaaguagauguuuaucacacaacuugaaauccaugucccauucuucauccagagugucuacaacacaccaucaaugaauauuuucaguaaacucugcaguuaucuuguaaauguuguaauuauacagaugggaugguauauuuauaugcuaacauuauuuuauuacaugugaauauuuaaagcuuuguagcacccaucagcauuauuuuuuuuuccuccuccucuuucuucccuuccuucuguacccauauccuccuccuucuccgccuuccccuucucaaaauacgaaagugaucagagcuuccaaggucaaccuuggaaagacucuggaucccuaaauagcuaagugaacucuccgagcauguagguggaaugugaagggugauagaaggcuugccugauaugagagaacagagccagaaaaacugcuuugauauuguauuacccuaguuuuagcucuaggcugguauuuucucaagacauugggguuacagcaggaaguucaaagcuuccauuauuguggccaaggcuuuugcacauagaaccugcugacugcugucauggaugauggcucagccuguauccuagagaagcagaggcuugauguaggacuuccuguuggcugggugacuucagcccgaggcaccugcagugcuggauuaaccaaggcgcaaacuaagcaggugcuuagcaugcaacuaaaucgaacaccacccccaucacccacuccaggaaaagcagagaggauuucacauuuaaagaacuuucugaggauuuugauuuuuccauccaaaugaaaaaaaaaagaacuuauuuuccuuucagcuugcauuuaaguuuucugucauuuuaagugauuuuauuuuauuaugaauuaaagugggaaugcaucacaguggugguggugguggugguaggauuaagugcucagagccuguaaaaguuuaaccuggcccuaauaaccauucccuaaauuuuccaggauccauccucaucccuccugggcucuuguucucuagcacacauauuuuguugugcaacaacucuauuuucuauuguauuuagccccacaucacuaauccuaccuuugccaggcuguucguuuucagcuccuaaauuuaggcagccuaguugucauuuacuuuguacaauauuuuuuuucaauauuaccccauaaaauuuugcauuuauaaaacaacucccacagauuccucuaacacauaaaauauacuuacaaugcuuaacuuacccuaguacugccccaagaucuuccaccaaaaguucaaacaucucuuuggggaagguggguuuuuuuuuuuuuuuuuuuuuuuuuuuuucacaaguucccaguguggacagcaucuaggcaccacuggguggaguggacagggguuugaggugggaaaaaagggagaaguguccuaggccuccauucagaaauuuuaauuuacucccucaaaucaaaacugguauucagcacuccagaguucccuuccacuucuuuuguuucagcuccugcuuguuguucaggaaaaauggcagauauguuucagagcaugcuuagaauugugagacagauaaaagaaagaugauucguagcuugauuccuucgaaaggggguacaguaaucagaaaguaaaggaaagaaugauuccaggacuuuauuucuccaaaaauacaauagaauaucucucuagugaaauucuaagagccauaugcagagauugaacccaucgguaaacucuagucuucaggccccuccacacuuaccucuaccaguuuguuggcaugcucacggaaaacuugggcauauucuuucacuuccuuuucauuuccgcucuuugcagccucaaugagaacuagcaaaggaacauugguuuccaggaaagagucagauaugugauccaucacugcuuuccgaagcuacaguugaaacaaaaacaaaaaaugacauacaauuaagaaauaguauaauugcccauuuuuuuucuaaacuguuuuugagcucucauuacccauggagauaauauuccuauuuucuuuuuaaaauuuucccagugcuuacauuauuaaaggaaaaccaaugacugauggaagcaugugaauuaaacauauuauaugucaacuugaaaguuacauaauggccuguugcucaauacacacuauggguccucucccaucaaaggccuucucucauccuucauugacccgaaccuucuggauguuuugaaucaugacacaguugaagaauucaggcucuuugaaaaggaaaaaucuaggcaucaaccaacaagucgggagaacuuuagauaaagaucuaaacuuugaagccaaccgugaaacuuggccacugugcagucuccugcccauucuagauccauuguuuguguuagauagaagcagaaacaugaaacaucuaacaaucucaaaacuguuugugcccaggugcuaugaugacauaguugcuauguuccagaaauacuuauaauuauucuucaagauaaaugagaauaaacaagcccaaaucuucuaacaaugcauaauuauacaucauucccacauuguuaaaauagaaaacagggcagcugcuugaaaauaaaaugaaacugucccugaaaaauuaccuuggugcuguuuuguucauaauuaucugaauguauaugggauauacauaaaaauaaacagaagagaagaugauaaacacucugcauguuuuccaaacaaauauaccuauccaggagcauucaagugaaucucuugauaggaugacacccacacguucguuauuggucagaacaaggaaaauuaagaacaaaucucaauuccuuuuugcacgaauuacuauaacguaugcaaugaaaguauguauaacuuaguuugguuuaacucugaauugugucugacauuuuaccuuauaaaauguaauaaagucuauguaaaguugacaucucccacauacucauuugacaaaguguauuaaauuacugccugggauaauguugguuauuagugagcucauguauaaugugucauuuacugagcuaaaaucuuugcauauuacaucauuucauuccuauuacacacuauuagauaggaaugauucuuauacuaguucuucaaaugaagaagcugggacuuuaaaaaguuaaauaauuugucugcagucauaaguuaacaaauggcagcgccuaggguaagaaggucugaaggagauccuacagugaacacuugaaauugaccugccguggcucucuuccagaacaggcccacaauggaggaaaagauauuuagaguggaaucaaaauugaacuugacagggacaacagagacaaaaggaagagaagguugagauaaaguaggggagauaagaagauucagguuaucucaacaauuagacaaacauauuuguuaauaccacacaaaaauaacagaagugagagcucugggaagcuugaaaagcugucugcaucaagccucuuucuaagccuucaggaagauaaugugcacaaaaaugagcaacuuaaaauuaucaaggccaaaucucauccaaaguuauaagaaaaauuagauuaagaaacauaauaccaucaucccuaggcacacugaaagcaugccagaaagauaugcuuauaaaauagauuaaaacugcaaccuaccauuucaaauaaauuaaaaacaucauaaaaauaauauaaaauauggaagaacaugauaaauuagaauaagaaaaacuaaagaauuaggucaugaaacucaagaaagaauuauaaauaaaagaaaaucauuugaaaaagacuaagaaugaauaaacaccacaucaaaugccauaagacaaauaaaauaagaaaaguuucaaauccaaaaaauauuuuuuaaagaacuuaaaaaccauuuuagaaaaugugacaaauauugaagauaggcaaagaaaagucaauacagggcuaccaggggguccaugaauaaagaaaaucaaaacaagaaaacagaaugaauaccaaaaauuguaaucaaugaaaacuuuccagaauauauguauguauuaaaacuauauucuaauacuguauauuuuuaaauugcugauaagguggguuuuuaauauucucaccaaaaaaaaaguauauaagaugauuaauauguuaucuuaauuuaaucauucauaauauauacauauauuaaaauaucauauuguacuccacaaacauauauauguuaaugaaaaauuaaaaauuuaaaauuaaacaaauaaccuacaaucugaaauaauguaucauguaccugagaagacugacccguaauuaucaaccaagguauuuuccaguaaaaugacugaauucuaaagaaaaacgagggggaaaaaacugcauuucagcaaauauagcauaugauuuauacaggaaaaaauagauuaucaccagacuuuuuaauaguaaagauuuaugccaaaggaaaauauugucuuuaagauacucaaggaaagagaauguaaacugagaauuuuauaaccagcaaaacugacuuucaaggguauaagacauacaaaaucugauaaaaaugcaagaacucagaauauuguucucaugaccuuuuccuaucuaguuauuuuaagaaauaaaauauuuuaagaauuaaaauaucuaggaaaauauuaacuuaaaaagugauagaauauaguauaaauguuuauauacucugacaauaaagacauauuacaacauugugaaaaggggaugagaaagggaauagaaaacaccaaaauauuuuaaguauuuuauguaauuuuaauuauaggggaaguaugaauauuauuauuccaauauuauugcguuuaaagguagaagaaagcaaaugauuaacuaugaaauuuuaauucaucauuuccuauguccuugcuaaccaggaguguugguggggaagaaagcaguuaaagaaaaauucuccaguguuagaucugaaguagaaaugucaguagaaacacaucggauuugauucagcuuucuugagguauaauugacaaauaaaauuguauauauuuaaaguguauaacaugaugauuugauaaacauacauuuuuuauaaacauauauauugugaaaugauuaccacaauugaguuaacauauacauuaccucauauagcuaccuuuuuuuuucuuuauuggugagaacacuuaagaucuacucucuuagcaaauuucaagcauacagcacagcauuuuugcuagucaucaugguguauauuagauucucauagcuuauucacuguauaacuuaaaguuuguacccuuugaccagcauuucccguuucaccacccccaccuccagccccuagcaaccacuggcuuacuuuuuguuucugugaguuccaccucuuguuuguuuguuuguuuuuagguuccauauauaagugaugccauacaguauuugucuuucucugucuggcuuauuucacuaagcacagugcccuccaaguccauccauguugucacauauaaaauauuucuauuuuuauaugguuaauaauauuccauuguguauauaucuauuuaucugccuaucacauuuuuuaauccauuuaucugucaguggauacuugguugauuccaugucuuggcuaucguaaauaaugcugcaauaaacauaggggugcagauaucucugagauauugauuuauuuccaucagauucuacccagaaguucuaguuuuaauuuuuugaggcaccuccauacuguuuucuaugauuguacuaauuuacauucccacaaacaacguucaaagcuuuccuuucuccauauccuugccaacguuugaaaacaugagauuuuaaauugaaaacauaugcauacuugcaaacacuuucucaguucugucuaaugaaaaagacugaaaauaauggcuagccuaguagugaugaacaacuugaaaaacaauuuuacacuacaaaaaaagaaaaaaacaaaaaaaacagagcuucauggagaaagggcugacuccaggcacccugaggccaggaguguacaaauaagcuugaaauaucuugucaugccagguagcaaagaacuaucaaagacucccaggggcaagccagaauaacaggaggcucccauggccaaagauagaggugcuuugaguugaagauaaaagacauucccugccucccaauuaaauuaggcccuugcauacaugaaggaaaacugccuaguguucuguuacugacccaguauugugcauuauuaagaaauguaauucugcuguucggagccuuuguacauuuugaaguuuauuagcuacguaguuggccugcccuaauuuaaccuggaaauagacuuuuuauuuuccuacaaacucugccuucccuuauuuagauccuuucuacuagaagugugggccacugaccaguaccacugccauuuccugggagcuuauuagaaaugcaaaaccaaggccccauccagaccugcuuuuaaccagaaucugcauuuuaguaagaugucuaggugauuauuccacaguauaaaguuugaggaaugccucccuagaagaccuauugucaaauucuuagucucaagcauuagaaacuaauucuagcugauuuaagcagaaagauugaccugucaguucacaaaauaggcaaaauucagaaauguuaaggcacccugugucuuugugacaauagguuuugauucaaaauguuaggcagaccugauuuucaucugggugaaacagagaccagaacucugggucauacguccucaacuaguugcaagaguacaggagguagcggucgggaggaaaguauucuuugaaaacaaguguuuuggccauuuaagcuucuuauacagagauucauaacaugaggaauucucugaacacagaaaaggaacucagauacugacccgaaaacaaaaaaguggccagcaaagaaaagaucugacagaaaacuaauucagggauucaagcaugaguggaaguugaaaauaaauagagauacauuuauaagaaauaauuaaaaggugaagaguuguuuauaaggaacaagaucaaaagcuaugaacuaggacaggaauggcaaguaugcuacaaugcuuccuuucuauguccacaccagacaugauuaaucaagugcugcacucuuuuaugcugggcucaaauacuacuuuauaauccuuuucaacacagugcuccaaguagcuacuacuaaucaauccuguuucuccuucaggaugaaagcuuucuuucuuugcuaaaccuucccugcaguugaagccuuuugcaugccaaucuuuaggcagaauuggcuaugugucugagcaacccaaugccaucuugacuuucagaaauaaaaguuaacacccaaguugaggcuggguagaugauguuuaauaaaugccugaccauuuaacaucuacccugucauuuagauaaauguguacaaaaaucuuguuaagaauaauaguguuaacuucuucauuacaaugauuuaagaaauaccagccaaggucaaaacugggguuagagggugauuucaaauaggcucaaaaaaucugaagccuuaaaucuuuccaugaauauggcugcuccaggcucuacaugauuacugacauguucugccauauuuccuuaagcugugugguaucauuguuauuaaaaauguaaaaucaaagcaacaaagugacugagccaggagccauccagccuagggggcuugacaaguagugagcuucauuaagucuggcaaaguuuagccagucugaaggucaaugaggguaaucagucagugcuauaaucuacccaaagucacuuuaauaagccaaggugccaucaaugcacacuccauugguaaugaaggcacucuucauuguucagguuggggugggagcagguagcgggaggagaggcauaucuauaaagccuagggaagacauuuaaagaauaaucaugguucuugcuuuauuuaguuuuccuuauacgagaaacacgaaauucucuggucauuaucuugaugaaaccaacugucuuucaugaagcaaaaucauuuuaauugggauacuagcaucucuuuuuaauggaaccaauuagcucuaucaggcccugugcuuuucccuacccaucucauucauuguccaccaaauucauucaggucugcuggaucaauuaaaaguacaacugucaucauuagcaacacuuauaauggagccagaucaacagccagaucaacauaugugcccuuagauuuuuuucucugugagugcugauagucaguauaaaaguuaggaacaugucucacugauggaauagauaauuauaguagauuuguugcaugaauaaccuuauucuucuaucuccuucuauccauaccauugccauguaacucuguagugccugcccucugugacucugggcuuggccaugugucauguuuagggccaauggacguuggacaccaugaugcauguggacauuugaaaggcucauucaacguuaggccggcuuggucuuguucucugccauccccaugagaagcaugugcccaggcuagacugccugucccaggaaaagggugacgaaccuauugaccaugacugagucaccucagucaucgaugucaagaccauccuagauccauuaagagcaacagaacccagacacaggagaaggccgggcuaagaugaccgccucagaccagugagcuacaagugcuauugcuguaugccccugagguacuguuaacacuacacuguugugacaauagauaacugauaagaugacauacauagaauaaguuuucauggucaccaaaucaccuuuuggugaagugguagagacaucuugaaaauaauuucugaucaauuaguggacuaguuuggugccauuucaauucauuucuuuggccaaaugcacugaaauaacaguagucuacuccucauguuccauuauauagccaugggcuguguguaagaaaaucacagcuguaauuuacuauuuguauagauuaaacaaaugcuuuacuuaaaauguuauaacaaagagacaagucauggggacuaggacagggaaggguugaucgggacuuuuccugaaggacaguaacagguacuuaguuccuucuguugauuucauuuucugccccagcacgcacaggucagugucaaauuccuccuuuaccuccacgauaugcaagagcacuugccuuuaugagaagagacagugacaagcugccucagggucccagggagugcugggaucauuguggaucuccagauggcuuaaucuagcagguacagcaccuugacauggugcuguuaaaaauguuagcagaaaauggagcccacgguugcugggugcagcacaagaaagcaaaggagaggcuaguggaagggagaguauaugcaaaagacagaaguaacugcagcggugagaugaggagagguggcaagagcagaaaagcauuggggaauauuaauauuucauaauagcaaucuucauuuagugcuuauuuugugccagauacugcuccaaaaaauuagaauaacuuguuuauuucugucaaaaaucacuggcuacuauuuuauuccuuuuauaggugaggagacugagacaauagaauuaagucacuugucuacauucacaaagcuaacagauggcaguggcaggauuuaaaccaauauugcuuggccccagacuacaugcuuuaaauacuaacauacacaagcugucacuugucuacuuugugccagcucugugaacauuauugaccaaaagcaaugguauauaugaugacagcagcaaacauuccaggaacaaaugugauuccugaacgaguaaaguauauauacaagggauucugaaagcuccccucuuccccacccaugauauaguaagaccaaaaagaagaagagccccuguggagaggauaaaagaagagaacccauggcagauggacaccauaagauggaaucagugauccuaccagagguagaagugaugcugaguccuaaugaaucccuacucugggaguagaaagagaccugcucgauacucacuaugagauucucacuuucuggggauuuagggaucggaaaaaaaaaggagaacuuguggucuaagauaggccuacuucaacaaucuauuugaugaauuauacuugcucuaauguaaccauuuucuuauaacucuuaaugaucaaaauguuuuaaaauaguaaauuguaagaugcuaaagaaaguguguuucuuaggguucuaacuggguucaagccaagggccaagagacuucucccagaaagacugguauccauuuuccacgcuuugauaugguaauuaugguuuauauggaaauccauaagccaggugguggcagaggugagccuuacuauagagaaaucuuugaaagcugcaaaugcagcuugauacugugacaaucuagcauucuaauuugcauucucacucuuaagaguauuaggaucaaaacuucuucuuaaauacaucuuuuccauagucuauaaacacaggcauauccaaaaguggaagccagaauccucagcagccaggaccagggacaucuugaacuugguaucagcuaacaagugcagaaacucauaaauacugccuucauuagcucaugggcccugugauuugugucucugaugagcaggggcacauuuuuuugaccccuccaguaaacaggcaauguaauuccucuguaaauugacuacuagaaugguuuaaaugcccuugccuacaagcugaaaggcauaguuaacacuuuuuacauaagcuagaagaccaaaauuuagcuaucaaucaaccagggcagaaaggaaugacuugacaaaaucauucguuaagucugacaggagucaagaacacaagacguuuuuccaaugguuuaaacguaugugugacaaaggaauauuaauugcauaagacaagacauuuaaagguauuagcucagcacuaccagucuauuuuacccaauuaaggcuauucaucaauguaaauaacugcauuuucuucagcaaacccaaaggaaugcagucaauagaucauaccugcucuagcaauucuuauuucgugggagcacacagucgugaaagaauagacacaguuuaacucacuaacucaaaaagaaaaacaaacugucucaaaaaugaccaaaaguugucuaccuauugggugggguaugaggaguguaugcuguacauugagccacaucuaauacugcaaaaguauuuuguacaaagucuaaaaaucugcaaccauuugauaaauaugaaacagcucccugcaaaagacaauccaagaaaaaaauaucucuccccagucaacuaguuuugcagaagcucacacuugcauaagacuuugaaggcugugugccucauuuuaauguacucaaugaaaaacaccucugcaauuccuuuuacuggagaaauauucauucuugaaaaacuaaaaaaguucucuuauuugccuuuaauugugaaauucaaaaauuccuuucuaaucucaagagaaauaauggaucuauaaagaaaaaucuacacaaaugccacaguuuuagucaggauuuuuaaguguuaugccaaagaaacgaaaugagaguaaacguaccaaaauaugaugguacagauacuaaugcaauuagcucagagguggcaggaaccuuauuauaagagaaauaagaaguccucagaaagaaauuaugcuuuaucacuuacuuacuuuacuaaacuguacucaagggccaguguuccgucauuuauuccuuccacuggcauuuaaguagcucuugguagaugaagcacuguuuuuggccagggauacagaagaaaacaagacaagccaucuccucucacuuucugcugaaaacuccuccacugucucaacucccaacuacuaacaaagcuacagcgaucaacacgaccucacacaugguugacuggccucauaaauggugcuuacagguaagcaugaguuauucccgucaaauguauuggaggcuggccuaaacaacacuguaaaaaagucuaauguuucuacauuucuuucacaucauauugcacuuuuuuuuuuuauuacuuaaagauucucuuaagauuucuccaccccuccaucagaacaggcauucuuucuauugcccaaugucuaacuuagcccagaagaguuggcauuucaaaagggugaaauuuuagguggcaagggugaagguggaaaagacauuucuagcauaacuaccuugcucagaucgcugaacccagaccaaaaagcaggucaacuuuucugcguauuuggaagggucuacucaguuucuggcugcuuauuuuuaauaauaauccugugcauguccuguuuuuauagcuugcagagaacuuuccuagacauuguuucauuugaccuuccuuacaaugucacggugugggugaagggugcaguuuguagggugagcaucguuauuuguguuguuuagaugaggaaagagaggauccucugguugcauauagaaaaugccagagucagguguucggguuccaauaguagugccauuuuacuuaagaucuauguguuuauggaccuggcuguugaaguucacaaauccuaacuggacaaaggucacuuuucuuucaauucuucacucccaccccuagucgauuacuuacucccagccuuaugucccaaccaccauugcuugcuccaaagggagaucuaagaucagaugccuggauguuuuauucugaguaucuaauaucugccauugauuaacugguggugaauaggcacaagcuucuugagcccagugugaaagggucaaaagcugcaucaguaacagaauagccuuacccuagcaaggaccuuuaggaagcuuguaauaugccccaaaaaugauuuaauccccucacaauuuaauugguaauugggaaagacaauuacugaauggauggauuugauggcaggcuaagagcagaagccuauaaaaaaugugugguuaaagagcaugaagcaagauauagagacgagcucucaaaaacuauuauuucuuucuaaugggguccauccuacacaccuguuacggugugguaggauugguaccagguagagucaccuggccuguacuuccacaugucaugcauuccacauuacagcacaaguccugugggucuuagaagaacgucuauuauaaauauaagcaccuggggaggaacccagacaaaacucacuacuucucacucuagguaugagugaaaccucaguucacuggagugggauggguaacuugggggaauaagaugcuguugagugaggaagggagaaugaugagcauuuacuucuuggugcagaugucacugauaaauguaccucugaaguuucuggccauuuguggucaguaaaggacucaacacacuuucuaaaacagaaaaccauuuaccacacuccccuguuuuacuccaguuauggauaacgguguaccucugagcuaccuucccucuccagaguucugcugccguaugcaauacuuuuuacuuccugucuuuaacuauugcacagccuugcauuuccaacagcugcugaauuuuucccuagagguacuucauuucagauagaagcccaaugauuacuccacauucccaacuuuguggaaauccuguaaaaugacuggugcugucgcuauuuaagagaaacguaguuggauucaagguccuuuagcuuuucagggaauucaggugcuuacaccauauuugucuuaucucaagcuagguuuacuuuuagagcagggauuggcagacucuccgcuguaaagggccagguaacauagauuuuguccuuugugagccaguuagucucugucaugacuacgcaagucugcaguuguagcacaaaagcagucaauacaacauuacauaaucaaacagagggcuaaguuugggacagagauaguaauuggcugaugccuguucuagaugguuucaucaguggauuuuagucuuauaugccucucacucuauacguaaguuucuacugcaaucucuggcuauuucaagcuccauuuacccacugcuuacuuauaaccaagcaucugcuguguccagaagcuaucuccuuaagaagagaacugaggaggcuaacuguggccucuaagagcccccaggugaucagugugacugguauuugaccaaacgacuuuuguuauuucccugccucauacucugcuagaaagcaaagguuauucuaguggucccuaagaaauuccuuuucuaauauaagcuuugaggcaaggaaggaagaggaaaguuacauggaagaguagaaguuguaucuaguuggguuggcuggccugcuuaauguagguguucugaccuggacuggaccccaaaucaugaauuuccugcugauuuggcaacaguaucaaggguacuuccacagaccgcccaaacacauagagaaugcacccagagcagcaggcaagcugguugcuauggcaacuugugacacaaugccuacuugaucagucacaaguuaucccuuuucuuuuuuuuuuuuuuuuuuuuuugagauggagucucgcucugucgcccaggcuggagugcaguggcccaaucuuggcucacugcaagcuccgccucccggguucacgccauucuccugccucagccucccgaguagcugggacuacaggcgcccgccaccacacccggcuaauuuuuuguauuuuuuaguagagacaggguuucaccgcguuagccacgauggucgcgauccccugaccucaugauccgccugccucggccucccaaagugcugggauuacaggcgugagccaccacgcccagccauccccuuucaacuaguuaauuugguaucuauagauacagccucagggccacauugaucuaagcuuuuguauuucaaaggaggggcugaagaagucugcucagaguccauuagugcugacuucucccugccccuuggaacucagcaaccucccgcucccauuuuucugguuucccagccuugcucaaaggugcauuuuuuuuuuuuuuucgagaaggaguuuugcucuugucgcccaggcuggagugcaguggcgcgaucucgacucacuguaaccuccgccucccggguucaagucauucuccugggaacacaggcgcaagccaccaugcccaccuaacuuuguauuuuuaguagagaugggguuucacccuguuggccaagauguucucgaucuccugaccuugugauccacccgccuuggccucccaaaaugcuggcauuacaggcgugagccaccgcgcguggcccaaaggugcuuuuuuagcuuuacagucacucccuuuagauaguugcaacucauaguguagcuacuacuuaaggcagccugauccuuguugaaauugaaggaaucaaauaaaaauccagaagcccugcccuuaacaguuaaacaggauugaugcauucgugaaaaacuaagaaauuauggaaggaaagaagaugggucugggacugauuaaucacccaaacuucugacauuuaugguuggaucaaagagaaaaauccacucuuauccucaaacuccucaggacaaaugguucuccuuuaauccuggaaugcucaggcacaauccauucaaccauuucucaaugaaugcaccaggcaagucugcuagucuccugauaugcauuuaaucagauauucccccagcuaaaaugaaaguccuuaaguuuuuucccuuacgauuaauuagaauaauaauuaucaaaaucccauucacaguucaguuucuggcauggagcuggacacagauaugaauggcauaaggaagaaagaaauggugauuauauuagacacgaagccuauuauuauaauuauuauagagaaacucaggucucuuuaauaauugauauuuaccuuaugcucuucccauuaaagaauuuuaauaaaagcuauaaacuaagagcaaaguguaccaacuuuaacaaccacagucauuaaaaggacaggcuucagagucaacccacuaggguuuucuaacuuaugaguuuuauaucagcaagaaauuuaaucuuauuauuggaauuucaauacucuacucggaaaaaaaaucuuuuugauaguaauaucucucugaagaauugcagcgaucgucaauaaagaaucaaguaaagaauggacacuaaaaaacugucagucuuaguggacagcuuuacuuuucugaccuucauacauaaccagauacaaacaggaguaauagaucagaugaucaagauggcugauuauuucaguugucucaaugaccagagacaugcccaguuccuaagccuaaccauucuuagcacucauagcuacgauaaggcaaggcaauuguuggugaagccauggcuuugaaugcaauaauguuuaauauuuguacgucucuggaacucuaaguagagcucuuuacugaauuuuuuaucuggggcuuagacauaggaagagaaaucaguuuugcagcaaaaaaucaacaucaaugguugauaacuacaaaaucacugaucuuaacucaauuuucuaacaaguaaaauuacccaauaauuguaccaacugcuguagugaaggaauuagcucccaucuuuaaagcugagguaaacaaaaggcaucuuaauauuccugaagaaagaccucuugcccugggaagacccauagugucccuuccaccccuaagaaccuacgaacccacgauuucugaaucaauagcuccuuuucaaagauaguuaacaaauaaguccacaaaacaguacuauuuuuccuguuucuccuuuccccaacuccuacccaucuccucauuuuggggguaacugaaaaucauuagacacauguaaccacauacuuacuagucugcuuuuaaaauaaguguuuaaagagauuauaaccuuauucaaguuaagaagauaugugauauuuccccccucacugggggacauucuuuguugagagaauuacauauauuacuauuuuuuucucuauauaaugggaaaaucaacaaauccaggagcuguguuuuuuugaaaaaaauaauaaaaucgacugcuagcuagacuaaaaaagaacaaaggagagaaaaucaaauagacacauaaaaaacaauaaaggggauaucaccacugaccccacagaaauguaaacaaccaucagagaauacuauaaacaccuaugcaaauaaacuagaaaaucuagaagaaauggauaaauuccuggacacauacacccucauuuugugaggccagcaucauccugauaccaaaaccuagcaggauaacaacacaaaaagaaaauuucaguccaauaucccugaugaauaucgaugcaaaaauccucaauaaaauacuggcaaaccaaacacaguagcacauuaaaaaguuuauccacuaccaccaagucagccucaucugcagguugcaaggcugguucaacauacacaaaucaauaaaucuaauucaucacauaaacagaacuaaagacaaacaucacaugaguaucucaauagaugcagaaaauaucuucgacaaaauucaacaucccuucauguuaaaaacucucaauaaacuagguauugauggaacauaccucaaaauaauaguaacagccauuuaugacaaacccacagccaauaucauacuaaaugggaauuuuccauacucuaguaugacaaaaaugccuguucugggcacaguuucuugaaaaguggcaccauaugugcaucaguaaacauuauguguagaguaaauuaaacccagccuuauaauuaggcaguaaggaaauuacuguagaccugaaagaguaaaucagcaguauuaaaguguucuccauuuucucuaaaguacuucggaaugccauaaaaagcccaugucacugugauaaacaucaagaagaaaugcauuuugagcaagacaaccuaaaagacaaccacaauucaaauaggucuucgaaucuggaguccaacgugucaucucauaaaauuuaaaagccagcccuuuugucacuacugugaaaggaaaaagaaagccaucugacauugagacuuugcgggggaacuuucuccuacagcaggugcaauaaagauuuucauagauagaggcucuggagcacagccaggacuaacaagagguucguccaugaugaagaaaacagcaacauuguaaauacagacagaaucaguauugcugauuuuccuuuugcuuccagcuucaacaugacucaacacugcacuaucuuauuuaugaugauccuaucuuuauuuacaacauugauguuuuguucaucauggauuucugcauuauuuuugauuuuuuaaaguguugcacacaauauuauuuauugugauuacugagcuuuuugguagccccuaaaaucuugcaccugaggcuacgccucacuugccuuacccuuguccuggcccugcuccagaaaguacagaucuuuccaagcccuacaauaagaagcagugaacaaucagaccauucacuucuaaccuaugcccagaagagaggagccuugugaaauaauaagaaauauauaaauauauagaauuauauaaauauauaauuuauauuaaacauaauuuauauauuauaaauuauauaaauauauaauauagaaauauauaaauuugccauugccccugguuccugaaccccucguucagaccucugcccugguuccuaaaacccuuguagauaagggguacuaggagaaucuuuugucuaauauuugaucuuuaaccccaguaacugacacagaacucuuaaaaucuuuguaauuuccuaggugguaacauuggaaacagcuucuaaagccacugaaauuucuugggugacagcaucuuuuauucuaaugaggcaauuuuugaugggcuccuggauagccccaggauccaggcuguuugcaagggaaaccaaccaugugauuagaaggugagaacuuuuagccccacccaccccaaccuccagagaggugagagaagcugaagguugaguuaauugccaauggccaaugacuuaaucaaucaugccuaugaaugcauaaaaacucaaaaggacagaguuuggaaaucuauugguugcugaaaaaauggaaguacagggaagguggugcacccacagagggcauggaagcucugagccccuucccacauaccucauccuaugcaucucuuccauuugacugcucaccugaauauucuuuauaauaaauagguaaaagugugcaguuucccugaguucugugggccacucuggcaaauuagguggaccugagggagggauaaugggaaucccccaauguauagcuggucagucagaaauauaggugacaaccuacuacuuucaacuggcaucugaaguagaagcagucuugugaaaaugagcccuuagucuaugaaaucugaaguuaucuccagguagauaguguuagaauugaauuauaggacagacagcuggugucaaagaacuagucagugagggaaaaucauaccgcauacguuuuggugacuagagguaaugugugcuauggagaguguguggcaaaacacuguuuuuuuuuuuucugucucuuacaagccucaaacauggauuuucugccccugaaaacagguauugacucugugaaguggaaaggucuaauagaggccaaggagauugcagaagaguuggaaggccucacaaauccucagauauaccaccugagggacugggaugaggucugaaaguuccaucuaucagaaacaaagacaguggaauucaaacaugggagaauaucagaaauaaguaggaagcuuguuaugacagagauuuuaaggugccaccagagguacaugaagucagaaucucccaaaauggagucaaauaucuucauuuuagcugcucuugagcuaagucuucucaagccaacugaguaacaggaaacuacuggauuaggguauccucauuaaucauggaaauuauccucaaaauauaaguagacuuuuuagacuagcauuuuuagcccuugagacaauggaaccagagacaugugaguuuagaauggaggcaaguugaugauugggauauuuccugggugcggugacuacagacaggggauucuucacucuuucagcaccuguguggugcaggcuuacuuuauuuugggcacuaggauauuaccugaagaaacaaagacuagaaagacaugagcacuggcaaaaacaaauaaacaacuaaacccacugcaaaaugugucaugauagagauauuuuuaaaugcuuugggagucuacuggauaaauccuguuuacaggaauuggauaaaguugugaugauaaggugacauuuaagcuaagccugguaggaaaagaugugaguuuucuuggaagaaaacaaaaaggguggugggaguauuccaggcagaagcaacacaagugcaaaggcagaaggaucuggaaacacuggcuuaugauacuguuggggcaaucauaacuggggucuaggagcuaccaggaggcuggggucuaggauacugguuaugagguuguggccauggccaucuuuugugugugugaaaagcagugaauuagggccaauggcaguggagaggagcaauggacucaaaaugcauuuaggaggugguaucaauuggauugaaugacugacggagauuuaaggaauaacaaaaggaggaguugcgugggacugucacugucuugaaaaguggaucacagugggaaacacauaauuguguagagccaugguggggugaagguuugguuuuaagauaaucuggaaauuucauucagcucaaaaagaggacaaagaugagucaagggcauguaauguaaauagaggguuguuaaaacuagcaucaucuucuucacaauuuuccacccaagcaaagagcaauguugaacucccucagccaucagcagcagcauccaugggaaucacuaaggcacaauaugaggacauccuggagcaaaugggcucccaccaggacugguggcgacaguaggcauggcagagccugcaggaagaugacucacuuucugaauuucagauuuguccagccuccucaggaaauggggagauaaagaaauaucagcaguccugauggaaauuuccccugggaaagaugaugccagaagccauuucagguaauaaaagguaaccucagcaaggaggggucaaauggaacagauauauuuggcuacaagcugacugcaaagauccacugaguacauucagucagaaucaaggcgauuagcuguuaucaucagcucuagaaacaccucaauucaggccauaaugguagaugcaccacacacucuaaaauuaucucguuuucagugacaguuuuggauaagaaucccagucuaaacacagccuccaacaacaaauaugggccaaccucacuuaaccaggauggguguaguaaaaugaauguucugguaaacugaaagggcauucuaugaaacaaucuuuguuauuucagucaccaugguugaaaauauucuaaguuucccugcuuaggaauuucaugcugaaaaaugugauggcauuuuuguuucauaauccuacaguggaucuuccagucucaggaucaggauucuuaaugguauuauucucuuugcuaaaaauagaagaagguguugggaauugaaccaaacacagacauuaucuggaagguguuuuggggcucagucauugcuauuuacuccuucccuucccacuuuuccuugauuucuagggccuagagaaauuagcagaaaagaauaaaucaguaguugaagcuuccacuucauugagaguuuucauguucauacuuacguuauagaucccucugcucaguauaguguaccauuugaugaaacaauguugaucaagcuacuagacucuuugcuccuuugugugaucuagacuugcuagugucaagccaaugugugaacaaucaaccauaugcuggcuuauagaaauaaauugaaccacuuugugaauugaauaguaccuugacaagagaacagcuagcccaagaugauauuucaagaaccguuuccaacugaugaaauaauguacuuuggacuuggccuaaugacuauuuuccaggugauaaguaaauggugcucugacauuuaggguuguuuuaucaggauuuuccuaagguagagguagcgugacuguacuacccaucaucaagggauacauccaaaggaugaccuuucacgguauugaggucaggaguuugagaccagccuggacaacagggugaaacucugucucugcuaaaaaaaaaaaaaaaauuagccaggcgugguggcacaugcuuguaaucccagcuacuugggauccugaggcaagaggaucacuuuagcccgggaggugaagguugcagugaguugagaucgcaccauugcacuccaaccuacuaccuacucugcuccgcuccuccugguauuuuugauucuaauuuuugguguuucugauuccauuucuuucuuucuuuuuuuuugagacagagucuugauguguuacccaggcugcagugcaggggugugaucucaacucacugcaaccuccaccuccugggcucaagcaauccuccugccucagccucccaaguggcugggauuacaggcacgugccaccaugccgggugaauuuuuuuuuuuuuuuuuguauuuuuagcagagacggaguuucaccauguuggucaggcuggucuugaacuccugacuucaagugauccuccugucucgaccucccaaaguguuaggauuacaggcaugagccaccaugcccagccucugaucccauuucuauuuagcugucucuggguucauguuucuuguauuucaaaucccauuugcugcaugaucauuuucugaucuccauguuuccacagcagcuugacaaucugaccuagacuccaaacuccagggauuauuagcucuuauguaggguuucaguuuacagaacacaaaccuuaacacuuggaggaacucaauauucuguaauauauuuuguugccauguagauagccucauauccuuaugaagaaaaacagauucaaauccagaaauaaaugguuuuaaaauuuuuuuacaaugaacuuaaaaauaauuggcccuaucaugagcagaugugagaaaaacaauagaacgccuuaacauucucuuuuuucuguaauuguucuggaaagucuauaauucauguuuugagaggccagauaccuaaacauaauugcacuuuuuaaaaagagaauccaaugaaccauaacagcuggagacccaagagaugauauaucacaaacaagaaccauguuuuugacauuuacuauaguuguguuuuuucuuucuuuucacagugcauucgugccaccaauuccaaaucuuagaguuguagaggugcugcucaaaaccucaaagcacuucuacguauuuaugugaaccuuccuucuuccccacguguauuucccagagugcauuaguauaugguugacccacaugcuuauguugguucuacggagaggcaggauagaguaaaauuuaugaguacaagacccuacagccagauugccuggcugcagcuuccauacguccacacccuauauggccaugggugcuguacuggucuguucucacgcuucuaauaaaaacauaccugagacuggguaauuuauaaaggaaauaggcuuaauugauucacaacuccacaagguuggggaggccgcacaacccuggaggaagguggaggaagagcaaagucacaucauacacggcggcaggcaagagagcgugugcaggggaauuccccuuuauaaaaccaucaggucuugugagacuuauucacuaucacaagaauggcacgggaaagaccugcccccaugauucauuuaccuccuuccaggucccucccaugacauaagggaauuaugggagcuacaauucaagaugaauggguagggaaacagccaaaccauaucagguacgguacuuggcuucacauccucaucuguaaaaugagcauggugacaaucuuuuagagcuaguguguggauuaaauguggucaauacauggagauaacuuagaacaguuccaggcaccuugcaaagacuuaauacaaguggguuauaaauuaguuuacauuuuauggacagugauuuuacaagcucuccaugguaacuguucaccuucagccagaguuuguacauaaggaauugggucaaaaaggagacagcuaaggaauuuuuuaguuguaauuguuuuuuauuaaucuuggaagauuuuucuguaguacuacuuggaaacacaauauuaaugaaucagccuuuaaacauuccauccaauaacauguuuugcuuauugauuuuuaaugcuuuguuauauuacuauucuaaguacucacccuaaugcaaaagcauucuauauauaaauucucauuguuaaaaauguuuugauuguaauaauagaauugagaccuuugucagguugacacucacuaaaucucauugcuggacucauugugguggcuaguaagggugaaggaauaagaauuaggccuuugauuuguuuggggagugaaagaguugcuaaguuuagcaacauugcaaugucauagauauuauuuauuagcuucucagagagaaauguuugggugcugauuuaucaacuuggaaaaucagggacuaauaaaaguacaaaaauaauauucagaaucaacuagcaucccuguaauuguaggaaaaauuaagagaucauaccuagaauaguucauagguggcacagagcaaaagggaauagggguacaguuggcagaaacugacugagucuucucugggggauggacagaccaugugggccaguaggcacccagaaggggcaucagccaagagcuauuguuuccacacugggcugauuccagaaucacagcagugacaauagcucagacacagggccugcugugcccacagcuuuaaaaugagaacccaaugcuuaaagcuggcaguuaucauccccuaaauccauuuuugauucuaaacaaaauacuccuuaggaggauucugcucuaccacugcccccugucauggguuugacuggcaagauggauucauguuaaucaguuuuaaaugguaccuuugggucccuauaaucuuuuucaccauuuauaaugccccaguuccuugggauauguugccucaagagaggaguucuacuuaccugaaaauuccacuuaaaccaaaauccuuuauauucaauuaaucuugauuucuuugaguaucuacaagucuaauuccacuuucuuucauuaggaaaguccaagauaaugaucaugauugacuuuguuucuuuucaauuugguggcuaaaacuuuucaaggcuccagggucacccuucugaaaagcacugcccaaacuuagcgcuaugaggaggaggcaggagacugaaagagcgggacaugauggaugucacuagaaauauuuuuuauaaacuaaaauauuugauuucaccuuuuuccccuaugagauuugaucucucuaaauauuauacaaaggaauacauguguacagggaaguggacaugaucacugagggaucucuuuuagaaucugcucuagcauacauuuaucuguaauugaaagaauagaaaguaucucagcaguauacauuugcuugagccauuagcguucucugagccacuauuguggaggggcuaucagagacccagguaacaccuuguuaaucuaauuacuaguuacccacaucuaagcuuaugaccuaccugggccaaacaaauuagucauugcauguuccaucugcccaagugcuagguagcuucaauuuagaucagagaagcuuuugugccacuacagguguacauggggaggcaaagagaugagaagaaagacaaaaauaucucaacauaugggcagggaugaaacugacagauggggaccaucgucauuuuagaaaggcagauuggagaagagaaagauguuucaaccaaauucauggauacagugugaaauuaugccauaacuguuggaucuuaauaccaugaaacauuucuccuuuuacccuuauuccucuauauuuuggagaaagguaaggaaagaaauaacauacauggaauaacuucagggaaggacacacuccuuccacugccaucuuacaggaagcucuccaaggagcuugucaccuaagcauuuaaaauuccaccauaauuuuucaccuucaaauuuuaccacuguccucugcuaaaaagagucaacccuuuccaggaauuguaacauaagaguaaaaauuacuuuuucauucauuucuaguaauaauaauaauaauccugccaugauugguccaugauugaaaagagcugagggggcuuguucuugaauguaaaaaaaaauguaaucacuacugagaccaagggaucaggaagaugggaagacccaguucaugaauuuuagcugguugacaaucuagccaaaggcaagaccuggagauguccucccacugcuuuuaaaaaucugugauuaucagucauugggaccucugacauaggaaugagaauaucccuuagacucacacaaucuuauacagcuuaaaaaaaaaagaguuugcagaucuaguuuggcuccuuauuuuuguaagaccaagagaugaaggauccacaaucacacugccaguuuagcggcagagcuaacacuaaaaccaagggcucugauaucuaauucagcguuuucaacuaaccuccaucccaauuccugccacccauaucauuucauaucaaauggggauauguagagaugaucuaagagaacaaagagauagagaccuggccauauauucauuugcuguuaguuacuaauaccuaaaaggacaauguuguauucugccuuauuucaaaguaaaguaaaagggaauguuucccccaaaagguuuguuagcuggggagcuagaauauucauauuccagaaauaauugugauaucuucugaaggacaccagaucaagugugucuacaccuucaggugaugucuugauaaaagccaagaagcuccccagcagucaucagaagugguggguuccucucauucaaaucauuuccaaguugcugcuuggccauucucgcccaggccucuugcuaauuuuguuuguacuuaacacacugcaggagcaaaugcuggauguggccaugcuaacccaauuguuucagcugcagaaaauacagcaggugcugccauggcagugguugguuuuagcuggcugucacagucaacaauuagugaaugagauggacauagccaaagcuacagcaggagacaggauucugcccuccugggcagaaaucaagaagaggggguuuuauuauaacucagugggugauagaaucucuuucagagaaauaauacuaccaaagaaagaggaguucaucauggccacauauaaaaucaggguucuaaggcaacauuuaccagcguucauacaacacuuucaaggagaaaaagggcccugaccggagauuucucccuguuaagaaaaauagacccaucaaacuaaugaugucauuagccauuuuauucccugcuucccaaacaaccaucugauaagcaaacuuucuccuagauuuauguucccaagggaauacacuggccaagagaccuuaauuaacccaucagauuaagaguuguauuucucauuaaccauuagcauucugguuuaucacuaaauucccgggaguuugauaaguaagaaccagcaaagaucagaggcaggcucuuggcauaccuggauuuggaaaacuaaagaccagauguagaaguagugaauucauccagucuccacugggacagauuggaucugggcagugagaagccaccugcucaggaacugucuccuugcuugcaacuggcucgucucuguccagcaaucucuaccuugccgauaaaaugggguuuuuauuuguauauguaaauguuauaaagaauaacaaccucauugucaucuccaagaagacacccuggaaaaggauauuguuggaaaccacuacugaauaucauggacuuaaaguaaaaauaaaaaauaguaccugucuccuuagaucucuuguuuucuuagucaucuuaucaaucgcaauguugagaggaucuccuuuuucuuuccuuccagucuauuaagaaaagagaaauaauuucugauuuagcauauucaauguuagagacauuaaaaauuuaaaaaaaucaggaaaacaugagaaguuaaauucaaacaauuuuuuaaaaagauuauuuucaauacauaacuauaacaugauuuggucucuaaaguugguuuuuccugaaauaauaauuaaaauugauaaagaccaauacguucucaggaugguuacacauauguccauauucaacuccacacaaaucuguguuuucaucccuccuccagacgcuuagcaguuaaguuaauauaacaaggauguuuuguuuuugccuucaaauacaaaugcuuugugugucuauauuguguaggcacauuucugaauagaagauaacugagauaauaaaaacuaaaucgaaaaagauuuuaaguaaaucaccagaauucggaauuuuauaccaauauuuuuuaagccauauugcaacuucuauaucaaauucaaaagagaugcuuuacuagaaaauacaguauugcuaaucucugcucugucauguaguggaaugcuaaaaaugauaauaagcaacccacagcuugaggucaugaggaaaauuucccuuaugacuacaacaggcagagguagagaaaaaaaaaaguguucuuuaauaaauuguucacuuggaaguuucacuaguuuccuauuucuuugcuuuuucuccuuuuuuugguggguacagaaaaacaauuaaaacucaacagaaaagaauccccauugucuuuuuaaaagagcaacaagauucccauggaugaaaagcucuauaaacuuuauggaugacaauaaucuuccccuuaaaagauaaauguuuucaaaaaccuugucaaauugauuaaauuaucuaaauuuuagucaaacgcuacagauugauuuauuuauggugcuaguggcaagucaauuauuguggccuacucagucucuauaaaaucauguaggucccuguaguaauuugcuuauaugauaaaaugagaucccagaucuuaaguugugccuaaugggauaacaugauuuggcaaugcauaaaaauuaccauccaacagguuucuaaauguucucuuuccgugacaaaauccgggaagcauaaagcugauacauacauacccgcucuccauagcuggguuuaaaguagucacucuucucugccacuugcuuaauuaacuauuuuuucugaacaaaugucugaugcacagcccuauaggguuuucauuaaaaagcccaaaccaaggcauaugugcauauauuuuuagucuucuaaaauccuaccauuccccaucauccuuucccacucccuaaacucacacacucacucuuucagauguagacacuaagguuuuuaaguagaaagagcuuaaaauacaguggcuaacauuuuacaacuuugaaauaucagccuacaaauagcuccaagaaaacaaaaguguauggagaagaauaacgugcugcucugucuuucaagggaaugugguugugcagugagugugacuucaaugcucugccucuccaaguucagaucugccacaaauucagcagccaaaggcuauuccuuuucuguuugguucucuccuugcaaauagguugucugccaucaaaauacagggcaccuauguggagcucuggaccaugauccuucugaaaaucauaauuuccuguggccuauucauuuauuagaauaaaaaaacuuacuuucaaacauuaaaaguuaugaguuuaguugaaaacuuggcugcaacagauggaggaucgauuacuaaacuuuucaaagugaaaagaaaaaaauugagacacuuuagauacacaaaauaauuacugagugaauguaaaugccagacucugggcuuauuccauccugccagugccauaucuauacaaccacuuuucagaugagaagaaugagaaucaaaugggccugggacuggugugaacagagugaagagggagagagggaguauaauuuagaugcaaaauuuaagguggcaccaaggaacucagucaucaagauaaauaauauuuuaauguaauacauacuuuuuuuuuuuuuuuuuucugagacagucgugcucugucacccaggcuggagcacaguggcgcaaucucagcucacugcaaccucugccuccuagguucaagcaauucuccugccucagucuccugaauagcugggauuacagacaugugccaccauguccagcuaauuuuuuuguauuuuuaguagagacaggauuucaccauauuggccaggcuggucucaaacuccugaccuugugauccacccacgucagccucccuaagugcugguauuacaggcaugagccaccacgcccgaccuaauguaauauuuuuaaaaucaaaacuaacgcaaauaaauccauguugaaaauaaaauaucaaaaauuuaaauaaagacaggauccaauagggcuaggauuaggguagggugaaugaggugaguugugcaaaugcagcaucagaugacauuuuaaacuuuuaaacuuaaaaaacagugcggauauauuuauucuuuaaaaauuauuguuuaccuaaaauucacauuaacugggcauccuguauuuuuaugugcugaaucugacaauccuacccccaggggaaagagucauguucaagauuguaacugcaguugcuacagacacguuugggaggcuugguugccccauucugugagcagaagggcaacaugugggaucuguaucccuucuggcaucaauauccugcaacuguaaaacacacaucccuuagaugugaggcguccuauuggucccuguggggaacacaugaaaagugauagccacaauucucaccaucaaagagcuccugauacaggggaauagaccagaacacaagaccagaacaauaccaaaaacugugcagaaagauuagcacgcucaaugacugaguugcucagaagagggagaagauguugccuuugggaagucaagucacagaggaaagagaaaauuagcuggaccuuaagcccuggguaagauuagaauaggaaagagagaggcacuuugacuggcaaaaagaaagucauguagacaagaaggcaaggugguucugggaaggcagugagugaaaugagccagcuuuuucuccaugaugugaagagaucaguuugacuagcuacagagacaaauuauuucuauaagagcuucuuuauagugugauuacuacuaacuuuauuuugaucugcaagcccagagaaucucugguaacauuaaucauuccauguuacucuuguccggauucuguuuguguaauauuugugauccuggguuucuccagccucaaagucuuuggcugaaaacaauucagaaaugaaguugacucuggagccauauuuguugugacuguacaugaaggcuggggaauguuaaaacaaggacuaggguuuaggaaauuugggccacuggaugggauagucaauuuacuggcccuuucuuagcuccaauuuuaaaaaauaagguauuugugcaggaauaacaauaguagcuugucaacgcucagcuuugcacagcaaaugggaacuuggaagccauuauguccuacuuuccucagcucuguaugucuaaauguggccauaauuuuaaauucaucaguuuaaacuggacaggaagccagcuacugagagugagacagagagaggaaaagagggagagauagagagacagagacacagacggagagggagaaagaggagaggagaaagggagagagcaaugggggauagugaggagggaggaaggaaggagcggagacuugccuccuaguaucagcucccuauuauuagccuccaugauccuugacuaaccauuuaccccauuuuuuuuuaaaagucugaguuuugucauaagcacaauggauagcauaauauaugcucugucuucuucacaagguuagcaggacgaucaaucacaauggcaaugugcuagaaacaauaaaagacauuuagacuauucaggguaauuaggaaaguauuuuugauguggaaaaaaaaugaaagaauugauuuagaaacuacauagaaacuauuuuuggaucaccuguccuucugcuuucuccauccaggcagauaauguacgaaaaccuugccaaaaacugguaucccuaaagaaaaaguucucucccuuuaaaaaggcaauauuuggggcaguucauuuuaaauacacaacuagucugagauauuucuaagaggugaaaugaggggcagaaucuccaguucagucuuuuacacaguagguccugggacauauuuugucuaguaacuaaggauuugaucaucacaagcacauucuaguucccuaggagucaaccagaagccucaccuagcucuccaucccugacccuccaggcucuacaaauuaagcauacuuuaacaaacugaagugaaagcagauguaaguauuuauuuugacaucaucaccuaauaauaaaagcaaaaugugugguguuaagucagucauccaauuauucccuguuuuugcugaacagaaggaaacaaaagccaauuaguuguaaccacucucugccaauaaccaccuaagugaccuggccacaucucuagacuccaaccuuaucaucuguagaaugaaagggccaaggaugaauuauggaaucgugaaauaugagaagcagaaaaaccaucaagcaccuguaacuauacuuuccuguuacagggaaacaaucauaacacugcagaaagggcugggaauugacaggcaguugaaguuuuucucuucucuaaaacguggcuaagugcuugcuuuuggggagcauaaaaagacauaggcccuguaauguguuuagccaauaccuaaccagcagaguuaacucagucaacguuagcugucuuucuuugcccaccuccucauuccccucaaagauaaggacagcaaggucuagagagaugaagugacugauuaugaucaccuggcucauuaguaucugaccagcaccuccagacucccagccagggcuuuuuccauuccauaucuaaacgaucucccuucucuaaaauuucaggauucugugauuucauaguuucauguguuucucuucaaaggcuaccaguaaaaucucacuuugagguguauuuccucugcugcuuuuuguccgcagaacuuauaugccuuuuuugagccugcuccccacuuuucuucuuuaucuuuaccugcagagaaugagugugcaauagacauagccauuuaauaaauaucguuauuaaaaaacgaagccaggcgggacuacucucuacauugcugugggcaccuucccuaguugccaucuguugugcuagggagaugcauguuuauuaaacuuuauuuguuuuagucuuugagaacuauuuuacaaaacgcauuuggggaagauccauggcuugaauucaugagagcaaagggaauaaauuuccugacuuggauuuuuaauaggagauccuuuauucucccauccucuggcuuuaaauucaaguccaguuugcuaaaggaucagauacuaccuugaagaccuuuauauuucguuuguccuuaaauagaaggauuaagccauuaacagaaauuucucuuuuuacaauuaaucuucagaaaaagaacaauauuuuauuucaacaauuucuuuuuaauaacacugcucuuugccccuuugcaaaauaaaggccccuccuuuggcccacuuuggacaaggauccccaccccacugucucccuauauaaauacccaucaccccuucugaaauucugaagguguuuguaauggauuuauauaaacaugcugaauaauacacaacugauacugacucccuaacuuauaaaacaaaaagcaauaaaaauuauuaauuuauaaaucucugaaaaugaguauuucuuuuuuuuuugagacaaagucuugcucuauugcccaggcuggagugcaguggcacaaucucggcucacugcaagcuccgccucccggguucaugccauucuccugccucagccucccgaguagcugggacuacaggugcccgccaccacgcccggcuaauuuuuuuguauuuuuaauaaagacgggguuucaccauguuagccaagauggucuugaucuccugaccucgugauccacccaccuuggccucccagaaaaugaguauuucuuuaaaggcuguucccaucccagccccucauccuaccauaaacacauaauccaguucuggggggucucucauggaagcccugggaauauaaaucgaccaucuuggugcuuccauuggauccauggcugcacaucaaccauguuucaggguacuauauuaauaugugggacaugguuguaagaagguagauguuuaucacuuccuuucuuucccuugaagggaccugcagacaugacugaauguauaaggaaucuucaaaauaucauguagcugugacuguaauauauuagauguuuuaggagcuaaucaaaugcccaguuuucaaauuguugucauuugaaagaaauggaagucaaaaucaucagaaugccagaaagcaauaauaugccaugcacucuaucuccaacacauuuugcugucauuuaaaccuacaauuuagacaacaggagggagaagaaaaaauuaucuauugauccaacagucacacuaucauuuuuggaggguugcccaccuacccugaaacccuggauauagaaaucauauccuuaguacaaauagcaccauuauuuauagaaccuugaacauuucauaauaucuuuauauuauguauaaaucuuaguuggagcauguggaccuuucuaaauauaccuuuucacuagcuaaggacauuucucuuggaaaagaaacaggcaguaucucuuuagaauggaugaaaguugaacaguggccacaaagcaaaucuauaaucaacauacucugaccacaucacaaccuagcuuucuuggucucugagguggugguggggaagggaaggagguaaaggugaaaagggaaacacugauguaucucugauucuucucugccaggcugcauccauuuucaaagaaauaauccucaauauauaauguaagaauaugguaauauuggugagacuaccaggcccuauccgauaguagagcaauaucaggauaugccuuggacaaugcgcaaagcaggacuggcucagagagaucaacaccuguucucauccccccaucaacccauccauguuauuucaguagcagcccucguaacucccaaccaagacucugugggcagggaacaaacugauaauaacauccaaaccagugagaaucagcaguagaaucacagguuguagguagaauuauuaggaaggagacauauuuucccacugagauugauaaacugguacuagauaaaccuugaacuacuuggggagucuccaaaaauagaccccacaaaaagaagagcauagcugaaagaaggagaggcagaggaagacggagaaagacagagagacaggagggagagaugaugagagaaacugcggcaagaaagggaugaagaauuggagaaaaagaaauuuaagggaagaagaaggaggggaagaaaagagaagucagcuuuuggagucaaaucaaaaugguucauauuuuccauuauguguucuuuuauuaauaauucauuugagcugcuauaacaaaaauaucauagacuggguggcuuaugacaacaggaaauuuauuucucacauuucuggaggcugggaaguccuagauuaaagcauuggcagaccucugugucuggugaggguccacuucuuauuccaagaaggcugucuucuuuuuguguguucacauggccaagggggcaagggaguccucuggggucucuuuuauaagggcacuuaucccauucgggagaucuccacccucaugacauaaucacuuaucaaaggccuccacuaaucccauucaggagaccuccacuuucaugacauaaucacuuaucaaaggccuccaccuccaaauaccaucacauuggagguuucaacauuugaauuuugaggggacacaagcauuuaguauauaaaacacauuaaccuauaaaauaauuguuuugcuugucauuauauagaaccuggaguuguaccuggaaugcaacagguuuucaguaaauuuuucuaagucaaugaaugacacacuuggccuccugaaucuaguugcacuuaaagccauaaguuucuauccauggguuaccuggugccaugaguuaauaaaugccuccauguuuauucauguggcauuucugucacuuacaaagaaaagggucuuauuaaaccagagaucuuaaaauacuaagccgcaguaacuggaaagcagagugguggguaucagggcagaccucaggcaaggucuggagcacugucugaggaguucaugucuuggcagggcaucuagguucauucacaggguuuuccccagcacaaauuacugacccagcucuaaaucuuaauaucguauuucuccccuaaauccaguuaguuacuaaccuugagaaaccacccaucaaaaagucuauaaggauucauacuguuccucaaaucucucuuuccaugacacccacucaccacaguggagaucucgaaugccacagcauccuuuguugacugcguucccucaucauccucauuaaggccugcuaagaacaagcuuuaauuuccucagcucaguauuccugaauucuuguuuagauuuuacugaacuccuauuuccuuuuuuuguuuuugaaucuuuuuuuuuuuucuuuuaacuuugagguucggggauacacaugcagguuucuuauauagguaaacucaugucacaaggauuuugugugacacauuuugugucacacacauuaugugucacaucaaauccgucaugcagguagugugccaaacagugcagauauuuugugacauaaguucaccuacagaagaauuauuuugucacuagacacuaagcauaguaccugauauauauuuuuucggauccucuccuuccucccacccuccacccucaaguagaccucaacgucuguuguuccccucuuuguguccauguguucauguuauuuagcuccuauuuguaagggagaacaugugauauuugguugucuguuccuguauuaguuuguuaaggauaauggucuccagcuccauccauguugcugcaaagaacaugaucuuguucuuuuuuguggcugcauaguguuucaugguauaugugacacauuuucuuuauccauucuaccguugauggucauuuagguugagaccaugucuuugcuauugugaagagugcugcaauaaacaaauuaguacgugugucuuuaugguagaaugauucauaugccuuuggguauauacccaaguaaugaaauugcuagguugaaugguaauuuuuuuuuuucuugggccuguauguuagggcuucagaaucuggucuccccuucauaaugguccaguucuaaucuauuuguauuuucucaacaacucacaaacguccuccuucuuuauaggcucauauuggugccugacuggaaggggccauuccccuucuaacucacaauucaccuagccagguuguacccauucuucaaagaaaagcucaaaaucucccaccucugaccacaucuuucauguagguagugugccaaaccaugcauauauuuacaguaugcuaccuaguguuaccuaauaaguuuuugugcggcugcagaauacaacccaagcuuuuugugaguagaaugugccugguuuucucccaaagaacucaggaugaaacucuuaagacauggucaggaaaugcuuguuuauugauagaaagauggaugguccaaguaggcaccuggggauaggcagcagguaugaaagggauagaugauuuggaaaauauggaguccuaaaaauaaauuucacccacuucacaauuugcugaucaaagccauaggaaguaguuggcaccuguguaagguuacaauucuuguuccuugauuuauuuuaucaacacagguguaguccucagugauuacuugccaggcaacccugcauaaaagacauuuuucauagugccaacccccugagcuugggugauugcuaaaagcugggguuaauuaaccacauaccccuucuaagccugcaagagaccaugaacugagcaaacugcuaaaaaaugccauuucaucuuuacaguugagauaaaaguaguuaaggcaaaagugcaaauucccauugauuuuauacacagauacacacacacauacccaaacugaauaaauaauuuaaauuucaaugaaauuaaaaguuccauuucauuuuuaagugcauauuccccaaaccacucagcuacuguuaaagcuuucaacaccuaaagaaucccuagagucuggcauuuuucuaccaucucaaaaagaggucaauaacuggguccacauugcugagaauucacagaaaucagaaaacauucaggcagaggguaaccuuaauuuauggaaaguaugucuauguggggauccacagucuugaccucccugugccucauuuaccauucuaucaagagccagcucauguuguaauuccuccaucaccccuucccugcccucccaguucacagaaacccagccucuucugugugccuauagccaucucuaccauuuauuugguucuuuaugaacaauucucaccaaggaaauaauucuauauugugcaaaccucuugcauuguuaauugaauuuccgaugucagacgguauacaaauaauauaagcugcaucauuacuauccuguaguguucagaaacuugucaugagcauuuuuuuuuuuuuauccaauuaaaggcacagcugcccaaggauaggaaagugucagaccauuacauuuccuugaaacugaaguuucuggcacagugccuuacacagaaucggugcuaagcaaauuagaaauauguauagauauguacauauaaauauguauuggcuaugaaugaaauaguauucuagcuacuuggcuuaauuacaugauaccgaucuuuggagacaaggcuaggugcagagguggaauugguggcucgcugcgacuucaccaacgguagagucauauuguugccuacucucauucccuuuuuacacuuuauacacucauucccuuucuucccugcucaaauaccuccccuaugcgggaaaaagauggaaauuucuaggagccaaagcuuuugauuguaugcauaggauuaagauguauauacccuuggaagaagaaguacaaagaguaaauggcuuuuaucaaaguagugaguggugggaguagauaagcuugaaaacaguaggaacugaaagagaauagauucgauaaaauggugcuucuaagagaugagaacccuuaauggaacaaggaggcaggauguguuugagaacaccuaggaccuuucccauugccagccccgcagcaaaggaaagugaggaaaguaugugggugccagugggcagaagaaguacaagguuugggagcaccaaggacucuuugcauccuaggggaucccaaagguaucuccacucuagugccagagccagggcuguuuugccugcccaaaucaacucugaccucucuuugucuuugccaaagccugugagaaugaccucuuccuguccucucuggcagcaccaucuuucaaucucuaucucguuguuuucucccucucaugucccccuccaaaaugccagcacugucuucaaagcaagcacacaggucccaagcacuuuaauucuuaacauuaugagggaacuagcacagaaauaaggucuucuuuuuaauuauaugaacaguuaaaacaaccaaagaaauauuuuaacuauuugcacacuaacaagccccaaucuagaggugcuaaccuuauuguuagcccacuuaugcugucuuuugcuugcuuugggugaagcuuaucaagcucugugcucuuccucgacuucucaaacugaucuccaagcugggggaaggccaggcugcccccaaccccagcaccaacacccaggagacuaccaccuccugaacacgaaggugcaagccacuggcacuccucaggcuuaggugaaucagggaccucacugagcaugcuuggagucugucauacuaguacuaucucuuggggcauucccucacacuuggaaccaaugaaaacuuuaugaggcaaaauggaauuuuuguagcaugacaguuaaaaacuaaacuauguagaaagcaggccgaaacccuggaacacaugucucacaucgucccaaauauuccucacucuguggcucccauaaacaccaucugcuguguuaauuuguaaagaauuacaagguucuuaaaauuacacuuugcucucuguagcguacacugugucuaugaagggggagacuugagaaugcauauuacauccagucauacacugagaucuuccuuccuaugcuggcaucuaaaugaaaguuugcuaggucugcauggaauuuuaagaagugcauuguaaucucugcaggccagcuguagggaaggaaaacacaaaaacaaaaaauacacacaauaagaccuuugccuagguuaucauccuacaagcuuauaccuuuucagauugcgcauauaucucacacuucacuggauucuuaugacaacacaaagucuucggcuauaagugaaaaaggcugaacagccaaaacugggagaacuucuugggagagacuuaauucuccauugcuggcuccugaccuccaaggccuccucagagcccuugcgggaggcugagaguuucucaguuguuccucccugucugcuuagaaauucagaagagcaacaucucuucccaaaaguacaucucuggccaggugcgguggcucacgccuguaaucccagcacuuugggaggccaaggugggaggaucacaaagucaggagaucgagauuauccuggcuaacacggugaaaccccgucucuaccaaaaauacaaaaaauuagccgggcaugguggcaggcaccuguaaucccagcuacucaggaggcugaggcaggagaauggcgugaacccgggaggcggagcuugcagugagccgagaucgugccacugcacuccagccugggcgacagagugagacuccgucucaaaaaaaaaaaaaaaaaaaaaaaaaaguacaucucgaacagugcaagacauugaugaauggcugcuaaugaaaacuuuuacguaacuuagguccucagggugcugcugcugguuaaauagugguaaaugguggcuaaaaaaugagaaaauaaauaggagagucuuagacucaauaguccauaggcuuaaaacuguuaauaggagauaguuauaacaaaugaagauuccuggucccuuucccaaaauacucuguuucaguaucucuaggguagggcauggaaauuuuccauuuuaauaaacauuuuuaaauuauagauaaauucuugaaacaggaggauaguucaauggguuucaaaccaacaaaucauuugauuaaucaaucucuccaauuguggccuaggaaucuguauuuucauauuuccuucaaaauuccauuguuuaaccuaauuugggaacuuauuuuuguaaccauuuacuggaaguacaccugaaauagaaccaaaauccacaauuauggcaauucugcuuaauucccagugaauuagucacuauaucuaaaaaaacccaagagauucauaaucaaaccacuuaauuagaagagaaaagccacacuuucugacacacuaaaacaauacaggcuaggcauacccuguaacaacauuucaaaaaaagucccugcacaaagaaagaaaaagcuauaccagcuucccaaauucuuugacuguuauugucauauccaccuguagacaucaaauaagguuagcugagacgauggacaaagagauaaaagugacugcugaucuuacuaaggcauaaagagcuuaagaaacuuuugcaaguuuacaaaaguaaaacaaaaaaccaggauccugauacaggcaauauuucagagcuucugcuuguaaaccugucuacacuaugcugauuuccuaauauuuuaagaaaauucacucccaaguuccucuuucuaugaucccaaccuuuccguucccuuguaauuaugccccagcccucaagaagaagaguuucucugagcaccccauaauaaucuccuaaaucccacuucugcccucuuccccauccugaagcauccucuacagccaagauaaaacccugccucucccugaccccagagccuacacagaacucucuucccgauaccacgacagaucagugcuuucugaugucgggcagacaaagaaagcccugaauagccuucuuggggaaagcuggcaccaaguggucucaccccgcaucccucauagucagauaccuggcuguagcuacucccugucuuccaagcccugaugaaaaaggcaagaguagggcuaaaggugggugcuugaagcuucucuguucacucagaauaagcugaggggaaugaacuauuguugcuucuaauuaugucaucggcccuauggaaaacuggauuuuuaacacugauuauaggaaacuauuggaguagguugacaauaacuccuaaacugcugaugaugcauuuguuaaucauauauacaacacagcagaguaaaauaaaaauguugugaucaugccuugcauuugaaugugugcauaugaaugaauguguguguguguguguguguguguguauacugcaaguucaugugacauuaugucuucucuguuauuuauuuauuuauuuauuuauuuauuuauuuauuuauuuauuuauuuuuugagacagaguuuugcucuuguugcccaggcuggaguacaauggcgcaaucucugcucacugcaagcuccgucuccugcguucaagugauucuccugccucagccucccaaguagcugggauuaaaggcgcgccaccaugcccggcuaauuuuuugcauguuuagugcagagacgggguuucaccauguugggcaggcuggucucaaacuccugaccucgugauucgcccaccucggccuaccaaagugcugggauuacaggcuugagccaccugcgccuggcccccuucucugcuauuuguaagcagguacucucccaguagauagaguuuaaacuaugucagggagagaccacaucucccagugucaggcacaaugcccccaaaaggaguuucccuuguacucaauaaagucuuguagugacauuagacuugggagucaaagaauguuaaggccaaguuuccucuggccacagaugagagaugggaccauagaugaccgaggaagauaaauuccaaaaucuuaguucuuccagaaucucauaccaaccugcuuauuugcauccagagcuaccuauccggccaugugucgccauggaaagccauagugcuagcuccaagguucaucuuagucuccuagaaggcuuaugacacuaagacuuaggguggggaaagacggaugcuuugauaaauaaaucaauguuaucucauuuuaccuucuuauguaaaaucacaaugcaaaugcaauuuccagucuuccuaccuccucaaccuucaugcucucccacaugccuuccuuuccuuccaagagcuuucgaaguagacacagacuuacauuacaucucagcugcucagcugugugaggcugggcaauuuuccuaaacucacugaaucucaguucucaucugcagaauagugaaaauaaugccuaacccaagauuaugguaaaaauaagaaaaugcauacaacaugucuaucucugagucuagcaugaaaaugguauccaauaagcaaauuccuuacccugaucuuuuccucuugugauaguaagcuuccuaaggaaaggcacagugccaagaaucugaacuauggauaaauggaagacagauggauugaaugucuagggagaauaaauuguuuuauaggcuggaucuggauuuaccaagacuugccauuuggaaaucuuugagcaucugaguaauauuuaacacuugugaaauuuucaccaaguuaaaauccauucaugacauacucauauaugaggcaaaugaaaaaggagaaccagacauugacccugauauuucacuucuauaguccagucaugaggaauucaagcucugacaaccgugguagcuucuacuggggaaagauggggagcaaaugcuggggacugauuccuccuuuucaguccucugcauggguaaugaaaucaguaaugaacacaccucacugaugauuguaaucaaacugagcaccuguaacugccagaaagagggagaucccccaagcaucaagaguggauucuauuucagucacccucacuuggcauaucaaggaagggauggccuugcagaaauuagaaagccagaugcagcaggcuuuccaugucugccccacacugauggggaguccucgaagggaauugcuaaucacuuauacacaccucagaagguagcagccuccagagcugggucugaacagcaagaaaaacauucuuuucuaaauguccucuccaccaugaugcaaagucuagagaucuaucuaucauucuuuaauguacaauucuuuauuguaacucauuuguaaugacuccagaaguucccugcuaaaacacuaauaaaacuaagaaggauguuacauagacaauuuacuuaccguuuuuuuuuuuuuuuccuguuucuaccauuagccuauaaaccucaauuaggaacuucaucucucuaguuugcuggcaugucuacuaaguccaguagcuggcaaaaguuucuuaaugaaggugugaccuaaaaugguugucauucuagaaaauagacagcuguucccuaaacagauagaauagaaaggcaagauggaaaccucugugugaagggugggagaagaaaacuuaaagaguuaaauaaaacaaacucuggucccauaggaaaucaguucauuaggaauuuaggauuuaggaauuagacauauguaugacucuaaacaaaaaacugaggggaaaaaaaaucaaauaaugguagagaugugggaggggcaaaaaaaagauucauuuuuauaguuuaaggcaaagagugacucagaccuucagaccuuauccuggagcuucugugugcugugguggauccaaagcaggaacuaccaagggaauaaaacuggccagagaucccauuucuacuaccaaaauaggagguacuuagaggaagucagaaagggaagccagaaaccaggaaucaaaagugaguaaaaaguccugaguaaaaccagcuauaagucugacuugaaggccaggcaugguggcucaugccuguaaucccagcacuuugggaggccgaggcgggugaaucaugaggucaggagaucgagaccauccuggcuaacacaguaaaacccuguuucuacuaaaaauacaaaaauuagcugggcauuguggcgggcgccuguagucccagcuacuugggaggcugaggcaggagaauggcaugaaccugggaggcggagcuugcagugagcugagaucacgccacugcacuccagccugggcaacagagugagacuccaucucaaaaaaaaaaaaaaaaaaaagaagccagaaaccaggaaucaaaagguaguaaaaaguccugaguaaaaccagcuauaagucugacuugagggugggucaccauguuauggguucaagucuuuucauuaccuguacagaagccagacuggugccaagcucaaaguuuccuggcaauccaccccuauccccacaaccuacauguaaacaaacacaaagccagguuuauaagaaccaaacuguauaccucccuucccccucucuuccucauccugagagcuccauagaaaucccuaccuccuggggaggcccuuuucccuccagaggaccuccugugccuuucccgaggcuaucccaacccucucuucucccuuguguccguucuccugugauuaaccaaagccuguuaaauggaaaacaaagaaagaacuuccaaccuaauaaacauuaaauacagucugaguaucauaauuuuguuuucuuaagcacagugacuccagggguagaaggaguaggcuuccaucugugcucgccugggguggggaagaaucugcaggcugcaaaucacaucaucugggcugaaggagccugccaccacacuccauuucaaacgauauaucauuccacuaaguaaguguuuauugggcaccuauguaauguugaguccuguagaggugugaugugggcugaacugugucucccccauccucaaauucacauuguggagugcuaaacccuaagaccucagaaugugacuauauuugggcgauacgaccuuuaaagagguaauuaaguuaaaaugagaucauuaguccuaacgaucucagcccuaauccaauaugacugguauccuuaaagaagagauuaggacacacacacacacacacacacacacacacacacgcacgcacgcacgcagaggaaagacagugugagggccgaaggagaagaucaccaucuccaagucaaggucagaggccucagaagaaaccaacccuguugacuccuucaucucagacuucuagucuccagaacugugagaaaacaaauuucuguuguuuucugugaauaagucuccaucuuauucacaacagcaaagacauggaaucaagcuagguacccaugaacgguaaauugguuaaagaagauguguuacauauacaccauggaauacugcacagccauaacaagaacaaaaucauguuccuucagcaacauggaugcagcuggcagccauuaucguaagcaaauuaacacagaaacagauaccaaaaaccacauguuuucacuuauaagugagaguuaaacauugguacagaaagauggaaacaauagauacuaggaacuaccaggguggaaagagaggaagccagggaggacugaaaaacuaccuguugauuacuauguuuacuaccuggaugaugggaccugcaccucgaacuucagcaucauacaguccaucaauauaacaaaccuguaccuguugcccugaaucaaaaauaagaguugaaaucuuuuuuuuuuuuaaaguuucccagucuuugguauuuuguuaugguagcccuagcaaacuaagauaugguguaacaggaaauaccagaguaaugguuuguugagguuugaugacauuacugauuaggcuacaaggaguucuagagagcugagaugaggacagguagggaggaugugacaggcuccagaaaucucuugugugaauucucggaaagcucuucaguauuucacagcacaagacucacgucaaucaguuugucugaauaacaaaagagcagcaucucauccaacaauuagaaauuucccaagcccaggagcagguuucuuggucugaaugccaggcugguuuccucaggcuuucucaagcuccuucuagagucuuacaucucuuauuagaaauuggcagcuauaggaugcaaaauaauucaauaauaaguaaguaaguaaauaaauaaauaaagcaaaguaaagccaccuuccuuauugguccucaaauauuucucauuucaguaagcauccagagacaaauuuaaucucaugcucucucacgguuuaauucagguaaaaaauagaacuucuauaugcuaugugaaagcuugcaggugcuuuugauuaagaaacuugaaguauuuuagguaacuauaugauaccuauccccuuaugggcaauauuucuuuaaugaugucccuuucagaguucagguuuacuauuccuaguacuccaagcaagcaguggguagcugugugcuugagauaccaugaaaacaaccuacauguugacuaaagggagugaagaaauacaugcaaagcuggaucauggcuaaaccauugguccugauucauucacuccacuaauuaacacugagacucauagaaugaucagguccugauuuguucacuccacuaauuaacacugagacucauagaaugaucagguccugauucuuccacuccacuaauuaacacugagacuccuagaaugaucacagggcuaggcacugggccauggcaacacaaucauggucacaaucugcauggaguuaccgucuaaagcuuguagucuaaaugucagcacuauugacauucugagcuggauaauucuuuguuguggagggcuacccuaggcauuguagaauauuuaacagcaucccuggucucugcuaauuagauuccaguguauuuuucccccaguuauggcaaucuaaaauaucuccagacauugcuaaguauccuggggaaggggggagcaaaauuuucccacuugggaacaacuggcuuaacaaaugagacauaauuuuuaaaguaauuaaaauagaguaagacaaaugcuaugauacagauacaaugcaaauugacugagaaguaacguggcucaauaaaaaaaaaaaaaaagcuguuuucccaaugaagagauaugaaaugaagacaaugucuauuuuuugggugucuacugugugucaaacacuugaccuugauuguuuauuuaauucuuaugacauacucauaugauaaacauuuuacagguaugcucaaagacaccaaugaacauguucaagggccaaagagugagagauaaacccaggaucaaauccagguucuacacucaaguccaauuaauucuuuaggaaggacagagaaauuuuaagaaagagcaaccuuugcuacaugagggcuaaaguagccaacagcuuaaaaaaaaaaaaaaaacuucucuaaaaauggagcuugcauggggauuuguggcccuaaauaaauauauuauugaaauaauguaaauuugagacugguuuaaggcaaugaguaaagguuauaguggagagguucugggguuccacagcauccauccuauagucaugagaguccauggauuggccuuauguuugagaguccucaaauaucaaccugccagcuaauuaucauccauaaauccaaucaucucacaccugcaugaauuuguuucauagggagggagaugauuccuucaaaauuucuuauauuguccuugcauaguugauaauaaugccuccuuucacucuauaaagugcuucaauucggacgacaaguuuuaugaccaccuuauuauuaguucaauuaagucuggagcugaaaaauuauuaggccagcuauuuuacgucauuucaugucaccaguuucacucugugaaaaucaaguccauuauuuaaucauuaccucuaauaagcauacauuacuucacucaccugccugaaauucuccaaugccaaccuaucaucuacaagauaaguccaagaagguccugggcaauuugacuucagguuugcucuccaaccuuaccuuccaccuccauugcucaaauagacugugcuuucaugccucuaggcucuuucacguggcauucucacugcugacauucccuccaucauuuuauucaauaacauugaccacuguguuagaaucuacaaugcuccccauucucucuucaccuguuuauugaugaucucauucaaauauuaucuucucuguaaaaaaaaaaaaaaaaucccugauuuccucaaacauuauuuguuccuuuguguguguguguguguguguaugcacugcacuucaugcaucuuucuaccaugguuccugucauccuaaaauugcagguuucuuugucuaugcuauucauaauacuacuauaucaucauuaucuuuauauuguuaacacuucacuaccucauauuuaguugacaucugauacauauuugcugauaaugacugcuauggguaaauguuaaaaucagaauuggccacauuuuggacaauucaucugagugccuaucaugugacagccauauggcuuuugcuguguaaugauggaguucaggacaugcuaccucaauauauggcaucuuggcauuugagaaaucugcagaagcagaaaggucacucucaccuucuucuugaauuucuccccucaagccagucauaugacccucauuugagaaguacccuuccuaacccugaagggaaagaacauucuuaacucugaagauauagggauacagaaaagaaagugaaaaucaggccaugcuguuuccucccguuucuuaccauuagaucauaucguuuuugcucaaucauacuucucuacaacuauuuaugucaucaucaaaccuagcauuaaaaaauauguagauuuacuuauuucauugggucuucauuucuuuaugaagccucuugugucauguaaaacauacuaaauacacuuguaugcuuuucuguuacuaaucugccuuuuguuacaggggccucagccaugaaccuagugaugaguaagaaaagauauuucuuuaaccuuucaguaacaaacacaaguaaguggcugugugguauagugaaaagccagaauaucuuuaucuuauuugccauuuucuucuuugucuuucugugaggacaggaaagucacugaacuguauuagaucccagcuuucuuaucucuaaagcaagguguuagaacuagauaauuuuuaaguuuuuuucuccucgauaguuaagucauccuuggucaaggugacacaccaaagucuucuggcuaguugucaaugaaucagcauugacuuggccuuauuauggcuauauuuuuccuccauauuuaaaaaaugguauuuaaaguuacacaauagucuauauuaaacauuuugaacaauauuuauaugaauaaaguaaaaggugaauuccccccuuuccacaaacacacagcccuuccugcccugaaauuguugguaauauuucacuagguagcuauagaucuuuuuccauucacacacgcacacaaacacauacacacacacacacaccacucaaauauguucauauacaauauuuuuucgcugaaauaggauacaauggcugcacugaguucuccuaccucuuucacucagcaagaguucaccaacacucuuccauguuucauggcaguacaauauaaaugccucaaccuuuuguugugaauucaugauacuugcuacuuggagugagcuaucguuuaaguguuucccuauauuuuagcaucuguguugccaaauuaguuuucuacugcugucauaacaaauuaccagacuuaguggcuuaagauagcacaaauauauugucuuaaguucuguaggucagaaauccuauagcauugaaaucaagguguggucaggcauacacuccuuucuggaggugcuagaagagaaucuguuuccgugccuuuuccugcuucuggaaacagcccacuuucuuggcucauuccucucuucaucuucaaagcuagcaauuuagcaucucucuggcugugcuucuguaguuccgucucucucugacucuagccaggaaagauuuucuaccuuugaagacucaaaugauuaaacuggauccaccugauaauccaagacacucuccccaucucagggucuuuaaccuuaaucacaucugugaaauuccuuuuccauauaagguaacauauucauggguuccaggacuuaguacguggauauccuuugagagccauaacauauucauggguuccaggacuuaguacguggauauccuuugagagccauuuuucugccuaccacaauuucaauauuucacuuuuacaaagaauaaggcagugggcaucuguauauguacauucuugcaugcuugggugagcacuugcguagaacagguuccuagaaguagauuacuaggucaaagaauauguauauuccccaacuuucuaagauacagagaaauuuaucccuuuaagaagucccugccuuauuuuuaaguguccuuucuaaacguuuagauauaugaaaauggugggggagaaauauauccuuuguggcaaaauaaccuaaaacguuuaaaauccuaguucacuauaacuugcauagguauaaaaagauaagaauaagauggugggauuaucugcccaggcaccucucacuccucuuuggaagcuugaggaaggggguuguaggacaaacaaaaugcucuauauagugaaaauaaacuuuaugaaccuguucuucaaaguauugcucugagcugacuaacccuauagcuuuagacauaggguucaagaaaaguauacuacaauauccuggagcacagucacccagcugaccugacaguuccaaacuucaccaguucuccuaccaucauuucucauuccuacccacuagccuagcgugccaaauauauauauauauauacacacacacacacacacacauauauacacacacacauauauauauacacauacuguuuuucauuuucuuuucuuuucuuuucuuuuuuuuuuugcuaaaaauggcaaaccuaucagccauugaaaacaggcugcuaaaaacaguuagagauauuuagaauaugccccuaaauuuggaguuugcugucacaaaaggaaaauuugacaucucccagaacaucuguaucauguaagugccuuaagaauaaaucugugcacaaaauagaucaaucaggcuaauuggauacuuuucacaggccuuuguguuaaggcuuacuuuuuguacccacauuggccugcuuucuaaacugaagcaaaaaugguuaaaaaaaaaauggcaucuguguauagugcauucaauucuccaaauuuagcacaugcacguaaaaauuuauagaaaggagauuauaugaugggaauuagcuuuacagcgugagacaauuucuguccucuacaugcacccuauuacuacuaauaauuuaaaaucuaacuagcuaaaauguagacaacauuucccagucuaugaaauacuuuucaaugccuuauuucauuuuaauccucagugcaacccauaacuuggguaguauuuuauaaucucucuuugcagaugcugaaagucuaaaaaugguaaagauuacauagacaggagaggggagaaauucagagcuuaaauguaaauauaugccaaaacaguguaugacauugauauggccucugagguucaaucaaauucuaaauugauauugugugaucucuaccacaggaauaucuuucuaugaaugugucaagcuuucagaagucauuuuuugcaugcauuuauuugguaacguggauuucuaaauuaugaugauaacagucugagcaaacugauaaacaucuuggaacucaacugccaaaagucacaucuaaacacaaucccaccugaaauuaacaaguugcuacgaaucucaauggagcagaugcuuacuauuucugauauccuacucagcugaaugauaaaaacaaaccaacaaaauaaaaaacaaccaaaggaaagaagagaauguaaucccuacuaguuaguagagcugauauugaauacuuaccucuuuuuuuaaaaacugcauuauuucaacaucuuuaaacauuuuuuucacaccauuacaagcaggauauaaaaguuauaaaaaaaaguuaaucauaaugcugguuuuuaccaagcauaaagcuauuuauaaagagcugaaugcucaaccaacuuuucaauuugcaucuagauauuggucauaggguagcugcuggcaaaauaaaauaaaauaaaauaaaaaauaaaacaaauaaaaguuuuaaaaucuuaagauaauaauaacaguuaucauuaaaugaaugucugcuacaggccaggagacuuauauucguuuucucccaccuccacaauaaccccaaacccuaaagcuucuuuuuaucaacgcauaaauggagcuucagaggccuuaagaaauuugccugugguuacaagacuagucagucggaggucucaaaccugggugaaucugugcacucuccacaacaccgcauuguauacucuaguucagcagcacccagaauagaagggaaaaacagugugauaaugaaguauuuuguuuuccguuuuucuacgcaaugugaaaguaaaauaaaucuuggggucccacuacccuaaagggaaaagucaagccgggaacugcuuagagcaaaccugccucccauucuauucaaagucaucccccugcucuuugagauacauguguaucugauugccuccuuuugaaagacuaaucagaaacucaaaaaaaaaaaaaaaugcaaccauuugucucucaccuaccugugaccuggaagcccccucccugcuuccaguugucccgcuuuucuggauggaaccaauggaaucaauguacaucugucauauauugauugaugucucaugucucccuaaaauguauaaaauuaaguugugccucgaccaccuugggcacaugucaucaggaccuccuaaggcugugucacagcugugcauccgcaaccuuggcaaaagaaacuuucuaaaguaacugagaccugucucagauauucgggguucacagcgauaugccugagggauuugacacacugcaacaacagcagcggaggaagaagggagaggcaaugaaagggaguugaagagguauuuuaggaaggcugauccaauaucugguggaugcauggccaccaccacaagguuggagagccuaucacuaaauaaccaugugacagccuucaucggcuagaucugcagaucucaaaagaugaucuguaggacaccaggccuugaauuugccccuaaaaaaguuaucaaauaugcaaaugcgucugugaacuacuuuauacaaacaaaugcaugcauacacacacgccgccacugccaccacagugcaccuuuaagaaaagaaaucaaugcaaguaucaaggcacugacagugacaaauaaaagaaaucuguuuaacuugauuaacccugcuuuuccaacuucuacugggccucagaaauguuuuucucuuguaauauccauuaaaaucuucaggagcugauguucagaggagcacgcccaugaagaagauauucuuugugaccuuucuaacucacauauuguauugcccaagaggugggaccagaaccccagaaguccuuaggucuucccugaaaugcauucuuccugguaaacugguauuugggauguuaaguguucugugugagaauugccacauucuaaucccauuaccuucccuaucauuaagguaagugacagcaauucgaguucccugucaguuuaauuagaggaagugaaacacaauuacagggcauuagugggcauuagugcaagccugaugcaggagagcagcaggccccgaggggcaagcauaacagccgaccacagggggaaaaaugcacucuucuccucugauucauugaaagucuuaauuacaaugcuacuguagggggaaauuguuuuauaaaugccauuacaaacacagucugauugcaaaaaucuuuuuaucuaaaaacuaauuaaaccauuauuuccucucagaugacaaugguaaguguaaguuuuucacuuaugaaaacaguuacacaaucuuauguuccucauauuuagagagcaucuuuuuuuuaaaagugucuacaggccaaaaugauuuuagaaauuagaaacacuaugaagaccauaauagaguuguuguuguuuuuuuuuuuuuuccaaaaaacacaaacuaucauguuguaggcaaaagacaguguuuuugcuaaaauguaaaaauauaaugagcuuauaugugccagcucauuuugaugaguacauuuuuaaaaaaucauguaaaaaauaauuuacaaaauacuauugccagauaugacaaaaacaagauuuuacaaccuuuaaaauauaagcugugagagggcaagcgguuguguuuaugcagggcugcacugucagcaugucaacagugaacagugggugccuacuacucauucuuugaugggaagaaagcuacucuccaaguggcuuugaaguagucccuugaauuucauguuagaaacaacuggauauuagaguugauuggaauugcacagguuuucuuugaacgauuugauguauguagauuaaguuuugaauagauacgguaaagguggugacaacaaccccaaauagaugccauuuccaauuacaggggaaugggaagaggcacaaggccagguaugcagguauguagauaaaaagaaagaagugauguuacaugaaggccaaaccccacagaugacuggauuacaguguguaggagcacgcuuuagccaaugccacuaaaucgagcuguuacuaucgcauuuaaccccaucacuaaucauaaacccgaguuucuucccuguucuccccucuagagcccagcuacauaucaagggaaucuuucccuugcuuagaaaagauaaaacacuuucugcuuuaaggaaaagcugauagacuaaaaaucugugcagaagacacagaggugauuauaaaaggcuuauuuccuuaacaaaaggauucucugcaggcuuauuuuaaacagugagcuucucuaaugaguugaaguguuuauuuacagaucaucaauuaccuggggugaggaaagaaaaguaugaggagugucagagggaagauacaaaguacuuaaaucaaguaaaucauuaggagccacugacaagugaggaaccaucagaaaaaaaaaaaaaaaaaaaauuacuuucucucaaauuauaauacagacauccaugggaaacuuacuuuuagaauacacaaacugaaauuacacccauaauuuuaggaacgacuaaaauaaggcaaagaguuuauauuuaauauuuucaggcuucaccaucuccuuuuuuguaaacuguguuuuaaaaagggaaaggagaaaagagaaaagaacaucuuguuacagaggcuuuaauuuuaaaauugacccuuucuauugaacucugaagaagugaucagauaauuuauaaaaacacgccuucaaaaguuuauuuuccaaagcuuuuuucuccaagagaaucauaggcaaaacagcaagacaggagaacaguuauuuuuagcaaucucagugguacagcuuucuccugaggcaaaacuuaaaucagauaagggucuccgaggaccugaaaggaaggaaaccacccacuuacuguauucaacucaguccuccccacacaaacucgauuuuagaaacagaauuagaaaacauguuagagaauauuuaaggaugacacacugcaguaaacgcuaggaaccacauuucaacaacuguuagaggcuauuaccacucccguugcaugcaagaaaauuagcuguaauuggguaagcgacacaaguguagcacaggaaugggaauugaacagacacuuaauuaaugguauugggagaagggaaaugggauuaaugaaugguugauauaaauuccguuuugcuauuggguuaaucacuggucucaugaaaauuuauuuccuggcuaagauuuauagcagggguuuuaaauauuuuauuccauucugaauaauuucuaacuggcauuguaauuuccagaaucauacuagccacauuauuuauugguguguauaccugcuacccauaugcacgcaccauuauaagaauguggcaggacucaauucuaaguacagaaauccucacgcaaauagaggaggauagcuuugauucgacaucuuguuuaauaauuagggccucaccaaugauucaucaccacgaaggugaugaauuccaugucugaagaacaaagcccaaucuuagcauuguuucagucaccagagcauuuacugagcccggcuuuauuugagagagcugguaaaaucauguagcaugcuugagauuuuugagucuuucaaucuucaauuuaauucuuauacuuagcauuaccauggagcuauuuuuaguuauuuuugcuuugcuuguacuuuaucucaugauaugucaaaucugucaaaucgaaguaccucugaauucaagcaauggcaucauuuuuuuuucuucauguuuuuaaaaaucauuucugaagaaaaaauauuucugugcuuguuuuccaccauaucuaaauucauuucuuguacuuauauuuauuuuuguauuaaaauguaucuugcaggauuuuuuaaaccaaaauaauuauuuaggacaugucuuuauaaaaauacaauuucugaaaaauauaucuagaugaauuaguuaauaaguuagaacagcuugaauuuacugugacuuuuuuuuuuuuuuuuuugagacgaugucuugcuauguugcccaggcuagaaugccauggugcagugguaauucacaggccugauauauagcaaaccuaagccucaaacuccuggacugaagcaauccuccuggcucagccucccaaguagcugggauuacaggcaugcaccaccacgcccaguuccuaacauuuauuguuaauacuacuauggaacaagaacacauugauaacaagagaauucauacacaacauuuacagaaaacugguucuuauggguaagacgugcagagagaguaaauguucaacuccaaccgauaaauguagagcugacacauuuuuguugcaaaaagauucuuggccuuguagagagagacucuuuuaaaaacguuaaguuuccacuuaaauauuagauucauguauuaaccaguaaagauaucucauuucuaguaauuucagcaucuaaaaugacaagugaguuuugcacaguuacuuuucuuaggcccugugugaugugaaauaauuaagaguguuauuacuccccuuucacagaugagaaaaaagauucaagaagauugaguggcuuccuaagauguguaaggguaagcacaaaucaaaaaagaaaaaguaaauaauucucucuguugaaaauagagaagagaccucucccucauccuuuuucuugcuuuagaaaacuuguaaauuauuuuucagucucuuugaaauguauguaaaucuuuuucaaaguuaaauaagccucuugccagccuuauaauggaggagugucuuucucaaggaccugggaacuaucucuuugaaauguuaucaaggaagaaagcauccuuaucaaccaguucuguggcagggguaggaaccuaacuucauuuagguuccuuucuccaaauugcaaaacugccucaugucauaaagauaagaguuuguuuuucuuugagacaaagucaauuagcuaaaacagauggucacccuaauuaccaagugaauucagguugaacugugugugacaaauggugcugucaaguccucuuacuagaggacuaguuauaguuuaucuuaagaacauguaugggauggguugcaucuauuuggcuuuuuaaaaaggugugauuucuuuuugucuuugcaaucucuuaguaggcggucuaugaugcacaucauauucuuguuuaguacuuauacaacaaugaaaccauuuucuuucucuuccaccuucauggagagguuuuggggggaaggaggagauuuuguucuaaauuauauuuccccaacaggugacacacauaauaaacaacagauggaguucaggccuggccuccagaauccaucccuugcaccucccuauucaucacagcuacuaauccugcuguauuuuucuaguugugaccgugucaugucaugauuuuuaaaauguccuuuuuuugggaacugguacuaugugucacccaaauggaagucaaacuacugauguguugucuuagaaauaagaauaagccauucaagaaacuacauguaguuugugaacauuuacuuuaaccauacuccuuaggauuaccuucacuuuaugaaacaagaaugacaguuuuuguuguuauauauucagaacccagugagcuacaauccauuuugcacccacgcugaguaaaaaaacuaauauaaugguguggcccaagugaggaacaaguaaaguuaugguuguuguuuaauuuuuaaccacguauuacuauuaagaaaugcauuucuauuuccucaugaggacucucagauaauucuuaugauuuacugagaaggccugaauauuugaccuaguuugaguaauaaagauccauuaccucuucagguugauguuccaucugcuagaaaaccaauuuguagccuacaaaaauugguauuacacagcucuuaaugggagaacaaaauaaagggguuggaggcaaugaaggccagcugggagaaaaaaaugugaggaccuuguucauaugacauccguguauaccauccauucccaggguaaaaaucagguucuggaaaaucaucuauuuaaaaaaaacccacuauaauacguuuaauaauuaauaauaauaaacacaaauuaauaauaaucaauagcaaguaucaauagaacauuaacaguagcauauucaaguuagugguuuagagcgacaaacuccagguucugcauagaucuccaugacaugagaaaucuuaucagaaagcaaguaagucaaaaugcuaucauuguagauuaacuuuaacuucauuaaaaaaauaaaacauuugcaaacgucacccuucugauucacuuguacuucuguucuagagaagugguuuguaagcagggccacuuacauguacucccuaagcauaugcagggacuaaucauagaguacccuaucaggacaguuuuaauaaaacaauugcuagauccucaaacucuguuaguauuaugaccuaaaauuagucuaagaugcuccugugguugaaauucuccuuuuccacuuucacucuuaccacucucccauuuuacaaaauaaggcacaauucucaccuauucuauaucuuacuaaaguauacugcucggauguguaaaaaacccuuaaguacuaccaaaagggauaauuagacaauuauuuuaauccaaguacccuaauagcuaccuccaucucucuauacuauguauuuucaaaaaauauacggugugucauaauuauccaucaaaaugguuaauaguuuugaucaguuguguguuacuuaucauagaaauagcucaaugcacaaugaacuuuucagcauauauaaacuuaugguucaccagaaaaaauuaaguaucaguuuaaauauuuuguuucacuaccucuuccaaucccuucaaaacaauaagaaaauuaggaauaaauuuaaugagagguguuuaagaccacuacauuagaaacuacaaaacuuugcuaaaaggaauuaaagauguaaauaaauggauaacuauaugaugguaaaagauaagaaaauucaauuucauuaagauguuaguuauccccaaauuuacugacagauuaaauauaauuccaaucaaaaucacaauagcuuguguuucugguacaaauuaacagucugauucuaaauugauauggaaauauaagaaaaaaggagucaagauuauguugaagaaaaauuagguuggaagauucacuccaucagauuucauaacuuagugaaaagcuauaauaauuaagacagcauauuaguccauucuuacacugcucuaaagaaauaccugagacugaguaacuuauaaagagaagagguuuaaugggcucaugguuccacaaacucuagaagcauaguggcaucugcuucuaggggggccucaggaaacuuacaguuaugucucaaggugaaggggaagcaggcacaucuuacauggccagagcaggaggaagaggggcaggugcucacacuuuuaaacaaucagaucucaugugaacucugucaugagaacagcaccaaagggggggugcuaaacccauucaugaaggauccacucccaugauccaaucaccucccaccaggcuccgccuccaacacuggggauuacaacugaacaugaguuuaggugggaauacagauccaaaccauaucagacaguguaucaucggcauaaauguagacaaaaagcucaguagaaccagaguccuaaaauucacuuaaacacauauggccacuuuauuuuuaauaaugauaucaauccaauuugauauggauggauagaaggaauuauuuauuuauuuuuuauuuauuuuagagacaggguccugccauauugcccaggcuggucuugaacuccugagcucaaguaauacuccugccucagccucccaaagugcuggugauuacaggugugagccaucauacucagcggcuaaaaagguuuuuuuuguuuuguuuuguuuuuuucauuagugagccuacaguaauggagucaaaaaaucaauaaaaauguucaauucuaaaaauauauugcuuuagaaucaauuucugugauaggauagaauggaaaccccaaugcaaaaaggaaaaagaaugaaguaauauuugaaaauguuauaaagaaccucuucauguuuuuuuuuaaugggugaagugauauuucuguuccguuuguuauauuucaaaagagugaugugagaguuuuauuuuacaauguuaacauauucaauauacuagaaagugcauccuuugcaacugguuagacuugagauauaacauuuuauauaucuacuuaaagauauacaaggaaauacauacuuuuucaaaaauuauuuaagggauguacaagcuaaacauaaaaguagaguaguggcugggcacaguggcucacgccuauaaucccagcacuuugggaagcucaggcggguagauaaccugaggggucaggaguucaaaaccagccuggucaacauggugaaaccccaucucuacuaaaaauacaaaaauuaggcaggcaugguggugggcaccuguaauuccagcuacucaggaggcugaggcaggagaauugcuugaaccugggaggcagagcuugcagugagccaagauugcgccauugcacuccagccuuggugacaagaccgaaacuccaucucaaaaaaaaaaaaaaaaaaaaaaaaguagaauacuacugacguagaacucauucauacauuuauuuagcaaaaauauuuugauaucuauuacaugccagacacucuucaagccuaaaauacuaguaagcaaugguuaaugacuauugaaggcuuacuccuugccacgcacuguccuaaggacuuuguaaguaagcauuaacugaauuuauuuucacaucgcuccugugaauagguacucauaguauccuuacuuucugggugauaaaacuaaggcacaaaaaggcuauagacguuuccccaguucacaaagauaaggaaugaacaagaaggacauagugucugcccccacagagccuaccuucaugaagacuagaaguuaggcagccccacuuauaucuagcuuugagugucacaugcaaagauaagcgccaccucuacccucucauguucuaagagcacccuguauuaccaagugucaauaaaaaaaaucaauuuuagagauggcuucucuuagcacaguucugggucaggcaguagcuguugacaaucuaugaagguaaguaucugaugguauuaucuaugugaaucaaauagguuauaaauuugcccaaguccuuggaaccaggaacccugaccuugucuuuuauucucagugcucgagugccaaauaggugguuuugacuagaagagucauauugauucuucugucuuuaguaugcaggccucaagaaauaucaagauacugacgagauccuccuuuuuccuauauucugccacacaucauuggucccacuuggaaucggggagcagggaagaagaaccaguuccaucuaucugucaauucggucuguccauagaggcaucugcuuugugcccggcucuaugauaggcacugucagagaugaggauaucgaaaagacuuccuggccucuggagaugcacaaaaggaggggcacuaugaauguaaauaccaaauacagauagacuaugagacugcugaacuauaucuacagaacaucaugcuaccuucuuucuuuccuuuccuuccccuuuugacuauuuuccuuccuugcuuaccaaaaaaaaauaaaaaauaaaaaaacaaaaacaaacaaacaaaaaaaaaacaaaaaaaaaaugcuauuuugaaugccuccuggcaagguaacuaaaagguaagccuucagggaucuguggugaugaacagguaccauggacucauuaaagaaaacuacuguuuucuaucauaaccauucacugaccuuuuucuuugcuauaauuuaagcacuccucaaggggugcauaugacuuccaguuugugcuugauuaugagugguuagccugccugaaguuaacacugcuaucuaccuuccuaccuucuccagugagcuaaauucaauccaaaaauauuaauaugacuccucgcuaggccucuagccuuuugaggagauccauagcacuugccugguuuauuuuauacuugauaccaaaagguauuuugauucagccauacacaaguaccuggccucuaagugcuuucaaacuaguugagagacaagaaaaaugcccccaaagagacuuccuaagacagcugaccgauaaguguugaaugaauggugucgacaaaaauacuuggagguucccuggauggugagauuaaugauggcugcaaugauccuggccauuaaaauggccaggcacauuuuaguuacuguuuccauuuccccccucuauuauuuuuucccaugacaguucuuccuucuguucucucucauuucugcacucucaaaccuugguuucuucucucuguaugguucauccccacaucuccauugccaggacaguggcuggccuaucauggguacacaauaaauguuuauuauuggaugagaauagcucaggauguuugagccggaagaaaccuuggagaccacucuuuuauaacugaguuccagagaggcuaagagauugcaggauucgcaguuggaaucagcaguguggaaucuuggugagcucacucuagguauaaugauguuuuuaccaugucuugcugccccuguuuauguucaaagcaaauacagauuccauuuucuguccauuagucaccuuugugccaaugugagguuaaauccacuuaccugguuuuuggcuuuuauagacagccaacuucuuuuaucacuaaccauuggucaaagcuauuuucaagaagaaaaucaggcccagcaggcauguucccuaucuuauugcucugcaggcugcuuugcagagagagaaaagaaacaaagugaaacaaaagccaaaaagggccaaacuauuauauaauugacauaacagaguugccaaggauaaagagggauccagcagguggacagugauuauuuugaagagugaaauggacaggcuaagaaauggaaucuuuuugggagaaaaaaaagaacaaugugacugugcuauuuacccagcaauauagaccauggaaggugaauacuuuuuugggguaucauuaauuuuaaccucugggcaguaaaaauuguucuaccuaaguaaaaauggucguuuaauguucauggaaaacaagacuuuuaaaauuauauaagaguucaaaaaagaaagaaagaaaaaguuguccaaugggaacaaaaauagaaaaguucaucauauacaacggagcaucuuugcugaugagaaauggucuuucccuaaaacuaaagugacaagagguuaccugccugaggcaugaugaucacuagaauaucagccaggacugugucuggcagcguguagccaaaacccaauaaagagcggcuuaauaaguaugaugcuuauuguucuuacauagcaagaaguuguucagaagacuaaucagggcuuguacaguggcccaagggagucgaguuggcaucccuaucauccuuagaauguagcucucauccucaucaucacaaaggaacugcugagccuccagacauuaugcccauaugccaggcaagauggggaaaagagaagagcaaaaagagcaugcagacuuuuuaucagaaaaacgaucuguucuagauggcuucugcuuacaucucauuggccaaaacuaugccauguggcuucuccuagccggaggagagucuguaaagucaacauuuuugcuuuuuagcugagaauauugccaggcuggacagugauauuacuaaggaaaaaaagagagaauggauaugugguaggcauauagcgaugucugcuacaauuaggaagaagauucauugccaaauggccccugacuaauacagaaacugcagugguaaacuagcacaugauaaaccagcccuuauccuguccacaucagugcccuggacauugggaggcagaaaaauaaacaccaugaauccuaccacuaagugcacucccuguacaagguauuagagugguuuagaggugaaagaaacacccacacuucucuguccacccucccaucuagagcaacaaucccugacccagcaccccugacagcagaucuucuggcauacaacugaagcaagggcgaucuagacccucacugccagaguaugggcccagaccggcagcuuuagcaccugaguuugagaaacacugaucuagaaguaauaucacuuccagagaacagcucuauuuauuagaaaaaaaaucucccacaugcuguguuggaaauauauuucccuaucauucugcacaugaucaagucauguauucaaauauuuaaauuacggaaaugcuauccucccuaagacuucucuucuaaaacucccccgaaacuccuuaucccauuugcuuucacaauccucacaacacugguaauucuguuugcguuuacuuguaccuuuguccccucaaaauucuaucuccagaaauccacaccacccuaaagaugcacucuguuugcaagagggaaaauggaggccauaugacucaugcucuuuucuaguugugcuucuagugggugagugauuugguuaugauggcauuggacaaaaagacuuuucaaaucaagcaccuuuaucauauccucccccuuccucuccucuguaguauauucccaucuucacccaccaacucccuccuacauguacacuuccuucuagaauuccauccccugauauucucccgugaugacauuuuaauuucugucuuauuuguuucuuucaauaaaguguuuggauaggaguacuccugaaguuagagugccacaaccgaagaagugcaagggacucauuaguugacgguuaagaagaaguucugaaagaggcucaguugugagugguuaacugcuuuaaccaaauucucaggggcaaacucugguucucucauuuaccuccauuuacccuggcaaccaccucccuccuuuggcuguauuaacauaccuccugaaaccuggagcacagagagcuugugucagugaaaaaugcauguggaaugagguuuuguuuuauuuuuuucauauuuaagcaauuuccuaaauuaggcucuuuuggcagcuguauuaauucaagccacuaagauauuauuuaguaccuugcugcuccagggcacuaaauaaugucacauuuucaaagcauaaugccauuagaguuuauaaagcacuuucaccuggguuaucucauucgaucuuggcaaaagcucagugcaaaaaguagaaguggugcauaaucauuguuuuguaaugauauagaugcuccuguuaugagcucaugcgguaaauaugugagaggcagagguaggucuagaacaucugucucuuaacuauuuguucagaauuguucucacaguggcauaaaggaguaaagagccucaauuaagggauaugugaucuuuguguuauauacauuuuuuaaauuuaaauguauccaauucaacuggacacaugguagcucuauauauuauagguuauaguagaaaggagagaauaguuaacaagauucuaaccuguaugguauguccgauauuugacaacagaagacaauuucaucauacuuaugccaagcuaccacauaacuccuuuaagucagaaaaugguaguaguucuugggcuguuguauccagucuuauauugucauggcagaauuuugucccuuauugcuugaaaauuacccccuucccuacccccaguaccuacuuugcuauuuaucaggggccugauaaucuaaauggagaaucuaaaucuaaaucuaaauggaggggaaauacuaaugauugaugagcaagaucgcucuggccaugauaaagaugcucuaggaccugagcauuuugguggaacaagaugaacuagguuucuuggggaagacauagucacaucuaaaccuccugaacacucauuuagaggguuuugucuucucaagcacugauacauguacuguccuaauagauguaaugaaccuacuuccccagaagaaacaucuuuuuuggaaucuuuauuuuuuuuuuuuaaaguaaccucuugaucugacauaauucaugggaaauuacaguggaggaucauauaugaucaggaagaaguuaaaaauaucuucauugccugguauuccauaaaauggaaucaacugaagauacauuugucuuauaauaaacucaaauaaauagcuuaauuagaugaagcacauaguucuccucagaucuuuuauaguacucauugacuaucauuucaagaaauggcauauuuccacaauccauuaaauaauaaaucaugcccuaagaaaggaucuuuuggggaccaagcaaccauuccuuuacaauucuuagaagcaaaguauuuacuuaaagaucccaguggaggaauucuuacugcugaugaaguguccuaucaaaacauuuaccuaaaaguacaauuggcauuagacucauugccugaaucaaugacugcugcuaguuggcuuucuaaucaccaacuauaguugaguuuacauuuaauaugaauacugaccagcggaaauaucaguuggggacauguagauuacauggcagaguaguaaggcauuuucaauauccauuacauuagccucaggcaauaaaaaaaauggcuccuuuauaggucgcucucuauguagguucaagacauuaauucacuagaagcacuuuuuuuuauuguuuuauuguuaucagcaugcaaauuuucagauuagcucagccuugacuuacucaugucagagaaauagcuuuaaaaugaccugacuuugaggacuaacuuauauuacuugaaagcuggauugcuacaucgaaaaauauuaaaaacauaacccuugauuccaaaauucucccuugcagugggcacacucaaggugaaugaggguuccacucugggaagacagacaugaaagaacaaaagcauagcacccuauuagacgagcuucccucugugucccugcaaagagaggaaaggucuggaaauggucaguaguugucaacuuuccccaacuauaaaauugaguggcuaauaugcugaauguuaauuagaugaucaacuaagcaaguaacuagcacaugguaagugcucaguuaauacugacauuaaagugagaaagagugagaaucauggaaaaaagauaaaauuagcccaaacugguagacuaaaguaccgaauuuggccagagcaucacgccuguuuugaagaagaaaaaugagagcaaaguauuauaccacgauuuuaguuauuuucaaaguaccgcagcaacucucaaaugugaaauuaacgccccucugcuuaccccccaugcauguuaaagcaaauuaaauuucaugccaaaucacccaggcaguuagcgagcagcacaauuucaaucuguaggauuuaaacugauugcucuaaaaauauaauucaccaaucgggcagcauugaagucaaacauggucuucuuuagucauuucuccugacaagcuauuuucccaggaauguggccauggugaacugcagguugacucaucucauagaagugagagguuuuauucucaucugcaacccagacacagcagggaauaauaaacugaccuguuggaggcauggaguucuuccccuggcuauaggcgaguauuacauuuaggcucuauugaccagacaacaaaaugcuuccuaguucaaaaagccacucugccuauguggggaaagaggucacuuuugguucccuauuuuuaucauauuuaaucacacuugcaacuggaauguaugucugugcguguguauguguuucauuuuuaaccugcaucucacuugcuauaguaggaaucuguuucuuuuuauucuuuuauucuguucucaaugguuguaggaguguucuaacaaaaugcauauaagugacuguuagagcucaucacgagaaagaauaaugaucaaacucacuugcuuucuucaguucaggcuuuaggucaucugaaguguuagcuuaaacccugcauuaugccuuauuuggaguuguuucaaaaauuauugucacaugagaguuuuuacuaaagucccccauuuugaaaagugcagguguuggauucagacaucuagaagacuucugucacgcuugaggcugcuguuaauauuaacagaggaucucaaauuccucgauucaugaaaacagucauugagccaugguuguuggggcacuggagguggguaagcaguuaucuuccagauauaaucaaggcaaugccagaguucaaauuggcuccaagugcuuuaccacauucauuuauuuaauuuucauuaaaauccuagguagaaaaauauuuuuucacauuauaaauuacuacaagguauggacucuuagucuuacuuggagagguucauucaaggaauagaaagcuagcauucauguaaucaggacaagcuccuuuguguuuaacuagaaugaugaaugcucuaugugccacuucuuguagcaacugcguugcacuugaucuuuaacacugacaugucuacauaauuauuuugcaguaagcauaagaaaucugaacaaaugauuagcgggcaucuaucuaaaugauggcacaguuuuaaagaaacuauuuuagauuuaacauagagaauaagaaugcuacaauaaaauaaaacuuaccauuucauucggaaaucuguguaaauguccuugacugucaaaugacucaguuggcacuaugggcauuuaguguucagggccaaggauuccaaacuuucugucaaagcccagcauucccucauacugaaaauuuauccacucaaaaaugccaaaagcacaccccuagaucugaagcaugauaguuuaaagaauaccuucucuugcucugcaguuauauuuauauuuaaaugaugcuucuacagaauugaagauucauucauacuccauuguauuuuaaauaucuuccuagaauuuauuguugcuguuaauaaaauauuuuagaaaaucuuucauaaauauagacuguaugaaaaucagcuucaauuuagccccuggacuagccaucacaauuucaaauaaguugaaauaaaacuucuuaaucaaaaaagauaagggaggagaguggcaauucaaaggugaaaagaugggagaagagaaaaugaacaggagagcccaguaugguggcucaugccugaaugccagcaacuccggaggcuaaggcaggaugauagcuugagcccaacaauucaagaccagccuaagcaacauagcaagaccccaucgauuuaauuaauucauucauuaaaaugaacagaagaaaggguagaaucuagggauauaacaagauaccagugaaaauaaagugggaggcaguggaaguuaaagaaauaaagacaaacugaggggagaccuggaaaacaggaaaaaaaaaggaaggugggaagaucucugcuucugcauauuacucauaaacauggugauuguaacaggaaaugguaaucagaaccuggggccagaacuccccuaccaggaucuccuuuuuggcuuuccuaggguuucagcaucaaguuuagaauaguuuaugccagaauauacccauccccaauacacaaacgaaucaacaaaucaacaaagcugccuuuuugcuagcauucucucagugugaugcuauggagaaacaugaagccauugggagcaaagauguuuauaagccaagguccuucucagauauacagaaauucaaucucagaaaagaauucacaaggauaugaaaacaaccagaugaaagacucugcauuuucagacagaacaauuccagucuucaucaggcaaugagaacagucagggaccacagauggcauguucuggaagcuaucauuuaacaaagucacugcuuuguuaagugccuuucauggcuggcuaugaaguggacaccaaaaaucucagcaaguuaauccauuuguccuuuacauugugccaucugcugcaauauacaaucugaaauaaccuuuuaguauuucugauaguaguacuuuuuccuuucuucuaaagcuugucuuuccucuguugcuuccuuccaaucugacuagagcagcagcucuuagugaagcaucuaccucuugcaaauucuuucaagcuacccuacccagcgcaccuaacaaacaucucaauaccuugugcuccucagucaccuucaauuccccuaacuucucugcuuguuuguuguuauuuaaaucagaaccuaagggcauauacuacguuuacucagugaugguugguggaaugucuuacacaaaauuucaaaaagcuacacaugucuauguguacacugcauaaggcuacacaaaaauaaaccagaaaugcucuuuuuaaaguugcuguuaaucauacacagcuacguuuuuccagaaacagcauggaggaucagaaaaguacgggcuuuaggaaucagauaaagacuuuucaaaugccaaguucaaccucuggcuuuuccaaugaccggcugugcaauuuaggcaguuauuuaacuuuuugaaaucucagcucuugcugcuuuaagagaaauaacuacugcauagcauugguaagaccuuuaaaugacauucuuuagaccauaaccuucccucugaaaacauauucggaaaugaaauucaauuaagcaaaucuuuugacuggucuagaauaaccauauaaaccaaagcuauccaucaauuuucaaauaagcagauaaaauagaaaaagcaguaaacuaaauagauaacuuacuugucucuggugauuaagaagacagcuaacauaugaguggauaaaacacaaauaaaaauuuguggcugguagaaugccaggucacaaauugaaagucuguuucagaaauugucaacucuucaccauucacaugugccugagaugcauucugguucugcucugaacuagaggcucucaaacucuguuguaccuuacaaccaccuggggagcuuuggaaacccaucaugaucgaacugaaucccauaccaauaaaaucgggcacucugacugcaggacccaggugucaaucaguauuuuaaaaacuccccccaaggugcucccaaugcacagccauguuugggaaacagggcuuuaaacaacccuucuggaaaaaaaaaaagaaaagaaaagaaaaaggaaaagauaaugugcaaaugaaucagcuggggaucuuguuaaaauaaagauccugagguguggacaccagaaacugccuuccaaaaagcuucuaggguauucugaugcuacugcuccggaacuacacuuugaguagcaacccuaaauccagugucaacagcuaaguauccacauggaaugucagauacaguuuguugcuuauuuccauuaugcaaugugagcucaaagaacacaugcuccucuuacuauuaccccucccaccuccaugaaaaguuacugagagucuaaggagcgcugugcauuucaaaaucaaauauaaaugaauuagguuggaucguucaugugacugcuccucuccccuggugaugacauucgugggcacauauauaauacacaggcacucugcuaaagcaguccaaagcaaguuuucuucgaaaucucuacacuugucuuggggcuuuagcugaauuuccuguuaaauggcauuaaugaggacucagagaaauaaaaccacaaaaauugguuuuacaguguaauguggggaaagugaccaaguguucacauggaggaauacauucaacucauccccacguccuguaacuccgaagugaacauucaugauuuugaggccauuuccaauugaaggugucagccuaguaggggcagagcgcugaaucugccacugcggugcucgcugauugcuauauagcacaaagcuugguuuaucucuagcaggaaauaugaguccacagauagcaaagacuauuuacuguaucagcuucucugcagccuuuaaucaagacaggaucccagcauguaaguccagaucuucaaaccuuucuagcggaagcauggucacccauaaauccuuaauucacagagaccauuuuccuuaagaagugcugagggcaaaauucugcugucuuagaacuucucagcaacaaaugugccauuuuauucaacacauggggguaccuaccuaggagaugaauacagaauuuuaaauuggaaaggcagaaauuaaaauaauuucauuccuggacauuuacauaaaccucuuucaaacaugaucuuguaggcauuuccuuuuuaagguuugugaaauuuagauaaauaccuugggaagagagaaagggagcuuuggaaaugcaucaugaucaaacugaaccccuuaucaauaaaaucaggcacuccgaugcugagagaaaggaaaauggaagaacuugaggaguauaagcagaaagcuacaaaggugauacaguuuggauauuuguccccaccccaauuucauguugaauuguaauccccaauguuggaggguggaccugguggaagguguucggaucaugaaggcaggucccucaugaauggcuugugccauccccauggugauaagugagaucucugaguucacacaagaucuggucauuuaaaaguguguggcaccucuccccgggcacucucucucuuuuacucuugccugcucccacuucaccuucuaccaugaguaaaagcuuccuggggccuucccagaagcagaggccagagccaugcuuccuguacagccugcagaaccaugauccaauuaaaccucuuuucuuauaaauuacacagucacagguguuucuuuaaagcaaugcaagaauggccuaauacaaaagaguucaaacaugauuuucccccuuguaaaauuaugcuagcgaaauuaaguccccgaaacaaaauaaauaaacagaucugaauuccuguaguucaauuaaaugguucaaaaaaauugugaucagaaaugaguuccaguuuuaucuuucuuauaaauaauugugugaaaauggaaaauuauuuucuccuuaugcccuuuauccucaaucugcaggccaccaugauuuaagcaguagcaaucauccaacagacaauaguagaguuuggcuuuauacuuugccucuuccucuaggccacguaugauuaaacaggaguucuuggguguggaaaacauccuuggaaaaauuuaagaagauacauuagcuuuagaauuuuaguacaaauuauguggguauaacuuuuucuaaaaaaaaguuuccauagauuucaucaaauuuuaaaauaguucauagucuguaagcuagaaaagauuaagaacuauugagucauucauucaauuuuuuuuuuuuaaauuagucccuaccaugcaucagguacucuuccgggcacugaugauauagcagugaacuaaacauacaaauaucccugccuccuagaagcuuacauucuucugggaggaugcaaacaauuaauaaaauaaguaaaauagauagcacaccagaugaugauaaaugauaccgagaaaauaaagcagagauaaaagccaaggcuugggaauugugauuuagaacaguacagacaaggaaggucuuauggaggaggugccacuugagcaaagacugaggggcuggagaaacaagucaugaaugucaguggggcaagggccuuccagacagaaggaccugcagauguaaauggcucugaagcaggaacauugcugagaauggcaauggggcuagugugccaggagcugaaugaagaagagcaguggaagguaacaucugugagauaagggggagggggccacagauguggcagcuauagaccacuguaaugauuuuggcaaaccacuggaggguuuugagaagagaaaugauucauucuaguuagauuuucuaaggaucacucuggcuauuguguugagaauagaccuggaaagaggguggcaaaggugaauauagggagagccauuaggaaguauuuguaaaaauucugaugcaaaaugauggagauuugguagugaucggaaguggugagaaacaguaagugcccagaucuauuucaguguagaggcaacagaguuugcuaauagauuagacauggaauaugagaggaugaagggaccccaaggcuuuugggauaaagcacuaggacgauagaguugacuuugauggacuugggaagagcagauagagagggauggucacuaauuuaguuucggaggccauguguuguggcucacaccuguaaucucagcacuuugggaagccaagaagggagaaucacuugagcucaggagcucaagaccagccugggcaacauggagaaacaccacaucuacaaaaaauacaaaaagauagcugggcgugguggcgcagggccauggucucagcuacuugggaugcuggggcaggaggaucaccugugccugggagaucgaggcuucagugagccaagaucauggcacugcacuccagccuggguggcagagugagacugagggaagacauuugggaauguuaagauugagacaccaauaaaacauucauguguugacauuucauagguaguuggauauagggaucuggaguuuagcagguaagcuugaguuaaagacauaaauuugggagucagcaacaaaaagaugauauuuaaacccugacccuggagaagaucacuaagggugugggugugcaucuacgaaaauguccaaagacugagguaggaagcccuccagaguuaagagaucagggagaugagaaggaccuaauauggaaugaaaaaaaagaaauccaugaaggaggagaaaaucaggagcuugugaguuccggaagccaauugaaagaaguauuucaagaagaaaaggaucaagugugcccaagcugcugauagugaguaagaggugggcugagaguccuccauuggauucaggaccuucacaaggguagguuggggcagagugcaggugcuaaaagccugauuggagaggccucaagagagaaugggugaauacaaauacuggaauagcucuucccuuaagaaguuuuguuaccaaagggauaaaggaauggggaaauagcuagagagauacugaagucaaguuauauauauaagugugugagggagaauuuagauguuugugugcugauagaaaugaugccacagaauauuguuuagguuucuuaacagaccuuacccaucuucuuuucuuucuauuuuugacugguuuauuuuuagccaaaguaccaauugcgagagaaaaaacaucacuccuuacauuuuuaguaauuccuuuuauugguucaaaaggaucgugaucagaaauggguuccaguccuauuuuucuuauaaauaauugugugaaaaugguaaguuuguuuuuuccuugugcccuuuauccugaauuugcaggccaagacgaucaaagaaaugguaacacacauacauuucuuggcagucgauaaaaacaguguuacagaaguaaaugacacaaaaccagaggauaauaaaacuucccaauuauauaaucauuuucauccuuuuuucucugcaggcuuggaacacuggagauuuuuuuuauguguuuuuuuuuuuuuuuuuaucaaaagucaccagauggaaaaugacaaagucagucaaaggagcccagguaaacuucaauucauacauggaugaucuuaagagaacaucuauucuugccucauuacaauggauuccucugauuaaaauuauaauuuuagcuaggccaagagaauauuaaaaaauuauaagcccuagaaugugacguaguguuauggauugaauugugucucuccaacugauguugaagucauaaccucugguaccugugaaugugacuacauuugaaaauagugucuuugcagaugaucaaauuaagaugaggucauuagauaugcccuaacccaauguaacuguuuccucauagaaaaggggaaauuuggacauagagacagacacacauagaaagaucacuccguucuuucacagggacacagggagaucaccaccuacaagucaaacaacauuugaggcuaccagaagcuaggagagaagaaugguacagaccaucccucacaaccuucaguaggaaccucccaugcugauaccuugaucuuggaccucuguccucccgaacugugacacaauacauuucuguuguuuaagcuacccaauguguaguauuuuguuccgauacccucuagaaaaucaauacacuuaaaauuuaguaaauagaauugaggucuuuguuaaaacauuaaaugaguaaacaaaaaacaugcaaacaaaaaacuggcacucugcauuuuuuuucauaauuugaaauuuuguaugaaaagaaagauuuuaaaaaaaauuagguggcaguugauuauuucagugcaugaaacauuuuauuugccuggaaagaaacuauuuuuauaaucaggaaaaaauaaaacucuucaaauaaaaucuaucauuguaauuuguauguuaauuucaggaugaccaugacugcuugcucccuggcaaagccaaucugacgacacugucaauuagcucuuacagcagcagcauuguuuauuuacaagaacugacuucaaguuccaguucaccaaguucaucagagggcaaaugagaauugcagugcuuggagacuuaauuuuagauguacuuauauguugucuggauggcccaacuccaggugauacuauuugcugauuuuucuaaacaucuuuauuuagaugcaauggauaugccauaaaauucacucaaagcauacaauuuaaugaguucagaguugugcaaccaucagcacucucuacauguagacacuuuuaucuuccccaaaauaaauugguuacccauuaccaaucauuuccuauucccucuacccuuuccuccagccauagacagucacuaaucuacuuucugucucuagauuugccuguucuggauauguaauauaaaugaaauuguacaauacacagucuuuugugacuaucuuccuuuacuuagcacaauguuuuuaagguucgucuauguuguagcaugcauuacuacuucauucuuuuuuauugcugaauuauauuccauugcauggcuauaccauauuuugcuuuucuauucaucaggcagcagacauuuguguucucugcaauuuuuggcuguugugaauaaugcuguaugaacauucaugugcaaguguguguggauguguguuuuccuaucucuuggauuaugcccagaaauggaauuacuggaucauaugguaacucuauauuuagcaacuugagaaccuaccgaacuauuuugcaaaguagcuguaccauucuacauuccuaucagcaaugagugaggguucuaauuucuccauauccucucccacacuuauuauuguccaucuucuuuuuugauuauagccauccuagugggugugaaguagaaucucacuaugguuuugauuugcauuucccuaauggguaaugauguugaggauauuuucaugugcuuauuagccauuugcaugucuuucuggauaaauaucuauucaaaucucuaguauaauaaaaaauauuuagucuucauccuuuguuccugucacacagcuucuaaaacgcuuggaagcucuagagugaugagcgucuuuucuauauuaaugagaugacugguagucccuagauagcuucagcaugggggcuguuugccaaaaagaccaaaccaugacuaaaagcauguaaauuucagccccucauccccaccucuggggaggagguaggagcuggagcuuggguggccaaugauuuaacaaaucaugccuauaugaugaaaccuccauuaaaaaaaaaucucuaaacaucaagguucagagaacuuccaaguuguuguuccaaacacauacacauucugggggaggugcaccccaacuccacagagacagaagauccuguauucaggagucuucuggaccuugcccuguguacuccuucaucuggcuguucauuuguuuccuuuauaauaaacugguaaaguuaaguuaaaugccuuccugacuucuaugagccuuccuagcuaauuaccgaaucugaggaggggaugaugagaacccccaauuuauagacagucggucagaaguaugggugguccaggauuugagauuggaguaugacaugggggcauuauuguggaacugagaccuuuaacucaugagaucugaugcuagcuccagguagauaaugucagaauugaauggaauuuuugcaccaaccaaaaagucaaauauuuauaacuuguuucccaaagccuguauauaauugucaacagaacuaaucaaacaaguucuaggucccacacaggagauagaaugagacucuaagucuguggucuggaaaccuugaugugaucaucauuguauggcuaaagggcuguaugucaccugguacauucaacuagccuuguuguuucucuuucaugagagauaaaaugggaagagacucaauucuucccaaucuaguagaaaauuaugaagauuaaagaaaauuaugaacgucaaaaccuuuugaaaagugaaccauuauaagaggguauucacagcaaucaaaacuuugccaaaggccucucuuaaagccauaaacuugaagacagcaaaaggccaugagaaaccucacugaaaguuaccaguuggcugauccuucucuacaggguucagacagaugagcaagcucaaggcaguuccuccccuaagagaugccauuguagaaccaggcuugcaaauuacuggcuguacugacauaaccgcaggacugcuccauagauuauaguuauuauccacguccaugaagaaucuggcaaguacugagagggguagccugacuucaagugauaaagauugcaugagacagauuaagccuugucagucgaaagaagaaaaauaaaucuuauuuauuuucucugcaauuacuuguauguuugaugaaaaagcugcauauacuuuguaagcacaauggccaccacuguuaagaaagcuacguuaauaacuuggugguguuccaauguaaaggcgucauucuuagauuaaaaugucugggaaaugaacuccccaaagacacacaaaaggaguuacuugcuuacagaaaacaucaagaucaaauaucuuugagcuacuccaaaccaaauaaucuccccuagcucaaagucaucuguugucugauuucuucaguuauaccuaguccuaacuguuaauaaaugguuuguuucuuacacuuuccucucauggcuuuauuaagauggugaauucauugaccaccaugaagacagguugccuuacucuucuuuugagucuccaguagcaccaaacccaugguagguauuuaaucaguaggggaugacuaguugaagaagcaauaugcaacauauauucuugagguaccuacaauuucuaaauccacacuggaagagguauuucuacuucucucugcauagcugggauaagauuugucaggguauucaccuuauauagaaaguauuuggagaguuggguuaugguauucuauuuuuuucuuuuaacauugaguuuauaaaaauggccccucaacccaaaccuaucucuaauaaaaaucaaauauucuaucugcugaaaguuuuggcauagaccucauuaauacccuuucuaggucagugccauaaaccaccuagaugcaacucaaacuauaaaucauaguuuggugaugacuaucuggcuauaacauauuuuauuccuugcaaaagagaguugauuauugaaacucaauggaugggugugauacacacacacacaugugcacacacacacacguuauauuauuagugaaagugguuuguuuuuguagauguuaaaaaaaaaucuaccauaugucagccucagcacucccuauauacacacuuccauggagauucaucuuuucagcuacuggccaauagagagcaaauaccacucauugugccauucugguacgaaguacagugaaguagacucaucagaaauacacuaaaaauagccagcucugauuguaaucagggauagaaaaugugcauuccuguucaacuuaaugugcuguuucauuuuuaaauuuguuccuuuguuguuuuuaugucuuuugcuccuggccuauccaaaagcucuagagucccccuauccugccuggugacuggaauucuaaucacaagccuagcucucucaaaucauuaggaaaacuaccaggacugcaguaaguuggcaccauucacuuucuucuguauguuaaucacuuagagguuuuuauuagggcauuuggacuggcuuuggcaaaaauaaaagggaugcaccuucuucaccagucagugguggaggcagcucuccagagucggccaugcucagaugccaaaagagaaggccuaaaugcaugcuuuuuaaaugcagggucagcauugaaggacuuccaccuaacccaacuguuagcauguucccacagugcucccauagccaacaacuugauauuauuuguacugcucucccauuccucauuuuggaccaucugcuuuggcugaaggcccagcuguuacugaaauguucuguuuucuccaaaaugguuuucuggaguucccacagaaagacuuccagaauauucccucuuuuaauccuuucuccccucccauuaucugcuuuaaaagugaaaaaaaaaaaaaaagaaaaagaaaaaaaggccaggugcagaggcucaugccaguaaucccagcacuuugggaagccaaggcgggaagaucaccuaagcucaggaguucgagaucagccuggccaacauggcaaaacccugucucuaccacaaauauaaaaauuagccgggcgugguggcacauaccuguagucccagcuacucgggaggcugaggcaggagaaucucuugaacccaagaggcagagguugcagugagcugaaacugugcuacugcaguccagccugggcaacagagugacacucugucucaaaaaaaaaaaagaaaaguaaacuacauucccuuucugauuuuacugcugcccauacauuccgcucuaggaagccaccuggggagcaggccuuuggcagccuugggcuugcuacuauccucuggaccagcccacuucccaugguggggucaauucgcuuacuauaaggggcugcagcaaguccuccuaugacuugucucuaccuuuugacauaaaacauuggcaguuaaggugcuugaagugucucccaguuguugggugcgcauuccccagggagaauccaucaugccugaagccaguacugaaccacuagucacccacaguuucauccaugagaagucaguuguuuuuggcuccuugguacaaucaggagagggguguguguguguauuugugugugugcacucacacacccugcagcaugugugggaaggggagcuugugaagggaguguggaguaucguucuucugcaucugccucucaaaacugcucuagcuuuucugauuaguuuccauaggagcaaaaaagaaaaaaaggguggggugggggggaguguagucaaauagagcauuccuacagcagaagcaaaagagcuugugacuuuuuuuuuuuaucccguuuacuuuuuuguuuguuugguugguuuuuuuuugagacagagucuggcucuguugcccaggcuagagugcaguggcacgaucuuggcucacugcaaccucagccucccagguucaagcgauuccccugccucagccuccagaguagccgggacuacaggugugugccaccacacccggcuaauguuuuguauuuuuaguagagacgggguuucaccaugucaaccaggauggucucgaucuccugaccucgugaucugcccaccucggccucccaaagugcugggauuacagggguaagccaccgugcccagcucugucucauuuucuuaugcccacaccccacccaguugaacauuuccagguaauuugccuuuuugagaugcagaguguggagauggaggagugaggaggcccaagucagcaaugggcugggaacaaugcucaauuuucuauaagguuuuguaucccucauguauccccuuugaauaucuccacuucuuucccacaugagugcauuuccuugacuuugagacuucaucuugcaugaauuaaaacuugcauagagucacuucuuaaguauuugaacagagcaccuuacggaaccugcuuuuaaaacuauagucuaauguuacacaaaucuguuuccugugaaaauguuuucuauauaaacaaguacaucuucaacagcaaacaauuuuaagaugauuguuuaaguaaaauguagcauguuuugaaauuuuuaaaauggaaaacucaaaguacuauauagggguuugagaugcauagaugcaagcauuugucaaaacucauucauuguguauaaauuuuaccuaaaaagauaagcaaauaucaaacuuuggauaauaaucugcauaaggugaaguguaguaaugucugcaauucuuuugaaaugcuucaaaaauaggauggacagauaucugauaaagcaaguauagcaaaauuguaauuguaaaauugagggggcggguugcuauaaucugaaugcuuacgucccccuaaauucauauguuaaaacccaauccccagugugaggguacuuggagaugaggccucagagcccucacgaguagaauuaggauccuuauaaaaggggccccaaagagcugcuuugcccccuucacccuauaagaauauggugagaaggugacaucuaugaggaacgaacccucaccagacacugaauaugcuggagcccuaaucuuggacuucccagccuucagaaucaugagaaauaaauuucuuuugcuuuuaagucagccagucuaagguagucuguuauugcagcaaaaaugaacuaagacaugaguacaugggugugcacuauacaauuucuucaauuuuucuguacauuaaaaaguuuucauaauaaaaugcagguauagaaggggagacacagcauuuggaauugggagaguugaguccuggucccaguguggcaugaacaagcuguacaauguggucaacucuuaacuuuucugggucuugguuuccccagcuacaaaauaagaaucucaaaugcauuuuugugucuaauaaccuauuauuuucagaaacaaauauggaucaaauggucagaagccuucaauucacaggaauugggaacucucacuuguggaauuuauauagucuaaaggaaacacugaaaauucuguuauucaacauuuuaccaauuggaaagcucuaaugugccuuucugauugugucaucucucccagugcaaacuucucaucuggugccaaguacugaugccagaaauacaguaggcaggaauaaccucucccagaccaauuggucuggaaaauuugagaaaaaacaauuagacugcugucccauggugcucuacccaaacuauuuugaugugauuguacacugcgcuguacuuucagaccccacagcccuguggucugaccccaggcagaguggaagcuaccuacaggauaaggcauuuggggccagucugaagguaggccuuccuccucacuccucuuucuuacccucaaacuauauucuccauccccaguucaaaacgucugccauuaugagaugaucauuugacuggagguucuauuuuuuauuaaaaaugcaacuacuccuggaguagguaacacauucaacuguagcagccauuuacaucacauuguuaagacccuccacauccuuuccagguggcacuuaguagugggaaaagaggacgggcucuaaugaaaguuuucucccugucuacaauauucuuuuccuaaccucauacugaaacuguaacucauccuuuaagcugagauggaaccuuauaugcaaagcaucccugauuaacccaucugaaagucaccucucugucauuguacuccuuucuuucuuaauucauucaaccaacuaaagucuuuugagcaccuauaacuuauugggaacuacucuauguucugcaguuacagugggaaacaagacaaaucugguccuugccuuugagggaaugauauucucacgugcugaucugggacauuccugguuuuaacauuaaaaucucaugucccugcaacucccucgguccugggcagaccaagaggauuggucaugcuaguuggacacauaaacaauuacaucaguugcaauucaauuauaauuauuagaaggagugaaggugcucugauuguguaucaagagaggauuucacucacccucugaagucagagaaaaacugauagguaaagaagggcaaagcaaucacaaauaaggaaaaauaaucacauucaaagacucuauguuagaaagagugugggaugucugagaaauguagggugacuuuauaucuugguuugccugggacuguccugauuauagccuguugccauggcaucauuauuaauagugccuccuuucauucucacaagugucuuguuuuugaaaaaugaauuacauauucacccuacagaaacuguaagauggccacauggccagaagaaaggaauuaaggggagagucaugcaaaugaggcucugaggucucaaaagcugauuguucaaggucucaagagauaugcccagauuugggauauuuucauaagaaauaugggaaaagugagacucaucauacacagagaaguagcaugauuauaugugaauuuuaaacagaacagaugcaagaguggacgagaaagauccauugcuuuagcugagauccaggccagagauaacaguggccuagauuagggaggaagcaucagaaauggagcuaaacugacaauucaaaagauauucuucaaaaggaagaaaugacauaauucauucugacagcagaaagguccagggaguuggaaaggcaaggcugccacaguuggccacaugggcuaagcauaacccuggagagugccuuugacgugcaacacugugcagggagcacugcagugcaagcagaggcagcaggugacugggugucaaagacaguggcuaggccgggugugguggcucgcgccuauaaucccagcacuuugggaggcugagacaggcggaucacuugaggccaggaguuugagaccagacuggccaacauggcgaaacccgucucuaguaaaaauacaaaaauuagcugggcaugauggugcgcaccugcaaucccagccacucagagucugaggcaggagaauuguugaauccaggaggcagagauugcagggagccgggaucacgcuacugccugugggacacagcaagacuccaucccccccaccaccucccccagaaaaaagaagaaaaaaaaggugguggcuggcuuucuggucugagcaacucacugaccaaugguauuaugcagguaaaaggaaucugaaggagauucagaaucucaugucaguuuuccugaaauccucuuauacgaaugugucacucuaccaaguauuuugaucaugcauaucucuuauuuaucuccaucauuuaucuugcucuuccucacaugcucucuaaacaaacuauaaguacucuagagcagacaccagauugaauucaucucuucaaucacccacaaagcccaacgcaggauccaccaugagauaagcccuuggaaacucuuggaaguaggugaguaaauggguaaguagguaaggggauuaccuucugcuaagggaagacuagaugaaggaggguuagacagaccgguggaaaggugacagccuuuaguaacuaauuccuaguuacucugagucaauagaccaauacagggauccgaaaacuuuuccuguaaagggcugauauuaauaguaaauauuuuaggcucugcagucucuguugcaaggaaucugcucuucuauuuuaaugaauagacagucauagaaaauauguaaacaaauagguauggcuguguuccaacgaaacuuuguguauggauacuaaaaucugaauuuuauauaauuuucaaaugucgcaaaauauuauucuucuuuugguuuauuuccagccauuuaaaaacauaaacucauucuuaucuugcaggcccuauaaaaacaggcagcagcugaauuuggcuuuagggccacugaacccuggaccaguauauucauuccccugagauggaggauagcaaggccucuuaucauacauuuuuccaagcagaauuacuuaaaagcucacgcuaaaugccuuccuuuucuucuugucucaagaacaaggaagauaucuaagaucauaccaugccugcucucuaacucgucuuucuaaaauggcuuugauuucuuaaauguuuucucuuucgucaaccuucuucuggggccuuccuuccuucucugcuuucccucuuuaacucuccuuuuuuauuaggcaaguuuguucucucacuaauaaauuuugcuuuugcuaccagaagcauuacugggcuugacauuuuuagugaggaugcugagauuucuccaguuuuuguuuaucacuugccuuuucacaaucauggacagccgcagaccuuccuaaauuaaggauugaugccuacacagcaugaccuacaccugaaaaucuauuaacaauuaacagccaguaaaaacagacaacccaaagauccagaggcugccagcuucaugggaggugagggccaauuuacagugcugaugaugugcacaggacuuaauauaguaaugccuguucaacaguaucuggaacucuacacuggucauagaaacagugagugaguuuguuuguuuaaggagaaacacuguucaaugcacacaauaauuuccaaaaguaaacuaagacauguaagugagaaggacagugucauuccugcuuguuucauuauagagcaauuagaccaaggcuggagacccucacuaaaaggcacuccauuaaauguguucugccaagaggacuccuguccaacagaaaccuuacuccugcacgggaaugguaccuccaguggaggauagcaucugcccaaaugcacagcuuacaaaaugaaagaaaauuugacacaacaagcagaaggauuggaguagcaucaauggagucauuuuauuauuuuuucccagaucgagacaagguguaaguuaugacaaucauagccaagauucuggaggggagcaguucuuaaggcuaugaauguaauggggauugggaagaaaaaguggggacccucacucuuuucucaagccaauccaucuuuuaucugucaucggguggagaucacccugcccuuuugguuuuugcuagcgaaaaguaguuggucaucauugcucgggaauauaacccuuuaucugggagauagcagaaguagugaagggagggagagaggaugugagcauagugggcaucaugcaagagaugcuuucuccccauuucccaccacagagaacacuuguaaagacaaccagcaauuaugguccucuccaauaagcuaggccuucugagcaucucuguuacuggaaagguagugcuuugaugugcaacccuauuucccaaucgacuuaucucugcaaucaguuucuuuggaauguugaacuagaugucaaacacaccaggcugaauuggagaguauuuaaacccauacgcuuggauggcauuaaaaugagcccuggcaaucaaacggaggcaagagaauuugagagacagcaaacacaaauccugccacaugaguaugucuggcgugguaccgcaugcccgaugugauaacgaauaccuaaugugcugacacagucguggcugcucugccuuugauucaccucaguuauggcagacucagccuuguuagauaaaagggcugcacuucuucuuugcaccauucacuggcccguggaaauggacuguucucacaaacugcuaauucugaaagccuuuaguggaugcagccggggaaggaaaaaaaaaaaaaaaaaacauacaguuuaaaggcaugcucugaauuugcuaauaggcaugcaugguccuuuuggaaccaaaauagaauuuuugaugaaguaccuuguggcaaaucugaaauauuagccugggggccccaacaagacauaauucacuccacuggugagaacaaaucucauuuccacauccauuccucuaaacucauuacugaccccgggggaaaauucuagccuggagcaaguuuuaauaaagacacugguggagccguugcuauaguaguaaacgcaauaaugaacaacaagacucuugguggcaauggaccccuggaccuguggagacccuggaaggcagcuucugaagggcuuaacacuccacccacagcagagcauagaguccagaaaagacuucauuacuuuaugugauaauuugucacauaagacucacucuggcuuaaacggccugauugucagcuugccuucaaaugaacaauggcuaagaauaauuuauuuuaaauuaauuucaauugcaaaaaaaaaaaaagaaaaaaguagaugcaguugggaaauuaaugacuuuggggucagaaagaccuagauucaaauuucagauccaggacaaaucuuauaaccuccucagggcuuaaucucucccacuagaaguagucucuuagcuaaguacaaguuaucugugggcauggccucugccuuuauuuuuuccuguuuuauccccaaaugcuuugucauguaauugacgcucagcagguacuguuaaguagauccacuuuaaaggauuauuaggaagacuaagaaagugaacauauguaaaaccuuuggcaccuugcuuggcacaagauagcuccacaaugaauuccgagcaaauuaacugcuaguguaagaccacugguggaaaggccagaagaagagcuuagaguggaaaauccaaacaaaugaagaaguuugacaauuauuugguucugguaggaagggaccagacucaaggaguugaaggaaguguuccauagaaggacauggcaggaaggggugcagggcaccuugaaaaugccaguggguacuucggaagagccauaagccaguuauaacaggugggaggucaugcuugcuaaucaauccucagcuuuaacaagaagauugaaaaguuucccuggguuuccagaguggaucuauaucuaggcagguacagucgaauacaaaaccgaagcuuguggcuagggaacauacauacugagccauuccccuauggacagucacuuuccugccgcacacaaacaugcccuuuuaccucacacaacuugaagucaccacaucaaagguuccaauguugcuuccucauucaggacaaagaaaagcucucaggagggaagugcaaauguaucuggaggcacacccuguccugacuuguuaagguagguauucuccuuacuucccaccgcauccuaacacagcccuuccguuucagucuggccaaccuguucccuacauccucugugaccacaggaugacuuccuuauucccaugugucugcucuuugaccaaaacuacacauucuuuaagucugaaauaaucuauacaaccuuuccauucauuaagagagagaaaaugagagcaaccuggugcaaugggaucauucuccaucuccucucagucuuuaccacacuguuucauuuacuucuacauaauaugagaauuuucucuaaguguuuauaacagacaucuuguuuccucaaacaaaacauuacuucuccaagcaggaacuccuuguugcauauuuuuccaugaacaccaggcugguuauucacccaaaugauccagcaaauaccaaucaaauaaagguugaaaggaagucagcugauaccugcuucacaucacauggacaggggcaaacagaguuugugugauucucgggaacuuucugcaaauauuuuuaguaaauauuauacaaaaaguaaucaaaaggaauaccaacugcacuguacaaacuuacauauaaacuuauacagucauaaugacacuccauaauggcauuuuggccaaugguggacugcauauaugaccauaaucccauaagacuguaauggaacauauauagaaaccugauacaugguccuucauauuggcauugcagaucaaguagcgaaaaugacuuauauuccguaauggugcugggacauuuaguuuuccauaugaaaaauguauauaaauaaaaaaauacauaccaucuagguuuguauaaguacauucuacgauguucgaccaacaaugaaaacgcauuucucagaacauauccugucaauaauggaagcaugacugucaucaaacauacacaacaugcacaaauacauucacacaccauuuagcccuuuucacaggcaagauuccuaagcagccucugauuuaacuucuggcuguaaucaacuuuugugagcugaggcugcccauaaccagcaaagccacuugagaaagagucuacagucucuguaagaggaucagggcugacccacuccagccacuagggcugacucucuggacuaccugcugcuccagaugacugcuccaaaucuauuccccucuacacuguccuuccucucaguaggucccucagucuggccccucagccuagccauuccccuauggagagucacuuuccugccacacacaaacaugccuuuuuaccucacacaacuugaagucaccacaugaaagguuccaaugcagcuuccucauucaggacagagcaaagaaggaguuguuaucggcccuuuaaugaggaacugaucaugcuucccugacaaagacagauaaugacaaaacccaaaaaagcaguccaucugcucucugauugcugggauuagaaugugggugagcgaggagacagggacaaagaguuuguugcuguaaagaacagaauggagaauccagagagcucuccucaucacuccagaaucaucaacuguucacuucucauuucauauuaacugugaaauacaucuaacagagugcuagauaagccauccauguuaauaagucaacauuuccaggcauccgaauugugggaaaacagagaaaguaacauaaaaaauaaaaaaacauuuauacauauaaagcagggaaaggaauucuagcucagaugguuucccacacugagcaaacggauacaugauuaucacaaaguugaaagaaggaagucuugggcauauguuauaucuaaagucaaagcaggggugcagauaguaaagcaggaaagaacaauuagggaauuaauuaaauaaagcucuguuuauacuucuauugucagugcuaauuauuuguggguuugaaguaagcuccccugucuucauuagugguugucagugaaugauaacauacuuagauuuccacacguccucguuguuuccaaggauuguauuugcagcgucagcucacauuuucacaugaugacaguaauaaucaagaaacucauacucacuaaagccaacuuugcuuuuuuuuuugucuuaaauaagagguauguuacuguuacuguuuccuugcuccacacuuuagccucugucuaguuguugguauaucaagguaacagcucuucaacuuugaagaagacaugaugguuagguucuuuggaacaggaugaguuagcaagaguucccuccacguagcauuugcagaccaccaaauccauucccauccuguguccgucccaugucccugcucaggccuuccugaugcaagcaagugccucuaggcaggagaucuguuugcaaaucuguaggaagccuuacaaugaggaauuggugacagaauccacuugcucaugccugugaucauuaacuuuuccuuuaauaaaagaguagcagcuauucuuuucuguugauuucuuacagcugcccucagaguuacacucagagaacagcauguguuugaacuucugcaauccuguaggaguuaugaggaucuagcugguaggagaaggggugggaguggugggagcaaagacugggaggagagaaaauaaaugucaucagcgguagugccuuaggaacacaccuagagagagaaaccagguuucuaaaaagcaaauaaauuagggggcuaggcacaguacuuuugacaacugagaaaaaguguguaaaagggaaggagggauggaagagaagagacagcagagagaccaaaaaucacaguguaugagaaaucugacacugcucuuuuuuuuuagccaguaacucagauaaucuaaucaaacccaucuuccuuuaaagcuagagcuggagaaacugacauuuuguuucuuuugaagauuuuuuuccuuaaauggaaaguuuucugugguacaucuuauuuuagaaucucuaucuucucccccucucuuuuuuuaaaaaaaaauuagaacuauuggcuaauuugugauuuuguuauuucuaggcacacuuagauuggccuucacagucagaugcuaauggaguugauuccauuggcagagggauggauccacuuacccauaucacccugagcaguacauaaagaugaacuucucagggagaggcaaggggggcagggauggcagaggacaacaucuucuaaguauagaaauagauaaaaugacaagaagacuagaguugccaucugcuggaggaugaaaagaaugacauuugacacuauuugcaacagcaaagcuaaacucauuaguaaaaauaauaaaucuccauguacuguguacugccaguuaaaugauacaaaauuauagcaguguguuauuauuucagcauggcaguuuuuggauaauguagaaaauauauagagguaguaaaacaauagcauccacuuucccuaauuuguacucuaccuacucuuagaagggcuuacaaauacugcuuuauucccuuucaaaugccagcaaguucccucaauauguauuucucacuuucaccacugcgacuuugaaaaugaugaugggguuucuucuaugaguaugccuagucauugcuuccagauuuucuuucugcuuauguaacaugaccaaaugcaugaagcucacuaagguucaauaaaaagaccgcuggacggagaaucacaagggugggguugauaaucuguuugcccaccagcuaccaauguaaccauaaaccaaucacuuuacuacucuggguccuggcauuuuaagcuguaaaaugauaaaugcuagggaggaugggcugcagaaucucagugaucucuaagguccuuuuuagcucucaaauuuugcaaaucuauaagcauuccaaacucauguagcacuuauaacaugaauauucaagcuaaauucucaucauggcuucuacugaaugcagcaaaacuguaucuaauggccugauuaaucagccauaaccaucuucuuugccagugaagggaaaaaauguuuucccccuucucauauuguagagaaagaggcaguuauuuaaacaagauuucucugaugcugcuuuuguuauggugagugacauaacaaaguucucugaucaggaaaaauacaaaacaaaaaacagcuuuaagaaccacagauuuagaauggcaaguagauuuaccucuacuuuagaauggcaaguaguuuugccuccaagaccaaaaguggagacuaagguuaaaggauucaccuauacuugaaugucugguuuggugccaaaauggauuagaucauuuaauugccaaauacuuccuuaccugaaagaaacucaucauccuucuuuccauagcuauaaauccugcaaaucuacaguauccaagucagguaucuccuccucucuaaucaauucuucuccccuucagccuagagugauucuucccucuucuagaaacacuaguguucaaugucugaaaaaccucacuuggcaagugacauagucuuucauucauuuauucauuugacauauauuuaaugaacauauuuuuaaugccuugcauucuucuaggugggacagaagcauugaaaccccuguucucaugaagcuuauauuuuaguggggaagagagagaaauauacauacauaggaacauaauauccaguaguaauaugugccauggcagaacaugaaagcaggugcuaugauaaugaucugaugccuucuuuagauggaguggucagggaagaguucucugaggcagugauucuaaauugaaacuugagugacgaaaaggagauggcuaugcaaagaugggaggaagggcauucauaaaacagaucccgcaugggggagaucaaaggaaagagugugucuggaauaaaaccaauaagagacauaguaacagcaagaugaggggagggagguggucaagguccagaugauuuggagucucaaggucacgccaaaaaaggaguauuuuauuccaagcauucugggaaaucacuugaagcuaagaauuuaguucucuuuucauguaaaucagucucccccacauccaagaauuaacaucucaccuuuuaaacauuucucacaauuccuagguccuccaaaccuuuuuacaugaaaggcuuuuuaauaaauagcugcuggcugauuguguuguacaugaaaucuuuaaguuaguuaauaguuuaaguaggggcuuaaccccgagacgaucagaggucaugaugauugcagcccucgaccucaaauccacaggaaagcugaagaaaugagcucagcauggaagcagaauguccugacuucgccuaugacuugacucugagagucgugaaagugccucacacugcgagcagcggcccacgaggauccaagagagccccuuugucgacccccuucaaagcaaagcaaaucaccuaacuuuggagagguucugacagucuucauauucaugugucacuuagcuuuaauugaaacuuuagaacagguaaauuuguaacaauucauauuuuucaugcucaaaagagugucuuuguguaaaacagcagccugaauaaugggggguagggggaggauuaauucagagagguuauuuguuuuuuucucucuugaugcaagccccauuuuuacaugcuuuucuuuugacugaagggcaaucuuuaauugcagcuuuaagggaagcuuaaagaggucauuaaacauuaugaaaacugaaauaccacuaauguuagcugagaguaaccugacuuguuuuuucauacugaacucuagaaaaggcaaauuccuuguaaagaguuaggguggaauauccugcuccacccaccccuaguggucuaggaguccuguaagcuaugaugggaggaauuuguggcuugaaacccaggcagaugcuagaaacuuuuaaauccugauauucauggugcuaaaaauacauauggauucacuaauagaaaaagaaggaggaggaggaggaggagaaaaagaaagaaaagaagaaacacaaagaacgugauuaagaaaaugagaggaugaaaguacagagagaaagagaagaggagcuggcaagagagaaggucaauaagaaaccacagaugcugcauagaggcagagaucauaaccuuccaagcaucuaggacagugccugacacacaacagaugcuuaaaacguugggggagggaggaaaauacaugggaaaauaaaagaggaguuguauuugugagacagcaggcaagcaaggaggaaagagagaagaggaaaagcuagaaaugaaggggaagaaagaaaggagaucuuggcgaugauucucacaucuggaugcauaucagaaccaccuagggagaccgccucaaaacgcagauucccaggccuguucggagcccuauuacaucagaagcuuggaguucuaacccgugucuaacaagucaaaaccaaaagcucucgccagcggcugcuaugugcugugauuugggaaccccacugagcuacacgaaaagcagaagagaagaaaggugcgaccagugugcagugacagagccggugccagcacugacccuggucacuccucagagacagggcaccugggggaccacgacagggcacgcacuucucuucaagaauauggcucaucuucaagaacuagaguuccucuccgguuaauacccguucucccuuuugccuguucccaaauuacauacccuucagugaugccuggaauggcaaggggugggcuacaaagggaacugcaugggaaggcggcguucucuuuugcccauggcacagguuagggaaacagccucgccuggcccgaaacgucuuggaugccgaggcagccccugguugauuuuggaguauggcccccgaguggcaccgagugagaagacaaucucucucacaugcugagugaggaaccagcaaaagcgacuggguuuuggauaauggacaaggcgacacuggcacccaucuccccacacacgcguuuccgaucguccugacaacacacgcggcggcugggcugcggccggggcagcgcaucugcgccggggccaggcuggcgcuuggggccccgcggccuccgccgccgcgcgccgucccggagcugcaagggcccgggggcugcaggcagccccgcggggagcguagccgcccaagcaagggaacaauugccucucgggauuaagucuacgugggcccgaauuguguguuacuaugacaaugguaaauagguucacuggcuuucagggaaguggcuccgugcagagugagcugaggaaggcacaauuucucuccaguucagcacaucuacacccauucaugggucuguuuucacgcuacauaaaaugaggggcuuagggaagacacuguauuaccuaguuuuaaucacugggcauuuuauugacagugacguauauugaguuugcuuuaguggcuccaacuaauaaaagccugguaguagacuagaaagaagaaaguuaagcaugcuuaucagaugguaauuaauuugcucucuagaaagaaaaaaagugagcuaaauguuuugauaaaguaguucuaugaaauucuacacauaccaggaaugucucaaaccucaucuuaaaaaauacacccacauuuaaaaugauguuuuguucuguuguugcuuccucagcaggaggaauaaccacucuacccugaaaccuaauacaccuuuuuaaaauaaauaaauaaauaaauaaauaaaauacagagaaucuucagaagggcuauagcuuuuccuagaguauagauuaccuaccaugccagagccagccucgcaaaacauguuagcagaaauaagguauugauuaaacauagucacaguaaaaacucaauuuacauuaacauuucccauuacuggugauuuagcauuucucauucaucagagcccacaaguacaugcgugcaugcauucacaaaaacgaaaccuugccacaacuaacugguuguagcauauacagacuuuuuugauauaucagaaaagacagauuguuuaagcccaccaugguaggcuuuuaaaaaaaagauuuauuccacaauuuuccugguuguaguucauuugcauacauuuuaugaauucauacaccacaaauuauuuuaaaauaugcuguucaauaaagaaauaacagauucaagacaaaucacuagcucuaaccuacuucuuucacuucaucucaaugcguacuucccccagcaucuguacuccguucaauauacacuguacugggaguguuucuguuccuaccaguuagacuucguccagaacauccucaccaccagucaagccuggaucuuaauacccuuuuccuagugccaucucccuacgauagaaaaucucuaaacccucccaaugaaaccuccaaagccucuccaauuuccuuuuuuuuuccaggaggccuuucuauuauaaucuauacacuaaauauuuacuugaggguuuaucaaguucuuccauguuauauccauaauuaacuuuucuuauaucauuucuuucagucauuuuuacaggugggcaugucagagaaccuaucaugucaaaaaaguuauauccaaauaucugugccaucuagcauauuuuaaaaacuuuaguaaauauuugauuaugugaauaaacauuaauauuggcacacuaugguggacugauuugcuuaacugaauagaguuauucuucuucucuguccccacuuaaagacaucaccacccuaaugaaauguggagacauauuuugguuacacauuaaaacucauucaacuuuaaaaaaauugagaaauaauuggacacaucuaaauauggacuauauauacagauaacauuaaauaaugucauuaauuugcuaggcugcaaugacagcauugugguuauguaaaaacagcuuuuuaaaauauauacauaaaauauuuaagcguaaaauauuauguaugagaucugugauuuacuuuaaaaaugauaaugcuaaaguggcaagauauuaaucacucagucuaauauuaauaauuaagucuaagucuaaucaaguaaauuuuuaagguugccucucuucaucccacacuugauauuuaacaagaaaugaaaguaaggguuucuccacauggcaaucaucggggggugaauucaaauggucuguuccucacccaauuacucuaugaggcgagcagcugacuguaucacaauucggagaaggugaaggcucaauccuagagauagguacaagagcugcugaagucagaagagaaaagcagagguggguuaaacauuaaggcuuuuucuaauauagauccccacuuugggaaaaugugcuuauuuggccaaauagaaggagaaauggcaaugcuauaagcagaucuacuauuuuagaagugguccuuacaaaagugacaaaaacaauaaaauuaucucauagcugcagaauguaccugugaaaccaacuguguauguaucacuuuauguuuauuuucuuaaaaguugugcuaugaggcaagacuauuaauccuguuuuuuagaugaagaaauuuagguucuaacaguaacuuuacauuuauuguugaguuguuuaaaaauauuaccuggaugaaaaauaauguccagaaugaaggcaaucgccaaaugucagaaucagaacaagauuauucucugacauucuuauuauuacuuuauaacauuccauuccucucuuaucugcucccaaaauaguuggauaaaaaaccuugccucauuuccuaccagcaggcugcaggaagagacacucucacuuuuacagaaaggcucagucugugaaugguuaccgucuuuauacagaacaucaaauauuucuggaggacuuuugaauaugucuuauuuuaacccuccugacaccacuucauuuaggugggugguaaaugccaucuaguuuacuuuaugacucaagaauucuuauuacaccugggauggggugcuaggugggaacagaaucagagugaaaagcagaauuguggaacuggagacccagauacagucucacuacauccacaucaccaaagucacaaaguauugcuuuucauuuucagcccuuagagauucugaaagagaaaaaccaucaaaguaaacaguacuuuguucuccauguugguugaauaauauccugagugguauacuuggaucucagaaagauuucuaaagccuuugcaauguucacaacaacuacagaagaaauauacuguucgccauauuauguaaugaaacaaauccuguuugggucuggagauguggccaguuuggcaauaugccagucucguuuuguugaacaacuauuuaauuguuugaaauaaaaacaacaacaacaaaaaaaaacugguugguauccaucagcccuugcuagguaauuauauuccaaauugguagacauccuucaaauaccaauuauauuaaaaguaguugaugaauuuaaauucuuuuagaaaauuauguuuuucuaaaaugaguacuuacccauauaggguuauuacugucugaacauaguuaaccugugcauauggucaaaggaauucagaagaccauuugaauagaguugcaaccaggccaggcucccaucugugaugggguuugauaaagggugagaaucuuuauuugauaauaccuucuaaagcacagagauaagccacuagcauauuaucuuuuuaaaauuaucaguuauggauuauuccaacauacacuaaaaccucuucuaggaucauucugauacugccaauguugacugucuaguguaagggguagcacccuaagaaggcugaaauagagaauuggcuuaccaagggacuaucucuugucugcauugcucuacgggcuuggaaagaauccuaaccuaacacucuguugaaaggcccagcuucacaaaaaagguccaaucugauuuuucaauaguuuguuuuuaaauuuacucugucucagucuauaagccagggacaauguuacauuucaguuagaaaaccacccaccacauaaauaaguuaaaaauaaacgccuuugaaacaaguuuuguauugcauguuuccuucacuuuccagaccuuguuagguauuuuagaauucacgaauccaugaaacccaugaaugucaaagcucaacgggaucuuagaaauucucaaacccaacucccacucuuuauauagagaaggaauuuacccccuaaauuacuaguaaguggcaaaacccaaaccuaaacauaacuaucccaacucuaucuucacuacaccaggaauacaaccuggacuuugcucuugagaaauuucaaacuagaaggcauaaaggaaaacaggggaggaggggcacacagaaacaaacacagagcaauuuaauacaguaaauuuaaauuuacuuaaaaugcucucuuaauuuuagauaaguaacaucucaaagaaggaggggauuaauauggacuucugggaguaugauucuccuacuagugagugaacucuucaaagaaaagacuauuaucuaaaauauuuuauauagcuuagcacuuagcacaguuaagaaaacagaguaaguacccacuacaugauugaggaauggaugggugaauacguggacauacggauuuguagggguagauggggugagggguagucuggagugagaaugggaccccuuagaaagaagguggaaauuuaauaggaguuagaaucagagugacaaugcagaggcuagagaauauggaaauaggcaucauuuauuuagagguucuugagaaaaacaaccugcuugaagcagguuacaaggaaguagcaggugauguaucuggacacugacaucugagcaucaugaagcugaugauugccuauucccaugacuucaaugaguuauguuuagauugguguuguagugcagggagaguuugagaaacuuguuaaugaagccagacucccacauacaaaacgagauuucugaaugugugugguugucgguauucuguucuguucuuuuucuacgcaaacagcaacagaugguagaagggggccgagaggagugggaauccaggaggaaaguuugaauugccccauccugccucuuguugggucuaaaccuggggaaaggaagauuuuaaaagggucaaguuuggcuuuuacagaguuaaaaaguugauugguauccagcccucuuaauuguuccauaaaaggguguagggaaugcagaaaaaucacuuuauaucaucaauaccagcuguguuaaggcacguagcuuaaguuuacugugccuugauuuccuuuguauauucugaaaguggaaggaucucacagaauuuugaugaauaaauggaauuaauauauuaaagugcuuuaauuuagugccugagacagagcaaucaaucacuuuauaaggucuaguggagguuaugaggaugcuggugaauguuugucaacauuuauaaaaaugugcauggauucuuuaagaaagcauauccuguguucaaaauccuccuucccaucucuucauccccgucucacucacuugagcacacuagccauuuuacagucucuuggaccaggucugguuuagugucugggccuuggcaccuucuguucucucugcuugguaugcauaucucauggcacuuuaaauggcuuccccuugcucaucauucaggugucaacucaaauaccaccaccucaaggaagccuugccuacccguagauaaagcagguccagucccucaauuucucucuuccagauggucuucuuuaauuuucccuuuaucaguaccuaaaauuaucuuauuaaucuauuugcuuaccaaguugcucaguuuuguuccccacuguauccccagaccuagaauaugccugcauaugugaaguacucaauagauauuuguuaacuauugauuggcuggcuaacugauugacaagaacaggaccucaaagcauauauaguuaaaagaacaucaguuauagcuucaaagaaguugucccauuuugagaagagaauauggcaagcaaacaucacacaaaacaacagcauucgguuuuaaugcaaaauugcuuuuuccucucucucucuguucagacuuaagguaaaaacaaacuaggggagaccagcagccggcacaugccagaugcuuaaauuguguuggucuuauuaauuguauaaaaucuuaaagaguaucccgagacuugcacauguucuagagauauuuaaacugcagacuaaagguuggagaaucaaucuuugaaccuucagaaaaucaagguccaguuaaguaaugguucagaaauggaaaaggucaguuuaaguacaugccuagcuguuucuacuucuuuaaaaauugcucuaauaucugaauggugcugccugguuaaauacaguauuuuuaaauauuuauguacuguuaucuuaauuuuucaauuuccauuaaaaaaaaggcacaggacaauugagcauaaaaauguuauauccucucucucuagcuauucacgcugugaagcaaccuguuuuacuguauaaaccuguguuuguucuguuucaguugugcagaaggaaacaguucuggcaccuuuaaaaaucaaagaucuaucacucaacaagagaagauagcaauucuaagaaagggacuuaggagaaacagcaaaaagauacagugcuucuaaaaccuuagcgggcuuaugaaucacuuggagaucuuggaaaaauguagauuccgauuuguuacagugggucuuggguggggccugagauucugcauuucuaacaagccauaggugauaccugcacugcugguccucaguguuuauggaugauacuguuagagucacauggcuugagaaauaaaaaucacuuuaaagcauuucauacuuagaguuguaauaauauuaagccaccacugcugcuguacuuaaacugcaaaaacaacuauaaauucuucccgucccaucaagagguggagccuauuucuccacuccuugauucagacugaccaugugauuggcuuuaguuaacagacaacagcaauuugccaaauggugagacuugaaaaguguuugcgcacugggacuucuccuuugcugcucuuggaacccuacaaucaccaccugauugcaccagagcuagccuacuggaggaugagacgacaugcgggagagaacucagguacccuaaccuaaaguuaguugagucccagccaacaggcugccaauugccaucccugugagugaagccauccuggauuguccagucuucugcuaauuuuccaguugaucauggacacuugagcgagcaccacagcuuucagucaaccugguccccacagaaguuauacucagccaacacauauugccagaaacuaaauaaagugauuguuguuuuaaccaccauguuuuggaguguuuguugcugccuuuuucauuuugauuuugcuuuuuaugcagccucuaaaguaggaacagauaucuaaagagggagcagucaaaagucugagauacugggcacaaugcaauuugugcuuaugauuauuuucccuccuuuucuucaaucuauagggugugauuuuugcccuggcauaguagaaauugauauagguaguuauugcaauagcauuuuaacuauuuucuguuuuuauaauucaacucauuuuuccuuuguuuuacuauguugaauguuucugcucagggguuaagucacuugcccagaucacacagcuucuaaauggcagaacaguuuucaggcuaauacgaagucagaaauuugaaaaugcuuuucacaauguuauuagaugucucaaauucuucugcuaaaaugcaaauauagauuugccucugaaggacaugaccuccagccaucaccuuguuccauguuugaggaaggaauauaaggucuauccgcaaaggaauaaucuuacauugaugugauaugccaauggcaaacccucuucagaaaugauacacucaacaccagcuagacauugacauagaaccaugaggcagacagcaucauccuuacacguuuccuuugcagcuucacucauggucaggcauccucccccauuguuggugaucuugaccauccaauguccucuccaaaucuaucaggaucaaccauauuuuaucucuuccacagccacaugaaguucauaauaaugacagucccauggccaucccuauauguuaaaggcugcuugcuauggacuaggggaguguuuccuaauuuuacuaaacuguccuuccuauugaggcgaucucuacuucuuccgccccauccuauucuuucuuguugagaaucaucacuuagaggcucugcaaacugguauuccuuaagcugaauacaguucacaauaucauuugcucacuaacaaaauucaguuguaauaaauuagaauuugaaugcuuuuaaucaaaaucugcacuuuguagguaacacaagguccuguuauuccucaucuaacugcuaccccagauauuaccuuacuggacugugaaaacuuuugauugugcaucagcugguauucuaaucuuucuuucuggaauuugcaucuacugccaccacuauagccaccaagcacauuccagggacucccugaucuauaugugcagcucuaaugucuguucagaucuucaacugcucacuccuggcuccaagugugagcuuagcuggcuuuuacauccuacucuuccuugccucccuucuccccuagagcaauccaucuauugaaaucaccuuucuuggaaagaguaccacuuaaaaguuugucaauccacugcagagcuauuauugcaccugcugcccugcccauuuguaaugugaacauagcccacauaguaucucauuugggaagauaugguagucugccaacugcucucauugcuuucaguauccuuucuccuccauucauguucaagggagucaucagaauuauauuccuuguacucacauuuuggaaaucauauuucuaguugaaagucuuuccaaucuggcacuaaauucacacuccuuucuuacccccuucuccugcauaccugugcuccagacaugguaugcaucucagaagucuucauauuuuuuucacagacuuugccuacugacuggaguggccuucuccauccauccaucuggucaauucgucuuccuuccucuaccuggucuugcucaauuagcuagaaaaaucucuucaaccacagcucuuguuuacaucucugccauagcaugaauaauauugguuuguuacucaucaucuccacuccagaacugugaacacacaggguaggcaccacauuuuaucuaacucugcuucucaucggguaaaauuccaucugacuuacaacaaaugaacaaaaacaagaauagcagcaaacacguauguuaaauaauuagaaaggcauuuucaagauucuugucagagauugaggagugagacagcuugaaugaagagauaaaugcaucuaacuaggcagguuaguuuaccacugaagaccuguugcuuauggauggugagggauuuccuacaacuaauagaucugcaacaggaggccacacauaaaggcauuaaucugugugacuucaacucaagaguuuuggcuuugcugggcuaauggcuugugucuauaugucaauguaauauagagguuuuuauauuuaauuuagauuccacaggcuauugauuaggcaagcauucaaacuaguuaauaaacucaauucaaugagaguguuuacaaacccagaacuacgcagacugcacuaagagaagagaaaacauauuuacuagugcuauguggcaauucucaugucucuauaucuggucucucacaucugaucuucuucucccuuuaaagguagauauuagaaggucuaaaacacagagaaaguaauaugucuguucuuagagaguuucauuuuaucugugaggacaaaauuuccaacaucuguaaaauucuauaaaacaagauaauuaagugucaaggaauaucagagacagagcagacagaacuuacuauagaauuaaauugguucuguuaaauauauugaaccccaaguuucucuucacaaaaucaguacgucaguagguucagcucucuuauucuuugauucuccauuuuaaaguuuaacuuccugguucucuuugcccacuugcuucuaguuucaguaaacaacuuucccacuaguccuaaucaguaguucacaucuguuccccuggucaucugcucuguccugacucauucuggucaccugcuuugaccugagucacccuuggucaccugcucugaccuaagucacuuuuaguuaccuguuucuaaccguuguccccaccaacuacucaccccgcuacucuggcucauacccccgcccucuuuaaauagcccaucagaauuagcuuagacugugcgguccaacccuagccaauaggggaaccacacagcaguaggggcuaccugcguaaggaguaagaacuccugccccuccucuguccaggugugcucuggccauuguuccaucugcgaugagcacccuuucugaagaaaguaaaaacugccuugcugagagaaucaaauuuauguucgaaugcuauuucuuuguggcaaugaggaacaagcauuucuaacaguuccuuuauuuauggcuaggaugagaaggugaaauuugcuaauagcaaguagaagaacuguaguugucuagguaucccccauaauugauaaaauuaugacauaaaacagguuccugcaccagcauucuucuauaaugcuugaaaucugaaccuuggaaugucuugguaaagugauagccaguuuaaagucaaaugcaauauaaacugcaauuaaauaaguuuucaaaacuguucugguuuaguguuaauagaaaucccaaauaaauggcugaaaccaugaaaaacaagauuucuuacaacugagauugugagacugagauuucuuaugagagugaaacaggaacaacagaacaaagccuugugcauuucacaaaugcauuuaaauacuuuuacccucguagagcauuuuaaguaaugcuggauuaauccauuuucagauauuaauggcuuugugaaaauaauuuggcuggccagcuacuuaauaagaugcaggaauuaaguccacguaaacucccagaaggaaucuugaaggccccaagccagcccucuuucugaagugggaauugccuucauaggauggaaugaggaaaugggugugaagaggaagaaugauuccaaggcauaauaaacaaaggcagacagaaauacaggucggggccccagccagaugaaggagaggggccccaaaacauguuuuaauuuaugguaucauggggguuucucaaggcaaagagaaagcagcaaagcaacuauugaggaugaaaagugugaaaucuuucaggaugacaauuuggcauuauguauuaauaguuuuuuuaaaauccucauccuuugaacaccaauuccacuucuagaauaaacauuuaaaggcaugggcgcccauauauucaaagguauaaggauauuaaucacaguaaauuuuauaaugacuaaaaaccagaaacaaccuaauuaauaaauaagagcagacaaauucugaaagaauguauacccaaaacuuaauaguucaucucuggugauugaauuuuaggugacuucauguucauuuaauuuuugucacuucuguguuucucuauuuacauuuuuuuuuuuuuuuuuugagauggagucucgcacugucacccaggcuggagugcaguagcgcgaucucagaucacugcaacauccgccucccggguucaagugauucuccugccucagcuucccaaguagcugggauuacaggcgcccgucaccaggcccagcuaauuuuuuguauuuucaguagagacaggguuucaucauguuggucaggcuggucuagaacuccugaccucaagugauccacccgccucggccucccaaaguacauuuuuuauaauaaaguauucaugagaaauacacacaugccauaguagcagauuggcagugauaagaaaacugaggaguaauguaagcaaacucuguuaacaucaaagcuuuucccagaaagacaacccuaaugcaccuccaacuuaccuccccucacuugucccugcugucuugacucuuccaaaauuguaugugugaaggggcaacauguugggcugccccaugggaucaauuaccaugcaacucugccugccuuggaagacugcaaucaaagucuuaugccagaugucagaauaccauuaucuccuaggauaauaugggaauaaaccagcugaaagauaccuaaagcuagcaccuaugaaggcucuacacugccugcuguaccaauuacaaaaucaaacuuuaagagcccugcuaagugcucaggccugugguacacauagacuuuccauucuaaguguuuaaaaucuaauaggagagaaaacacauuauucagaaaguuuuauuuuuuuggacccaauuccacuagcaagggugggcaaucacuuaacauuucugucccuuuagcuucucaauuacaaaacuagggaaucaaugauaucuggguuuuuauuucagguuaaaauuugugaauguuccaauaaugcaucucaaaauuuaauuaccuggggcuaaugguuaaaugcagauuugauuccaugggucuggggagaggccugagaaucuacauuucuaauaagcuccaagguuuguggucucaggccuacacuuuugaguggccaaacucuauuagaguuuguucauuuaaucuuugugacuucuguguuucucuauuuacauuuuuuuuuuuuugagaugugguagcugggugugguggcgggcgccuguaaucccagcuacuugggaggcugaggcaggauaaucacuugaacccgggagaaggagguugcagugacccgagaucaugccacugcacuccagccugggugaccgugcgagacuccgucucaaaaacaaaaaaaaauguaaauagagaaacacagaagugacaaaaauuaaaugaacaaacucuauagaguuuacaugauuucauuuaauuaccccaaguauccucugagauagccauccuuagcccuauuucacugaccaagaagugacuuguauaggguuauaccgauuaaaaaguggcaaagcagaaaucccaacaaggucuuuuuauucuuuaucuccaagauguuuaaugucccuuucaguuuuaaaauacuaucauuagaaauuauugccacacucauauaaagugaacaggaccacaagauugauaaaaguaagcugcuaauggaguucagaagaagaaaaagggauugcuuuauagagggcaggggccucggagucaguuaagaaaucauagaggagauuugccaucaaccuugaaggauaguuaaaaugaagguaagcaaagauggagagaauauaaaaacauagguaagcauaacauggcauaaucagagcaccaguauguucucuacaccaguauagagaaaaccuguggagagggaggacaggccucaugaacuggcauuucuuucuuuucuuucucucucucucucucuuuuuuuucuuuuuuccuuuuucugagacagagucucacucuguuguccaggcuggaaugcaguggcgugaucucggcucacugcaaccuccaccucccagguucaagugauucuccugccucagccuccugaguagcugggauuacaggcacccaccaccacgccuggcuaauuuuuguaguuuuaguagagaggggguuucacagguuucaccauguuggccaggcuggccucaaacuccugaccucagaugaucugcccaccucagccucccaaagugcugggauuacaggcaugagucaccaugcccaggagaacuugcauuucuauuuauuauuauuaauucauuuauuauuucuuuuauuauuuauucucaucauuuacaucauucauagagcauggcaguuaguuucuuauugcuauccauguuaccacguugcuuuaagaguuggacaaaguuugauaaguagaaugaccucaauuucuaauuuguuucuccuaaguggaucuccugagagcagccuuggggcccccacccucagccucuccaugcaccuuuugagcauucuguaaaaugccagcuguaugguaugugcccacagaaacaacaaaguuaauucucucuuuuugaaauugugacucccacucuccgccaauucuucuaaagguuuccuuuuaaagaaaagccaugguucgcugccacugaaaauuaaagacaacagcauaaagaucaagguccaggcuggugcuagcgaugacagaacauuaaaauaaucacucaaauuuccuuccuugaacauugacaaagauugcuaauggaaagccaauccccagaaugcagauucauuucagacuuucugcacuugcaccucuguguucacaaauuauuuugacuaaaaugaacaaauuggaaguguugagauaaaacagaaguaaugacauaccaaaaaaaaaauuguauguuacucccccacuccacuucacaacauagaguaccacgaaaaacaggagggcucauuaggcaaaggcuaauuuacaagguugaagagagaaggaauuaaucgacucuucccuccgucaagcuauacuucuggccucucuaacuacaacgaauuugcuccaugagcuucucucuucuaccuccccuuaguuccagauuauguuuggccaucagauucauaacucauauaacccagacuuccuucccauuugcugaauccauauuuucaagauucuuaucauuucuuaccccaaacuggaggucuggccucagugcccaaucacauguuggcaugauggcuugggaugguauucuugaugcccaacuauuaguacuagacuugcagcuauagcgguucagcuagaugagcucagguuccuuccccugacaaacauggaaaaugucaaggguauuuucaaagcauauaaagcaucucuuauccaauauacaacauuugaagaagaaguuugccaacagaaaucuauggucacccgggaagaagagauugauccaguacaugcaauagcuacauuguaaccuggugaaucagauauuuucaaaagacagguacagacauaugagagaauaagcaggaggaaagaaaaaaaacuucaggugagcuuuuuuuuucuuuuuuuccuuuuuuaguucauuggacacuuacaggcaugaaauuaaaacucaugaaaaacagccauaucgacuugcuguggugacucaaaaguugucguuucucgauucaacuuugcugaaacacucgauucauguuguucuuauuuaaccuaauuugcauugauuuaaucagugcugguaugcuuuaaauacauaauaaauugggauucugcaacuuagaugacuuagaauagcuaaauuucaauaaagcucauuucaaucuguuaauguauacgguucugccaagggguuuaaaacuguagaaaagaugcaaacuugccacauuagaggugggaaaggcuuaaagauaccauauagaugaaaugauuugcaggauaauaaugcaaaaagcaauauauagaaaauauauauuuauauauaauauauauauauaauuuauuuauuuuaauuacagccuaggagcaucuuguaaguuuugaguagcacacuuagaagaaaacucacauauaaaucagugaauuuaauuuuauucccuuucuuucuugccaacacucaacucuucugccucucugcaccagcucuacaaaucaagugacauccaaagugggaccucuucuugcccauuuggcagccucugucaccacuuugccaagcagccagcauuaggaggauuuuuuuuuuuccuagcaacccuagggauugggugguguguacucacaguacucgcugaauggcuggccgcuguuuaacccugcgggugccuccucaacaccccucccccaccucccaacccuuuagaguuuauggcuccaucagcuggccugcugucacgaauaauugucuuggcaagaggugaaaccacuugauggugaauuuguuugucugucuguuaaaguguuccgcagcaccuuggaggugccaggaugaaacaugcaaaugccugauccagaguuagguaggcagcaagagugacagagaggcaaucaucaagaauggcaaauuaagaaagaaagaaagagagagagagaaagaaagaaagaaagaaagaaagaaagaaagaaagaaagaaagaaagaaaagaaaagaaaagaaaagaaaagaaagaaagaaagaaaaaaccaucugugccaguugcaagcuguaugaccuuggauaaaccaugaugucucuuggccucaguuuagucacgugcaaaauuaaggggguugauuuucuaaugucucuucuaacuccuaagacagcaugugaugucuaggacauuucagauuuguguuccuuccaauuaaaugauacaucucagagaugaaugaccagggcagagcucagaugaauacaaaauggaaugauucaugccccuguucauaugacuuuuccugaaaaguaccaccagucuuuggugacuuugauuccauugguuggccucuucagcuuagaugcuaaggaccaauccaguuacuuguccagucuaucuacccuggcucugguaauccacccucauuccuaucaaaguaagugccacuacauauaaugccuacugauuuugacuuccuuagaggcagaaacgaugggaauucaaacaguggagcuggagacucacauuugacucucccuaccaucucccugggcaucuuugucaagaaggaaggcuugcccacacucacuucccgcaggcuuucucagccaucuuggaggacuuuguuuaaacagaugaccaacugacccuccccagggcagacccucuacagaccaguaggcacaagguguguguguggggagguggggggagagcucauuguaaggacuccuaucuauaaaugauuaugaauagaaauaaugaggcaaaggcuucucgucauacucagaggaaaaaguggcacaacuuagugcagucucaaagauuaauuaggauguguguauggagacggguaggcuucauuauggcuuaaacuaucacgucccuacacauucacacucucuuggaguggggugcacugcagggcccaguaaucaccaugaacagcacaagucaggguaagcccuccccaugucagacaguacaaucguucuuuaauccacucuguaccccauauguaucuguggagccugaugaagccccggagggaucucagucaagucucccugcacacagacauaccuuuuugccacacuggaucucacaccaccgggacuuggauggcuucccaaacuagguggguuuggaaagcauuuccccucuccaccucaaaaaagggcuggcugacugcagaauuccaguacccgcaagagggggaaaaaaccccaaaaaucuuagccaagccccaaaucauugccuuccugugucuucucucaaguugcuuuucuaaagcaaagguccaaacguugauuucucuacagauuccuacguaucucuuacacguagacaguuuuaaaggggaaaagaauauauccccaaaaggcaagggggagagcacagaacauuucaguuucccacuuggaaauaucuugucguggaugaugcuaccccuaccuccaccucccuccccccuccuuuuuuuuuuuuuuuuuuuuuuugaaauauggacaaaaaagcugaaaguguuuuccguuucaucaaaaaacauauauuacuuuagugguucgguaaaauguugguuuuaugcccaccccuuuucaaucugcccaugucugaggugcucggggaagacgcacaaucgugagcagcuuacgacacucagugagcaguaggugccugugcaagcucgcgccgcacacugccugguggagggaaggagcccgggcgccgcucgccgcuccccgcgccgccguccgcaccuccccaccgcccgccgcccgccgcccgccgcccgcaaagcaugagugagcccgcucucugcagcugcccggggcgcgaauggcaggcuguuuccgcggaguaaaagguggcgccggucaguggucguuuccaaugacggacauuaaccagacugucagauccuggggagucgcgagccccgaguuuggaguuuuuuccccccacaacgucacaguccgaacugcagagggaaaggaaggcggcaggaaggcgaagcucgggcuccggcacguaguugggaaacuugcggguccuagaagucgccuccccgccuugccggccgcccuugcagccccgagccgagcagcaaagugagacauugugcgccugccagauccgccggccgcggaccggggcugccucggaaacacagaggggucuucucucgcccugcauauaauuagccugcacacaaagggagcagcugaauggagguugucacucucuggaaaaggguggguaagacacuuuuuaauuaaauucuuucccgaagauuuuuuuuuuccucccuuuucuuugcugcagcaucuaacauggaccaaaucaccaucucuuugaucuuuccguggcugugaacuuucuaugcugcccagcuuucugcaugcuuagaggugaacgugugguuuuuggggagggggguccuucuuuauuucuauguauuuauuugauuuuuugcccuuuucucccccucccccgcuuccccucccucggaauaaaauaugauguagauuucugaccgagcgcuuccaauggacauucuccagucucucuggaaagauucucgcuaauggauuuccugcugcucggucucugucuauacuggcugcugaggaggcccucggggguggucuugugucugcugggggccugcuuucagaugcugcccgccgcccccagcgggugcccgcagcugugccggugcgaggggcggcugcuguacugcgaggcgcucaaccucaccgaggcgccccacaaccuguccggccugcugggcuugucccugcgcuacaacagccucucggagcugcgcgccggccaguucacgggguuaaugcagcucacguggcucuaucuggaucacaaucacaucugcuccgugcagggggacgccuuucagaaacugcgccgaguuaaggaacucacgcugaguuccaaccagaucacccaacugcccaacaccaccuuccggcccaugcccaaccugcgcagcguggaccucucguacaacaagcugcaggcgcucgcgcccgaccucuuccacgggcugcggaagcucaccacgcugcauaugcgggccaacgccauccaguuugugcccgugcgcaucuuccaggacugccgcagccucaaguuucucgacaucggauacaaucagcucaagagucuggcgcgcaacucuuucgccggcuuguuuaagcucaccgagcugcaccucgagcacaacgacuuggucaaggugaacuucgcccacuucccgcgccucaucucccugcacucgcucugccugcggaggaacaagguggccauuguggucagcucgcuggacuggguuuggaaccuggagaaaauggacuugucgggcaacgagaucgaguacauggagccccauguguucgagaccgugccgcaccugcagucccugcagcuggacuccaaccgccucaccuacaucgagccccggauccucaacucuuggaagucccugacaagcaucacccuggccgggaaccugugggauugcgggcgcaacgugugugcccuagccucguggcucaacaacuuccaggggcgcuacgauggcaacuugcagugcgccagcccggaguacgcacagggcgaggacguccuggacgccguguacgccuuccaccugugcgaggauggggccgagcccaccagcggccaccugcucucggccgucaccaaccgcagugaucuggggcccccugccagcucggccaccacgcucgcggacggcggggaggggcagcacgacggcacauucgagccugccaccguggcucuuccaggcggcgagcacgccgagaacgccgugcagauccacaagguggucacgggcaccauggcccucaucuucuccuuccucaucgugguccuggugcucuacguguccuggaaguguuucccagccagccucaggcagcucagacagugcuuugucacgcagcgcaggaagcaaaagcagaaacagaccaugcaucagauggcugccaugucugcccaggaauacuacguugauuacaaaccgaaccacauugagggagcccuggugaucaucaacgaguauggcucguguaccugccaccagcagcccgcgagggaaugcgaggugugauugucccaguggcucucaacccaugcgcuaccaaauacgccugggcagccgggacgggccggcgggcaccaggcuggggucuccuugucugugcucugauaugcuccuugacugaaacuuuaaggggaucucucccagagacuugacauuuuagcuuuauugugucuuaaaaacaaaagcgaauuaaaacacaacaaaaaaccccaccccacaaccuucaggacagucuaucuuaaauuucauaugagaacuccuuccucccuuugaagaucuguccauauucaggaaucugagaguguaaaaaagguaccaaucauugauuuuuuuuuuuuuuguaaacuaaaauguuuaaaauaaaauagcauuuacaguuuuuacagacugguguaaccuaaaugaauuguuaccuguguuacaagaaaagcaacaguuaaaauuuccuugguggguggggagggaguuguccaggggccagaaggaaaauccaggagcaacguagucagauucaauuugaaauuuuaaagaagggcaaagaaagcuuaucagauuaaugauuuauguuaauuuacuccacauguguaaggacuagaaaaagaaaaacugcaagacccuuuauauuacuggggcagggacagugcaaucuaaccaccuucaggcaacugagagguggacugaggacugggcacccuuacucagccuuuaaagcagagagcauugcaaaugguuuuuaaaaagcaaugccagacaguuucuccuaggaacacgaaacauuuuugcacuuaauguaaccaucuuucaaaucaccucaaaaucucauccccaaaugccaccuguucuuaauucuccugagucuuugauucaccagacuuaguagcauuugugcccuucuuguacccccuguuaaagggagccccucagcucacugcucucuuuggucuggcugaggggaaggaggcagaaucccgauguuuagggcugaaagcugugcuucuggagcacauugcuaagacugcagcaagcuuaggcucccaaacagugacagcacauuccuaguuucuauggggaaugaggagaaaaaccuaccuuaggaugaaugccugcaggguaaugacuuguagcaagagacuuuaggggcagaggugacagagcagugaugggguggggagagugggagaagauacucauuugauccuguguuugcauauuucugagaugggaauaauuuguuaacccaggacagaaaagcugccucuucucagauggcccuuuuguguaaugcuugcuuucccuuuuuuuuuuuucuguguugagagugaugauugcuccuucucaccccucauagguuuccagguccaucauugagauuucaguuucuauugaacuaaagagugaggagguggugguaguggcaguuggugggugcagagaagggaaggggaaggcugugugcauuggacggagggcuccuucaucagaugacaauuuaagcaaauguaugauugaaauaaacugucauggaugacagaugcugaaccaauguagcccaugucccuaagucuuucucuucccucucuaacggacacuaaagaguugcaucuuucuguuuuuauuuuuccuuuuuuuugagagagagaaguccaaauagcaggaagagggaauggggggauggggaaccacacacuaccaucccccaacaugcaaaugucuccagcuaccaaucuuaggaggcaaaaucagcuuuuugaaaugcagaaugguaucaccagaagguuuccuuaagcuaaggguuggugguagguuucucuuuuaccuauggagaaaccaguaugccuaaaaauaguauuucuaagagucucuuucaagagaaauauuuugcaaaugucuuuuaagauguuaagcccugggagacagcuucuuacacacacacacacacacacacacacacacacacacacacacacacacacaccccaacaccccagcucauuuuuccuggccaggaaacuucaucuugcuuuauuuauaauuaaaacaugacauuaugacacacaucaugcacaugacacccauucagacuauuaguguucuagaagagaggugcuuuguuugauaacuuugaggaggggguuuugaauuuaagcauaaucauuuggguuugccuuucuaaauagcauaccacuccaagagcagggguagcaggaaaaagauucucucagggaugugccuuaccuaaaacccuacuaaagcgaccuccucuagaagacggcauaccuuuuuuagaaaacaaaaaauguagcaacugaaggagggcuccuuggauuccgugaacuuaaccaucucauaggaaggcuacaggaauccagcgcccaaagcugcuuuggcuuggugcauuaaagagcugugugggugugcuuacagggaaagcuuucagaagcaaaaccuuucuggcaagcaucagaaccacaaguccccuccuacccucuagaaaucugaauauuggaaacuguaguuuaucuccuauccccaagacauuuuuaucuuucacucuucuuguuucaagguggccauaagacagagagagaauaaucgugcuuuguuuuaugcuacuccucccacccugcccaugauuaaacaucauguauguagaagaucuuaaguccauacgcauuucaugaagaaccauuggaaagaggaaucugcaaucugggagcuuaagagcaaaugaugaccauagaaagcuauguucuuacuuugugugugugucuguauguuucugcguugugugucuuuguaggcaagcaaacguugucuacacaaacgggaauuuagcucacaucauuucaugccccugugccucuagcucuggagauugguggggggagguggggggaaacggcaggaauaagggaaagugguaguuuuaacuaagguuuuguaacacuugaaaucuuuucuuucucaaauuaauuaaucuuuaagcuucaagaaacuugcucugaccccucuaagcaaacuacuaagcauuuaaaagagaaucuaauuuuuaaagguguagcaccuuuuuuuuauucuucccacagagggugcuaaucucauuaugcugugcuaucugaaaagaacuuaaggccacaauucacgucucguccugggcauugugauggauugacccuccauuugcaguaccuucccagcugauuaaaguucagcagugguauugagguuuuucgaauauuuauauagaaaaaaagucuuuucacaugacaaaugacacucucacaccagucuuagcccuaguaguuuuuuagguuggaccagaggaagcagguuaaaugagaccuguccucugcugcacucagaaaaaauaggcagucccugaugcucagaucuuagccuugauauuaauaguugagaccaccuacccacaaugcagccuauacucccaagacuacaaaguuaccaucgcaaaggaaagguuauuccaguaaaaggaaauaguuuucucaaccauuuaaaaauauucuucugaacucaucaaaguagaagagcccccaaccuuuucucucugccuucaagaaggcagacauuugguaugauuuagcaucaacaacacauuuaugaguauauguaaguaaucagaggggcaaaugccacuuguuauuccucccaaguuuuccaagcaaguacacacagaucucugguaggauuaggggccacuuguguuuccggcuuauuuuagucgacuugucagcaaguuugaugccuagucuaucugacauggcccaguagaacagggcauugauggaucacaugagaugguagaaggaacaucaucacauaccccucucacagagaaaauuaucaaagaaccagaaauuauaucuguuuuggagcaagagugucauaauguuucaggguagucaaaauaaacauaaauuaucuccucuagaugaguggcgauguuggcugauuugggucugccauugacagaaugucaaauaaaaaggaauuagcuagaauaugaccauuaaaugugcuucugaaauauauuuugagauagguuuagaaugucaaaaaaaaggaauuagcuagaauaugaccauuaaaugugcuucugaaauauacacacacacuccuaccucucaaucuaucucuguauauauaacagcacacacacaaauaugcacacauguguguguguguauauauauauauaauauauaauauauaaaaccacauaguaccacacacacacacauauauaaccacacacacacacccauacacgcgcaggcaggugaccauuauguaacuaccuucuagcacuaaucauccuaauacuuucuucuucauaaucaaacuuuuauucaggaaaggaucugauaaaaucagugacaguuaagauauaaaugacugauauggcugaugguauuuucaggcauuaguuaaugaguagguagacgcuuugcaggcuggggaacuucugggcuccuuaugccacagcagaguguaaccugcugucuagugggaagagccagcaaaugggaauauauuuuuugagaguauuuuccaccucaguauuuuuccauuaaaguaugcucuacucugauuuuuuuguuuuucugggauucaggaggcaaaauucuuacuucugauugggcaccaucuccuggccuugcucaacuggacacaauuucugaagacuuuugcuuuuuuuacucaaagugaagggccuggcaauugcauucuuacaauuuagacaaagauauaaaugagauggagaaauacaauuuacugagcagucgcugguauggugccuuuaucuagaucacaauaagugagggaggugcuagcaaccuuaucuucacaugaagaaccugaggcuuacagaagucagguacauugugcaaagucacccagcuagugauuggaagcacugggaugugcuaauugacuugguggccuuuucacuacacacuguuucuuuauuccuugaaugguugccccuccacuccuacaccuaacaaagagccuagaacuagacugggaacaggauacaugcucaacacauucuuguugaaugccaugggcacaguggugaaauccaggaauucugaccaugacuuguuugcucuggucacugguaauugggcaaugcaggacucugccaauagaggagacuucuccgggguuccaggagaagaaauggccaguacauucaguccgaccccuuaaaauaggauuuuagacucagagagaguaaaguagagacauccauauguuauugucagggauuuaucugcauuucuuccuuagugauuaaauggaucaugugucuaugguacugguucucaaccaggggcaaauuugccacccaguagacauuuacuuguuugugucuggagacaguuaaaauuuuuaugcaugggugagauggugcuacugguauccaguagguagaugucuggauacugugaaacauccuacaagcaaaggacaucccccacaucaaauaauuauuugaccuaaaaugucaagagugcugaaguugaaaaacccugcuccacgacagaaaguaauggugcuaucuaaagcaucaugcugugcuucagcuuuacaaggaauggucuuacuucugaguuaguuuuagauuuaccuagacuuauuccuuuuaagucuuucucuugccagguaacuggaaaucuaaauuaaaagcccuuagguucacugauaaucagcaaaaguuaacacauaguuaacacaugcuucucaaagaacauauggcaaaacuuaaauuaacuaggacaaaacuagucagaacccucaauugacccacuuuuucuuuagcaauaccucauuuaggaaacaggaaaaaaaaaucaaguuaacaguggagauuuaauuaacaagaaggaaaaugagaaacuugauauuccuuccaggagggguucugcagucugaacaaauccaacccaccagccugugccuucuucuuccccaaccaaaacuguaauguaugugagguggugaugaaccucuauuuuaaaaaucagugugcuaaaaaaauaaaugcuugaggugauagauaccucauuuuccaugaugcaauuguuacacauugcaugccucuaucaaaauaucucauguaccccauaaauuuaugcaucuacuauguacccgcaauaaucguaaaaaacuaaaaaaaaauaagcuagaaaaaaaucaaugugcucagucuggugaguagggugcacauauuuagggaaaugaucucaguccuuagaaacaggauagucuagagauacaagaacugcaaacugaaauucaucuggggacagacaggcaacacagaugagugagguucaugggcagaugaaauuauaaggaacuagagaauucacuuaaaagaauauaauucacauuugguucugguuaaucauaacauuucugcagggcaggucaaguaagcgcucuggaagaaauagggucuagaagucaggaguuaucaucuuuagacauaguacugucauuuacaugccugggaucaucuguuaaucaucuuacugcaauuggucucugugucuacuuuuagaaggauucuucuagguauucccuaagaaccuuuccaguuuggggcuucuauuuuaccauuuuuuccccacaauaaaacuugaaacaaaagugguuuucaagagagugucacuuaaccagaaaauuaaaauuccccugaauuccuauuccuccagacauucugauucaucaggcuugccugaauauuaaugagcagauauagguuaaaaaaaaauucacugagagucaggggcuucagagagguagguggacaugcuggaaaacagaggagaagaugagaaagcucaggcauguaugggugggagaauuggguuuuuagaaugugcagaagagaugaaagggaauccuagagaggacacacacacucacccgcacaugagaccugagacacagggauguggugugagguagcccccuacccacaaaaaaaaaaaaaauuuguucaggacucucaaaaugacauacuacauuguaaguggccacaauggauauuaggaauugagagaccuuucuaguaaaaugggguaugggaugggagggaaagagagagaaagagagauugagaagaaaaaaaggcaaggugggagaaggagaugagaggagaagagagaacaaaacaaaacagaaagaaaaaagaaaaagagaggaagaggagagaguuucaagaucuguguuuuaugcuacucaaguuaacauaaguagcugugauuacacugacuccucaauccuuuucaaucauuucuuuauucugguccaccagguuagcuauuugucuguucucaauguaauguuguaaaguuauuuucccucguguuaugagaagaaggaauucguucucuagcugcaucuuauuucucuauugcucagcuagcagagugcuugucaacccuggcugcacacuggaaccacuugggagccucaauaaauacugacuccuggaccccacccucaacagauugugaguuaacuggucugggguguggccuuggugaggagaauuauuuuuauuauuauuauuauuuuuuuuaagcuucccaggugauuccauaguucagcuaaggcugagaagcacugagcuagcggguugccuacucacagcauggacaacucagcaaucuacaagauccaaaagucugacugcagcucuuuaaaaagacaugguuggcuggugccugggcuccauggggucagggcuccauggggucagggcuccauggggucagguuacgugggcuacauggcagggagaagggagucaccuucccaccuccugccauugacuccaucugguggcacugauagaagaaagacgugcaagcaucgguguacuuagaauuagucucugagcacucuaguuuacaaagcgcuguuuagaauuauucuuauauuuguuuuuacucucccaauaauuucacaaggcagacauaaacuugucccauuuuuaaggcaagaagacucaaaucugaaaagguucaguagcuugcccaaggucauuguuacugcugggcuggcacugagaaaugucucuucuaaauucugaguccuucucccgcuaccaccuuccuuuccuucucugauugguugugucauuaugagguaaagcuaguccugcucaaaauauacaaaucaauaacuucuuuaggaggauuccuggaaaacccauugcacacaggcuccuacaccuccucccacugaaguccugcaguuacaaaguuugacaucauaguuucaccacugccccucugugucuccaccccaaucccaagccugacacucuuuucuuugccaaaggagacuccacgacacccaagagacaaccaaauaggcaucaauucuuuccaaauaccccuaacaccaaaauauucccuuuccacucaguccacugcauccgcagauuugccaccagcucuuccaagaauguaaacauaaauccuaguaggacacugaucgguggaguggugauaauucuacuccggggauuuuugcaacuuaaacaaggaucuuugggggaaauaaccaaaggaaaucacucuaaugcuggaauuucaggcacuuaaacagacggguagcauacauuuggccaggacaucccaccuuguuccccuuaaaugaaacaacacaagugaaugcucucuuacaagagcagauuagucaacaguuuauggggcuuaaaguaaagccaggauaaagauuggaucuucugucauauuuuaccuccuuaaaccaaaguccucuuuaaaaaucacauauuuuuagguguucaccaucagcauauuuauccucagugaagaacucucaauauugcaaacuauguguagcagggcucucuaucuuagagauauuguaggcagccuucaguauaagugagauggcucagcagcacacagagcuggauuagucugccacagaaaggucuggaaaagccaaguuacacacaauuaauggaacaaugcaacaaucugucuucagcuggccaaggcaauucugucauuugucccucagcugcagaacaaccacucacucuguuauuuugccucacugucucugcuccauagugauugcauuuauggugaaaucuauauuucccugaaacugagacuguguuucuuuuauuuuauuaaauuuuuauuuuaaaaauaaugggacuuuucagaaugcagcagcacugcuuugcuguccaggccauuuuuugucugaguguuucauacugaucuuuuuugcauauuauuucaaaaaucauaaagguacaaaaaaaagagcaaacaugcuguaggaaagaaaaggagaaaccacauuauaacugaaaugccacuaaacauaacauaucacucagaugcuuuuaacuuccgauuauauugcucaacucauucaaucaaaguagcacaacauuucuuguucagagcuuaagucaacauuuguggagugaacaauagaaccauuuaacuuauaaaugauugcaccugcgaaggugaggcauucucaagaggacuaugcuggcauaggccuaucagacucaccaugagaguaugcagaagaggccuccacuucuucuugauccauuuaugaaacaugaccuccaccuauaggaguguuaaucauauauuuuacuugcuaggugccuggcaaccugcaaaauccuuaagauuuucucauuuaagcccugcaaaaagccuucaucccuccucguucagaguaguauuagcauccucccuuuacaaacagguaaacugagguuggggugggucaacaacuugcccaaggucacuuaccaugguaggaugugucaagggagacacauuccuuggguucaaauucuggcugagugacuuuggcaaggcaauuaaccuuucugauccucaguuccuucaucuauaaaauggacauaggguuguuauaagaauuaagcccauuguuacugagaaugaaagaguuauuccuuauaaagugcuuagaauggugucuggcauguggcaaguacuagauaaguguuuucuaaauaaaagaugaacaaaacaaggucacauagccaggaagggguugaaucaggguguaaccaggauugucauccugcaaagcuaggcugucaccauuuucuucugugauaggaugagacucaaaaaccugaauuccugaaagcacugggccuaaaagagggauauggaggcagugaagucuggaguugcaaagacuacacauggcuuccuucccagcuuucuaacuggccaggccuuagcccauacaccacucacugacuuuguucugguucuuuaguggcuugccuuuaccacuguggucuggcagcccuggugaaccugauccuggaauacacguggccaugugcacacacaucuuccaguuuucauaggagcugaaggcuagcagccagcuacaagggccuucuggugauguggaaaaacuguuuccacaucugagcuguuugcuaucuauagucaauuccuggaggugaaaaacugcuacccagcuugcaauuguuauccaagccccaaacucuuauuuaauauuggcaauauuaaaucauacuggccccugggacacuaagcauacaucuucagcugaagcagauuugcugguguuuauuuaaagaagcuuuuucuuuguguaaucacagccauaguuggaugcugcucaaggaaauuuaacaaaugaugaaguacacaucugagguugacccuuucuucuggcagaggagguccuguaucaagagacaaacuccaugucccagcuuugacacuaauuugcuccuggcccuugagcaaguugguuccaccuguccagaccuuucuuucuuaggucuguaguggugaauucuggcuuuccuucuaguucuccaauuuguuaggcaggguaugaaguuaaggaggagaaaauaaaaguaagaguaacuuucuaugcauucuccuuugcuaucgcuuaucaacaggcaaagcgaugaacuucccccaagggaaagacuccaacgucuuuagagaucuacuaaaucccacgaggaaaaacuaucuuuggucagagggaacauucucguuugcaacuagggaauugagauuccaaaaguugaguguguuucaagccacaccuuguucuuugggauucacucacagaaugauuaaagcaugcucugucccagcuuuggacagaaauauuggcaaugcuuuggccauagugaaaccucaauacuugaaucuauacuagcagggaaugcuagagcuguugggaaauugaggacaucgucaguuuaguguuuuacgucauugcuggcuuguuuuauuguuuguuuguuuucuacucucccuucauuuuuucuuucccucccuccauccuuccuuccuucuuuucuuuuuaccgaauucauaguuaugagcuacaccaggcauucacaacaagagcaaaauggcacugagggagcaaacauuguuucuuaugugggugaaauaaauuguacuaauuuuugggguaaaccacagauauacauauaguacauaaaaagauauacaacauaucugugguauuaagauuucagggagggggaguaauuaggaaaaaaaaugucuaaauaguauuuucaagggggcagugggagaaugaaaaaaaauggcugggaaacacugagcuagauaaugauuaccaugugggagaaaaaaacagcaaaaaguaaaagcaucacgggagccucaccaaccucaccauggugagguuucaugacgcuuuuacuuucugcuguuuuuuuucuuacccacgguaaucacuggggaagaaaugagaaggucaaggaaguuuggguacuucaguauucaaaaccaggacugagacuauuuggacagguucaugugaaggacuuugucuuaucagcuccuucugcauucaacacaucccagaguugucuuuauuuggaggccucaugauguacuaaaaaacuaucuggcauggaauuaauuagacagagcuucugccauuugcuggcuuagauaaaucagcacuuuucuguaccucaauucccuugucuauaaaauucagaaaacaauccuugcucagccugcuucacaaggaucugguaaggaucaaaugagaucaugugagugacagaacuucaaaaacugugagguccuaugcaaagauuuaaggcagugggaggagagugaugagaacccaagcucugugguuggccccucacacacagugacuuuugaggcccauauccuucaaacucuccuccacagggauuuaaauuccugcucuuggucacugcugugaauuaaguccuucauuacuccaucauccguagcagggagcagggaggcaaguacacuuuugacuucuuauuaggaagaagucccuccugucaguugacuuuuuucccuaccguauaacacagucugacccaagugggcuaaguggccuuagacagucacuagugugacucugugaaccuggguguccacaccuguaaaauggucauaucaguggcugccuugcugguuuuuaggaagauuaucagagagcaugugcauugaguuggccaaauugcuggccaauaguagauucucaaucagcauuagucccacuccugccccaucaccacaguagagugacauguuauguuuauaaaaauagccucaggggaaauguggauggcauuaggagcaauuggcuccuagaagcagaagcuaagaagaggauuuaagagguuucuuuaaugagaacacuaaaucaguaauauaaaaauuaucucuaaagaggcgagaacugggguagagauuaguagggcaaguaauauugcagaauaauuaguaaacaggaugaagaauagcacccucucuguuagucaauggcaacuggaauguuaagagggaaguuacaaagaucccuuagccacuacagaugcuuugacacuugccucaggugacugccuuuuauuuauuuauuuauuuuaauauuaugguucuucccaguucugucaacagauucaguccccaguccuccuucucugagcagaccucucauccgcagcauauaucugcuagaucuucuaagagcugaaauggagacuucuggaagaaggugggaaagaaauccaucucggcuuaauuaaccauuuaucgcaucauauuacucccaucuuaaaagugcacgcguuguuuuucugaacccucacacaaaggcuacuacuguggucccauaucugucggcccaugagaaacaguguucuuggaccucacagccaagcagcacugaacugcagcaaaauccagcaacacauucagcagcgagcagccugcugagcuccacugguuuauccggggccaccaaccccaaagaacugggaugaaagcagaugugagagaggaaaaggaucuguuuuuguuuuauuuucuaccaggcccagcucuuuguggggggaauaaaaaagaagaaaaaucgagcuccaagcuggugcccugccaagcuuccuccccucccuuccuaguccaagcacuccaccgucugugcagacugcauaacagcaauuucuggaaacaggcugaagaaucugggccaguccagaggcaguggauuccugguuuauguguggugggguuuuuaggaauuuuauuuuucaccuuaauucuuucaacaacugccagcuguuugaagcacaucuguaauaaacagcuucuguuuguaaaaugagacugaaguuauccucuccagagaaauuccugaaucuucucuguaguucaaugccuucacugacaguuuggcucaaaaaguaugagugugguaaauauuaaagaauguuaauacaaguguaaugaaacaccuagggauauuuuuuuuucuccccccaaauucugcuuugcucacuacuaaaguuaaucuugacauaaaauuuacuucuuugauccacgucauuucccaaagcaauuuucuaacagcaaacauaaauuucuggugaucgcuuggagguuuucaaucccuguguuaaggaggccgugggguuucaacuguuugccucacuuucaguugaaugucccccacuuggaaugcuaucaccagaggacccugggcagcaacuaaggacaaaggcccaaaaauggguuuugaggugucaacaaaaauaggguugguagcggggagaugauuugaguaucaagaucaaaccuugaagaggcaauuaagucauuaacuaaggagguaauugccuaagcccacauaucuguauucgcaaauaagaugaagcacuaaguaaaugcaaugccuuuaccuggugcugaacuuugagcagguuaaugcagauuacauuuguacccuaucgaaggugugaguuaagcacauaucaugagaugacacuugugcucuucccuuugucauguuugucagccguuagggcucuagggaaugaaaaaugacuggacuuuggaauaaaauagacuucaauaugagccccaguucuaccgaacaacagcugugugaugcagagcaaacgacucaaccccuauuaaucuagagauggcuuaaaaauucgacuuucaagguguugggagguuuaguauuaauauaugcaaaacauuuugcacaugcugggcacauagugaguauucaguaaguguuauuacuaucgucaguaucgucaccaucagugucauccucgucaucauuacuuuugguaccaagcauaucuauuaccaauggaguccauuuugacuauacacagugaaucuccuuuacaauguuauuugcaauggaaugaaauucagucuauggaccucacuagaugaaucauauaaaguaguauaugugacagcaguuucuaaguuuuaaaguuugaugaaaacauaagguaucacgggaggggggaagaugguagucuuucugauguacccaaaauaaccaaaagaugcuuaagucauuucuaucauucucucuauuuccaugccuucccuguccucuccuuuucuuucuacucaguaaaauuuucaugaugacacaauauccaucucaaguuguaaagacagcuaugaggcuuuucuugacgcccucagcucaccaugguccucccucuuaccaucagaagguguuagaacagucauuguccuuagcaaucaacucuggacuguucaggacaucucuuuucauuguucauaucauuaauuuacuuauguaccaugucuauauauuuuguguccuguuauauacuauuuauggucaggggacaacuaauuuguaucaguucaauucaguuaguuucuagggacugaagaugaaucacaaagaagaaaacauagcccuccucucaaaggguuuacauaccaauacaauggguacaacauccacauacauaaugacaaccaaagguagaauaggaugaauacuauaacacagguguagcaaagucuuccaaugauacagcaaaaggaaacgguuuccucaauucagggaaugugugagaaguuucguagggcuugaugaagaagguggacuauacacugugucuaguuaggugggugggauuugacaugcagaauggaagaaaagggucuccuaagagcacaauccacgaugugaaagagcauggaggcagcccagcaaaugaaagggaaacacuggcuaagcgcaccagcaaaaugcucaacagcaugugaugauuugauauuuuauaaguagcuacuucaucaccaggacaauccagaaucuaauuuuauuccauuucaauauggaauguauccuaucuauaacaggaugaguuagugagaaaacaacucaccacucuuauauccuuccccuacacucaucauacaaagaacagaguccagacuaguguuuccuaaggcccucugaggagaauaucaucucacgguggggcggggggaaaagaagaaaguacuugaaggagguugcuggacaugcagacuccauaggggaauggguacggagggcuccuuaggaggcugggucauggccaccagugggucuauccacagaagagacuucaauaaccaaacacggcauaaagcagcaauucugccugcauucaagggaccauguggacauagacaaugagcagguaaguggaaaucagguggccugaagaucagagcaccauuccugagaguucuggaccaauauuaggccaccuggaccacugcauaaucaagauggguuggcacuguaagaaaaucuuuauggaaauugacagucaauuucccugguaagaggaagcaucaaguggauuagaugcaauuuugaaaagaaaaaauaaaaaggcaagugaaauguuuuuaccuuuguuguauagggaauuuuauauccguuacagugacuauuaucauacaagucaugccugucuaacaacaugugaauagcaguggcugaaauguugcugguauucuguaucaauucauauuugaaggcucaucugucaggagaccauuuaauucuacaucagacuuugauuaucugaugaacaucucugaagggacauucauuugcauucccacugggaguccuggcuucucugaguuuuaucuauuuauccagugggcucacugggacaaaauaaagggacauuuugggaauaaugacuugguccccagacuaugacccuuguacaaagaccagaagcaagaugaccauucaccucuccauggauccccuggaagaaaacagaaaucacucugagguaagaaugucaagacacccaggcuugaucuuaaaguguuaguugacugucaucagggauggacacauuugaguaugacacugacuuuuauuaagacauuaaaauaauccagugagaauguggguagucccaccgaauguauaaugcuucuugcugccacugcugcugaagaaagagggcagaaucucuuccuuagagaaugaaugagaaugaaaauucaauaagagagauaccagugugguagaugcuacuggcaaucuacucaauugccauuccccaccuucuucauccaugauggcagucugcugccaugauaaaggcuaaaaucaucauggucugguuuugccaguuuccaugaagccaggucauggcugaccagcuggacggacaucuacuuggaaaccucagaguaauauuucacuuccagaaaaaaaaagaaagugaugucuagaagaaagagccccuccuuuuuggccuacagacaaccuuccugauucuugcaaugaacaaacacuaggacuaagugagauagcagagcagaaaauggaaagagacuccacugugcuccacagucuagcuggggggauccaccucuagaccuauugccauguggaguaauaaacaacuauuauucaaccauuggaaagugaauuaucuaucuaugcaaccauaaucaucuuaaccaauaugacaaaauucuaaauggagugggauagagacaggaauguguggaaagcucaaaggaugaggcaaaugaauauccaaggagaaaaggaaaaugacauuucccugggaacagguucaaauccugcccugccucuauuaggaauuugaggaauucucagagaugaugcaaaaaaaaaugugugauugaaugucagagaucaugggagggauggaacugguggauucauaguagaggaaaaacccaguaaugaagagaaaacugcauugaaccacauucaaugcucuucauuaagagcacugaagaggaaacugguuugaaccacuguguaucaggauggagagagaaaaggccaccacuucuguccuuuuugggcucagucaagggaaggaaagguuggaagaacugcucuggauagggcucagagcugaaaacuacaaccaaaaucuugacaguuguuuaucuuacuccuuuacugacuacuuuaaaauugauuggccugagaaaguugggacuacuucugccuuuggaguagaguguuaucuggugguauuuuaucauccagaguuagggccccuuauccuccaaaaaauuagcuaguaauuccauucaauuguuaauucacuauccucaucuuuuaaaacaugaaaucuguauuaagacauuaaaauaauccagugagaacuuguguagucccgcuaaauguauaaugcuucuugcugccacugcugcugaagaaagaaggcagaaucucuuccacuuggauugccaugaaugggaucauucuacucacacuaauuguucauggucaagggaauugagauaauacaagucaaauacuuggcaugaugccuagaauuaaccauucaauaauuauuaguggucagcccccuuuucuuucccuccuccuucucccucuccuccuauccccuuucuuucuuaucucuuccuuuccuuacccuucuuuugcccucccaucuuccauucuuccacucccuguauguucagcauaugcaguggcuggagaacugcccuucuuccugcaugacuagcuguccuuccagcucuaagagagcacaggggcacucuuuccagcuucucucagcugcauuagggugaaccagaggcauauccaaccuguuaucaucuauuguaacucaugagacaucuucccauugaaauaaugccagaaaaauggguaagucccuagccuaucaagcaauacucacugaaaacuuaaacacauucagguucuaucucagaggcugcauuuuuaaauaugagguuacugccuuuuuauguaggucucacacaccaauacuaucuuguuauuuguccuuugauuauuuuuuaaauuuauauuuuaaauugacauuuaguaauuguacagaaagguauuucaauacauauauacaauuuguaaugaucgaaucaguguaauuagcauauccaucaccucaaaccagcauuuccuuaauauuaucaaauauccagguaguguucaaacaucucugauauucucuccccucccugcacccugaccuuuaguuuguuugagucaaaauccaaacaggguucauacucucauugguugauaaugucuuuuaagugucuuucaaucacaacucaucucuuuuucuccccucuugcaauuuauuugaugauuaaaacuaguuauuuguccuaaagaauuaccuauauccuaaauuuuauugauuuacaugacuuuuuaaaugucacccucaaucuccaaaauucugccuucuuuaauuuaauucuuauaagauugcuucccuuuuaaagaaaaauugcaacuugucauuccuuugcuuauuaccuugaggauccacuagcccauauuuugccugauuuugaccaauaucuucuccuuuuaauauccauuauuuaccuauuacuucuuucugaaaaaaaaacuugaaccaucuggagugcccuuuaaaucagguuuuaaaauggauacuggucuacucaucuagagaagcuugcucagcucuaagauugcaagacauaacuaguaagcaacagguguuguuuugauuaacaauugugccacaugacuacauuuuaaaaguacauuucuauuacugauuaaacacauacauauuuuaaaaguacauuucuauuacugauuaaacacauacauauuuacuaugagauuauauaucugagauuugcuuuaaaauaauaggagagagggagcagugguuuagauguaguaagauugcccaugguugauauuguugcagcuggauaauaccuauaggagagcugauuguauuauucuaucuacuucuguuuaaauuugaaauuucacaccaugagaaguaaaugugaguuguacuauguuaccaaaacuaaguaaugagacauuucacuugagaggccuacauugucauauuuuuugccaagggccaucaaaaaaucaugucuaaagaaaaauguacucgcuuuucucauucuacaaaucugauuugcccaagaaaaguaaguuuuaaacuuaaaaaaaaaacagcaaauaaauaacauuuaaauaacagggaaaugguuugaagugaaugaaaauauaacucauguagaugugguucauagguuuugggauuugucuaagcugccuuucuuaagacucuacuguggcagaacccauuggcauuucccugugaccuaucacuagcugauagaagacucccagaaggaaagagacagcaagauccacuggaucacuucauaagaaacaguugcuagcaucauuaugaaggcugcacuuacaugcuuuuccuacuacaaugccggaucaacaugcagguucuauuauuccaaggugaaaauuaaaaaaaaaaaacuuuccaaaaaccuauuaucuuccaacuuuagcauuacuucuuuuuauuccauucaaauguugaaaagauaagagaauuuaaugcauuauauuacacuaaccauauauacuagagaauauuuuaaaaacuauauagccuuuaucaauaauaauuuuguauucacuuauuaguauuauauuuaaguaauuucauuaauaguaauuuuuaaacuauaauuaacuauacaacugcaaaauucauaguguugauuuguuucaauauaucuucugaaguugcaugaauuuaacaccacauaugcaaguucucagucaguccagcugaagauaaugaagggaaaaaaaaguaagaaccaagggcccuaaauagagagggaauaaagacagaugcacagugaaaggaggugcuuuuguaugaagguuuggaggacauaaggagaaauugcccuuugacuauacccacagacacuaauguacgcucuuuagaaaauaacuucuuaaaagcauuuaauggccuguuucagugauuaaaucccuuauucucaaguucucccccuuuaaagcuaacuugugcaucccagauuaaacccucagaagcugaccuuuuuaugagcucuaaggacuucaccuccagaagugagucacuucugcacgccacaggcugcacagaccuagucuuuaaauuuccaaugaccucauaacccuggccugagccuugacaaugcaccacccuaacaacacagauccugagcaaguauccagggacauuucugaauauaauuuguguguaguuaaucucuggucacccuggggaucucaaaucccuucagaucaaugaaaccaagaggcagcauuuuagcuaauagccaauagcauuuuauggcucucuugagaaggcagagagaaaugauggcguuucccugcagcauuucaaaaauaaaccgagggggaaaaucaacucaccaaaggaaauaauauuuuguguucacugaaugccuuucagaaauacucucucccuuauuggcaggaguauauucuaagacccccaguagaugcccgaaacaauagauagugucaaacccuauaugcaucaugguuuuuuuucuuauacaauaacaggcagggagcauauacaauguggauaugcugggcaaaaggguaauuuaugucucagacaggacugagcaggacagugcaagauuucaucauguuccucagaauagcauacaauuuaaaacuuaugcguuguuuauuucuggaauuguccauggaacauuuuuggaccacccuugacuguggguaacagaaacugcacaaagcaaagccuuggauaaggguggaugauuaucugagaguccuuugcagaucuauaucaggcuguaaaaaauaaaagguguguaagaucagcgcaagauuguaugagguccaagguuagccaucccacccauaagcugagugccacuggccugaaauauuugauugaaauguaccauucucuaaagggcucaaaucaaggguaggugccuauguuuuugcuguauuaccuaucuaaggcuccagaauuuaaguugauauguauagaccaacuuauggguugacguccccagggaagugggucaacagucagcagaaggcagcaguuggcaaaagaaauaaugaauuauuacuaucagcaccagcacauacuccaggauuugagaaauaccagaagauucucauugcucaaauccuggaguaugugcuggugccaauaauaauaauucauuuuuuuguuuuguacuuuacaaagugcugcaaccagcacacaagauccuauuuggucagcucagcaaagggguaaagggacaaaaggaaaacaaauauuacuugaagucauacaaggacggaggcccugaccuuagcauguauugagcuuuaugucauuuccuucuuacaacagcacuguuaggugaguguugcugaacuggagagaaaacugagacucacggagggugaggaaaugcacaacaucccauagcuaaugcuguucuuccuauuccaaauuuaaccaauauugucauuuuagaagagauauaaauuuuuuuaaaaaagccugauucccaccucagggugagacaaucaccuauuuuuaucagggaaaucucccaggagcccaggccaugacauagaaaucuccaugcauugaccacugccucucacuugggcaaggaacauuucaaggcuuucuauguaauaccaugcagggaucaugaaaaguccucugccacagaaauugacucuauugauacaaucuuuuuuguggucaguauuucauucugcccauuggugggugccaucaaagcaauaagcugagagcugaagagccaggacagaaaaugaguaagcuuuaaaagcgaaaaaaauaaauaguauaauauuguauaauuguacaauaucacaacuggaagaugccuuugaaaucaucaaaacuaaugcccucauuaaacagauguaaaagaaaaacgguuuuucuaugaucacuuggaaaaucauaguggcagcacuagacgcuguguccaggccaguaccaauccuggagaagacacucaacgugucuuugcaccauaaaggaacaaaugaaagaaauauaacucucuagaacuagucuaguggcccuucucucuauuauaucaccagagccuggagugcuggaaaggugggcuggccagagcugcaggaccuccuccaguucucuugcccagauggcaugaggcuaucaaggucucuugccucaggaauguuucuccaggcugucccuccuaguuucccuucauuauucugucuucuucauuucuucacuucucucucucucucucuguuucacacacacacacacacacacacacacacacacacacguaaaagucauuaauguaccagggaacaaaaccaaauucagucuccaauagaauaauccauucuccacuggcaauuuuuuuguaagagacagagucucacuuugucacccaggcuagagugcagugguacaauggcucacugcagccuuaacccccuggguucaagugauccuccugccucagcuuuccaaguagcuagaaccccaggugugcccaacugauauauauauauuuuuuuaauuuuuaguagagauggggucucacuauacuacucaggcuagucaugaaaacuagcaccuuuaaaauacuauuuuagaaagagaauuuuaguccgaggcagacugccagaugagccacgccauucuuucucucuccuuuaauccaugaccuuaggaguugcugccccacagcaacucuagacuuucuuucaccaauaggaugguaguaaauaugacacaaauggauacuuggaaaacacuugugcagcaggauaugccuucuggcugcuccugggaauccugccccccuaccaugugaacuagcccaggcugacuggaugaugauaagaacacuugucuggaaucacagaugcagccaaucaaccaccagaccaugggugagaacuucaaccaccaguagguggcaaauacaugaaagagcccacccaagaucagcagaacucuccagcugagccuagcucaaguugccagcacauagaaucaugaguuauuuuaauuuuaagauauuaaaaucugggagcuuuuuguuauuauuuuuuauagcuaaaucuaacagacacggucccuuaauaauacaucauauacaucaaauauuuacuauauuuggggcgcugucuuaagugcuuugccuacauuacuucacagaauuuuuaccauacucuaugagggaauuauuaauaucccuacuucauagaagaggaaacugaguuucaaagugguuaauuaauguauacaccuggacaacggcaggugucaagccacaaucucucugaugucacaaaacacacuguuaaccacuacccaauccagaaagacaaaaucaaugaauggggaacucaaaaccacauggacugaaggaugggggcaagaauuagguuggcuuaacccggggaaaguagacacucagaggccaugaaauaaacucucacucuucuaguaacuguuucaugaagggcagaacagggcucugaggagaaauuaccagaagguugacgugguugaugacaaagaagaaccuucuagcagaaggagugaugaagaauagaacaggucuacucaagggaaaaagaauucccuauaaccaaauauucaaguaaggaaauauaaaccauccacaaauaccauaaacuuauuccugucucacauuuucucauuuuguuccucucaccagaaggucccuauuuucuccuuuuaggauccaguuucuacacaugcuucaagguuugguugaaguccauuuuuuuuuuuuuuuuuuuucagaaauccuucccugagucucuccuuccccacugagcucuuuuucccugaacuuguacugacaauguucauucucucuaccucucaauucauggugggauucauagguagcuucaagaugguggccagucauagaaagagcaaucaugcaaucagaggauuaaaacuuugggccagcccaaccuucaggaagggaaaagggacuagagauuaggacuuaaucaauccugccuauguaaugagaccucaguaaaaacucugaacucaaggaucuguggagcuuccugacugacaaacacauugaucugcugaaagaaugauguggccagauuccacagugagaauacagaaaagcuuuucacccccaccccucccugaccuuguccuacacaguuuccccauuugguuguuccugagguauaccuuuuauaaggaaucuauaaucuuaaauuuagcuuuuucugugaauucugugaauuauucuaguaaauuuuugaaccaaggaaguugucagaaccuccaaauuuuucuucaguuugucagaagcuuggguggcccugagaccuacaacuguccccucuagagaggugucuaaaguagcaauagucuuguaaaggacuuugucuucaaccuguggggucugggcuaacuuugugaugugguuuggauauuuguccucucuaaaucucauguugaaauuugauccccaauuuuggagucugggccuaacuggggguguuugggucauggggguggaucccuuaugaauggguuggugccauucucauggaauugagugaguucucauucuuaguuccugugagaucugguuguuaaaaagagucuggcacaucccuccuccuccuccucuucuucuucuuccuccuccuccuccuccuucuccuccucucuuucucucauuuccuuccccuugccaugugaugccuucucuccuucaucuucugcuauuagugaaaguacauugaagccuucaucagaagcaggugcuggcaccaugcuucuuauagagucugcagaaucauaagccaaauaaaccucuuuucuuuauauauuccccagccucagguauuuccuuuauagcaacgcaaauggacaaagacacucuagguagugucagaacuggguuacaguccauacuauugagguagagaugaagcagcuuggaauuuguauccagccgggcagaaauccaaguggcuugaggacaaacacccaaaacuuaugucuggcaucugaaguggggacacucuugugaaggacuuugcuuuuaucuguggggugugugcuaacuucagguaguuaguuucagaacuacucaauaguucugaauuguggaauauccaguucauauggaaugacugaugucagaaccuaaaaccaaauaaucaaucacuuauugaauauccgacuaucucuuccuguaucagaaaaauaauuccaacaaguuauauuaaauauauaugcacuuagaguagcuuucuuuaaauucccaacauuaauugccuaaauuauuucccuccauuauaaaguugauauuuagcaucccaaaggaugucauugaugggaauaaaaaaaaaucuccuaaugaaauucacaacaaggaaaauauuaugacauauaacuuaaaguaucaguuauuaauuuuaaaaaagagagaaaauaauaugucauuaaguaaauucugauauuuuuacaacaugccauaauauacaccaugcauuuucuuuaagcaauuaguuuugcuugagugcuaaacuacaauuuagauuauuuuuccguuuggaaguuuacacacauuuauucucucucucucucucuuucucucucucucugaaaaauucuuaagagugacagaauaauauucucuguaauuuccugagauaauguuacugggguaaaugaagugucagguuccacacuaauucaucacuuauuaauuaacaauaucaacaacuccuuuuucauuacugauaacacauuuuagugacuaccagaaggauucuuuauuacaaaacuuaucucaaaggcucuuuccuguuaucuacugcaauaauaaaaaaaucaucauucaaucaucauuuuaaugacugaucauuuuuccucucacuaaaauuaaaucauaaaagccauuuaauuaaaucaaaugguaauugaaugacuuuaaucaugcaaagaauuaaaaugaagaaugcuuuuucucaaagccugacaacauguaaugacaugguuugaccaaugugggagauccugagaguaagcagguugaugauugccuugccuuuugguaugaucaacaaaagagcuacuguuagacauuuuguucucucuaguuuuggaacaggguucaacuaacacaucuucaugugaccaagaggucacggggguuugacuuaagggagguuauuaugaagaacaaagaaaaacaaaaccaauaucuccagagaacuauauguaaaggagcaauaauaaauuucucugaacuuuacaaacuaaauuaucuaaugugacuuaauaaucaucuaauuauuacauaccuucuauaugcuauaauugaugguggagauacacaaaugcucuaucuucugagggugacagauaagucaacaaaucauuaugguaugauaaggucagucgcaacaaagguaugugcaaggcauuacgaaauccuagaagagggaccaguaaaugccuucaagagaaaugaagaaaauucuccaaagagcugacauguaaguugaguugugagagcugagaacuucuccaggcaauggaggugauucuagagagugggaaaaaacaagaacaauaugaaaaugugcagaagcucaguguagcuagccuguagaaaggacagaaggaaaacaagcaugggaaaacagggggagguggaguuuauucccaguagggaaaaaugcuaauugagaagcuagacaauaauacggcuugauuaguucuuuaggaagauauuucuggaagcaauguuauaagggucuucgaauugagacuacagcauagagcagaagagaagaauagaagcagagaagaguggcagaaagaucaguugucauaauacacuguguauaugauccccacagcccagagcgaacugggcuuuuaauuaucuuaaugucuucccagauccugggaauaacgugggagcuccagcacgaagacuauugcuauacggaguauuacuuucauagcgagaugauaaacaaauacuucuagagucugauuuugcaaaaggacagucucuggcugaauuauaaagcauccccaauacgucuucagacaaccaaaggccucauaaugaccugccuauccaacuguucccuauugucucggccuuuuucaucuccugcuaccacacucugaauauucugcaaaaugugacccugacauuacagcuacccuguccuauguccauucuuuuaagacugcuauuuccaaauaagugucuaacuccaaaagcaauuuguuuaaaaacuguugcugauguauucauucgacaaauauuuauggagcacuuuccaugugccaggcacuaagcacugggauacaguaauaaccagaauaagcaagagccacaacacaucucgcaucuccacagagcuuucauucuagugggagagaaaugcaauaacaagauaaacaggggaaagguagaguguuuacaaagacacaggccaggcagaaaaaagguagcauaagaaagagggaguagaggaggacugcaauugcugagguugagacaucugaacggaacuuugaaggaaccaaagaagcaaagcaaacagauaccuauugcaagcagaggagacuauugcaaagcuccugaggcaggagugugucugugauacagugagagauuugcaagggggccaguguggcaggagaagggugauggggaggcacugcaggagauaaacucagagaagcagaauggagaggaguggagcuggccuuacaggucauuguuagggcuugacaugagugaaauggcagucauuuaagggcuuuaagugacaucucagauuuagauuuaaacaugauccaaucaaaaugcuguguggggaguaaacugaaagggcaauggugaaaauggagagagacugaggcuacuacgauauuucaggugagaaaugaugguguccuggaccagcuuguuagcaaaggaugugguaggaaauggacagauucagcuuauauuuugaagguaaagcugacaacacuuauuguuggauuggauuuggaauguaagaaaaaucgauuccaugauuuuuggcuugaguaaccaaaagggugaaguugucagguuucaaccuucuucuccccucuccacccagugcaagauuuaugguuaaaaauuuuaaaaauaauaaaauaaaauaaaacagugacugcauuuugauccuacugcuuuccuccuuccuucucuccuucugccaggcgugugaguacagggaacaaaugccaccuauauguucuaaauuuagguacaacagaaaggcuuucccaacagaauaaucuuuauaaaccaccuuucacgcacgcccaaaguucuaccaacagagauucauuugggggaucaaagaagaguuuggucuuucagauuuucuaaucaaaauuaugccuucagaaagauaaacuuugacccuacuuuuucaagcaaauaucuuggcaaaauaguugucucgcagcuuggguugcuagauuuaauaaacacaaauacagaaugaccaguuucagauaaaagauaaauuauuuuuagcauaaguaggucucaaauauugcaugggacauacuuauacuaaaauauaauaaacaacuaucugaaauuaaaauuuaacuagguguccuguauuuuuucugacagcucuauuuguaggugaaaauauauggaguuguucucagcuaugcuagagaugaagaaggggcauaaaaaaguaggggagaagagagagaauguaguuuucccuguuucccucuuuucccugggucugacugcuaaucugaagguucuuuagagccaaugguucuaaaagugaaaugugcaaacaccacugaugguccuuagaggaaauaaacauagaaagauuuaaauaaaacuuucagccuuuggaaaucacauuuugaaaauguagccaacucuguaauuaaguuccaaauuauuugguauagucgguuuggcuaacagauggaacgguauuuuuguuccuccuucauccccggagugaguuuccagaaauccugaguggggcauuucuagauuauugccugagugacaguuacaagugucuaauaauuuacuagaaucaauggauuucuuuaaacgaauuuagugaacuguuauuuauguagauaugaauaauacauuuauaaggggaaaagaagcaguugaaaaguacuuucuaaaaugauguauugcaguaaucauaaguaauuauacagccacauacuacuugcugauaggauuuaagaagcucuguuucaaaaaguguuuccuccuaugguccacugugauucauauuccaguggaauccaaccuaaccgggguggccuuccaccuacaaggcagaaagcacucacuaaaagacucucuuauggaucagucugauaugaaacaauggccagaugaaauccucuaaggcuuuaaauugucuuguuuuaauaugauccuuauauggaauuuucucccagauauauuuuuaguguuuaccauauaugccuguguuauuuaucacuagaggcagcccucugaaguauuucuuauauccacugucaugaaaaaguacaguaagacugaggauaggcugggcacgguggcucacaccuguaaucccagcacuuugggaggccgaggcagguagaucacgaggucaggagaucgagaccauccuggcuaacacggugaaaccccgucucuacuaaaaauauaaaaaaauuagccuggcgugguggcuugcgccuguagucccagcuacucgggaggcugaggcaggagaauggcgugaacacgggagguggagcuugcagugagccgagaucgcgccacugcacuccagccugagcuaaagagcgagacuccaucucagaaaaaaaaaaaaaaaagacugaggauaaagaagcuuggucaaugugguauaauuugugacuggaagacuggaagauccuucuucuuacccaccauauuauguuaauggagcuagccaacugggcacauugcacacucucaguguaaacauacacauacauaccccaaccuaauaucacuaucaccaccacuacauauguuacaaauauauuucucagucuuauaugacccaagggggggauaaagacagacucucuuuauugcuauuagauauaaacuuauuuuuccuagauuugugucuuggcaccacauugaaacuuucugucauuucacuaacagcaaaauaguccacaucugcuagaggggcaucucacauuacaggauugggauugagaaauugcaggucaaacugaucuugugucuucuuggggguggggaccuuauaugaucaaagauaacuuuucuuggcaguagcugccaauuguguuucuuugccauccacuuacccauucacacuuacucucaaauugccagucccauaaacaaucaucugaauauaccaggguggcuagcauuuaauuauuaaauauuuuaauaagcagaaugaauuguuauuguaaauaaccucuccaaacuuuguucaauuuauuauaaauuauauuuucuuuaaaaaucuucuucugaagucucagacauguuuaccugauagguguugaacugccuaugacugguauuacugaguugaaaaugauaucacucaaaaaauuauaguacuaccucugguaugccaauuuuugucagacucagaaacagugauuugaagagacuaucauauagugagaacacaaaccauaaagggcucuaugaagacaucagguaaacuuucacugaauugugucuaaaaauuuuucuuccuuaaauuaagacugugguuuggguuugaaccaguuauuuugaaugcuguagguccauaaucuaucacacuuaagacaaugaguucccugcugaguaagagcaaugguuaagcucugcaccccaucaguggcaaagaaagccuuuuaguacaucaagaaaccucuaaggcuugucuuuuccaucuucauaggcuguuuuuaaguuacaaaauauuggaaagaaauugggaaaaaaaucccuaaaaaaauagaggauuuaguacaguuugggcugagcaaagaaaacggaggaaucacaaacucagguacccacaggggcuaagcaggaagcauaaaugagugcauaggguaaaguguaucauuauggaaugggggagccuguggcuaagggacaacaucuuucucaucggaacgaauucaccuucauauguaaauacaaauuauauuagccaaauaaacacaccuggauuuggccugcuuacagucaguuuuacaacuccugguuuauggcgcugauuauagccucuuguuuacagccccugguuuauuaggugagacuccugcuagguuggccagagcugcuuagguugcuggcagcuuuucucaaauggcgcucauaacacuuuaagaaaacgcuagagguguuucuauuucaacucaauauaaaaaauaauucauaaauaacacaguuauuuaguuuuaaaauguuuuaauuguaauauauuaguacuaagaaaaugagugggaagacuacucauauuugccauauuaucugauggaaaauaguacucagaauuuucuguuuuaagcagaaggaccacuuaauagcauucagauuguauaguucuuauauguaaacauguuucugauauugaaaaaaaauucauaguugaaucugcugggcuugggauugauagaaacauauaacagcauuuuuuuuucugaaugauauaggacaauacuaacacuuucuucaggaauaucuaaauugcaagagcaccgaugaauuaaaauuaagguauccuuuugcaucagucuguucucacauugcuauaaggauauacccgagacuuacaaagaaaagagguuuaauugacucacaguucugaagggcuggggaggccucaagaaacuuaugaucaugguggaaggcgaagcaaacacguccuucuucacaaggcaucaggagagagaagaaugauugcugagcaaagggggaagccccuuauaaaaccauccaaucuugugagcauuuacuaucacgagaauagcaagggggaaaccaccucugugaugcaauuaccucccacaagaccccugccaccacacguggggauuaugggaacuaccauucaagaugagauuugggugggaacacagccaaacuauaucaccuuuuaauauaaaaauucaaguuguaacacaacaaaugggaugauacaauuuguuaagccuugacuuuauguuauggucaugaaaacuugcuugcuuucuugagcagacagcuauuucuuugacuacugcauugaaauacauagaucucuucucacuugcaugaacuuugcuacuuuuaagagguuuuugaaaaguuaucauuuucagaaaaggguugcaggagaguauggagcccccagcacuuccagcauccugacugauucuggguguguuuaucaguuucuggccuuggacuauauaguggucaccuguuucuauaaaaaccuuggaaaaaaugaauuuuuccuuuuauuguaauguuguggucuccucagagucgucauauguaucccauaccaaugauucagagcaccauaaauacaccuaauaggacugaacuaaauuaaaucuuucuuugaugauuuacaaggcagcuugagauuauucuugggggauauaaauuuucauuauauaggagcugagguaguaaaguuaugugugagaaagacuaaauguugucugagauuuaucuuucaagaauuucuggucucaguuuucuugucauuugucuccaaaugaaaaaugagggcucuaauuagaggguuacuccuaaaugaaaaccaauaaggaaaacuaaaaaagaauauggucugugaacuugggcaaucauuuaacuucucuguaauaugguuuugucaccuguaaaauagagauguccuguggauaucaaaugaaauaaaaauagauguaggacagguuugcaaauuucaaaacacuacaaaaggaagcagagaccucuuuaggucugauagcacucuacacccguccagccgguacccacccccuuucuauucucggguuauaauuuugcuuuaaaauagugccagccugugcuugcaucugggguccagggcuaugagcacagccaugucuggcaugagcacaaccuuuagggcagcagcugccauuccaacucucaggcugguagaaguuuccagaaaagcaagagcugaacucugugggcuuacagccccugcauagccccuggccuacuuccuguuuaccagagcagacugcagccacuuccaaguauaaagucaguuccauaucuaccuaguuuucuuaagacgccucuagggcaguagcugggaagcagaaaggaagacaucuuuaggacuaaggcagccuccucugguaaauuccuucuggucacaaaaggaaacauaggaacagucuugcccuuccuccuacuccccuuagacucucauccucacugaaaaauccacuaacacagccucuguccacucaucugagaacaauugucagcucauccuuuggcuccggucacuuagauugcauguauucauucuacagaugucuccucaaauaugcuuuccuccggaaaaacuuuuccagguccccagaccagcccaggaacccuuuuuuuauguucucauuuagagcgaaucgucuccuucccagcuuguauugucauuuguaguuucccauccagguggcaauuucauuccaucuguuucccucccagacuggaagcuccaugauggcaggggaaguauguuugccucagcacuauaguccgggaucccaggaaugcauggauagaagaaaauccaauuaggcuauuggugagcagugcaucagguacuggguccaagauuuugcugucagcaaaugccagucuuauucccaacucucucuuucucaacccuuucuuuuucauuuucauuucucuuacuuauuacuuuccaccaugcuauaucuauucuauucucugaaugcuguucauagacauauuuaucaaaguuguguccccacccccuucaccaccacauacacuguauauccucugagaacuagugggaagaugugggggaagugagaaugaagaggagagggagaggaagccaucggaaggagcaguccaugaaugugagugaaagccuaauauagcccucagggaaggaugucuugaggcggugucccucuggagacuggggagccugacauagguguuuuucagcugggguucuuccuugauccucacaacauagaaagugacuuuuucucaauucuccaagggaugcuacaaaaauaacaccauucuagaugcagaagaaauuaauuccuuacauacaauggaugccuuaagguauuaggacuugauccacuugcagaaucugggaugacaggggcccaucuggaggcagaacauccagagaguuuuaggaagaugccugcucugugcugggugcauguguaaggaccugggcacacacagaucucucauucugcauaagcggcucauucccucgguauacuuugcaguccagcucaguacugacaacuucacaaguaacuucuucugaugaaguacagccaagaaggcaaaaauagaucaaacuuaucuuuuuuaauacugcacaucaauuacucuuuauccauaccgguuaaacaaggaggagcuugcugucagccuagcauaggaaaauuccuacuagcucuccauggaagaagagggcauagaaaaauuguauaacaaaucagcaagcuuucagcgcaccugagguguggcucaggcaucaagaaggcccuguaggcgaaaagcuggcaagaggcaggggcacagcugaugcuggcccacaggcgucugaagggagcccccacacacucucuuagccaccuaccaccaucuggugcucuacauaggacucucgaccacacuucccugugggcgauggcauuggccaugagcucucucugugugcccacccagccuccucacauggaggucccuuaggcaagaagaucccaccagggagagugacacagaacauuagcauaaggaugcacucuaauacguuuggggaauuaccuagucuacucccaggacagacucuacucuuaaggugggaaauuaguuaugaccuagaaagcaaccucaucuaggcaaaucccauggcagaagugaccucugacuccaacuacuucaaugcuguaauuucucaaauggggaaauugaagcccucaauuuuuagugccucgauaagaccacagaguccaauaugaccaaaagucagaaucagaaacucugccgacaguuuaacacauccaaauggccaccagaaucagcugaaguuaaagaacguacauuccuggaucucauucuagaacuacuuaaucagauguuccauguugggacaaaagaaucuuuaguuuuccaaguucccagguaaugaaugggucagauaugggaaacacuaucccagacacuucucuucucuucucaguuguuaucuguguccacagaggaugcaaaaggaagguaaccaaggucugugacuucuaggagcuuauauauuagcugaguagaucaggcacauagaggacagaaguuacaugucaacacagaaaaauaggaaauguuuuggcucaauaagggaugcagaagcagcaaucaauguaaggccaguaagcagacaagggguggucuaugucaccucucagguuugggaagggucucaagacuauacucugaucauuuacauugaaauaggugaaggagggaagacuggggaaauuccaaaugucuccagaaucccuaugcaucuuuccauucccaaugccacugccaccaucuuuguucugacauuugaaauuccuuaguuuuaccaacagccucccaacucauguccccugcuugagaaccacucuccucuaaccuacccuccguauuguugcucaaaaaacguuucacaaauacaaagcuguugugcucuucugccuagaacucuuccuggccgggaggaguggcucacgccuguaauuccaacauuuuaggaggccaaggcaggcagaucuccugaggucaggaguucgagaccagucuggccaacauggugaaacccugucucuaccaaaaauacaaaaauuagcugggugugguggugggcgccuguaaucccagcuacucaggaggcugagccaggagaauugcuugaacccaggaggcggagguugcagugagccaagauugcacaacugcacuccagugugggugacagagcaagacuccaccucaaaaaaaaaaaaaaacaccucuucccuauccuucccuauccuuucucauugauaaacuaaagucaaaaagcauuagaaaugcuuucaggauccuuccuaaucucuaaucuggucauugauuaucuguuuggcuucauuuucaaucuguuccuacaaaccuugagcuccacauaagaagaaauauuugcugcccccauuaauauugcuaucuuuguguaucaguaucaccaccucgauccuuucuuucucaguuucuacuuguaugacacauauucuucaagucauaguugaaauguuaucuccuaauauuaauaguaucccacccuagagauauuugauauuuucauuuuaauagggagaaaagcuaagggauuuuaggcuaagcuaagccugggauucuaggcaucaaccagcaaugaggaggauguuggugagcauugaagccacugaaaucccagucuguaaacaguuaccucuuucaccaaugaauaaugcagucaaaaucaaauggagaaauauaugaauauugggcaugaaauaacuucuaauacauuuuuaccugaaacaaaagcaaacaccuucuugugugauuggugaagacacaaauauugauacuguugagucugacauacaaguccagauuaaauuuuugggcucguuuauggaaauaaguaagcuggaaaaugcaauuacuauuuguaaaucauuuugcuauaaccuucuccuccaauaucguuaaauagcaaaaugaugcuauuuuagcuacaagcagaagaaaauaaaucguuguggcaacaugcaucugucaagggauuugauguucuccaaaauacuccuugguauuaagcaagcaaucuuucacuucuaaaggggauucucauugauauguaugagcuaagcacucuauuauuuaugguuaagugcaaauugauauguuuaagaaaaaugcaaaauuaagggacguguguauuaaaagacuuaaagugguaauuaggcaaccaguguggauaauuuaaauacagugacauuacaauaugcuuuaauaagccuaaguauggcuuugaaaugcaauaaugcauugcuuucaaaaggucuccacauaaaguuacaauauucaggguugcucuggaagacauucaguggcuguaaaaaauguuucaguggaacaguggaaccaauauucaaguguuagacuagagguuaaaaagcagaguuggcuaguagaaacuucuaugauaauaaaaauguuguauaucuguauuguccuauaugguagccguuaggaacaugugacugucaaacacaacacuuauguggcgagaguggcuaaggaacugaauuuaaauuugcuacacauggccgggugcaguggcucacgccuguaaucccugcacuuugggaggccgaggcagguggaucacuugagguuaggaguucgacaacagcugggccaacauggugaaaccccaucuguacuaaaaagacagaaaauuagccaggcaugguggcacgugccuguaaucccaucuacucgagaagcugaggcagaagaauuacuugaacccaggaggcggagguuucagugagccaagacugugccacuggcacuccagccugggcaacagagugaaacucuaucuaauaaauaaauaaauauauaaauucacuucacaaaauuuugucucuucaccucucuaguccucaguuuccucgugugcagaauaguuuuaacaaaaucuaauauucuguggauuuauagauuuuuaauuguucucauacccaaucugccgccaauccaucaagugaaacagaaaacaaauaaaaaucaguaaggacauccuccuaggaccaaaaacccaguuaagcaauuauguacaaacucuccccacuccacacccuaccccccaugccccaucacauacacucaguuaaaagaauauucuaaaauuagucuaaagaaauuccauuuccgagggccagauuacauaauuccguucuggcacguuagaauuuguauuagguauuguuauuguuguuuuuauuauuuuugucaauauuguuguuuuuauuauuuuugucaauauuguuguugauggaauagacagucuuauuagaaucuggaaauuuugaaaggguccugauuuuuaguucuuaagaaccuucuggagauggaagcugaggacauguugauaauuuguaggcauaauauaggaacuagccaacaagacagcagggaugacaaugauauuucuauguuguuaauuaaggcauugcuaacccuuaucugucuaaaccuuucaaaggccucccucacaaacaagaaaacagccccaaggccauaggaccccggaaugcauauguguagauccaaggagaaaaggggagagaggugugaaggaccacauuacaggccuaagcaacccugcagggcacagccacaugggcaauccucagagaaagucaggagugaaaggagaagcagcagcgaagcacuucuacucagcaguuacauuucgaaagaauucccauuaggaaauaagcuuaaaauuguacaaaaauauauauacaccaauuuguuuauacacaagcauuguugcaauaaugaaauccuggaaacuauccauauuccuagcaauaggguacugguuagaggauaaucuauagaacagaacacucugcagccaauaaaauuuauauuaacaaauggaaagauuaucaaaauuuacuuuauaguuauuauaaaaugagugaaaauauugagcaauaugaucuccagcuauauagauguagaaucuccagauacaucuggagaucuucauauacauaugaacaggcaccaaaauguuaauaguaggucuuuccaggugguaggaucuugugugacuuaauguccuuuauauauuuauucuaguuuuucuaaaauuaucauguauuuacaauuguuauuaaucauauuuuaaaaucuuucuuaaauuuaacuucuuauugcacuaacagaauacacuucaacacaguaacagacuagcaaguagucagcuuugcagaugucaccacauuuauguacagugaacugagagguucauuagcaauguguaauaacaugucuuaggguaacauagaagggauaauaguccuccuaaaacacucuauuuaggcauagggagaaaaccaaauucauuucauguuggauuuagacuaauaaauggcuacaaauauucaucaaccucuauugccuuugguuuuauguaaagccuaaauauaauuuucaaaucacuauuuauuugcccuuaggaaaagcaauggcuacuacaagugaucucuuuauaacacuggaguuagcugagauucaauuggguauucaauuauuaccucagaccauauugguagugaaaguccccaaccacguggacccuacggggucccauuucagcgacauuuuuuauuuuggccauuuaaacaagugaaacccgccucuccuauuacauagaaauagcucaagauagcuacaaacugguguuaaaaaauauauuacgcagugcuugagagcacgcaaacugcucuguaaugaagucauuaaacuggaugaagcuaauuucugagguacauucuaaccuacaaccuaagccagcaagcagaagucaauaaacuuuuacgggguucuguaaccaagccauuccuaggagcuaaauuaucaaagccuauuacaagggguguuugaccagcaaaauuugaacugacauuugcagcacacacuaaaaaaauaaaguuagcaaauacacaucuaaauuuucuacuaacucaauagguauaugugucaucugaggagagccauauuuauguaugaaccgggaagcaacuauugcaugcuguuuugaacaauuuaccuaaagucaagcaauucaaccaaggaucaaaaugcaagcacuggaaauguuuagaaccgugcagagucugacuaucauuguggugccaccagguacuuagguggaucgcuacacugucagcaccauaagggcagagacuaggucuauccuuccacaugugguucccagcacuugcacucggccuggcagguaacaaauguuaccuaaauauuuuacaaugauugcuuugguggaaaaaaaaauguacaacucaaagaauacauccucaaaugcuuaauucaauuacgaauuaucagcugacuucuuucuuaacccuuuguauucccaccaaaaauagauaaaauggagcuuauuuuaacaugugacguggguuggcucugcucuuugcuauuuuacaaacuuggcuuaucuuuucugcucugagaacuugacgauuucucagucucuggccuauccaugcaucuuggugucucugcauucuuccauugguuuaugugagugaggucauagcuguuaccugaaagccucgcguugaaaaacaaaacaacgaaauaaccaaauaagaagagagguuccuucaauuugugcaaauaaacagauguagccucuacuuugggcaagcaccaagaauuaggacuagaaaggaucuuaccauuucagucaaaccaucccagacccuccaggcaaagacagaguuguagauaccaguaaaugagauauuuuuggauauuaauguccuucagaaauagugccauggcuccaugagcaacuucuacaaaauauacacuuuagcugacccucugccaucuuucuucacugucagauuaauggaagaacaucaaucuuccaggucguugcuuauuauuguuauuacuaauugcuacauuacugaggauguagcaaugaugguugagagugcaggcucagggcugagucaagauuucaauacuggauuugccacauaauugagauacuaggaaaauuuuuaacuuuuggaagucuucacaauaaugucggaaaauaauggaguaauaaugguaccaagcucauuggauuacugugacgauuaaaagagauaaagugugaaaacuaaucaacacaguaccuggaacauaguuaagggcucacgagguggcaguuauucuuauucuuauuggccacauugugguccaagauuauaaaacacaccuuuuaauuuucaaacccuuugcgcagccacaaucucauuuaaugcucccaucagcuuuguaacuuagacaggggaaguauucguaaagggaaagaaguaaauccuuuguccauuauuacuuaguaacuuaguugaagaaugagaaaacaaaggcugaaaccuauaucuucuacaucauagcuuaauuaaucuuucugccacacaaaggcugaaaauaacagauuagaugucuugauugagacaacauuguaguaaagaaaauucuugaguugcuuuaugucccaggaacaccuugugagauccacagagacucuggugagugaacugagacuucuggaaaaggguuaaaaccacacacuucagaacaggccacuuaggacugcgggagaggcgcagugccaggaaggaaggucauugugaagagggauauaugacagcucacuacuggaggcagcucaggggcuccugugaccucccucaguacuguacaucaucaggggcuggacaagcaaccagguggaauugaaggcccugcaggagguuuggccuugcagaugucaaaaaccccaguuauucugugcaguuccgucuccucaccuuggugcucugcuugcauccucucaaaacccugacauucagugaacaguggaauaaauggggucaauguuagggaucaugucugaguugggaaauguccccaaaugggcugucuaauuacauaaugcuacucauagcagcuacccaguaucuagacacuguugaaccgcaaaaucaagagucaguguucuugcccaaauagagaggaucuaauuagggccaugagucaaucacuccuggaacgaacaacauaaaggcugggacaggguuucagaaacccugaauucuauccaguucugaccuugacacugauaauucuacuaacucgacauuauccaaagcacuucuccuuuuuaaaugggggccuccuucucuguagaaguagacuuaaucauaaugucaguaacguuuaggagagguaccaugucucugggaagugaggcgguaagagcagaguccuuuccaccaaagguccugccaauccugguaguccugccaaacucaauaugugucccuuuguccaguagaggaauccagguucaaucagcaacugccuuccgaccaggguugugucuaacaugugaguuccuucugccuucccugccgguuaugguuuugaugccugugaaaugcucccuaaagauacuuccacugaagcaguucucaaacaugcagaauugcaugugaaaaauauucaauuucccuguugccucuggaaacagggagauggucuguuuaucaucaauggcucaguggaacauucccuagcuugacuauaugucucgacuccagugcaauaccauaaucucacucccaucuccacacuuugccaugccccucacagugugcgacauaaauaaagcuucuacuuugcacuguuguguguuccaggacgcugucuucuacuucccuuaggacaaggauccgcagaaaaaguguugcacaaauuaaguugacuuuucagauaacaaauuuacuuugauuuaggaacagcugcaagcuuccuaagugcaaaaaaauaaccugagauucuuaagauuggaagauuuuuaaaaggaaguuuugcucacuucagucugagaagaauugacugucauucugcccaagauaggaaaagcucacacauagagcugacauaaagaacaauaaaaugcuucaaagcaagaaaaauuuauccuuuuagcuagcccauacaguaccuuacuuuacauccaucuguuagaaacauauugugaaauguuagauuguuaaaaccacacacuucaggaauuugucauaauaaauauacaacucucuaacguccagggugugugugaugcacccuuacuuugcgcagugugcaaccuucacaacuguaugugacaauuuuaaauuugaccacagauaggauuccucacucuugggaugcuugucuugccuuuugaauacaaauaaaauucagaaagcaaguggcaguauaaucgacugcacugaugauugcccggguguagacuucccuaugagcaucucuguauucauggacacuaauaucuggccuccuuguucaauuauugcuuauuccugacagaaugccgaaggcagaguugcaauauauaccagagcgcgagugcuugaggagaaaauaaucacauccacaugaaugguuuaggacugagcugcacugugcacacuaacacaccauccauggauugaugaaucccacauucauuggaacucuccuuggagaucuaccuuccagccucucuccagcacugcauucaucaggguggcuacacccaggccacagaauaugaugaaaaguccuuuauucugucugcccuuucucacagcagagacaaucauuaacauucacaggguucuuuauauuuucaaaaguccuuuuacuacaugugucaucugaaaauuuguucccugugguaaugcucuaggguuggucucauuauuauucucacuuuaaaaaccagcaaaaugauuugcugagugcaacacagccaauauagagugacuuugggucuaacaauuaagauacaugacucuaaaugauuauauacuauauauuuauauguauguauuuauauacauauauuuuacauauuuuaaaauuauaaccacguagcucaaaauuaauaagaaggagaaaugguagguaagaagaauuagaagcaaaaagaggcaagauagugcugcacugaagacuauaaaaugcccuuguaauggugcaucuggauccucagaacuuuccagagugaaaagacagucuuuaaacaugauacgucgauuuuaacuaaagaggaaacacugggucauauucacagauacgguuaaagugaggucauccuuccuacaaaaugaagccccaguaaaauggggaacugaacuccucuugaaucaagugaguguucuagacacagcagcuucuacuaagugcccagaagagaugaaccaaugguguuauucauucaguugcugcuucauguauuaauaguucuuguuguucaagcugugaaauucucauucaccuacaacuuugcuagaaucuguccuacgucuggcuucagcgaaauuuugaaguuucugcuucauaaaaaagcauguaugaaacauuccagaucgccgcaaugaugaacugguguuccucaagaucugugggauucugcuuuacugaaguuguucaaguggaaggcuggaugaccgcuuucuagggcuggugugagucacucccccaaguggaggaaacuugaauugaugacauauuuuuauccagaaguagggauuuuuuuucccuagauggugcaacaaaugaguuagcaacaaaguuccaaaggauuucuagaaggauccuggauguuucuggaaaagagagguuauuuucuugccauguugucacaguuucuacugauuuuguauucagaugugccgcagcugucucaacauccagggagaugaaagcagcacagaggagcuacuaacacacccaucagugaguggacuucagugugagacugaaaauacagagccuaugagggaguguugcuggcuagauagagcccguguauauauuuuugugaugaauuuccccugacacaggggaaaacugaauucacaugguauggcugagggcagcaacaaaaggcugugccuuuuaacggguuucugaagaugcugcauucccuccuuugacaaaggaagcccauuaauaaagggagaguggcugguaaccugcuacugagaguggggcugugcuggcugucugugauuagaaggcuugcugcauuuaauacauccccuauccacaaugaaaaagcuucauuuaauaaagcaguauuacugcugacacaaaugcauuaaaaaguucgcauaagcaguagucuaaagcucuugggaauauuccaccugccagagggaaggguggcaggaaggugcaguccuaaauaggccuguauuuauuuucccggauacuaaaagacaauggcaacagcacgugauuccugugaagccaacagaguucauaaauguaaaauaccacuuugggguaaggauacacacacacauuucagcuaaacaaaucuguccuuucauccuuuccuggaacaauaggaaacucuuaggucaccaauauagcuuucuuucaacuuauuuuuaucucagggaaaugugggaucuuuuauucagacauggcauaaacaaaguugcgguaggagagaaguacugaaucucaagacaaggcccgcgaguuugauggacaaauuuucucuuugaaacaaguuagucauuuaucuccugggagaauucauuacagacaaggcucacaaaucuauuugaaagaaaucagcauuauaaaauauaaauaugggacugaagcccagcaauuacagcucauuuagaucacugugcauuuuuuuuuucuuucauucuuucugaaaggaaaaagaggaaacagcagugagcugugagaaaggcaccagagcccguauggaaucacuguauuaccauggggcacuggcuuucuucauguggaaaauggggauaaucacacguucuguucuuaacccccuggguucauaugaggauucaaacagauacugugggugaaauuauuuugaaagaauaacacagauguaagauguaucuaaaauuucugcuaaccaugaaaggauuaggaaaucaauuugcucaaacacagaucaguggaaagacgaacaucuaucgacacaggaaggcugguggguaacauguggaagagacaugcauuucugggacuccugccaugucaggacccauucaucccccuagaccugcucaggauaacccuagaagcuugagcucauuauguucaauuucugcaugaauagcagaguaagaggaggaauaugaaacccauccaacucauagggagagugagagcacccaguacccagguucugucucuuccauuugagauguagcccaacucuaccaguuacucacugugugaucuuggccagaucaauuucuucuuuugaaaaacaaaggaauuuccucaaacuuaguaauuuaaauacaauuuucaugacuuuauuaaauauauacacuaccuauuauuuaaugcuuuucuaaauuuaguaagaaaaacccauuguuucuguaaauaggaaaucaguauuuugcuaacaguaauuaaaauacaaagcaacuuuuccaauguauaucaaaacgaccagcuaugauaauauaaaggugcucaucugucuucuuccuaggcugcacaauuugggaaacacuaggucagucgacccuuagcucagcuuagcucuggaaaccuguguucugaugugguucaaagggccagaccugugcagaguuccugaaccagcuccccccauaccuuggcuacacuuuuacagugguuucuuauucuguuucaaauacuuuuccuccauccuuucuuucuuauuuuuucuacagucuucccaacuuuuaguuucuagcccucuucaaugcaaauuucagcaagcuuuuucugagaaucaaugugggcagaagcaugugguagguguuauaggggcuuauaaaaugaauaaagaaugcacauaauauaugagucaagagucaaaacagaugaaacagguuaagaaaaaaacuuauaaagaauugcuguuaacauacaauauuguaauguaaucuaauagagauauagauagaguugaagaacaaauaugcauauuggauugaaaaggcacuacaauggccccuaaauucauaaccuguauaccagaggccuaggauuugaauucaacuggcaagcauguuuggcuuggcaugcaaauuacuuaaaaaaauaauggaaugccucuuuucuucagcacucucuaugaucuuaccccagaccuaucuuacuuauuuauaugcucuaccuucccaugaaaauguuugagaauauacauucucugauaaacuucaacccccaacccuaucuccaugccauuauucaaaaguaggagaaagaggcccaaaguggcuaauggccuuguuguuuguggcagaucugggacuagaauccuauaauucuugauuaucauuaaagugcuuuaguaaauucaaucuacaaugaugcuuccagaaucuaucacucuuauacuguguccucaaagagaugauaaugaaucaaaucuugaaagaagagauuuugauugaggaaguuugcaaaaaaagaaagguugaagagagcagauuggggagcaugagaggugaaggagauacacauuaaaaccaagccagugcaaaagaacagcagguagauuggaaugcagcucaauccuuccuagggccugcaagguaaggaagaugaggacaggcaagaugagagagcauagaacuagagagucgaggcuccaccacaaagguucaaaaguuauuuuaagaacuauuaugcagguacaaaguuguguaucuggacauacccuguuuuagaacuaauaggaaacaagucuaaaaagucaggguggucaugagaaauagaagggcuugaaaauuaauugagaugucuuaguaaaauguacuuagauaucauauagugcaaacugauucuucucaagaagagacaauggcuccagaaagguuaugaaacuugcucaacuuuaccuggcuggguagacacagaaaggaaccagguaccuggccucuguacuuccaguuugguguacuuuuccacuuguuuuggguuaggguuaauauaauaggcaauaaagauaauggugaugugaaaguauaguuugaggagugaaguuugcuaaaugcaggaaggacuggaguagaaaguaagggggaaaacagaucuacaucugcuacuacugcuuccuggccuuacuuuagagccaggguuucuuuguugcaguuaccaauaucaccaucccccuucccaagaaccugauaaaugaaauuuaaaaucaaugcucuuugcaaaacucaccaacuuaccacucccacucacccuacccauuacgccuccugcagauacaucaccuugcaaacaagucgccgccuacaaguccucuuguaaccucgugagcuugcauaacuucuauuauaacaucaucgagugaaggcacagucaaccacuagucaugguaaaaagcaccuaggacauauuucugagcaacuacagggcaauuuauuuuccaucugcccagauccaugucaacaguucacuuucugacuuuugaaaucacaaagaguuucuguugaccagaauuuaucgagcuguuuuagaaaacaccuaaugucagcaaagggaacuauuuuuaucacugcauguuguuuaacagcccuugauggugaucaaauuuacugcaucuauaaaaggcaggacaacccaagaggcugagccaagaacuuugaauuucuaaagaacuaagcauuacacagcaaagauucuagcuaacaccucacaaagcaaggaauaaauggugccacuaaacagaaaaguaaaggcauaaagaauuaggcauauaaccaaacggguaaguauuuaaauuaucuucuuaauucuaagcccuccucagaguuuaguaauccagaaaauauuuauugagcaguaacuaugugcaagguucuguuccagauauuaagagggucaguaaauaaauaaauaagacuucauccuuuuccuucaagagcucccaaaauagugaggcacagagagauguaaauaacuuaccguaauaucuaauaggauguuuuaaguauuauaauagaggucuaagcaacaugcugaagcuugcccagaggaauugacucuagaaaguuuuaaaaguuuauuauacaaacaaaauuuaacaauuugcaagcaauaauguggauuaaaucaacuucuuuugacugaaaauuaauuaaaauaacuaaaacugcagccauuuaaaacgcugacauuuugucuacaaguuuauuacuagaacagggauuucaaaaugugaaggcaauuuucugguaaaaguuggcuagacuccaccagaaagaggaaaaggcguuagcuccaaugacucuuaauuaaguauuuguagguaguacuucucagguaacuggauuaauauggggcccaaagcagguuuugcugucugccauuuucuuuuuccuauuuuuguuucuagccuuccaacaauucagaaaugagcaaucauccaauaacaaagagagccagagccaaauggaucagaucguggcuagacuuaggagaaguuauaucaccuguagaaaguuaggaucuuugguuugguuggcuuucuuuauaauguaaugggagucaucacccuuacugguuccaugggagccugcuagagccuucuuuuucauuacacaguuuaagaggguuucauucaggucccccucuucguauggauuuccauuuuucaaacugggaaguuggugggggccucugaacagaggccagugauugcagugguagaacaccaaaccaagaaugaaugucaagacugauuauuugagcaaacucacuauaugguaccaauuugauuauugcuuucaauaucauuauuuaacaaauggcaucucaaagaaggagaaaacaauauguaaaguuuaaggaacaugccgggugccggacguaguuggcacauggacuagauggacaccaagauguggguucuaauaagcccugcaucagugcuacuaaggacuuacuuaaaauuguccauaaacgugugggaagaaacaccauugaggagauauuaaaaggguacacuaaucacucaugacuaaaauuaaaguauaaaaaugguacagauaacaacagcaauauucagaaggucagaccucccuuaagacucccuuaagacucauuuagcccauaaguugaugacuacucuagaguuaauuuuuccccuugaaguauuuguauugggugucuggggagaguuuaauaccuaccaauaucauaguaugcauagcacuagaauuggaguguauuuagacaacuguaauccauuucccuaaauuguauagcuuaggaaacuuagguucagaagauaaaguauugcccaaagucacuaaauguuagugcuagagccagaacuagaaguucagcauagacagaggaagcaggcugccucugaaccuuuuauuuucuccucagccacagcccuguguccugcaugcucauuaucccaauggaaugacacuuacuaaccucuccacuggcccauagcaucagauccagagggcagucuccaaguguguucucuaaaacauuccaccuuccuggaacccucugcuccauugaauggagccccuuucucuuaauuuucuucugacuucucugacuccuuuuucucauucacuaucacaggucucuaaaauguuggucuucacuggacucccauccucagccugcuucucuucuaucuuugcguuuacucccugaaacaucucugcagacuuauauggaucauaugcuaauaauuccugguuauaugcuaauaacuccuaaaggaauaucugugagccagacuugaccccugagcugcugaucuccugggcaucuccauguggauucccuauagucauucaaauuaacaugucaccaacuuauuucaagacacacacacacacacacacacacacacacucucucucucucucucucucuccccccauccauguaucuaucuacaaauguguguguguaucgugucagaaauaauauaguuguaaaaagugcuuugagcuucaaguuaaagacacagggccuaagaaagggggcgaggcaaagaaacaagaagcaaaugauuccaucuuguauauaugggaggaggggcuggaacaugguucaauucuuucgacucauaaucaguuaaauguaaguugcaaauugcuucagaaaauaauagaaaaagaacagaaagaaaacauuaagaaaauauaaaaaacaaauaacaugaagcaagauaucagaaguaacauuauuaagcuauaaacauaauaaugaugaagaauuuuuaauaacagguaugcuaugguuuuucauaacaugggaugcuuagugaaauaaagcaggcuaugaaauugcacgcauauggaucacaacaauguguaacaugccaggauguugacaggcagcugaauguaauaguuuuaaauauguaucuuagaaucccgcagaacaggacuugaguuccuaauccacgaagcaccaacugugugaccgugagccaccuaucaaacccacugugccucaaugucuucuucuuuuuuaauuaauauaauaauaguaguuuguuggugaagauuaaguuaaaacuaucuuccagcuuuaggaaaguuccaggcacaaaguacaugcucaauaagugguuacaaugauuacacuauuaacagcuugguaaacaguaugccagugucuuugauucauucccuaagagcucccuucgcaaagcaauauuggggacaaagcuuggaagggaaguaaggaggccugaauccuggcucuccaacuaucaauaaaaagcucagugauguugaguaauccaccugaaugcccuaugcgacgaggagcuggucucaaugcuccugcagguucuuuagaacucuaucauaauggucagaggaaggauaaauaaaaggagaaaaacagugucaaacauggacucuggcccuuucuuuguguuuugguuugccuugccuuccagguuacucucuguagaaauaaaagcaugcuguggaaaugaaaccacaucaucaccuuuucuucuggaagagccugcugaugauggaggagagaagggcacugcaggcucuuucuacuaaaacccugauuagaaaaguaaaucaggcucugccaccugaccgugcaaucaccauguucagcauguaaaugauauggauuuccacuuuuaucaaacaauauuccuucaccucccuuauuccucaucaguagcaaugguaguaagauccaaaguucaaacauuuucuuaacuuacugaauaauuaaaaaauaauuaaaguucauugcuucacuacuaaacugggccuuuagccauuucucucucuacauucugaggaccaauauuuuauguccuagagacauauuugcuaccacccacaguggcaaagggaccagccaauuacagccagcaccucugagagagauggcaccucuccuggguuaaggccucaaugauccaaccagcagcugcugagagacagacucuccggggaagcagcacagugguuggaagacggcagacaaaacugggcuacaaaguggcugaguuuguuuuuaauaacuaugaugaaaugacacacuaaugggauaaaacaauuuuuaaugcaacgaaucuggagaaauaaaagaagacccugcaaacccuuaguuagauguuacagccaaagcacaaagaguagggaaugaauuaggggucaaaacucuggaaucucuccugcccaacagacaaauaacaguucuuaauuuccucuggcaggagauugaugaucacaucugaaacaacaagaagaauuugugagcuguuuccaaagcagauggagagggaccgcacuucagacuaagucuaaaauuccaucuaucuugacaaaagcuugcuaaccgacugaaggaugaaccucugcucaguaggccaggcauaaaagaggcuaugacaggaauggugagagaguuucuuaaauaauaaaggcagacagggacacccauuaguuaguccaaaccucaaagagauagggcacaagcauagccacaguuucgauuauguaguucaaaguccagaaaaaugaguccccugcccccacaaaaaaaaaaaaauaaagaaaagacaaaugauagagguaccaauuuuaaaggcuuuuagaauucuaacaugcagauugcuucaguaagaaauucuagauuucaauaaccugcagacuaaggccacuugggauauuuauucuggguuucugguauccaaccaauauaagaaucuauuuaguuccucuaauuucauuuuccuucagacuucaggccuuauuaaauccuggauauccaccuacauaaucuaaguuacagaugcuuaugggugaguguuuuguacgugccaaaaaaaaauucauucagaagggaucugaaaguuggacguaaacaacccaagaaagauagcacagagaauucuaaaaaggaagaauggaaaaacaagguuugaggagguagaagauucugauuaggaaaaguaaacaaaagagagagagagaaaagcagaagacguggcacuaucuccuccauccaaaaggauagacuuguuggagauaagcuaccggucuggcucacugacauccuuuaaggucuguaagugguggucagcagucaguuccaaguuagucagguuggggagguucacacaggaggucuggaauaauugauuacagagaaugguaaggcuuuaagaugucugagagguuaauugcuccaaucuucuccuuucauaggccaggaaagagagguuuaaaaguacuggucaaagcgguacagcaaacacaguuauuaugagugcuauuggcaacagggaguccaaagcuucccaauuuaauguucuugugccuauuggacaucagcagggaucagcuuaugcaccucauucucaucuucauuauuugaacugucugcagcuuuagaagagcuuucgaaugucaucaagaucuuaaagcuuucuccauccuucccuugcaaugugccccuuuauauugguucuuucucauuuuuacuacuucuucauugccuuauggugcugggcacaguauaaaacucacuaaacgacauucuaucaaggaggagauggucaccaaagauccgaaguauucagugaaauauuucccauuuggaauguaagauccugggcagagauaaguggaauuguauuuccaaggacauacuaagguaccauaggccuugauucuuaucuuagacaaucuagugucucagggucucagagguucugcaauuaaccaguuaauguaaguggccuggagcuaaggcuagggaauaugugcagaugccagaaguggugccugaguaauccuuuccuuugcacagugcuuacuucuugcaaagugauucuagaucuagcaucaugccuaaugcacccaagaggauccuucaaugcucagugagcuguagagagcaacaucaaauuuaugacauguccuguuugugguauuaugacaucaucaccaccaucuaguuuuugguuuuggcuuccuaagagcuauuuauucauuugagcgcaacuacugaacagguccauacuuggccuuuguagugauuugacaaagaccuacauccaaugcucugauuauuuucuauauucaaguuaugcccaauucauuuguucaguuuucauuaaacaaguuauuucuguaccagcaaaaggucaauuuaauugcaacaauaaccuugaaaaagacaauccaaucaauacaauuguaugugcacuaacauuuaccuugcuacuuccaauagcaaauugcaaacaguagcaauuaacagcaauuuauuucugcuuucaauaacucccucacuucccagccccauuaaauaaauucuugugagaccauucacaaacugggucuugaaaucagcaagcauuugaugcugggaugggcacuaaaugugggaaacagguagcccucuaucugaaggagugcccaaucuacuuagagaggcaagauauaaacagguaaaaaguuaaaucauaggccaagcaugguggaucucgccuauaaucccagcacuucaggaggcccaggcgggcggaucacgaggucaggagaucgagaccguccuggcuaacacggugacaccccgucucuacuaaaaauacaaaaaauuagccgggugugguggugggcaccuguagucccagcuacucggaaggcugaggcaggagaauggcgugaauccggaaggcagagcuugcagugagccgagauugagccacugcacuccagccugggcuacagagugcaaaaaaaaaaaaaaaaaaaaaaaaaaaaaguuaaaucauaaucacaguuuuaaaugguuguucaaaauuaaaaauaaaagagaugucaugaaguaccaccucauuagcugucagauuaauaggacagaaaacaguugucauagggagucaggggaaagagaggucccuauaggcuuugaugguuucaugagucuuagagaaggggcaggaauguacacacugaaugacaagcaggaaugggaugggaaaaagcaagaaaaauaugugaggaaaggcauagaaggcagaagugaaauugauguaucugugggacuauaaggaaaauaaccuaauagaagacugguuauauaaagacucguugugaaugugaucuaaauauucacccccugguuaaaauauuucaaagcaaagaaugugaaaaugaaagugauacaauuuuagggaaaguacuaauaaccacuucagcuacagguagcuuuccaaaauacaugcuaguaaaacaaaugauuaggaauaugcccuaaaucaauauuuuacauaggcucucauguuugccaaugacucgaauaagagagaguucacugacaaagaauuugcaaagaacaaagcugguucugaacacugcagccugugcagguuauucucagaaacuucaaguaauaacaauacacauuuucagcucagcugccccggcuuuccaaaccaaaugcugccuugagauaaugaauucaaaaaggggaacucgacugugaacacuuugcaagguucagcagcguggaaaauccuuuugugcacuucauaauuuucuguuuguuuuagugucugaacaauaaaaacgcccgcuuugucacaugcacauaaacuaguuuuuggggcaggugaagagucucccaccuggcucucgcuuguaggucugcuagauuuuccauguggauuuucguauuucucuguugagaugugugauauggaaaugacuacagaaacucacaauauuucucucugagcaccaugcugaggaugguuagaucugggauaaguaagccccagagccgagaucccaaugacccuaagauacugccugguuauaugauuuuaagauguacgaaaugagagaaguauucgguugaugcaaaaauaauugugguuucuugacguuacuuuuaauggcaaaacccacaauuacuuuugcacuaaccuaacaaaagaggugcuauugucugaagccugacuuagcuuccuuauacuguggacuuguucuguuugagcaguguuauguggaccaucugagucuaaguuacuucacgugcccaggccaguaguuaugaauuccuuaaauaaaaaucugcuccaugaacaaaacgcuugacuagaaccaggcuuccccaggagguagugagccuaugggcacuuguguucugagaaaagguagaagggaauucugcucuaggcauuugggcuaaaugacuauggucagaaccacuuuucucuuuguuaagaaucgucuaagguagauuuuucuaucucugaacaucacauguuagucaaucuacaaauaacauguacuggauucuguaaaaagaaagacaaagcauauguacuuuccuuucuuccuuuauaauaauggccagaaauuuugauccacauuaauuuauuacaccacgguucugacaaacacuauacugcaaaaguucuucuuuaguuauuuguaagcucacaaaauagauaguuucucuucauguuaggucauuaauaucccuuggucuguguuuuucuucuucguccagccaaaaccuugacucuuugauguguggccagagaugaggccacguuugaugcagauggcccugcaggcugcugcauugauguccccuaguagaaacugcagcaaaagccagccaggauguggaggaauugggacucucagucagugggaauauaaaaugguacagccucuuuggaaaaggguuugguuguuccuuaaaaagucaaacauacucuuucauauaaaccuauucuagguaccuacccaagaguagcuauucuacuccuacauauuuaaccaagggaaaugaaggcaugcaaaaacuuguacacaaaugccccuagcaacuuuauuuguuauaguuccaagcuggaaacaacucaaauguccauuauccaggugaauggauaaacaaacuguaguauauccacacaauggaaugcugcucagcauccaucaccaucgauacacgaugcaauguagauaaaucccaaaauaauccuguugacagaaagaagcuaaaacaaaaagagugcauauuguuugaugccauuuauauaaaagucuagaaaauacaaacuaauauauacuaacagaaaacagaucagucguugccuggagaugagagugggaugugaagggggugcaaauagcccaaggaaauauuagggcgucauggaucuuuucaucaucuugauggaaaugauuaucucguggaaaccaucaaauaaaaagcuuaucaaauuguuuauuuuaaauaugugcaguuuauuagauaacaauuauaucccaauaaagcugauuuuacaaaagaugugaaaaacagcuuagaagaaaaaggaagacacaggaauucccccuuagugucugugggaugacccccauaauguuucuuacuacucacuacugaaauaaaaauuuaaaccaaauaacaugcucaugucugaagaaggaaauucauaaaauagcauucuaucugaacauguuggucucuucucuaaacaaccugaccgauacuuguggagucacccucuagcucuugaccuaguucugaucugcauuugggccuguguucaaaugacuucuguuuugcaccuccagaaacuguuucuggcccuuugcugcucccuccgccucucuccuccagugguccuagugaaaacccauagccuggacccugguggcagcauagcuauucugcuccaucuagcaggaucccugcagaaugaagaaaacacaccacccagaguuaccaucaagaagagagaacagacccaggcuggcagaggaacagcucgggccagacugcuguucagcugcccuaucuggauaagggaggcaucuggggagauggagccaaacucugagugggaaaugccauuguuugaguugacacuuagacagugagggcugggacagauguaaacguuuccugcugcagcgcaaaauggaaagaucacaggaggcuggcaccuuugauuuggcucuuacaguaccacaaggaaagccagcaaugccaggcuauuuuuaaugcucaaagagccuagcaaaagauuuaugacuacaaauauguagugugggagagauaaauugaagcaggacucucccagcuccaacagaggagucagccugccagccuggucaauaaaguauuuaagcccugagugcuguguggguugucauagauuaaaauuugaaaaucuuuuaugguguaacaagguccuuaauuauaacucugagcuuuggaucauuuucagguugugcaaacagcaagaguuaugccacagugaacauccuuggauacaauagccuuucaauccaauguccaugagagaaaacacucaauucucaaguucagaauuauuuuccuggaauaaaggaaucugagagauuuccaccauaaaaucuucuccagucucaguuguacuugguauuauuucucucuuuuauggaauucagagaaucuaaugagcugacggaaguuucacggugauuuuguuuucaacuguuuuucuuuugucacucaauauugcuaaaacauucuuucuaaaauuuaagauucauuaugaguuaacuugcuguggauuucagcugcugaugaacuucuuuggcugacaguuauuaaaucaacaaccucucuuggaaaaaaaggagucuugagucgguaacuaauaggacuugaauagcaaaauauuuaacuaucaucaauagauuauacuaaaguaguuuugauucuugaagaauaucuggcauuaaucuacagcaaaguuaaccuuauccuuaggcucagugcuugggacugacuucuagauccaacugccauauaaucagauaaucucagaauaucauuaaccuagaguuaguuaaaugcccuauacagaugaauuuaucuuauaaaauagaaauuauguauaggccuaaauauaacaaagaugauagauagauagauagauagauagauagauagauagauauaauagaugcauugauagauagauggagauacagauguauagauauauauggcauuuuauauacaggaauguaagaaggguguucauggaccuguauagcucauaaugaauauauauaucuaggccccagaugaaucuuaauuuauaaaacagaaauguuccuaaaaugcuuuaaaguaauagaaucacugugccaucuaguagcuccuccuccuuccucccucaacugacucuacuuaccauuuacaaagaaacuuccaaaauuguuugaugaaguuuuuguuuaaccuauaugucucaauuuuccuggucacugaguaaacaaauacugcagugcauuagaaguacuccugauuaaaaaaaaaaggacuccauaaaaucaaucacauuugcagugaaaauaauuuccaguugguuagauaugaauuugugaagaugggauacuuuuacaacuggcccuuuaaaugugaaggcagauugaauaggacaaaguggguguccugaccgaauuagaacuccuucaccugccugaauuggcagccgacuuccaugcuaacuuccccauuuuuccaaccuugucaauugaacucagggaauuuagggcagugggaagggcauucauggaccugucuggcuccuaaaaugccacccagccucagaguucuaacuauauucacauguaaaguaaagggcaaauuccugaauauacauacccugaugcuacuucagaaaauguacccaacacauccauguuuuacauuauauguuaacucccucaaacaguuaaauccugucucuuccuaaaaacccagguugaaccuuggcuccacagugaagauuuuaaugaucuuacauucccauaugagaucuucuugccucuauaccuauaaauuacacuaugguauuaaugaugaaggagcaaaaaaaacagaaucauguaacagagagaauuuuuuucccgggguuauuaaugcugugugggaaggaaagagaaacaaagauuuggacacaaaaugaguacgaauauauguuaauguaccaugggagccaaagagauuggguggguuucacagggcuauacucgagagauaauuugagcaaguaaucuggugagaaggagugggacuacggugcacauaucuguggagauggcuggaggcaggaauagcaagcaauuuccguggaaacauuaaagauugaguguugcaggggaaacacaggguacuagcauuaacaccauagaaguucucaaaucuggguugaguucaaguuauuuuguguauucucuaagauauccuaaagccaaggccaagugaugacuuauguuguugaucauuauuucaugugugucuuagagucaccacuuagauuggacagggacuuuguucauccuucucuaauaccuuccauugggaugaaccagaacucagcucacugaggguguucaauacucauugcuggguucucugaguaccaccuaagagguauguaggaugcccauaugguaguccccacuuaugcacgcuuucacuuuccagaguuucagcuaacugugggcaaccaugguucaaugacaugaaauggaaaauuucagaaauaaacauucacacagcuuuuauuacaguauauuguuaugacuuuguuuuguuuuguuuuguuuuuuguuuuuuuuuuugagauggagucuugcucuuguugcccaggcuggagugcaauggagcgaucucggcucacugcaacuucugccucccagguucaaacgauucuccugccucagccucccgaguagcuggaauuacaggcacaugccaucacgccuggcuaauuuuuguauuuuuaguaaagacgggguuucaccauguuggccaggcuggucucgaacuccugaccucaggugauccacccaccucagccucccaaagugcugggauuacagaugugagccaccacgccaggccauaacuauucuauuuuauuauuaguuauuguuguucaucuuuuacuguacccgauuuauaaauuaaacuuugucauagguauguauagaaaaaaauaguguauagaaaaaaaacaguguacuauuagaccuccacugcggggcuuggaacguauuccccguggauaagaggggggcuauuguauuugcuucaacuuaacaaauauauuuauacauaugcccacacacuacauacaaucacaaacacacuccccacacacauacacaaacauccccacaugauacguaaaugacuuucugacaaucacccaaguuucgcauagcuaagcugggggugguuacccaggucucaacucuaggccaaaagcuauuuucagcacugaaauucucccagcaugagagcacucuucagaguacaucaaaaguaguaucucauggaagaacuuuaucuagaacagacgucuuaaaaauagcauaauaauuguaaucuuuaaauacacacauggauggaagacguagaauugguuacuauauucaauuauccucauacucaacuucaucuaauccugagcuggaugaauuguuuaagugaaaaauuauguugucuucaggcuaaaaaucuuccccugcucugaaauauuuuacgcccccucuuaacauuuuuauaacaauuagcuucuauugugaauacggacuauauuaagccucccagccgacagaucagcauguuguuccccauucugccacuagguggccgguaguaauugaucugauuuaucccuguggcgugaauucccaggagugagacuuagagacaauuccggauguuucuaccguguugauguccuguggggaagccaguuuuacuuuacuuacccuaaugacuaugucccuucccccauuccaucccucuauuucucuuucagagcaaagugcucuuuaacuuuuacgcuagcuucaggauguuucauaagcaaagagguucacuuucuuccaguuaagcuaugggacuugucaggaacuguuucauguucuuauuuucucugagugagcuaucauuaugcaggggccucucugcaggcugucuacaaaaucucuuucacaucugcaugguuaacauccuccguacuucuccuccucauucccuuucccagcuucauaauaaaaaggcacaucagccuguaacaaacucuugucaagacucaagggcuucuaauuaauuccuuguaauguuauuucuuauaucaauuaacuccuggggaaccagcaacucccugucaaggccagcucuuuacaacugcagaguggaagucuuucugugcaggaaguggcuacaugaacucgacugcacaacgugcugucagccccuccuugccugccaugccgccauuccccuugcccuggagccucaaaugaucuugaguaaagucauuccuugaggucacagagucauaaauggacuuuuauuucuggauucuccuugugagaaugcacuauuacaguccagaacagugcuggagccaggggagggagucuuaccaguuccuuccucuagaugagguaugcucauuccuuaaagcuuguccuuggacggcacagauaccuaaauguagcuuuaagagacacgucaggggaguggcuagggggagcaagaaaaagaagugucaacuuagagaaggugcuggaccaagaagaguugucaccaacuggguauccagaaugagcaccuuaggagaggguccaggcagcccuucaaugaagggcagguugaagaccaacucaacccaccaccacuuugcccaggauauagagucuucauaaagcaaauccuuucauuuucuugcuucauuucccaauccugaguuucauauucaggacagaauuuuaagaacucaugccuaugaaacaucaaugcagauccuuagaaccuuguaguuggaggagguauuuaaagucuuguugcccaggguagggcuaugcaggugucuguuccacaggugcuuccucuggcauccagucucacuagccccuuccacugugaaggccuggcacauuuuggaguuaacaaugguaacaaaaaaggaacaagaguaccucuccuacuacuauugccaagaaccaccacugagaaaacacaacagucagucuuuagguuuccuuacaccuauguauagaugcuccucaacuuacaaugagacacauccuaauacacccaucguaaguugaaaauauucuacauugaaaauacauuuaauacccugauaaacccauccuaaagucaaaauaucaugcauugaaccauuguaauuuggguacuguauguauuuugaacaaacacauuauucaauuuuuuagcaaaaaugcagacauuuaguaacauauccaagguaaccacauuggauauuagcagggcugggaccagugucuccauaugcuugacucaaucauauagaauauuccuucucuuguaugacuuguaagacacuuauucugaacucaugucuuuguggcuguguuuucugaucuaaggaugagguuacauggacugacaaugggaagggauccuugaaauuucaggguaguaccagcuguugagaugacacaaaugaaaacugugcauuucuuucaauauguuacugcuuucucucuuaaaacagagguuugaaaaagcuuccuucucuuugcuuucccucuuaaaacagagguuugaaaaagcuuccuucucuuuuguagugaaaaaguccauggagccuauaaauuggugccaucucacauuuaauagugaggagaagccuaccaccauuguggauucucugugucugauuagccacaauguuuuccuuuuugggaaugagcccaggaaaacuauuucacuuauccuagugauuucacagacauaaggcuccuugacagauaaauaaaagcaaguucaaguucacuugugcaaacagacaauaaucuauaggccuacuuuacuguauuuuuagacugacuaguuguucacugaauccauuuuccuuuccuccugcacacacuaguagauuacauuucccaguaucccuugugacagacugcugccugagucuucauuugcaagcaggauagggaggacuacaaggcacuaaguaaugagaaggcacaagauggaaaaaaggcuaaguaacaguaugacucuuuggaagagaccacccaucucccucacugcacugcacugauuugaccaauaacgucaacucucuugagaacuucagugcaagauacagaaagugggauugccaucauccgaacgagcaaucccauuaauggguauauacucagaggaauacaaaucacucuaccauaaagacacuugcacacaaauguucagugaaguacuauucacaauagcacagacauggaaucaaccuauaugcccaucagugacagaccagauaaagaaaaugugguacauauaaaccauggaauacuacacagccauaaaaaagaacaagaucaugucuuuugagagaacauggauagagcuggaggccauuaucccuagcaaacuaaugcaggaacagaaaaccaaauacugcauguucucacuuauaagugggagcuaaaugauaagaacucaugaacacaaagaaggaaacaacagacauuggggucuacuggaggguggagggugggaaaagggagagcagcagacaaaauaacuauugaguacugggcuucauaccugggugaugaaauaaucuguauaacaaacccccaugacacaaguuuacuuauguaacaaaccucacguaccccugaacuuaaaauaaaaauuuugaaaaaaucagagaagcaguagaaacacaggaagccacugaugugcauuuauggugcgacccuaagguaaguggggugaucaagagacuaacaccagguacuugauucuucacuggacugugucuguaauucuccccuaaggugggggcagggcuccucuggguuuucaugaggcucaggcaaaugggagugaucccaaucuucuucuaauaaacuuucacucccugaauuaaccugugugagucucuguuuccugcaaccaaaggacucucccaacugacacaaaggagccagcagccacuuguucucuccugcuucccacaacuuccucagucaguaucugugccacucaccagccaggcagccccacacuuggccuugacuggcaucuacuguuauuaguguuugcagugauugauaguuccuucaagagcagaaacagcccgaauacuuggaaaaaucuccuagaguguuuaguacagugucaggcucuccauucacacagaauugcaguguuguuuucaggguuuaugguuccuagaguuaauuauggaaaucccucuuuuauggggaagaaguguguuaagcuuaacucuauguacuaaacaaacuuacuuucauauaugcauauuugaacauuuaaaauauuauuaaaguaacaauggacaaauaugaaaaaaaucacaaagcuuaaaaagggaguuacuaaucuucagaauacuaguucauucuaaauuuuaauaaacauaagaauuggguuuggcaucaggcauaccauauaucaacgaauguagugcaaauuuuauaaacaagugauuagauagccugcaggccaaaucagcaaucaccuuucuuugguaaguaaauauuuaucagacacagccacacccauuuauuuguuauuguuuauggaucuuuauggcugaguuaaauaguugugacugaaacuggccuacaaaacuaaaaauauuuacaagcuagcacauaccaaaaaaaaaaaaaucugccaacuuuuggaauagaagaaauauuauauuaaccauuccccugucuucauaauauuucucaguacugugucgucuuucuucauuccuuuuauuuccccucugaucuacauacucaauccugcuccucucaacugcagcaguauccuccaauucaacuccuaucauccauuccucacccucuugccugagacuuugccugugguaaucucuucuguaagacuuuaucagccgaaaaacucuugauagcaucaauccagcauucaaaaugacaagaucccugcuuuaccuuugagaggucaugaguaaaagaacccuucccaaaggaagauuauaagaguauaaugaaagauuagugaaauauuaacuaaagcacuuuuccuagaagccaccaaaaagaauuagagguguuagggugggggaaagguucuacgaagauuaauaccuucuaacauuugugcuuccucuauaugcaauauuucccuuaaaguauagugagaccuguaaucccuguaguuugggaggccaaggcagguggaucacuugaggucaggaguuugagaccagccuggccaacauggcaaaacccugugucuacuaaaaauacaaaaauuagcugggcaugcuggugcguaccuugggaggcugaggcaggagaauugcuugaaccagggagguggagguugcagugagccaagauggugccacugcauuccagccugggcgacagagugagaugccaucucaaaaaaaaaaacaaauagugagucuauuaguauccuuuauuugggcaugagggugcaggaagauuguaaaaaucuacuuagucaaaguagugauacuagcuaacacauauuuuauuuaccacuucuauaguacuuugaagaucaaaagaacuagauauagccuccuacaaggacaacacuuaauauuaugagaaaucuuuccuuguucugacauguaaugaaauacuucuucaaagcuauuaacccaaagucuaggugggauugccugagugaaugaauauggcauucaaucccuaacuuaguggguguccuaaagguauggaugauauuuugcugugcagauauuucuccauggcuguguuuccaaaaucugacugcuaauugucaucacucauaaagagaugccuuuucuagcaaaauaugauagcauuaccucaaauccaugucaauauaauuaaguuuuagucugucugucacaucacagauaauggcugaguggauuuucauuaaauuuggaggcuaugugucauaugcuaaaauuaauuugggggacugauagaagggggaaugccacaaaagagggcaguuauucuccagagcagcugcaauugagauaagauggaagguuuagaagcuuugcauguagaagagacaggccauaaguauuaaaaugccaugacagagaaaacaaguagugucuucaaaugagucucaaaucgacacuuccagggggcaucugcucuuuuucggugggauugcuucucacaugggcaacuuuguggaagagcacucugcugugcaccucagcagacauuuauuucacaauaauucacaauuuuugcaacacuaccaaggccagaguccucaauaauuuaaagaagauacucuguauuuuauuacuuagguaugcagaccuacaguuaccauuacccagguuccuacugaauuuucaggguggcaguucauaauccaucaaggaugucacgaagcaacuaaagaguaauucucuuuucucugauaucugacaggcaacagucacagaauauuuuaggaauaaaguagaugaauugaucuuucuuggucacuuaaccagcaagugaaauggaaaaaauaaacaugauaaaguuagaaaaacuaggcugaaucccagcuggcuacaaaucagcuuuggugaaccuuucucaucuuugauugcaucauguguaaguugagaugaacacgaccccuuuuugggucagucaagguuguuugguuauaggaaguagaagccaucccaagcuaucuaacgaagugacauuggaacucaagggcaggaagguaggggccauuccucaugugagaccugaaccaagggcagaaggucuggcuuuccgggaugcuuuggacuccaagacugugucccacuuuguuucugcccagaaguuuucuuuacucugcacauggcacaaaaauggccacuccaagcuugcaauccauccaacauuccaguuaacaugcucacugauaauuucuguaucagauucacaaucagauaaucugauugcucagcccagauuaccucuaagucagccacucacuccuggcccaagucaggacuggguaugggagaugaagaaggagaaggguggggaaagagguuacaauuucuaaguagagcugccaaaacuaguguuaacaaaaaaaaaaaaaaaaaaaaaaaaaaaaaaaaaaaaaaaaaaacaaacaaacaaacaaacaaacaaaacccaaauucuguaaaauauuugaagagauuuauuccaagucaaauaugaggacgaugaccuguaacauagccucaggagguccugggaacauguggcaaagugguuggguuacagcuugguuuuacauguuuuagagagacuuacgauguuaaucaauacaugugacguauacauugguuugguccagaaagguaggacaacuugaagugagggcuuacaguucacagguagagucaaagauuuucuugccaagauuugcaauugguugaaagaguuaaguuauuaucuaaagaccuggaauugauagaaaugacugucuggcuuaagauaagggguuguggagaccaagggucuuauuauguagauaaaaucucauagguggccacccuuagaggcaauagauggcagaugauuucuauuuagaccuuuaaaaggugccagacucucuggaaaaaaaacuaguaagggaaggagauucucuacagaaugcaaauuucuuccauaagagacagcugugcagggccuuucuaaaauaugucaaagaaauauauuuugggguaaaauacuuugauuuccugcggggccugcugucugucaugugaugcuauaccagugucagguuggaauuugggaucuuauugccacaaagagccucuuuugucauucuuaaggucucucuuuuaauguuaauguuggucaauugugucuaaccuccaagaggaggaaaguauaaugaaacaugucugaccccuccuucccaucauugccuaaaauaguuucucaaguuuucuuuggguucucugggaccugaagagggguccacccagcugauugagaaacuuauaauuuuauauuugguuuacacuggacaguagaaauugccuaagaaggacagugccuugccugaucagugggaagaugaccugaggcauguauguaugaaugccguaccaucacaggcagucucagaggugacgcucugaaccacugugacugagcuggaugaucagaauggauucaaacaccaggaacaggccgggugugguggcucacaccuguaaucauaauacucugggagacugaggaggguggaucaccugaggucaggacuucagacugagaucaagagaccagccuggccaacauggugaaacccugucucuacuaaaaauacaaaaaaauuagcgggggaugguagugcaugccugucaucccagcuacuugggaggccgaggcaggagaaucacuugaaccugggagauggagguuucagugagccgagaucauaccacugcacuccagccuggacgacagagcgagauucuggcccauaaaaacaaaacaaaacaaaacaaaacaaacaccaggaacacaaucauucuacgucugcuucugcacuguguuaacugagaggaauuuggcuaaaaguaagauaauguccaauucaaccuagcauaaagaaugagaaucuuuauuggcugacagaauaaaaaguacaaagguagagcaagcuuugggaaugaacucuaccuaguagcuccaguuuuggaucccuggaauucucugugauuuccuuaugugagcuucaucuuccucuggauaacaacaaaauagcugcagugguuccaagccuuguggccacaugacaaugcccaggagaagagugaaaacaucucuucuuguggcuuucucugaagaaagagaacacuuuucaucauggcccagaaaacuuucccuuuuccgucugcuuuuucaaaugggaacagguucucauuuguuugaugagaaacugauaaaugccacaaacuguuuggcuuacaccuggauuccuagaugaauccagagacaugagggcauagaaagugaugaugaaaaaacacccacaauguugauuauuguaauacugauuuauaauaaugaauauagaccagugcaguggcuuacaccuacaauccuaccacuuugggagaccaaggcaggaagauugcuugaggccaggaguucaagaccagccugaacaacaaagcaagacucuaucucuuaaaaaaaaaaaaaaaaacaaagaaaaaaaaagagagagagagacaaagaaauauauacaggcaugcauugcuuaacaauggggaauaaguucuaagaaaucuguuguuagguuauuuuguuuuugugugaacaucauagaguguacuuacacaaaccuagaugguacagccuacuacuugccuaggcucuaugguguagccuacugcuuguaggcuacaaacaugucuagcauguuauucaacugaaaauuguaggcaguuguaaaacaguaguacuuuuauaucuaaaaauaaaaagauacaguaaaaauaggguauuguaaucuuauaggaccaccgcuaucauauauggagucccucauuggccaaaacauuauauagagaaccccuaaagcgcccagaauuuccuaaguaauacaaacaauaaaagugaaaggagugucuuuugcuguuuauaauaagucccuuucauccuuaccugaguuuauguuaaugaguaacuuuuggaaggucucuaaggauagagacugguugccaugggaaucaaguauuugaacacauuugauuagaggguuggaacuuucaauccccugucccaucaccaauggccagggauuuaaccuaucaugccuauguaaugagaccuccauaaaacccaaaggauggaguucagggagcugccagguugcugaacacuuagaggugcugggaggauggugcaccuagagagggcaugacagcucugcacccaucccucauaucuugccuuggcaucucuuccaucuggcuguuccugaguuguauccuuuuauaauaaaccaguaaucugguaaguaaacuuuucuugcgugaugugagccauucuaacaauuauuaaaccuggggagaagauuauguggaccucugauagacagucaaucagacagcacuggacuuggaacuggcaucugaaauaggggcagccuuuucagacggagcccuuaaccuacaggaucugauguugucaccaguuagcuagcaccagaauugaguuuaauugcaggaaacugaagaaauaccugguaugaaaaauacuccauaucugaugucagaaaugaaguauagaguguaguacuggcaugaauuucacagacaggaaaaaagaguuucauuucuauuauacacacuugcccaucugauuccucagguaauugugacauggaaaaaucuauuuguuuacgaaagggagaagcuaccuuuaaaaaauaauucucugucauccauuagauaucaaggaagaaauaaugucuaucuacucuuagaaaauagggcugggcauuugaaucuaaaaugcaugcauaaaagguaugaaugacuaacauaaagcucaggguuuauguuugcuguuacaaaaugagaaagaacauaagaagaagagugaaguaauauauucaaggcuaguccaaucauaagggaauaagcaguacacaaacuguaaauggugacguaagcucuccuacaaccagcuuuaccccucuauuuugucuuaugugcuucuuuuuaauuguccucaaugugcacugaacaauaacacuacuauuucagauucagacagugaccucagaauccccuguaaugaguccuccccaauaggugaguggaucuguuucuugugacaccaaaugaagaaacaccucaaagggaaguuaaaggagaggggacaguaaaaauaggguauuauaaucuuaugagauacgauagcugcuauggccugaauauuugugcucacccccaucaucagauucauauguugaaacauaauucuuggugcagugguuuugggaggucaggcuuuuggaagaugauuaggucauaaaggcagagaccucaugaaugguauuagugcccauguaaaagaggccugagggagcuuguucacuccuuccaccauaugaaaacacagccagaagacacuaucuaugaagcagagaaugagcccucaucagacaacaaaucugcuggucccuugauuuugaaccuaccagauuccggaacugugagcaauaaacuucuguuguuuauaaaucgccuggucaaagauauuuuauuauggcagcccaaauggacuuaggcaauggccagucuuacugacaacaaaauuuugcugaacacagauccugaccaugugcacucauggagaguuuguccaaguuuggucuugauacagaaaagcagcuuggucuacauaggacucaaacacaguacacacuguacacuaaccacugaacccaccagccacauaucaaagggcauauuuuaggaaaaaaaaaaugcugccugggcaacuucccuuucucaaauuuguccacacuuccccauaucuagaucacacaauaacuuaagcaugugguuauucuccacugggguccuuuaauaguuguuuuuuuuuguuuuuuguuuuuuucgaauuuugucuuuauacaucaguaagcugcuaaacacccaccuuucuccuggaucucucagacaagucauaaaugucaucuucacuauguuucuucaucagucaaucugguugacaucuguaaccaagugaagcaaaaccacagcaggacagcuagaaagcaugggaggcugcccugugcacaucaugaggaccuaggccaacauuugugggucaucacgccacaggcacaacucgggcucacauccauggacagaaagagccaucagcaaagucaagaagcagcuccugucugugcuucuauggagaaggauaauuaucaaauagauggcugaaugccuggaaauaucaguaagggcugggcguggauuguaacgugagacaaaagacccuaaacgcagaagucagaacaaacguggacaagcuuccagugcuucaucuauaaaugaagauuauaucacccccuccuuauauuaguaugugaggcaaaaauaagucagaaaauauuuuguaaacuuaucauucagcaccugacacuugguaaguauucaaaaaacaguagugcuuauuauuauuucaugaaauaaugccuaagguggugucccuucuuggaaacacaggcccaugaaaauucauccacaguggcaaaaauacacuaauuuauauccacuaagcaauaagauauaauaaagggaacccuaagcggagguuugaaauggaugaucuguguauucaaauacuccguaucauccuaaaaugaagguggcauuuacaacagcugugcccaugcaauccugcgaaugaauuugcuacaugauauauccuaaagcuguuguuaacccaaguuuagcauccaugauaacauacccaugcuucuauaagcaggaggaaccuagaguugauuuuagggaaaugaaauaaaagugaaggggggugacacucggggcagggcagaacaaaugcacugcauccuggagaugagcuggaggggaaggggcccaaggagaggugugagaugggauaugagaaagagggagauguuucuaugucaaguauuuuagucugaauuucaggucccuuuggcccccagagucaugaaguagguuuggggaauuugucacucaggaccuccaucagguccuuccuguacgaaaaggcuucccaaauucaagcucgagggaaaaaguaggguggagggagauaugaagacaagaaagcauggcugucuguguacagcauauaagccacgcacugccucacuccagggggaccagucaaaucagagugaugccagugccgcagugaguuggauccgagagauguacaccaccauaggcagaagccccacaaauugucagugacacucuaagucaccugugccgauguggcaccugccacgaacaaacacauuugaacagccaacaucccaaguuucagggcagcugugugaccuugaaccucugguaacacucucaagaucuagucauagggaaaaggccuccagucccucagaggaguucgguuuaaaaccaugccuuuaucccuucaucaugaagucauaguuaaguauucgucuaauugaacauagaaugaaaucacaggccuauuaagagagaccaacuguaauuauccaaaugagcuguuuuaacccuagcaauuuagguauguuccacaaaacacauagucccauuagcugaagucauggaaggccaucauaaggauggauuaucucaauccucaucugauaaugaaugccacagaaaaaaagauuauuaaacuuuuggaggaacuuaauauugggaaugaucaauuaaaaacugugauacagaaccaauucauuauacacaaaaaggauaaugccacacucuuucugaauugagaucaagaauggcuccuaguaucuaaucaguauuuuugguuguuauagcuaucacuuaaaacaacacaaauccaccaucagauaaacacuaauaguacauccaaaggaaauugaaauugauuucuguauuagcuugcacuagaucaacaaauuucauuuauguaggaucccauugcuuugacuucaaggcugaaugagauacaaagcaacuauuuuaauaaaaucuaauuccucaggaaaaaaaaucaucauccuacauuuaugcuucagcuaguaggaaaauaagucugacagaaccauuauaugcuauucuauauacauagcuguuuucaaugaaguuacuucaugauguuuuccuacuauggcaauggagaauguuuucaaaaaaaauuaaaaauagggaauugcugcucuaaaacauauacaucacaaaggacucauauucugcauuuuucuuaaaccacuuaccauaaaacuuucauuuuuuauggccaacucggugcugauuucaugauuugcagccaggaacaacugauuucacagcaucagucugucauaaaucuuaagaaccuaaguucugaaucccaaagcagugcccagagacacaaaugagauuucucuucacaaagugugaccuguguuugcaguuuagauuaaaagaaacaaaguugagaaaagggcaaucgggcucugcuuuuccaauauuuagagaaauguuuaauuucuuuuccaaauguagccauggccagguuggagcucugagagugaaccugcuggaugguugucacuuggggacagcaacacaaauucccaaggaggagacagcacugaccuccauggcacugguggggccacucauggaaccaaacauuuauuuuauuguguggcccccuuaaggaaagauacugacacacuagaaugggguccaugugauagugaccaggcuggugcaguguggggauuuggaugcagcaggcugaguuuucuuaagcuauuuauccugcacagaacugggcagggggguuagguggaaaugauccuucuauuuuaacagcucuaaaaggacaauuaaauuuaaucuguggaagcaagaaaggugugggaaagaaaaaaaaagcuguauaauugaggaugugaucaauugacugaagagggccuaauaguuuagcaacuagagguaggucucuuguagcauuaauaaaugcagcuguggcugggcacgaguggcucaugccuguaaucccagcacuuugggaggccgaggugagcagaucacgagaucaggagauugagaccauccuggcuaacauggugaaacccugucucuacuaaaaauacaaaacauuagccgggcaugguggcaggcacauguaaucccagcuacuugggaggcugaggcaggagaaucgcuugaacccaggagauggagguugcagugagccgagaucacaccacuguacuccagcuugggcgacagagcgacacuccaucucaaaauaaaauaaaaauaaaaauaaaaauaaaugcagcuguagaggacugacugaauugacaggccagauaugaaaaccuggcaaagagauacaagccaugaguaugccaaugucauucccgacucuaagacuuagguggagagaaucuugcuuauggccagaagacauaugcuucauuaauuauaaaagagaagaggguaagggugggugcuaaugaagaugaugugguugguauaaauugagaaguggcaguguggggucuccuugguagcuggcaguugagaguguccuucuuucuguauucuuuaugauaugagcaggauccuaagcucuagggacaugagaacagaagacaagagaguuuaugugucaagagggcuagaacaagucaugggaagugagcagcuaaggcugguucucuggcugggacaaucgaggggccaucuaagagcacugagugccaauggcacacuaggaacuggcacuggcagauuucuuucuucuuaacuccuuauaugucagcuuuacuacccguaaugcauauacucaagugugguaucuaaacaguaugauuaccuuggaccuggcaaacuacaacaccaaggaggcugggauaauaccucuuuuuaagauuaucagucacaucugaagccacaggcaugagcauugauucaaagccuuaaaugggaucaaauuuuccaaacuagaugggagccuaguucauucuguagaaagcaaaguugcuuuuaggauauauccuaagugguggucacucuuuccuuccaacagacagauuaaagaguguccugugacaagaacacagaacucuugaguguucugugauauggcuguuuaaggagacugagaaaauuuuauauguaagaaauagggccaggcgcaguggcucacgccuguaaucccagcacuuugggaggccaaggcaggcagaucaccugaggucgggaguuugagaccagccugaccaacauggagaaaacccaucucuacuaaauauacaaaauuagcugggcaugguggcucaugccuauaaucccagccacucgggaggcugaggcaggagaaucacuugaacccuggaggcagagguugcugugagccgagauugcgccaccagcaauuccucucucuucccuuccucuauccugacuuccugauguuuucguuuaucgcuuuauugaccaaaagccuccuggaaaacaaguauucuucauuacguuccagaaauaaagaccacucaaagaaagccucuguuacauccugagaaacacuaacuuuaacucaauuugccugaucuuuccagugcacuggacagcccauagaauuuacaaacucaauaaacagauaauaauauggucaugauggguaucugaaaccuaggauguaaaaaaacagauuauggagagcugcaugaguacaaucaauuacugagauuuucccgaauacaaauccuauccaagcaaaacuaauauaacccccaaauuaggagaaguccacagucauuuuagaugaaaucucaaaagaaaccacaaucucauucucuuuuuuucaaauuucaggacuuuaacauuuauuaaacaacaaaaacaaaaaugcugacauauuauauuguacauauuugcaaauccaacuguguaagaaggugcuuuggugggauuugagauuauagcuaaagagauccaggcauaaaguuaucacugccugauagggaacguaagcuuuauuuacaaugagaugacaaauacuuuugaguuuuucuuguacauccuuguacacccaccuggcuuccuaggguuuguguaccagcuaacuaauuuauguauugugacagcaagagugaagaagaaaaaagugcuugggccugggcuuuagaagaccaaaauucuaguucugucuuugccauuaacuaguuguaccauuucagaggagucaccuauggcauuucuuuggaccuuaaauuccuucacccuaaccuuuaggaucugagucucuagaagaucugagucaugacuuucucuuugcauuauauaagauuugcaaauauaaacagcaaauuuaauauuuaaauauuaacaaaacuaugcaugguauaaggaaauauaagugauaagauaaagauauaauuugaaaucagguagaguaugagaauaauuuauuguggaaguaagacuugcuuuguguauaagcagaauuugggacucuggaggcagaaaaguaauuuaaaaaauauagaccaggaugaugagaugauggggccuauggcugauuuucuagccugguuuuugucaccagugcuuuucauccugacuccuaucucacuguguauugacaaaugcccuuguguuuggcuugggcaaaggggauguguugguuugcucuccauaauucuacaugucaaguguuggcuguuuggcagugguggggaauggcaaagccuuccaggagucugagcacugguaagcauucucaaaagcagugguuuuauuaugaagcaauuuagauaaaaagccaaacuccuucaauuuaaagccauacaacuggaggcaauuaaaccugcaugauuaaauuucagaaauuaaaaaccuauaaaaagcauccuaccaaaaggaucugucuugcacacauuuugaucauuaaucugaaagcucuuuggcuguccaauaccaccucauccuuuccuucaucuuuuugauugcucaggcaguuuauaagacauguagcacauggaaaaucaaaccaagguagugcagcaucggauccauuuccacccuucuuccaugaaauuuucaauaauuaaggggaagagguaccaauggaagaaaggaagcugaaugccaggaaaugaguauaucaggaauaaguggcucaugaaaggagauuuagacucagucugcauuuucuaguauagucgcugaauugguaaaucaccuuucacuuagccauuccugggacauggugccccagcaugggucagcagaauuguaagccccuaacuugggcagggugggguauuguaagaaaugggauuucuuuccaacuugccagcuggccugagguccccauaucacuuccuucucuaccauacaccccucuacugcagaagaaaauccaaucuggggaaagaacuuaagccaacauuugucccaguaagaaaguaguaguccuugaaagagggcaguaauccuacacuuaaugagcuaucagaaccuaugugcuugauuccuauuauaugcagcugguagucuuuaauaaaaacgggaagggcugggcaagguggcucacgccuguaaucccaacacuuugggaggccgagggagguggaucacuugaggucaggcguuggagaccagccuggccaacaugguaaaaccccgucucuacuacaaacaccaaaauuagcccggcaugcuuggcgggugccuguaauccuagcuacuugggaggcugaggcaggagaaucgcuugaacucaggagguggaggcugcagugagccgagauugugccacugcaauucagccugggcaacagagugagacucugucucagaaaacaaaaacaaaacaaaacaaaaacaaacaaaaaaccagaaagaaguauuguuauuaacagacccuuaagguccuaaagcuuagauacucagauggaaaauauauaacucuaaaauagcagaaaagaauucuaacuucugaugagaggguguacaagcugagcuucagcacacauauggugggcuccuacaccagcagcaagaaguccaacagaagcagcaaacauggaagaaaucacugcaaagugugacuauccaugacaaaugcagcaguacccagaaccaugaaggccaucccaaagaaggaaucuuuucuuaacucuuuaauuuuauuuuuaauagagccgaggucuugcuauguugcccaggcuggucucaaacuccugagcucaagcaguccuccagucuuggccucccaaagugcuaggauuacaggcaugagccuccaugcccagcugaaaauuuaaaaaaugcaaaaacuaggcaacuuacuguuaaauuaauugccuugaggcagaaggaaaaaacguggaugccauauaaaagcugaugagucuucuauuauuugugagcccauguggcagacguccugagugugucaaaaauauucaguguugacuccaggagacuggggagagaggagcauuguguagcuucuuuccaaguaucaagcaugaacugaugaauuaguaugucuauggcagaagaagagggcaaaggaauucauuuaaaucgugaacuuuuacaguuacaggaagaacugcagucaguauccccagcaguauccuugguauacugcauucaguauccuuuguggucaaaacaaaguaagguauuaaagggaugcaauugcacaggaaguuggguauuuuuguuuguugguuuguugguugugguuuuuguguuuuuuuuguuuguuuguuucaauuuaauguacugugagggaaggaauaaacauacaucuguuauaucauaaaaauguaaacaguugauauaaaaugcagaguaauuaaacauaaaguugcauagagaaaccucucuugauguguuuauguuaaauggagagaaaauaaagggacuuaacaaaaagagugcuaauuaagaagcaagagggcuagaaauaugaaucaauaauggacacaaaauugagguuuuguuauauauuuaauuuuucuuauuagauauagauuuuuguuuuuguuaaucaaacccuuucuaaaggcagguacugaggaaauagaaugggcaaagguaaagaacuauguacaucaacucugcaguguuacagguauuacagagaagauaggugaaugggucgauuggugaguagucuggacacagacugguauucuagaucuuaaauuagguaguauauauuuaaaacaaaagcgauagaaauuagaaacuuugauccucaccuagauaauucauagggauucaaagagguugaaucaaaugugaaaauauauaaaagaaauuauuuuaaaaucauuaaaugcuauaggaacauuguguauuaagauaauaauagauaacagugcuucaaacccaauaguuucucaauaauuugguugaauuauagauauugcuaaguccccucucacugugcagaauccugggaauauagugggauacugaacaaaguuuauugcacagaauuacugcaaucaaagauggcauugcaaaggccaugcaaagaugggaugcaaagauggugugcucaaaauuacaauaugacaaaagucaaggucuuagcaaccuaagucagucaagguucaauccuggcuuuuuuucuuucuuucuuucucuuucuuuagcucuugaaaauggauuucucuauuuccacuaauaauugccacgauauccaaguaaccuaaguacagucuacacaggugauuauauucugguuguggauccuuagcaugugauucuacauaacauuaaauugagguuuuaauguguguaaucauccauuacuaaaugauacgauuaaauauuucucauaauaaguauuauccuauaccucagauaauucuaagcauuaaauaaauuguagcaccaauucaacaacacaaaguacucuuaaauauauuuucacuuugucaaauggggagaaaguugaaugcauaaggaggccaacaugaauacuaauagcuauauuuauugaguccuuacuaaguagcaggcacugggcuaagggcuuuacaugcauuaugucuucuaaaucucacaacaacccugugaguaaacaauaugacuacucucauuuuacagucaagagaacugagccuaauagaggguaaggaauauguucaaggugacagagcuaaucauaucagagcugaauuccaaucuccucugauuccagagcccuugcucuuaacuacuuuguuguacugccuuucuauucaccuuuuaauacauuggucaauaaucggaugucugccccaagggcaaucccuuuaaauauagguuugucuggucuuuucaugaauccauaaacugcugucggauuaacauaggauguccugaaggucugcccaccuccagguacuguaagagcugucaccuuguugauugagcaaauaucucugcccccucagccucuucccauaagauggggcacaaacagagacccacagccauuuucuucuugccuuccaaagcccaaagcaguuuacuucucucuggguagagccagacuuauggguagucaagagagagaguuuuccacaguuggugaaaacagagauauugagaaguacucaacaccucaacugcuccacccuuucagcucauccccaaguugggaaaaauaaauaaccucuagcugauugguguuaugcuggaauauucauauuuagaaacacauucuucagaguuagguaauaggcaaaugcaaacauauugagaggauacaucauaaugaguuauuaaccugugauauggccucauuaauaaaugagauccuuuugcaacaguuccugugaagcaugauggccuaugcagagguuuucaagcuguguucugggagcgcucugcucugcagaggaggcucaggugugcagaauaucaagugguccagcccugaaccccucuccccauuucaaccacaguggcucugcuauuaucugcuacuagccuggguucugcauuucacuuuggggaaaacaaaugaucaacaacaacaaaaucauuacacaguuuuuauaaaaugaaaaucacaguuuaguggaaagagugaaaauguguacucagcaauaucuaauauagugccuacaacaauuaagagucaguuaucacucccuuagagcagguuuggauuugggaguaaggaaguaacauuucuugaaagccaugggcuuucagugucacucaaugggucagacccugagucugaucuuuaauuuuuagguucucuguggggaaggcauuaggcccauuuuaaagguaacaaaacugaggcuuugagagguuagaugauuugcacagaauuacacagcugcugaguagcagagcuggcacucacacuaagguguccuuggaccccgagacacuggguuccugaugaagaggaugaaguuauaugaaguuauggguuuagaaaccaauguaaaaaugggcaucugaaguccauaauuuaagcuuugccugcuuagcaauauauauaugccaaccaacccuguaguguuugcuucaaaagcuacauagaaacuauucaucugguucauuaucauuuuguggggccucuaagaaguagaaauaggcugggcucgguggcucaugccuguaaucccagcauuuugggaggccgaggugggcagaucacuugaggucaggagaucaagaccagccuggccaacauggugaaauuccgucucuaguacaaaaauuagcugguuguggugguguacgccuguagucacagcuacgugggaggcugagguaugagaauugcuugaaucugggaggcacaagaugcaguaagccgagguugugguacugcacuacagccugggugacagagcaagaauucaucucaaaaaaaaaaaaaaaauggaaauagcuuaggcuaagucaggccccggagaaauauuuccugauuaugucugugaauauuuucuuuauuauuuuuacuagucuuaguuagagcuacuauaacaaauuacuugucaacaacagaaauuuguuucucaccguucuggaggcuggaagcccaagacuggagugccagccugguuggcuucuggggagggcccucuucugggcugcagacuaccaacuucuccuaguauccucacaugguaaaaagagagauagcuagcucuauggcuucuucuuauaaaggcacugaucucauucaugagggaucaacccucacgaccuaguaacucccaaaggcgucaccuccaaauaaugagauuacaguuucaacauaugaauuuuguuggacacaaacauucaauauacauuauuauuauuauuguuauuuuccauauuaauuaaacugcugugccugcugaaaagaaucuguucagaguuccaguuccaagcaugagugaugcagaagaugggucauuucugcauuuccaauugagguaccagguucaucucacuggagcuugucggacaguggguguagcccacgcagugugagccgaagcagggcggggcaucaccucaccuuggaagcacaaggggucggggaauucccuuucuuagccaagggaagccgugacagacgguaccuggaaaaucgguauacucccacccuaauacugcgcuuuuccaacagucuuagcaaauggcacaccaggagauuauaucccaugccuggcucggagggucccaugcccauggagccucgcucacugcuagcacagcagucugagauagaacugcaagauggcagcgaggcuggaggaggggugucugccauugcugaggcuugaguaggaaaacaaaguggucaggaagcucgaauuggguggagcccacugcagcucaaggaggccugccugccucuguagacuccaccucugggggcagggcauagaugaacaaaaggcagcagaaacuucugcagacuuaaaugucccugucugacaucuuugaagagaguagugguucucccagcacagaguuugagaucugagaacggacagacugccuccucaagugggucccugacccuugaguagccaaauugcaagacaccucccaguaggggccgacugacacuucauacagccaggugccccucugagacgaagcuuccagaggaaggaucaggcagcaacauuugccauucugcaauauuugcuguucugcagccucagcugguguuacccaggcaaacagcgucuggagucgaccuccagcaaacuccaacagaccugcagcugaggguccugacuguuagaaggaaaacuaacaaacagaaaggacauccacaccaaaaccccaccuguacaucgccaucaucaaagaccaaagguaaauaaaaccacaaagauagggauagagcagaaaagcugaaaguucuaaaaaucagagcagcucuucuccuccaaaggaaugcagcuccucaccagcagcagaacaaagcuggauaaagaaugacuuugacgagcugagagaagaaggcuucagaugaucgguaauaacaaacuucuccgaacuaaaggaggauguucuaacccauuguaaagaagcuaaaaaccuugaaaaaaagacuagacaaauggcuaacuagaauaaacagcacagagaagaccuuaaaugaccugauggagcugaaaaccauggcacgagaacuaugugaugaaugcauaagcuugaguagccgauuugaucaaguggaagaaaggguaucagugauugaagguuaaaugaaugaaaugaagcgagaagagaaguuuagagaaaaaagaguaaaagaaacgaacaaaggcuccaagaaauaugggacuauaagaaaagaccaaaucuacgucugauugguguaccugaaaaugacggggauaauggagccaaguuggaaaacacucugcaggauauuaugcaggagaacuuccccaaccuagcaaggcaggccaacauucaaauucaggaaauacagagaacgccacaaagauacuccucaagaagggcaacuccaagacacauaauugucagauucaccaaaguugaaaugaaggaaaaaauauuaagggcagccagagagagaggucggguuacccacaaagagaagcccaucacagccagagagagaggucggguuacccacaaagggaagcccaucagacuaacagcugaucucucggcagaaacucuacaagccagaagagagugguagccaacauuuaacauucuugaagaaaagaauuuucaacccagaauuucauauccagccaaacuaagguucauaagugaaggagaaauaaaauccuuuacagacaagcaaaugcugagagauuuugucaccaccaggccugccuuauaagagcuccugaaggaagcacuaaacaugggaaggaacaacugguaccagccacugcaaaaacaugccaaauuguaaggaccaucgaugcuaggaagaaacugcaucaccuaaugagcaaaauaaccagcuaacaucauaaugacaggaucacauucacacauaacaauauuaaccuuaaauguaaaugggcuaaaugcuccaaguaaaagacacagacuagcaaacuggauaaagagucaagacccaucagugugcuguauucaggagacccaucucaugugcagagacacauaggcucaaaacaaagggauggaggaagaucuagcaagcaaauggaaaacaaaaacaagcagggguugcaauccuagucucugauaaaacagacuuuaaaccaacaaagaucaaaagagacaaagaaggccauuacuuaaugguaaaggcaucaauucaacaaaaagagcuaacuauccuaaauauauaugcacucaauacuagagcacccagauucauaaagcaaguccuuagagaccaacaaagagacuuagacucccacauaauaauaaugggagacuuuaacaccccacugucaacauuagacagaucaacaagacagaaaguuaacaaggauacccaggaauugaacucagcucugcaccaagcagaccuaauagacaucuauagaacucuccaccccaaaucagcagaauauacauucuuuucagcaccacaccacacuuauuccaaaauugaccacacaguuggaaguaaagcacuccucagcaaauguaaaagaacagaaauuauaacaaacugucucucagaccacagugcaaucaaauuagaacucaggauuaagaaacucacucaaaacugcucaacuacguggaaacugaacaaugugcuccugaaugacuacuggguacauaaugaaaugaaggcagaaauaaaaauguucuuugaaaccaauaagaacaaagacacaacauaccagaaucucugggacacauuuaaagcaguguguagagggaaauuuauagcacuaaaugcccacaagagaaagcaggaaagaucuaaaauugacacccuaacaucacaauuaaaagaacuagagaagcaagagcaaacacauucaaaaacuagcagaaggcaagaaauaacuaagaucagaggagaagugaaggagauagagacacaaaaaacccuucaaaaaaucaaugaauccaguagcugguuuuuugaaaagaucaacaaaauugaugggccgcuagcaagacaaauaaagaagaaaagagagaagaaucaaauagacacaauaaaaaaugauaaaggggauaucaccacugaucccacagagauacaaacuaccaucagagaauacuauaaacaccucugugcaaauaaacuagaaaaucuagaagaaauggauaaauuccucgacacauacacccucccaugacuaaaccaggaagaaguugaaucccugaauagaccaauaacaggcucugaaauugaggcacuaauuaauagccuaccaaccaaaaaaauuccaggaccagauggauucacagccaaauucuaccagagguacaaggaagagcuuguaccuucugaaacuauuccaaucaauagaaaaagagggaauccugccuaacucauucuaugaggccagcaucauccugauaccaaagccuggcagagacacaacaaaaaaagagaauuuuagacuaguaucccugaugaacauugaugcaaaaauccucaauaaaauacuggcaaaccgaauccggcagcacaucaaaaaguuuauccaccacgaucaaguuggcuucaucccugggaugcaaggcugguucaacauaugcaaaucaauaaacauaauccaucagauaaacagaaccaaagacaaaaaccacaugauuaucucaauagaugcagaaaaggccuuugacaaaauucaacagcccuucaugcuaaaaacucucaauaaacuagguauugaugggacauaucucaaaauaauaagaacuguuuaugacaaacccacacccaauaucauacugaaugggcaaaaacuugaagcauucccuuugaaaacuggcacaagacaaggaugcccucucucaccacuucuauucaacauaauguuggaaguucuggccagggcaaucaggcaggagaaagaaauaaaggguauucaauuaggaaaagaggaaguuaaauugucccuguuuguagaugacaugauuguauaucuagaaaaccccauugucuccgcccaaaaucuccuuaagcugauaggcaacuucugcaaagucucaggaaacaaaauaaaugugcaaaaaucacuagcauugcuauacaccaauaacagacaaacagagagccaaaucaugagugaacucccauucauaauugcuacaaagagaauaaaauacuuaggaacccaacuuacaagggauaugaaggaccucuucaaggagaacuacaaaccacugcucaacaaaauaaaagaggacacaaacaaaggaagaacauuccacgcuuauggguaggaagaaucaauauugugaaaauggccauacuucucaagguaauuuauagauucaaugccauccccaucaagcuaccaaugacuuucuucacagaauuggaaaaaaacuacuuuaaaguucauauggaaccaaaaaagagcccacauugccaagacaauccucagccaaaagaacaaagcuagaggcaucaugcuaccugacuucaaacuauacuacaaggcuacaguaaccaaaauagcaugguccugguaccaaaacagaaauauagaccaauggaacagaauagagcccucauaaauaauacuacacaucuacaaccaucugaucuuugacaaaccugacaaaaacaagaaauggggaaaggauucccuauuuaauaaauggugcugggaaaacuggcuagccacauguagaaagcugaaacuggaucccuuucuuauaccuuauacaaaaauuaacucaagauggauuaaagacuuaaauauuagaccuaaaaccauagaaagccuaaaagaaaaccuaggcaauaccauucaggccauaggcaugggcaaggacuucaugacuaaaacaccaaaagcaauggcaacaaaagccaaaguagacaaaugggauauauuuaaacuaaagagcuucugcacagcaaaagaaacuaucauuagagugaacaggcaaccuacacaaugggagaaaauucuugcaaucuacccaucugacaaggggcuaauauccagaaucuacaaagaacuucaacaaauuuacaagaaaaaaucaaacaaccccaucaaaaagugggcaaaggauaugaacagacacuucucaaaagaagacauuuaugcagccaacagacacaugaaaaaauguucaucaucacuggccaucagagaaaugcaaaucaaaaccacaaugagauaccauaucacaccaguuagaauggcgauuauuaaaaagucaggagacaacaggagcuggagaggauguggagaaauaggaacacuuuuacacuguuggugggacuguaaacuaguucaaucauuguggaagacacuguggcgauuccucaacgaucuagaacuagaaauaccauuugacccagccaugccauuacuggguauauacccaaaggauuauauaaaucaugcugcuauaaagacacaggcacacauguguuuauugcggcacuauucacaauagcaaagacuuggaaccaacccaaauguccaucaaugauagacuggauuaagaaaauguggcacauauauaccauggaaaacuacgcagccauaaaaaaggaugaguucauguccuuuguagggacauggaugaagcuggaaaccaucauucucagcaaacuaucgcaaggacagaaaaucaaacacugcauguucucacucauaggugggaacugaacaaugagaacacuuggacauaggguggggaacaucacauacuggggccugucaugggguauggggaggggggaaggauagcauuaggcgauauaccuaauauaaaugacgaguuaaugggugcaggacaacaacauggcacauguauacauauguaacaaaccugcacguugugcacuuguacccuagaacuuaaagucuaauaaaaaagaaagaaaaacaauguguucagaaaguauguaauaggauggcuuuaauuugacauuggaaauggaaacccuaaaguuaucuaaaaaacuaucucugcauacugauuagaagauguguuuagggugaauuauuuaaaaauuguaaaacaacauauaugacuaggauccuaucgaaaaaauuguauuuacauauauuuauucuugcaagggaaaaguucuuccauaaaccacaccaagcuaacagcaguuaucuuaggaaauaggauuacugaagauauucauuuucuacauuaggcuuuucuguaauauuugaacguuauguaauaagcauaccaauauuuuuguaaucaaaaaaaugauauauaaauacuacaggucuaugcuagcauucggguuuucgcucuuuaacuuaaucauguauagccuuacucagguuguuagcugaggaaccucuuaacugacugaaacaacuugcagguacagcagagcaucagaauauuucucuuuguacaagcacagaugugaaauauuaugaugguacacuucaggcaauuugaugaucaugcuguuuuuaguaugugugugcguguggugugucugugugugugugugugugugucuguguguaugagaaugagugggcuaugacaaaaauguucauaagagaaugagaucugaacaucgguuauggagaggauuucaaaaauuuguggcacaauaaaaauacucugggcagcguacaguagcucaagccuguacucucagcacuuugggaggccgaggcgggcggaucaccugaggucaggaguucaagaccagccuggccaacauggugaaaccccacaugcaaaaauuagcugagugugguggcgugcaccuguaaucccagguagucaggaggcugaggcagaagagucgcuccaaccugggaggcggagguugcagugagccaggaucgugccgcugcaguucagccugggcaacagagcaagacuccuucucagaaaaaaaaaaaagaauuaaaaaaaaaaagaauaaacauacucugaaaggcuaguuuuuagugugacagauauuguuuccaaaugauauuuucauucaucacaaagauguaguuggugguuucacaaugaugucucagucuuccuaccuccuuacuaugauauuuucuauuuacuuuaaaauucuccuuagaaaaaaagagugaguuauguguguucuuuucuuuaaaucccacugaaggagcaguuuauugccuuaaucaggaauucacacccucauggguggucacaaguuuucccccauaaaagucacacaguagagguggccaguguaaaugcuccuagguauauuucaauuaacaucaggggcuuugcauaacaaauauuagaaauggcuuuucauuggugaaauuguuggccaguuaauuaacacaacggaugauucaugggugaaaauacugauauucaacauuguggaugggcuaaaauauuuuagagauacugcccacgauuauaugaagaacaaaucauauagcuaugccugaggccuggauccuuagggaugguacgcgaggucucagcccuaaaugcucugugccccgagacugagaugcagaauuucugccugccugaucacucccauaagguaacaauccugccucccaaaggcagcagguuuaccucaagugcuccuuucaugcaagcuauuguucagagcaccuauuaggacaggaaacugagaauccaucaauacauuuuguugagaauuucuuuccuuauaauuguuagcaguauaguaagagaguagcugaagcucuccuaccucaaacauuuugguagccacuauuuaucugucuuaucuaucuaucuauccacccaucuauuuauccaucuauauuuaacaguugcacauaaccaaauuggcaacuagguuauuuuucaacacuccuauuucuaaacaaacaaacaaaugaacgaaaauuaaagcacauaugaaaagaagucauaaugaucuuggcugagaauggaguggauugauugaccugugugcauuuguagagguguaauccuucuguaaauaaagccaauuuagaaaccuuggcaaaguacccuagcacagggauuggucuugcuuaagcaauaaacauuuucuggaaacacaucugacuucucucugagcuacuuauccagauccacaaaccacuggaugauuucaguucuuauuucaucugaucucccugcauguguuauugcugacaauuucuuuuuuccugugacuccacccuucuuguucuucucucagcugccugacuauucuuucucaguuuccuuuuuuggcucccuuucuuaguugcuccccuaaguucugcugcuccccagaauucuauucuuugcuaucuuccuuucucuccuugggcaaucucaucaauucaguggcccaaagagccuuauuuauauauggugugcugcugcacuccagaucuauagcuauaucccuaaacccucucccacacuccaaacacuuauauaaaaccauucacucugccugcaugcccucaaacucaacuugucccagacugaacuuagcaucuuccccaggguugcucaccucccacauuaauuauguuccaagcaaugccaacucuaucccuuaguuauuccucaucugucuccacacuuccucaucccuaaugccauaagcccuaguucagacacucaccaucucuucacuggauuauuuuuaaggaugcucucugccuccauuucaccucucucucuacuccagucuccaugcgguuuuaguuggaucuuuaaaguacauaaaaucauaucuccuuauuuugccuucagcauaaauucaaacuuucuagcaaggaggccaauggcccugcuaggcucaauauagcuaucaucaucuccauuucucucugucuggaauuucuauuguaccacaccuccuacccuuccuauagacauaauguccaauacaucuguaauuaaucuuuguucaagaaaagaauaaaugaccagauuuauuucaguggauuuaaaaauauauacaaacuauucuccauucauuucccauggcuauuucaggaauaguccugugcaaaaucaaaaaacccuucauuuaucaggggaagaaacguagccucagagacuauaaguaagcaaagucacacaaccagaaaugaauacgauggaaugagaaucagauauugagaugcccacccuagaacacaggagccuucagaugccagcucugcuuuuucuaauugcuuaucaguuggcacugggaacaugcuuaaggaggaagccucagccuuucuccagaccagcuucuguuaauacaucagauggccaugaaagaaugagcucugcauuuagaggaaaucuaucaugcucaaauuauuagugauucauaaaaaaacaaauugguuuaucaauucuaauguuuucaggccaaaaccauaucaagcaaaugugacagacuuucaagagcauucaaaacaccaccucagagugggagauguaggggagggagggacaaccagaaucagaaugaguacaagaugcagguaacacagaugauagaacaggaacauagaaugcacucgcuucucccugcccgcacuauauguagauaccucuucucucuuuucaccaugcaaaacuguguuuuuguugcuucuccacagaagcuuauuaaacacuugaauuucaaaauugaucaugucuuguuaaagaacauuggaugugaugugauagcaucuuacaaauacaaggaucuucccuauaugugcaagucauauauucaguuuagccccaaauaaugcauaggcuucaaauuguucuaaucccacugugugugaguaccucuccccagcaaggcuaugccugaaaucaaggauuccuuggggucuacaugauagugauguuuacauaaggguugggaacacaaugguguucuaaaaauacacauucuauucuaaagaauccacaucuuaaucuguagugacauggucggaaaaguucaggucuacauucuguaaugccgugagacaaaaauaauaauagauuuccauaugauuaaggagaauaugcugauaauuauggaaaaaaggcaauggugagucagaguauuauggcagcugugaaaagaaaacacaugaaauggauuaccaugacaagaaagcugaacaaaauauaauucauuguaaugugaaaggcuauaucuaaagucacuugaugaucuauauaaagugcuuuauaaauauguuuuaaaugcauuguccugaaucaauuuaaaaaacuuuuagugucaguuguuauauucaagaugucagaacuuuggauuuuuaaacaaguaucucuuuuuucuuggauuacaaagaaauaaaauacugcugacaugagaaacaauuuucucuuuugaaacaaucgcagucaccuucuauuugaggaguaccuuaagacauacagaagaguuucaauagagaagguuuagcaaucuggaaaaccgcaagagaggcaguaaguuaacaccaaaagcaaacaaaaaagaaacucaugagcauccaauaucaaccucaggaugacacaguguuaaauguguguggucauuugcugauugaaauauauuccugcuaaagaagaaaauuguuucauuuaauucaguuuucagggaaauuuuucaccauaaauuauccaucuucuuuaccuucugaaaugaauuuccuuuaaucuaaauaaaucuuuaucugcugccucuggaccgucagugucaacacuaauuauugugcucuuuaucaugcagggacaacagggagagcuauugagaaagcuaaauaucugcuguuauuuuuauucccuggaucuguugguuuucaaagagguuuuuuguucaacuguuucauaguuucuguguguaugguuuuuuuucuuuuucauuauucagguguugggggucacauuuucccugggaucaaaauacaauccuucaaauaacucucuaccuuuuagguuugguuauugcuaauuguccaggaugucagaaagccaagaauaucagaacugaguguaugauaugguuaaggcucuauguccccacccaaaucucaucuuguagcucacauaauucacauguguuaugggagggaccuggugggagaugauugaauuaugggggcaggucuuucucaugcuguucuugucagagugaauuugucucaugagaucugaugguuuuaaaaacuggaguugcccuacacaagcucucuuucccugcugacaucuaugugagaugugacuugcuccuccuugucuuccaucaugauugugaggccuucccagccauguggaaguguaaguucauaaaucuuuuuuuuuuuuuuggaaauugcccagucuuggguaugucuuuaucagcagcaugaaaaugaacuaauacaguaaauugguaccaguagaguggggcgcugcugaaaagauacccaaaaacauggaagcuacuuuggaacuggguaauaggcagaaguuggaacaguuuggagggcucagaagaagacaggaaaaugugggaaaguuuggaacuuccuagagacuuguugaaugucuuugacaaaaaaugcuaauaggcauauaaaaaauaagguccagacugagguggucucagauggagauaaggaacuuauugggaacuggagcaaaggugacacuuguuauguuuuagcaaagagacugguggcauuuugccucugcucuagagauuugugaaacuuugaacuugagagggaugauuuaggguaucuggcagaagaaauuucuaagcagcaaagcauucaagaagugacuugggugcuguuaagcauucaguuuuaaaggggaaagacagcauaaacguuugggaaguuugcagccugacaacgcaauagaaaagaaaaucccauuuucugaggagaaauucaagcuggcuucagaaauguguauaaguaaugaggagccaaauguuaaucacuaagagaauggggaaaauaucuccagggcauguuagagaacuuugcggcagccccucccaucacaggcccagagguuuaggaggaaaaaaugauuuugugguccgggcccagggucccucugcugugugcagucuagggacuuggugcccugugacccagccacuccagccauaacuaaaaggggccaugguauagcucaggcuguugcuucagaggguggaagccucaagccuuggcagcuuccacaugguguugagccugcaggugcacagaagucaagaauugggauuugggaaccuccgccuagauuucagaggauguaugaaaaugccuggaugcccaggcagaaguuuguugcaggggugggacccucauagagaaccucugcuaaggcagugcggaagggaaauguggaguuggagcccccacacagagucccuacuggggcaccaccuaguggagcugugagaagagggccaccauccuccagaaaccagagugguaacuccaccaacagcuugcacugugcaccuggaaaagcugcagacacccaaaaccagccugugaaagcagccaggagggaagcaauauccugcaaagccacaggaguggaggugccaaagacuauaggaaccuaccacuugcaucagcaugaccuggaugugagacauggagucaaaagagaucauuuuagagcuuuaagauuuaacuacccugcuggauuucagacuugcauggggccuguggccccauuguuuuggccaauuucucccauuuggaauugguguauuuacccaaugucuguacccucuugguaucuaggaaguaacuaacuugcuuuugauuuuacaggcucauagguagaagggaauugcuugucuuggaugagacuuuggaauguggacuuuugaauuaauacugaaaugaguggagacuuuggagggcuguugggaaggcauaguugguguugaaaugugaagauaugagauuugagaggggccagggacagaaugacacaguuuggcucuguguccccacccaaaucucaucuuguaguucccauaauucccauguguuaugggagggaccaggugggagaugauugaauaauggggaugggucuucccaugcuguucucaugauagugagugggugucaugagagcucaugguuuuaaaaacaggaguugcucugcacaagcucucuuugucugcugccauccauguaagaucugccuugcuccuccuuuccuucugccaugauuguuaggccuccccggucacguggaacuguaaguccauaaaccucuugcuuuuguaaauugcccagucuuggguaugucuuuaucaugagugugaaaacagacuaauacagugugauuugcuuuaaggagaggcuuuaaaaagucuuuaaaagccaauacaaucagcucagggcuuacagguagcuuugucuuuuucuuuuuuuuuuuuaaaucucuuggaaacaaaguucuuugcuccauaguuuauggcugguuugauuauuaguugagcuuugugcuauuuuaauuaauauacuauuuuuaauauggacauuccaaagugccuuauaauauuuucuuaauggaaauauuacugaguuguguaaaagagaugaaagggaagucaauaucacugauuaucaagguuugcuauuaaugcaaaugaauucuggauucaacccauuuuucuaccuaugguauggucaaucauuccaaaugacagccaauaggggaagccuucccugcuaccaaggcuggagugguagcuccuucuguguguuccugaaucuucuucuaaucuguaugguugccuguaccacauuuuauuacaauuuucuguuuaugugucggccucuccuuucagacugcugguuccuggagacuagaauugaugcuucaguguccuggagccuauuucauacaggugcugagcuaugucugggugauuaauuaauucaucaacagauacagguacauacagguuuaguaauaggaaaagaaauuaauacagagcagaucaagcagggaaagagggaggaggagagaagacuuauagucauaugcauauucugcugauaaugaaaaguaaacauaaacaaggcuaggcagcaucaguugaagcuaguagggaaaauaaaaugcaaaaaugcaguagaguaugagaagggugcaggggauaagaauguuuuccuugcucaguugggguggugaagggaguagauaauagggauaaauuaggcccauuaaaauguagcgagggcagcagauuaauguuuucuccaaaaagguggcaguccugagaucauucuuuaauuaguguuuaacagagaaaagaaaauugggcaauuagaaaaauaacaacaacuaggcaaaaacaucuccuguuaaaaggcucaggaagaaaaggaauauacauuaacuacaagauuaguccugcauguugaaacacugggaaaccuggcauguuugcugaacacuuuaccaugauuagaaaaagaauuauuguggccgggcacgguggcucacgccuguaaucccagcacuuugggaggccgaggcaggcggauuacgaggucaggagaucgagaccauccuagcuaacacggugaaaccccaucucuacuaaaaaaauacacaaauuuagccaggcaugguggcaggcgccuguagucccagcuacucgggaggcugaggcaggagaauggcaugaaccugggaggcggagcuugcagugagccgaguuugcaccacugcacuccagccugggugacauagcaagacucugucucaaaaaaaaaaaaaaaaaaaaaaaagaaagaaaaagaaauauuguggauacgauaaaacaugcccaaauauucuuaaauaaaagacugauuugccucauuuuucuucuuugggaauguagucaggccuccuuaucugugaguuauacacccauggauucaagcaacugagcauuaaaaaugucaaaaauauacaaauuaaaaauaacaauacaauaauaaaaauaauacaaauaaaagacaauucaguaugauaacaauuaacauagcauuuacauugcauuagguauuuuaauuaaucuagagaugguuaaaguaaaugagaggaugugugcagguuauguguaaauacuaugccauuuuauaucagggacuugagauugccauuuuauaucagggaauugauucagggguccuggaaucaauuccccgugaauacuuagggaugauuguauaaucuuuguuacuuccucagguaucauggaucccaucccaagacacugagaagguacaggaaaaaaaaaaaccaaggcuaucagguuggcaaaaacacucacucacagccaggcaugguggcucaugccuguaaucccagcacuuugggaggcugauguggguggaucaugagguuaggagauguauaccauccuggccaacauggugaaaccccaucucuacuaaaaauacaaaaauuagccgggcgugguggcaggugccuguaaucccagcuacucaggaggcuaaggcaggagaauugcuugaacccaggagguggagauugcagugagccgggaucacgccauugcacuccagccugggugauacagugagacuccaucucaaaaacaaacaaacaaacaaacaaacaaacaaacucacuuuaauauguccaugcauagguuuauauaaaauacaaauguauacauauacacacuauucucauacaaaguaguauggugauuuucccugaacuccagauaucaauuacauaacacagcauaaugauagugaggaaggccacugauuuagaaauuaaagagcuuggguuuauauucuagguucaucccuuccgggccucaugaacuuuaagcuagucgucuaaagcaauucagagucuguuucucaucuauagaaagggaauaacagagucugccuguggaauauuauauauaaaacauaugauacauugucuggcacaaggcaaauuacucaauaaaugcugauuuucuuucuuucuuuucucaagggucaaaaugggaaaguggugccgauucaauuuucuucuggagcauuccuacucucccaaacaguuggguagccaaggauagugaacuggcugucgaguuguuucaaaugucuccaaguaucuaaguguguuagcuuucugguuguaucuaaggaaagucagaaacauaggugccuaggagagagucaggugagcuccuggugaaaccuccugcccucugcucucccugagagagagagaacaggacauaggcagaucucacacaauuccugguuccacuuuaguuacacuuuuucuaaguaggucaggagcuaauagcccuuucuucuuuaugaugacauaccugucuucuggaagcacauuuaaguacauuuaaucucccuuuacuauccugaccagcacuuugucccaggaaggaucaagucuaaacaaauacccaccuugugcuuccacagagguaaccaugauaccuaagauuggucagcaaggugguucaagcuacuuugcauucuucaaauauuuuucucugccuuucuccuuugaaauguacugcccuuucccucauucuggcucucaccucccaugugcuacuccugcucaggcauuaaucuggacaaacuguuuaugacagcugacuuauuaacagguuacuacccucaggaauauuugcauuucuuuuggcugaaauauucaagacagagaugaucuuagaaauggugauuauacugccauauuaaaaagaaugugucacagcacacaaaauccuaaagauccuuaaaacccucuaugucuuaacucucuucaauuucagggaucaugucuucaaguugcucaccacauagcuagaacagacaauugaaaauauauggcagugauugccuugaauuuucuaaauuaaagaguuuagcacuguuccuaucaacuauguacugcaguucuuuuuuuuuuuuuuuuuuuuuuuuuuuucugagauggagucucacucugucucccaggcuggagugcaauggcacaaucucagcucacugcaaccuccgccuccugggucccagugauucuccugucucagccucccaaguagcugagauuacaggcaugcaccaccacacccagcuaauuuuuuuauuuuuaguagagacgggguuucacuauguuggcuagguuggucuugaacucuugaccucgugauaugcccgccuuggccuccaaaugugcugggauuauaggcaugaaccaucaagcccagcccuaugcacugcaauucuaaaggacaguuccacucauuuaaggaaacaaaacaaaacaaaacugacguugggcauaugagaaauaaaucaguaaacacaauaaugagcaaugacaucacgggcaauaagccucaugaauauagucaacauaaauccucuuccaagcacuuugggauaggggucauaaaauuaguaaauucggcaaugaaugguguuucauauuucaacuucaggagagaauauacuguucugucuuguggcauuucacuugcaaauuugauucuaauuugauugguuaaaaacagucucacacauugaauguugaaaagcacacuguuaaaaaaucagacuaacuggcaaucucauaaacugaagagaggugaauauuaugguuuauuaagcauagguuagauguauccaacaaagacacaaucccuugauaauaaugcuuuauauuuuaugagagcuuagcuuucacuccuuucacuaauuuaacugcauugauacuaauuucuuucaucuucucauagacauuauuguccagaauuuaaucacuuugaaagcaaucuccuuucuguagucccauguuccuauaaaucugaaagagcaaagaccucaaacaaggguaagagcagaagacaccccugacguaacuggugagcucacuuccugaggcguccuuaggugcucuggugucauacuugaauuuuaacaauggugacucuaucaugggcucacuaccagcuccuccuccauuggaguuuauuguuuuuacccagauuuuuucaugugcaugaggggugauacaaaaccccaaacucugguucuaaagcaucaauccuuuucuaaauguuuucuuauauugugagcccugcuaguauuucagagugacuauugccacagucauaaauguucaguggguaggauacauggggaagugggauguccaugagucuauucacauuguaaguugggaacuuauuuucucccaagcucuagaccaaauaauuuagguaguagcuaccacucaaguagggaaugcuugggcucugccuaaccaaacaaacaucucuaggcuacaaaaagcaaguauggauacuagcuuaugacucaauuacugagacuugucuacaugaagauaauuccacaucagugugagagacugaaggugagccugacuggaccgagaaaggcugacacacacaucaagggucagguuggcacuuggugauggcucuacaguaguuaucuguagagaggauggagaaguuugggcaguagaaaaugaauguucugaggugggagagcacagacuugggagucaaaaagauucggaacauaauucuggcuucaucaugacuaguuuuaugacuuggcacaaaucacuacauguuuaucaucuccauucuuguaagaugggaauaauaacaucugccuuauauugagacuguaaggauuugagguaauucaugcugauuucuugguacauaagaugugacugcaauaaacaauaauuauucuuaguagaguagggaaagaagcgauacauuauaauccaagcagacaaucuguucauuuaauaguuuaaacaugaaguccacaaaccaaccuacucuacaagugaaucaauuugcuaagauuuggguauccaguggugaacgaugugagucugagcccugccuucacagauccuacuaucuaagcagccauuaagcaaguaagacaacauaaauaauugacuacagauugugaaaagugcucugaauagagaucucauugggaaaauaacagaguguaccaaggaaauaacauauucacagagaccugaaagauggguagguauuaccuuuaagagcuuagaggggaaaggaggcaagagauggaaaauaguacgugcaugcaauauacagaaagaaaaagggcagcggguuugaagauuaaaagcagucagugaauaagagacagaauggcuuuggaggauugggcacaggcaagauuaagcagggacuucaagaaucacauuaaagaacuguuuaaugcacuggaaagccacuggaguaguuuugagcagagaugcugcaugauccaauuuacuuuuuaaagugaucuuucguauugggguggcuggcaaacgagagaacagaaaauuauuguaguaguucagagacagauggugaugacuugggccaaaguguagagaacggcuucauagaaguccaggaagaaguaaucauuggccauuccagcagcuagguaaaacuuuucagcaggaaacucaaaauuauccaauaaaaagggaaaucaaagcagaagauaguaggcauuuaggguuguugaaaauuggcaauaguuccacugcugaguugguauggguaaagcaaaauaggaauucauuuucuauaaaaucugugcagugccaagagauuaaaauagggccuuaguugugacaugcaaguuucugugacuacagauaagguaggacauggacgcugaaaguuacgagguaggggcacaaggucacaggaaauagcauaguuugcucauguuugccaaagcugaaaugauggcuggcaaugcauuuaauauccuauaacuaggaauaggaucagucucagacacuaggaagagcugaacuaacagaugaaagcuaugagacccaaccuuaggaccuagcuguccccaggcagcaacaaagggugauuguugugcuuuauuaacuuaauuuggguauauguuuuuuacagucucccaguaagaaaaaucuauaauuacaugcauuuuacaaaaaaagauguuaggucagguaaaaugacacauucaaagacauaauuucacuacccugccacguaagcaaaauaucacuuaucuauuuuuaauauaaugguauuuuucauuuacuguuugauagugaugcaaauccacugucucaggacuauagagagcucuggcuauuaaaagauguggaccuugucuuuucuacaguuugguuugugaccugcgguucccaaugcaacacuacuucucaauuucuugcccucaagugauccuccugccucaccucccaaaauucugggauuacaggugugagccacugcaucuggcauaugcaauaucaaguggcuagcaagauaaugagcaaugucuuucaugucauuccaugaauaucaggaagcaaaaacacauagguuuucuacuuguuuguuuucaaaagcaagaaucuuucugaauugcuuugcauuuuuaauguccuaaaucauauugcuucuauucuaaaaaaaaaaaaaaaaaagauguuuugguuuuccaccaugggcuuggauggaugauuaaauccgauuaucucuagaagucauuaagggucaaucagaaggacuaaggauuaagauuggagugaggacuaagauuguaaacuuggacucgauuugucaaaauaaacaguucuauucuugcucacauggaauuguuuauuuuaccuuucaaauauguuaaaucaagauucacaaaccaaaauaucacaugaauauguucucugugcaguuugauuuuuuuuccccaggcaugaaaaucaaauuuacaaugcuaauauuucuccagaaauguucugagugguauacuuuucuucaaaugggcaacagauuugucugucuguaaacaugcuuauaguccuauuggaguacagaaaagaggcaggcauacggaauucaauauauagacuauaaaaccaagagaauacucauacauuagaaagcugucaucaagaacagucaacuguuccuuuacauaauugaguucaacaaacauuuacuaagagucuuuaaguaaagguccgcuaguugcugcaaggaaugaaaacuagauaaagcucuuguucucaaggaaauuaaaauacacgaagcaaacuaaauuauagauuuuuuucauuaaagccauuauuaggcagaaggaagaaaagguuugaauuuauguuugaauuugaauucugaauaucgcuuguucuucaaagcaggaaucuaaagucaaauaaagccuguguguauauauauacacacauacacacacacacauacauaaauguauauacacacacaaaaacacagauguauauagcaugauucaucaauugcaaauauauaauauauuaauagaauuaauuuauauaauuaauauuaauaaguauguauagugacacacggguauuuuuccucaaauaaauaaaaaaucgccugucuccucaaggguauaauagaacuccuuauuaccuaaucuuuuuuuacuaccuagagauauuugccugggucugguuuuaagcuauaauagaaacuauauauacagacauugagucauacacccacacaucacucccuaucccccaccacacaccugcauaccuuaguguaaaaaaaaaaacuaucacaucauguaaaauauaauuuugaaguuaaauuaugcuaagcuugucucaaauugaaaacauguugaagcacugcuaaacuuaguauaguugcccuaagaacaucucacauuaauuucucuguauuuaaaaaauggugauguccugcauuuaccauccacgguaucacugcucucuuggcaugacggcuuaaagccuccuaaucugaagcaucagcaugugcagggaguauuuccugauguaugccaccuuuaauaauuuaguauguugacuuauacuuuccacacaaauagaaugugucuuaacaguaguaaauacagcuacaaagcggugagaaauggcaauuggcugagggcacuaauuacacugccuugacuugaauuaaaauugcuaaacagcaaaugagauuaccagucuaaagauaaccuuaauuuaaaugccaagcugcauuuaucucaucuacaauguaauuuuccagagguguagaauaauacaauuuuaauggaaauccauuguuuaaaaauauaauuaaagucccuggucccuccccaccacaccuuuugauuuuguuuuacaggcaagauaugcagacugauuuagaggucagaaugaaaacauucagauccuguccucauggccagacaugacuuucaguaucaucuucauuuuuaaugauuaacagcuggauaugggaaaaguaaaugucaaaggggugagagguggaggaggaaaagaaaaugaccuucucuaauuccuggagcucuaaggaauguuacacaugauaagagcucaaaccaccaauugauuaaugagaaaacccaagacccagaaaagccaagugauuuuucuaaaaacacagagcaagaaagcagcacugcccagcagagaugcuggccugggauuuacagacagaaaaucuaugaaucccaucucuuuucuuauuaguucugugaaggcaacuuacuaucuuucagccucaauuucugcaucuguaaaauggagaagggaauaauuccaaucucacaggucagugagaaugcauacaugccugacuuacacaagugcucaauaaaagacacauuuuaucgucaaugacuucccacgaccagaacccaaauauaccgauugccauuucaagcuugcuucuauuacaccuacuuuaccuuucacuaacccaagacuaugcccauggucucaugaaucacaccaaacacuugauguacauguaaguggaaagggacaaaggaacaagaaauaauuaagaacuaauauuucucauugguugauaugaaugaacauucaguugauaguuaccaaugaacuauuauuacuaaaaacacuaagguuuauaagauaaaggucaaggguuuuuaaaaaucugcucauuuuaugaauaugaaagcauauaaacaaaacaaagcugaagguuagucacugagaauugagggacaguaauuucaauaugaaguuccucaaucaucaaugaccuacaauccuguauacaccuuacacacuuacaaucacucacacacacacaccacuauacacacucccaaaauacgcaucauaguaguuucaucauucucaguauggugggacugaguagaugcaugacugaguagauuauauuucugaggguaacaaagaguuggauucuuugaaaaguuuacagauuagugcacgggugcgguggcucgcgccuguaaucccaucacuuugggaggccgaggcggguggaucacaaguucaggaguucgagaccagccuggccaauguggcgaaaccccaucucuacuaaaaauacaaaaaauguggcuagugccguaacccuagcuacucgggaggcugaggcaggagaaucgcuugaacccaugaggcagagguugcagugagccaagauugugcccuuacacucuagccugggugacaagagcaagacucugucaaaaaauaaaaagaaaaaaaaagaaaaguuuuacagauuagcccauuuuaagauuuauuuuacuauucucauuaaucagagagaagaugaauaaauacuaaaagggaagacaagaaaucaagaagaaaggaaaacagaaaggaguuaaaucaucaugaccacugggcaauagagucuucuuuacagacaaucguauggugguuuuggcuaagguaaggcuugcgauagagugaaaacaacuuugaauuagaagaaagguguccuaguuucuaacuucagucuugccuguacguaguuagauuacauuugauaguuguuuaacauuucuucuaccuaucuauaaaauaaauaauuuuccuuaucagugugaaaaugagaugguuagaucagaguuccuccaaaguuaugucugcaauucugugauuccaugaauauucaccacugcagaccucaaacucuuuuugaagaugaaaaaucccauauuuucaauguauaauuuuagagaaaauucacuaaucaguuugaauuaugguaggaccuuucacuggguccuaaugcucugaauaauucuacuuucuagaaugggucaugacuagccaauuaaucaggauuuccuuaugucuuagcuuuaugucuaaaccuggagaaguaaaagauguccauguuugguuaucuuuaaccacacccuaaacucugaguuguuuucaguaaacugaacuaaguacuguuuguagaugaaaugccuuaaucaguauccauguagucaccaucauuuacacugcaguguugaaauauauacguaauaacucacucuucccuacagagauauauuaggcauuuuuacuucucaaauaauguuuuuuguuacucuucauauuuucaaguuucucuaaacagcacuugcucucucagucucaacuuuaagaugacucaagagacuacaucugaaguugaguauauacugagauuacuugauuuccaguuggaaaccagugaggagugaagaaaaaggugaagaagggaagaaaaagggcaucugaaugggaagaagugagacucacuugcucaucuaaauugaagucaaucuccugacaggauuugcagggauuacaucuuaacuaguccuuaguaccacuucuggcacacagcaaguacugaauaaauacuucuuggaagaaagagagauaguaaauaaagacagccaauaaggaagagaagacuuaauucaugcugggguuuguuggaauacugauaggaagugugaguaaaaucuuaccaaaguuuguuuuuuucccuaagcuaguuucauaucuccuacuauucugucuuauggcuuugucuucccuuuuaaaauauuggcaaauugcaaauuuccucagacaaggaaagcacaaaaguggucaucuccuggcaaaguaguccaggaaaaugcugucugauuuaacuuuuugaauaguguaaaauaugacuaugauagagaacauuucacugaggaaguuuaaggucaccauacauauaagacccuagcggucaaaacacuagaacagcugcagccuauuuuaaaggcgguggaacaaguugcacuucagaucauggaaaucagcugucucgucuccucccaggacagcucauaggauaaagaauaaucaacagcaacgacugaacagccagcugccucagagauggacauugcuguugcaaaaggaaucccuauaauuuagaaauuaagaaaccauaagagauggcauucuaaguugaagagacuucacaaaauacucaaacaggaguuuaauaugggacuguauuuaggccagaaaccauagaagccaggauauuaccuuuugcaacugaccucaguagucaaaccaaggggccacauagaaggguaaaugcaccugauagcaaugauuucagcauacccuuagaauaacccuguauggcagaugcaccucaauguguguuuugagcuacagauucugggaguggccaacccugagauuuguuucuuauauauaauaaacaucugaacccccggcccauccuguggaacaugggccauacagaggacugaggcccugaguuuugggguaaaugaagguugccagguggaguucauuacggggaaaguguuaacugaaaaugcuauacaaaccgcaugcuguuugcaggugguugaaguuuuccugcccaggccacugccacugagcgaugcgguuaucugguccagccugccaccacuggaccacuucugcagguaagaugguuuuccucuccagcccaccaccacuggacucucuccccuguaaucagccccuaguaaaaccccaugucacauuugcuggcucugggucuccuucaggcuuuugaaccaaagccuucccuguuaagguuaauagggguuaaccucauuaaccccuauuaaucaugauacugauggcuuuaaggucuaguuuuagagauucaguuucuaugugugcacacauugaaucucuaaaaccagaccuuaaaggcaucaguaauuagauuuuuuuuucauggauuuccccauucauguuuccucugaccucaaagucuuaguuaaguguaugcuuuucaugaaggaaugcucccauuuuaacaucuucugauuaacugaggauuaaacacacacacaacaaaacucucugauuuauccuuguuaguacaaaugcuuccuaaauauuugacauuauuacacuucuaccuggaacauuuucuuauggggaaauauuuuuuuguuuuauuguguguguguguguuuuuguuuuguuuuuuuuuuaacugguugaggaccuugucuagucaccucuagucugguauugugagguggaacaacgccacauaggcggcccaggcaugggccuggaagucuguguaggucuagguucuacaucuuugcuaauuuauuuuccuucccugagcuccucuuugcucccuuaggaaaauaauaggcuuagacaaugugauccugaaggcuacuaggaacucaaugcuacuguccuguggagggcaaacuuugacgauggcugccaaagucucaggaucccaugcugcagggaagaaugggauacaagauuuuguaagcauggagaaggaaucaaagaugugacuccaacuucucuuguggcuagcucagcuagaguugagaaguggaggcugacaagacacugacuucaauuaauaucagaagagaaucagcacucagcauuggcagaaauuucugaccaggcccaguacucuuguuaacugaggcagcuuauuaaaaacaccaccaggccaggugcaguggcucaugccuguaaucccagcacuuuggaaggccaaggcagguggaucaccugaggccaggaguuugagaccagccaggccaacauggugaaaccucgucucuacuaaaaauacaaaaaauuagccaggugagguggcaggugccuguaaucccagcuacucggaaggcugaggcaggagaagugcuuaaaccuggagaugggagguugcagugagcugagaucaugccacuguacuccagucuggugacagaguaaggcucugucucaaaaaaaaaaaaaaaaaaaaaaaaaaagugaccaccugcacaggacacaguagguuggaaagaguuuguuuuaguuagugcuuaugguaggcacucccccaaagauauccacauccuaaucucaggacccugcaaauguguugccuuacauggcaaaaagaccuuuucagacacaauuaaagaucuugagacggggagguuaccucgacuauccaaguggucccaauguaaaucaugagucuuugauaguggagaaccuuuccuagcugcugugaacaggauagacaacaguaugagaaggacuugucuuacugucacaggcuuugaagauggaaaggggcugugagccaaggaauuggguggccucuagaaguuguacaaggcaaggaaauggauuuucuagaggcucaagaaggaaugcagcccuguccacaucuuuauuuuaguccauugagaccauauuggacuucuaaucuccagacuaucagauaauaaauuuuuguuguuucaagccucuaaguuuguuguaauuuguuacagcagcaauagaaaacucauacagugccaccagcugaaaggauccagggacacucccaucuggucuuaaaacacugucacaaaaugggcagaggaauuugcuuaaaaagaaaaagaaaaacuaaaaaaucuucuuauuuuguaacuuuucucccuugcaaggaucuucacauucacauuuucuuaucaaaauucagucucaugagacaaccuaaaacauucccucuagacuagaaggauacaugugacugaugucagcuucaaauauucaauaugcauuuuagcauagauaaaaccuugaaauaacagaugaaauucgaaaauauugucuucaaagagcagccaguaauggagaaacaauagguugggggcacuggcuuuacucgggaucuuguaaacauuccacacaggcagguacaaacuucucuguccuucuggcuacaccaggacauccuguaaacuuuguucugaugucuugggaacauacucugucuaaccuauacaucuacaaccuuagcaauggaaucuuaggaagaaaaaaaagauacauaugguuguaaggugaggauaaaaggaguggaaaugagggauagaaaaaagcauuuuuuuuuuuuuuaguguuuaaauuucucagagauguagacauucaagguuuuaaaaauugagaggcaucugugauaacuauaagcaucauucucacuaucauucccaaccaucugccccucuuucucucuguucuuccucuacggauguugcugguuccaauuucccucuguuuuucugccuauucucugcccuuugccuuguaaaguucaaugguagcccaaggccuuacuuuauucuauuacugcccucguucuugggcugaaccacacaacccuuagaaauacaaacauguuuucuguaaaaaaggaaaggcccuauuuagaauagccguuuccacgggaaguauagaugagcaacauacguaguugauuuauaaaccaaaccagaaaccugugacagcacuuuguuauauagugugaauaaaacuuaacaaauuacuauuuaguugacuaucuucuacuguguacuauuuuucaucaccauaucuuucuucaccucccuccuccuacguuauaaauuagcaccauuuucuggcacuuuucagacacaacagauguaaugcuaucaacauucugauaaugcugaagucaccacgagcuccaggcauacuguuugcugccagugaucccauguuuuuauuauaaguuucucucuuuuucuaaugcauuggaccauaugagauauauauuacauagaaauguguguacuacaauaccaauugcagaaugggccauaaaccaaaaugagcaaauggaaacaucugcucaccuucaaaagucaucaaugaauaaauaauuuuuuaaaagcagcuggagcaagcaccauaauucaccaagguguuuaauaugcuauccaguguaaguucuagaugcaucaaccacccauagauuaguacugaggcaauauuccagcaggaacccuucuuuugcagauuucuggugaguugauuagugagacuuccuggugacuuuuguuuugcugaaagacuaucucaugaaauuguaggagacauaaauaagaaaaaaguguggaugugcagagagacaaaaauacauaaacauagauguagacacaauaaaaaaccugauuuaauuuaacucauaagaacuauaaagaagugggcuuggcaucaaagagguaugaacgaucaaaaucuucucuccaggccuccccacuggaaaugugcaaaauaauauuuacaaguggcaggaaaugagaaaaaagaauaauuaucaggcuaaaauacaaacaaacauuguuaauguguucugacauuuaacuaugagcuaauaauaaccaugcuuaugccccaccugccgugacaaucuacucaauccaccaaacacccagagccuauuuagaaaaguguccagggcacugaacucugcuguacuggggagggacaugcagacaugcaugcuacaguucgugauaucaaggccaugauaucugucugagaaggacaaaucacaugggccauuaaagauccaaacaagaaguuaaauagcaauggaguccuucuauacaugagcugcugcaauuuauuguucauuuuuaaaggagagacaugagaaauaaaguaaaaucaauaaggcaaugugucucuaggaguugacaguuuuuuagagugauguaugaaggcuccaacaucuuuauuuccagagugaagaagauaaugauggauacugguggcuuuccaauucccauaggauggggguggggugggguuggacuaaggacagaaguggcagaguuggccacagucuggcuuugccauccacaaagggagaaaggagagcaccagcuggaagcuaaucuccacaacaauuggcucacagacauuucauaaauguguucaacaucaacucuuacacucuuuuuuacuuauauggcuuauguugccagcagcugauguaagagaugacccaguggaaaucaugaucaugguggcauaaauaaaccaugugucaaucuaauaagaugcaaagaaccuaacagcuucaggauaagugcacuggcccagguucugcagccaauggcaaugcaccucucauauucucaguaacuucugugucaagugaaaaugguaggcagccauucaccaaagguuuugagaaaggaucauuuaacaugccgcucuuuaacaaaaaggacucaccgaacaaacaggauugagaaacacuccauuccauagacccuuuccacuuacaauuugcaaugcaguuagcaugcucaagacucugaaagguccugugauaaaccugacauuucacaaucuuuuagaacauuaaacccucauaacauuacuaccugccacagagaguuucugaaaugucucccagugauccccaccuccugguauucaugcuuuuuugcaauuccuuuuccugagugugggcuggacuuaguaauuagcuucuaaucaacagaauggcaaaagugauggggugucacuucugagauuacauuacaaaagacagugacuucccucuuguuacuacucccucucuugcccucugacucgcucagucugaugaagcuauauaccauguugcgagcugaccuacagagcagcccauuuggcaaggaacugagggugacuucuggccaacagccaguaagagacaaaauccugccaauaaccacacaaauuaacuuggaguggaucuucucugagugaagcuuuaagauuccuguagccccagcugacuugcagccuugugagacaccuuacaugagagaugcagcuaagccauacuugaauucacaacucacagaaccaggagauaauaaacccuguuguuuuaaaccauugaguuuugggauaauuuauuacacagcaaauagcagugccaauauacuagcauacagaagaacuaugcuaugggaaacugacuuuaggaugugcugauaggauguuuaagcauaggauguuucuugcacaucuuuuaaauaugugagauaaagccaaucauuggaaauuuuaaaaauugcauuagcgaagaaauuacauaagccuuuaaacaaaaugaacucaauuguuacuaaauuaaaaugacugagccaagguuugucuuuucacugucuauuaggaggguauauaaaacaaacuaaaguauagaaaagacaggcacacauucuucaagcacucuggauauaccccaauccauuggggaguucauugcacacuaaauccuauccacucaagcagguggucaaaauggcucuccuugaccacacauuuucagaccaguuuaagucuugguaugaaacucacaguauuaaaauuauauuucaucaauacuacuguuccuucuaguuggccccugauucaaacaugcuucaauucaucaaaacuauucugccacuauaaagcuaugauuccaucauuuauacucuuaccacugugaagcaauaugagaaugccaucaaagcccuaagcacugugauggugcauaauacaagcuuaauguuaguauuauuauuauuucuuuaucacacuuaaugaauauauaaauguauaaacaaaaauaaauaugcaucugucugucaaugacaugcuaaaauuaauaagauugauuuccuaauaaauauacagaauguacaaauacaaaugagcauugucuccuucaaauguaucacacugaagaacucacacuuuucuuaugaugcugucaucaguuagguuuuuuuugcauaauuuccuuuuaaauuacuuuuaaaagauaacauguuuugugguuauuauuauuauuauuauuauagccuacaaugguaaaauccaauuuuauuauccaucucauucaacauaauuuguucagaaugacuuuuaguuguucaaaaaacaaggcacaagcucacaaguugaugacuuguuaugauuuaagaucuccccaaagaugccccauacaaugcuuacacacacacacacacacacacacacccaagagcacacacuucuucuuacguuuaaucgcgagguuaaucgaaaacaaacaugaagucaaaguuguauugauaucuaaaaaguuaagugaagcaaaaaauuaaacaacaaucauuucuucuaaauaucaagugauuuacucaucuaaaugcauagggaguuaaagccauaaauuauuuugcaucugaaugauaauauacaaugugcuuuggcagaugaaacauuauaaacaacauccggcugcagugagcaauggaagaauguuuauugcauuaaaucaaacuuauuugucuggggcagcauugaacagaaggcgggcuuucaaguuuacccucccucaaaacacagauaaagaccauuaaaagaaaaugucauccauagaaaucugaauguaucaaagaggaauauuaggaaaauauucuuuuuacacagcauuuuugugguuuugguuugcuugcuuuccaucugccaaaaccaacuaugauuggagguaaaaauaugggugcuagcugugcuguaguaaaauaaguaccagguauugagucagaaaagaaaacccaagcugugccauuuauuugcuuuccuuuacugggccuccauuuccacaucuguaaacugaaaagguuccagucauucuaaucaagaucacuaccaccccugauugacauguagaaaaguguguaugcuggugagggagagguugguauuuuccgauaaauggugucuggggggaucuauugacauuuagcggugggaagcaggcagaauuuccaggaauaacaccaggaauaauaccaggaauaccauucagguuguauucuauguaaacaguauugacaagcauuuugcaguaugauaaugcuccugcacagcaaacuguccuaaccgaagugaucaugcuccuucucccuuugaauaacugguuuucuaaggcaccuucuaaucacacaugcaguggugcucagaugucaugccuuugggucaacgccuugcccuuguuaacccuaugaauaauggcauguuaaaguuuuucucauuuucucugacacagauagcuccuuaccacuguagggcuuuuucacucacuacugcuucugccuggaaaccucuguccucaacugcacauagcuggcuuuuucgccauaaaaauccagcucaaaugcaaugccucagagaggccuacuugggcaauccaacucuucuccugaggccauuuucaaucuaauccuuauuuucuaucacaccacccuauuugauuuucuucauugagccuauugugaucugcaauuuuucucauguauguguggguguuuuuuguuuuguuuuuguccuuccccaucagaaugagcaugguaugugugaugauuaauguugagugucaacuugauuggauugaaggaggcaaaguauuguuccucagugugucugugaggguauugccaaaggagauuaauacuugagucaguggacugggagaggcagacccaacauuuaauuagcugccagcacagcuaggauaaaagcaggcagaggaauguggaaggacuagacugacugagucuucuggccuccaucuuucucuugagcuggaugcuuccugcccucaaacauuggacuccaaguucuucagcuuuuggacacuuggaccugcaccuaaaccagugguuuaccaggggcucuugggcuuugguuacagacuaagggcugcacugucugcuucccuacuuuugagguuuugugacuuguacuggcuucuuugcuccucagcuugcagauggccuacugugggaaucuaccuugugauugugugagccaauaugccuuaauaaacucccuuucauauauacauuuauccuauuaguccuguaucucuagagaacccagacuaacacagauguugucaccaagagugguucuagaggaacagaauuuuaaggauggaguucuuuaguugauuugggggcuucuggaguuggcugcuuaauaugauuagacaaaaaaugcuaaggacucuacuucuaauagcauggagaacacugauaguccuuggcaugaacuguuuagacaguuaugcaaaauaaauucauuugauacuccugauucaccauuugugaguggcaaagaauacagugacucuauacauaauaccuuugaccauacguggagaaccaaggaauauaaugaaguugguugccuaguucacuagacaaagugaugaaagaaaaugaugaacucggggauucuagcucccagcuucagaagcacauacugagccucaaaucuuccaagauuacccugagucuuaucuccuguagagaaagagcugaaauuguggaaaaucagacacaagcucuugacaugugaguggcugaccugaaaaaaggugcacagguagccucaauaggugucuacuauuaaagugagggcauugauuggaaaagaaugggacccugcaacuuggaauggggaugugugggaggacccugaugaggcugugggcaccgaacuccuaaauucugaaaagucucuucugccagaggaaacagccuucccacccccagugguggcaacaucuccuuccccacccaugcugccaucagccuuuccaccuuugucagagauuaauccuguacugccugagacaacagugauggccuccccugaggcaguugcuaggcaagacaaugcugauucuccuuaggacccaccccaaaccuguuugcuucuagaccuauaacuaaaguccuggcaagccccuagaagugagguugagaguguaacccaugaggaagugcacuacacuccaaaauaacuccuugaguuuucuaauuuauguaagcagaaaacuggaaaacaggcaugggaauggauauuaaggguaugggauaaugauggaaggaacauaaaguuggaucaggcugaauuuauugauuuggguccacuaagcagggauucugcauuuaauguugcagcuuggagaguuaaaaaaauggucuaaucguuuauuugcuugguuagcugaaauacagaucaaaagccacugugagcaagcugcaaaugccugcucuccauugguuuaauguagaggaagggaucaaaaggcuuagggagauugggauguugggauagacgagucaauuuagacuuacucaucuuagcugggaggguccagaagauauacccuuuaacaauacuuugcaaaauagauaugugagagcaggaccugcauccuugaagggcucugugauugcucuucucuguauggcagaucuuacaagaggaaccgcagucacucaacuacaaaauuuaaaugcaacaggaauaguuagauccugagguggcagaggccaaauggcagcacucaacugucaaaggcaaggugggcauaguuaccguaauggacagcagaugcaaagcagcaaucagaauagucugacucauguagagcucuggcauugucuaauuaaucacaguguuccuagaacugaaauugacagcaagcuuauugcauacuuauuuaauuuauauaggcagaaaacugccaggucgagugaacaaaaaacuaauuugaauuauaaaaauagagaaucauggugucucaaucaauuuccagacuugaaccaguuuacaaacccagaaccccuugaaugaaggagagacuggguccccuugaggaaagaccccacuauacuauugauaauuuaugcuguuaaucuuucucccauccuugcccaaggagaucuccagccuuuuaccaggguaacugugcacuggggaaagggaaaugaucagaacuuucggggacuacuggacccuggcuuugagcugauguugauuccaagggacacaaaacaucauuauaguucuccaauuaaaguggggucuuauguuugucaaguaauuaaugaaguuuuagcucagguccaacuuacaguggguccagugaguccccagacucauccuguggucacuucuccagugccagaaugcauaauuggcauagacauacuuaacagcuggcagaacccccacauuggcuaccugacugguaagaugacggcuaguauggagggaaaggccaaauggaagccauuagagcugccucuaccuagaaagauaguaaaucaaaaacaauauugcaucucuggagggauugcagagaucagugccaucaucaaggacuugaaauaugcaaagguggugauucuuggccgggcacaguggcucacaccuguaaucccagcauuuugggaggcugucgugggcggaucacgaggucaggagaucuagaccauccuggcuaacacggugaaaucccuucucuacuaaaaauacaaaaaauuagcccggugugguggcgggugccuguagucccagcuauucgggaggcugaggcaggagaauggcgugaaccugggaggcagagccugcagugagcugagaucaugccacugcacuccagccugggcgacagagcgagacuccgucucaaaaaaaacaaaaaaacaaaaaaaaacuugaaagacauggagguggugauucccaccacauuccuguucaucucuccuauuuggccugugcagaagacagauggaucuuggagaaugacaguggauuaucauaaguuuaaccaaguggugacuccaacugcaucugcuguaccagaugugguuucauugcuugagcaaauuaacacaucucuugguaacugguaugcagccacugauucggcaaaugccauuccuuuucauaaggcccaccagaagcaaucugccuucagcugucaagaccagcaauauaccuucucuguccuaccucagggguacaucaacucucuggcauuguaucaugaucuuguucacaaagaucuugaucgcuuuucccuuccacaagauaucauacugguccauuacauugaugauauuacgcugauuggauccagugagugagaaguagcaaauacacuggacuuauuguugagacauuugugugccagaggauggaaaauaaagccaacuaaaauucagggaccuucuacuucaguaaaauuucuaggaguacaguguuguggggccuaucaagauauuccuucuaaggagaaggauaaguugcugcauuuggccccuccuacaaccaagaaaaaggcacaaugcuaagugggucuauuuggauuuuggaggcaacacauuccucauuuggguguauuacucuggcccauuuuucgagugaccugaaaggcugccaguuuugagugggguccagaacaggagaaggcucugcaacagguccacacugcugugcaagcugcucugccacuugagccaugugacccaucaagauccaauggugucugaggugucaguggcaaauagggaugcaguuuggagccuuuggcaggcccccauaggugaaucacagcagaggccucuaggauuuuggaacaaggcccugucaucuucugcagauaacuaaucuccuuuuugagagacagcucuuggccuguuacugggcuuuguuagaaacugaacguucaacuauaggucaucaagucaccaugugaccugaacugccuaucaugaaccaagugcuuucugacccaucuagccauaaagugggggaauguacagcaccauuccaucaucaaauguaaaugauauguauguacgugaacaggcuugaacagguccuuggggcacaaguaaguuacaugaggaaauggcucagaugcccaugguccccacuccugccaccuugucuucucucccccagccugcacugauggccucauggauauuucccuaugaucaguugacagaggaaaaggugacaagggccugauuuacacaggcuuugugcaauaugcaggcaccaccugaaaguggacagcugcagcacuacagccccuuucuagggcauugcugaaggacaguggugaagagaaaucuucccagugggcagaacuuugagcauugcaccuuguugugcacuuugcuuggaaggagaaauggacagaugugugauuauauacucauucaugggcuauagccaaugguuugacuggauguucaggaauuuggaaaaagcauuauuggaaaauuggugacaaagaaauuuggggaagagguauauagauggaccucgcugaguggucaaaaacugugaagauauuuguaucucaugugcguguucaccaaagggugaccauagccagaggaggauuuuaauaaucaaguggaaaggaugacuuguucuaugugcaccacucagucucuuuccccagucaccccugucauugcccagugggcccaugaaaaaaguggccaugguaacagagauggagguuaugcaugggcucagcaacacggacuuccacucaccaaggcugaccuggcuaugaccaccacugagugcccaauuugcuggcagcagagaccaacacugagcccucaauauggcaacauuccuuggguaaucaaccagcuacuugguggcagguugaguauacuagacuucuuccaucauggaaagggcagcaauuuguccucaccggaaucgacuuacuccagauauggauuugccuauccugcaugaaaugcuucugccgagacuaccauccauggacucacauaaugccuuauccaccaucaugguauuccacauagcauugccucugaccaaggcacucacuuuagagcuaaagaagugcagcagugggcuugugcucaugaaacccacuggucucaccauguuccccaucacccuaaagcagcuggacugauagaaugguaaaauggccuuuugaagucaaauuacaaugccaacuaggugacaauacuuugcagggcugggacaaaguucucuagaaggcuguguaugaucugaaucagcauccaauauaugguacuguuucucccauagccaggauucaugguuccaggaaucaagggauggaaauggaagcgucauuucucaccaucaccagaagacacaacaacgauucuauuaaacuggaaguuaagauugccacuuggccacuuugggcucccccuaccucuaagucaacaggcaacaaaggaagaaaggaaguuauaggguuggcuggggugauugacccagauuaucaagauaaaaucaguuuacuacuccacaguggagguaaagaagaguaugcauggaauauaggagaucccuuagggcaucucuuaguauuaucaugcccugugauuaaggucaauggaaaacuauaacaacccaauccaggcaggacuacaaaugacauagacccuacaggaaugaagguuugugucacuccaccagguaaaaaaaccacgaccugcugaggagauugcugaaggcaaaaggaauacagaauagguaguagaagaagguagucaucaauaccagcuaugacacgugaccaguugcagaaacaaagaugguaauugucguauuuccucucuauuuuguuaugaacauguuucagcuuguauacacuuguacuaagaaaauaucuucauuuuauuucuuuuuccuuugucaugugacauaagauuuauugacuucauaucagcauuucaguguuguuaaauuuaucuaauagcauuuggguugggaauugguaguuucugguaguacaaaggauagcuauauuauguuaggcauaauuaugaccuuauuauugucuuuauuugaagauuauguaugauuucaaaagauguguauggguuuaaggugacaaggaguggacuugugaugguuaauauugucaacuucauuggaugcaaaguauuguuccuggauguaucugugaagguguugccaaaggggauuaacauuugagucaguggauuaggagaggcagacccacccucaaucuggguggacaccaucuagucagcugccagcacagcuaggauaaaagcaggcagaggaauguggaaggauaagacuggcugagucuucuggccuccaucuuucuccugugcuggaugcuuccugcccucgaacauugaacuccaaguucuucagccuuugaacuauuagaccuacaacuaaaccaguggcuugccgaggcucuugggccuuaggccacagacugaaggcugaacuguuggcuucccuacuuuugagguuugacucagacuggauuccuugcuccucagcuugcagacagccuaucgugggacuucaccuugugaucaugugagucaguacuccuuaauaaacucccuuucauauauacauuuauccgauuaguccuaucccucuagacaacccaaacuaauacaacaugagagagcaggaaucuuauuuggaagcacaguuccaaauauagaagcaaacacauguaggugcucacuaaauauuuguugaaggagagaguaaauuucagcaagaaauuuuagcacaugaauuccaauauuuagauuccuuauuuugccuaaauaaaaggcauugggcuagacacugagaauacaauagugaggaauuauuaaugcguauccugccaaaguagauccuacagucuagaaauaggcauugaccaaacaauuaaugaaaaaauauaacauuugacucugaaaagugcuaucagggagaagcaguuccuaaggugcaaugggagcugauaaugggggcauuugagcuggauagagugaucagggaaugguugaggugggaucugaagaguauuccaggcacagggaagagcauacgcaaagguccuauaucccgaaagaguggguugaaaaaagccaguguagcugauccagagaaaucaagagaaggccagaggugaagucagucuugagagguggagaagagcuagaccaugcaggacuuugaaagucaugucaagaguuuuguguuuguccuaacagcaaugaagaaacauugaaaaauaugaagcagugggagagaagugaaggugagggugauauuagauucauauuaggaaaaaggccagagggguugcuaauaaaucaguugggaggcuguauggugguccaggucauaugugauguaguacacauguggguggugcuaauguagacagagagaugugaacaaaaucaagagguauuuaggggauaagauccaggaacucugacauggaagugauauggaagguaaaggaaaagagagaaagauaacauaaacauaaguugccauucuuugagaaagagaaaaaaauaacagacugggggugaauguggugauaauaaaugagcuugauuugaauauguugaguuuggggugucuuugugaccuucaagauuggcuucaaggagacuaucguuaggaacucagaauagcaacccggucagaggaauguguucaugaguaaugaaagccaugggcaagaaugagauggccuaggauuguguaaaugagcucaauuauggcauaaaugguccagagucuuggaaaaacagcccaaggaagguagccccagaggaugacgucuuagauaacuaggagucagggugagugccuggcacugcugugcugcggguaucauaacacaagaguauacauaggugagcaccaucaucaagguaugcucaguucccaaguuuaguaacaacuuccauuuucaauauuaucucaccccuccaaaucauauuaugaggcaacacaguuggaaaaaagcaguguauguaugggaauuagagaaaggcuagggagaacuaacuacuuaucuaucggauaaggcauuaagaauuccacauuuuuuauuucucuuauucucugaggccauauuugauauuagcauugagaaaacgacuuuauauuggcacagugcaugugccacucaucaaucuauuaccucccagcuacaaagucugcccuuaauuacuuguugugcaauaguggaauggauccuuuagcauuucuuuguugcaacaggcaugacauuaaauuaugucaguagaggguguuggagcgggagagaagaagagucuuuucuucccgguucugguguacugcucuucuuuucacaucuuccuauugcaggcuacuagugguauacuguaggggcauccaguguuguguacauucccuaggugagcucagggcucugucugcaguccaguauccauguaacugcagaccuccugaugcagacgccaugcacccuaggccuucccuugacaggcagcagguuccuggcaccuugcuucccucugaucccccucaccagcauugugcagccuauacccuggagcauacaggccaacccauaaaacguguuuaccauccagugcgaggaaacuauaccuucuccagugaagucugaauucaagcuuuggagagaaggucccuucauuuaaaauuugucccuuccuuaaauaaucucccuaaguucuaaggucuuauuuagaguucuuuuuauaccuuuauaauuacucuccucuaauagauacuaauuucucuguucaaaugaauugcaugucugucuccugacuggauucugacugauacagucaugcuuuccauuuuuaaauauuugguaaaucugauaguccuuacaauauucuuuugaaauaacuauuccaauuuuagacaugaaagcacuuugucccacuuuuuucacucauccaauaaguguuuacugagugcugaauaugagccuggcacauggcugugcacuaaacgugacguggcuaggguagguucagaauccagaacccaagacuaggcugcuuuccauuacacauuaaaggugguaguaaguguguugguggcacauuauuuuuugaagaauguuaaggcauggcuucucaaacuuuaaugugcauacaaauuaccuauauaaguacagguucugauucagagguuuuuauggauugaauuguaccccuuccccacaaauuuauauguuaaaguacucaccccccaggacuucagaaugugaccuuauuugaagauggcaucauuguagaugauuagguuaauaugaagucacacuggcguagacugggcccuuaauccaauauggccaguguuuugauaaauaacggcaugugagaaggcaccugcacacagggagugcaccaugugaacuugaaggcagagaucagggugaugcaucuauaagccaagggacguaaagacugccaauuaaccaccagaaacuagaagagcugcaaggaacacauucucccucagagacaauagauggaaccaacccagcuaacaccuugaucucagacuucuggccucuagagccaugagacaauacauuuccauuguuuaagccacccaguuuauggcacgcuguuauggcagcucuaggaaacuaauacagugggcuugagguguagccugagauucugaauuucuaacaaacucccaggugaugcugaugcuauuggucuuuagaucacacuuugaguggaaugaggagugaguauauaaaagaggacaccauaccuucucccccugcuuccuuucagagaacaguguccuuccuacaguaucgguuaaaggaacaaaccccauagucuggccaguaaccuagaaccuguauagccugucucaaaacaaugaaaugauuuucugguuggcauagagggagaaauuauauauugcuaaaagggagaguaaagcucaaggcaguucauauacaagcauaaauuaagaggaauaagcagaacaaaccaguuaguugggcugaaaaaacacaugugacgguauagccaaaucauuuuagugcaggagguggcagaucaacaaaguccaacugcagggguccccgaguagccauaaacauggaaaccgcucccugucaugaucuuuguggggucugauccugcuaggcuugccuuuucuaugauuucucccuugcugcuuuacaugcacccucauaauacuuccucuuugcuuucccucauuauuuguaaccaaaguguucuaacuauuaaaauacacaaagcauuuuaguaaagaugaacacaucuguccucugcaauggaucccccacagcagagauauuaaauugucuccugcuagccuuacuuuucuuucuuccuuuuaugaauuuuaccagggcauauggccuccuagcugaugauuuuguuucccagcuccccugccacuagguguggccaugugacugaguuugggacaauggaauauggguugacgugaugugugcaauuucagcaucauguccuuaaggcagagcuuucccugggcaucgcuuuuuuucauuacaacaaccugggaaucagcaacaagaacagcagcuguuagacucaaaaauggaagcugcauggaggaaagugcaugagacucgcuagccuaggugccuugagcacugaugccuccccauccuagauugcuguuaccuuuggguugucacauauuugggggcuucuuuguuacaguaucuuaacagauacccuaagaaaucacugucuaagaaacuguccacaauguuuacuuuuauagaaccuugcuguccaucuccaauucuaagccuuggccugccagcuccauucugcuuuauuugagauuggcgggacuuagcaguacuaagguaucugugcccaugcacaaaccagaagaucagcaccuucauuuuuagucagggcuguacagcagcuuccggccauugcaugagccuuaaggacaugcuuuuccaucaagcacgaucgugccugaacugagaugggcucuugucuucauuuggagccaauguuauuccauccauguauaugcacaggcuaaaauguuaaaacagauaucagcccugcaaaaaagcaaacacaaaugcuggaugacuaaggagaauuuuaaauaauaaaaaaucucuccuuuuucagagcuaguauuuacacagccaggucuucugcuaaucaacaacuuauauugagagcaaugcccaagaauucccagcacucaacuagagcaccuaguuuuauuaaacauuuuucccuguuuaggcagauacuauggaccuauuuuauagacagggaaacugauacacugaaaaguuguacccuuucaguguauagagcaguuaaauauaaaagcaaccccagcauaacaccucacccacccaacagaugcuuauucaccauucauucauuuguucauucauuuaauuuauucuuacuuuuuaaaaauuuacauauucaaccaauaaacauguggcuugccuguuaauuaacauaaaaugggccaguuauauaacuuaucauuugcauauuauuucaucggauaagcauuaacuuagcacuuacuauguguggcccaguacacccaggaaaggguauugaacaaggagcauacaguccuguuuuugaaacacuacaauagguuguaauaggucaugguuaaccucuugagacuggagucaguccugccucaguuuaccagcacauacugagugccacuggcugaguacacccaggccaaaugaccaggcuccauccacauaucaguucuacuggucucacuguagaaaaccuagaucaggugacgguugggugaagaagaagauaaacugucaaagaaagaaauaugaacagccuucuccucauaaaaacucaaagugcuuggccuccugauaguaggcuaguugucacuuugauauaugaaggauguacuccacacacacacacaaacacacacacacacacagagagagagagagagagagagauagagagagagagagagagacaagcaggcagaacuaagaguuggaaaaugcauuauaaaaagaaaaacaaaaaauaucaauuauuuaguccagaaaauguaaauaagagggguagaggagaauuguuauuguuuuuaaaugaauugcccuuacuugauaaacggaaacaauuauuuacugaguucuugcuaccucuaggcacugugccaacacuuuuccaugcuuccuuguuuccucauuuaguucuaacaccaugccagguagguauugcuaacucugauuacaaauauaaauauaaauaauaaagaagccaagguuuagaaaggucaaggaugucaccuaaagucacgcaaguggcaaguggcagaacuaagacuagaaaucaugucuaucuggcaccaaaacccauguauuuuguauacuguuacaaugcuauauaugcaaccaugcaagagcaggagcagcucacagccaaaaugacacggagcuagugaaaggaauccagaggugaaaucucaguugcucagggcucuguggguaacaagaggaaggugccgccaagguaggaagcauccaucaggccaacaccuccuacccacagaguuuaggccacagaaacagauagagcagggguggucacaggccagaugcugacauuuccagagcucagcaaagagucaauauggggacugaaauaccauaucuuaaauauuuaaguguuauaagucaagcaaacaaacuuaaauauuuuccauucuucuuuuguaacacguauaccuuuauaacguauaccuuuguaaaagcugggaaggccagauucugauuggauuucuccaaccuaagugguuaaucugugaccucagccaccacuaucaucccaaggccuucccccucuccccuccgaucccagcuccauggugaggaauuucgugcucaugacuauggacauccaguuaaaaucaauguccaggcuugagucacacaaucuucccuacaaauaacagcauuugggggauccauccacagcaucacuguuuucugcccccaggcaagaggccccacaaacccuggaagccagcucggagcuauuuggauagucaguuuuaaggccuugguacccauaguguggugcaggauaaaggcaugggcucccaaggucaggccccguggcccauggauuccuuaucucacggagcagagcccagccaggggaggccaaagugggggccucuaaaucgcauggcuuaggauaggugcuccucuugccaagaucaaaggucagucuuguggagucacauacuucucuugcaaagggagaagaaaauuugguuugcgggaaucaacuggguuggaaauguucuaauucguaaguucucauccccuacuauacauucgaaucaccuaagaaagucuaaaaaaaaauguguaccugaaaaaaaaauacauauaccuggucccacccauagacaaucugauuuaauugauauggaaagcaccuuggguaucaaaaaguuuguaaagcugcccaaugggauguaaaugugcaaccaagauuggauacuacuauuaauuacauaaaagaauggauauuauggccuggaaacaacuccucccacucuaaccauguaugugucugugaaacuuugaugaucacuuaggggugagagugagaauaguaggaaggugaucagaaggaggaggggagguaggggcccaggacagagguaagacacugagacaagacuguaccauucaucugacaccaaagcauuucuccaggaguaaugauacgugauuucuaugggcaggugggggauggaauuauuuuauuuggcuuuuauagauauuuucuuucuuucaaauuguccccacaucccugcaccucaaugccugucaccuauuucaaacuagugguuuugauaaaaucuuacuucuacuuagggucagagagucuuccaggaucauguccuugaacuucccuuuucugagagcugugaggcuggagggggaaagaaagggagugcagagaacaaauaccucugcuccuuuccucugguacugcacccagccaugccccuccccugguggugccucucugauaccuauucaggagaugaaauaaacaaacguacagccauucccugcuucucccccaaggcacugauuuuguguccucaggguagacugguuauggcaaagaauaaaaagugggaaaaaguguuucaguaaagugagcacacaaauacacgcugauuaaaugcuucccucacaaacagccgcagagccccugcuuuaucucuaucaauauuaucaaagcacaccuuuccuaaggcucuacuggaaauuccaguuacaaucacguauuagcuacuuuauuuucaggcauuuuucccucuaagagcugaauggaaaacucaagcugaaugcauuagugaaaugauggaaaaaaaauccgugcauuacaacuaauuccugauaaccauucaagacaaauucugaauauggccagagaagaauaucugacuguaguuaucuuuuaggcuaaaggucuaggcagauguuuugcuuaagcaaauuuugguuagaacaaugaucuuuaacacugguacccucagguccacauucaaggacaguuaugagggaaacaaauuccauauuuucacuguauuuacucucucaaauugcccaagaauguaugauguaucuuuuuucaaaaguccucccauuuuaccaaagauugcauaacuguuagccaacauaaauaucauuacugcauugcccugagaauagacauacuuccaagcaccaaagggauaaagcuaaauauuauuuucuaaaaugugguuuaaaacuuuuugauaaaauaaccuuguauauuuauuucaauuauaaugauuccucuuauuucacucucugagcuguuucauauugucaagcuucuaauaacaagaaaaauauauuugaacuuuaauuaaaauguuuaaauauaaacaaaaugugugagauagacuucuuggaagauacagcguuagguuggugcaaaaguaagugugauuuuugccauuaacaauaauggcaauuacuaauauauauauauacuuuuuuuuccuauuccuccugcuaaguaccaguaaaaucuguggccauuauguauaaaacaaguguaagaagaaugaaaugcaagaagaagucaggcuggcuagggauuacaggaucuguagaaggacaguggugaguccccuggguuuucuuucuguaauaucuuacacuugaagcugacggcacagacaaaaaaaaagacccaaccuaaaagaaaaacaaacugcuuccuaauucugacagaaaacgugaggguuuuccauaccaaacaauuuuccagcucuccagacaccaacugagugucccacaauucaacuaugacaccagcuucccagaguuaauacaaaucccacaaguaaagggcucauucccacaagacugcaccccucccagcuucagacacagaucacaagccccagacugugaccugucaucugaucaacuggcuauaaaucagggguucccaugaccuuccucagguuugacaauuugcuagaauaacucacggaaugcagaaaaacauugaccuaaggauacaacucagaaacagccaacagccaaauagaagagaugaauaagcuaagguaugggaguuaggagguggcauggagcuuccaugcccuuuccaaacacaccauccucccaaccccuccauguguucagcaacccagcagcucucugaccccaucccuuagguuuuaauggaagcuucacugccuaggcaugguugauuaaaucauuggccuuugcugacugagucaaucuccaguccuccucucccugaaggucuuggagaugggaaaguagagugggggugaaaguuccaacccuuuaaucauaaaacucuuuccuugacaauaugccccauccccuaagagucauuccuuagcauaaacuaaacucagguaugguugaaaaugugcauauuaagaauaacaaaacaugauccucucacuccuaccacucagaaaauuucaaagguuuuuggagcucugugccaggaacuagggucaaagaucaaauauauauuucuuaauauaucacaauaucaugacaucaaagcugcuuucucuaaccaaaggaucauaaaagggaaagccuguuaauguagaaaaauuuuagauaauagccacuuuagguaaacaccauugaaaaaaacugugccuccaaccucauguaggccagcaaaggccaaguggggagcugagacuuccacccuuaugaggcuguaaugacauguuccaacauucacaccagggugguaucagagaagcccaaguagaacgccaagacugugauccacauaauaagaaaacuugccaggggucuuaguggagacuaugugaggagcuugaaauaccaucauccuacucuguugacaugacaucagaagaggccugugaagagucaggucuuuaccaucagccagugauaauccggucauccccacuaagaugucagcacaggagacaugaaaagccagaacucccaauccuuuccagcagcaaugggaguuuuccccacuuacaugucaacagagacuucuagacuuccacuucuuguaaugcagguaugaaaaaaaugcuucaaagagcaauuacuaacacacuugaaacaaacaauaaauagaaggccuuaucaaagaaauggauaauuucaacaaagaaguagaagauauuuuuaaaaacuacauguaacuuuuagaaccaaaacaaugcaauaacaaaaauuaaaauuucaguggaugagcuuaauagcagaauagaagagauggaggaaagaauuggugaacuggaaaauuaaaaaaaaaaggaaagaaaaaaaucaggaacuagccaaucuuuugaacaacagagagaaaccagauugaaaaaaaaaauaaauuaauuaacaaagccuuagggaccuaugguacuauaaaagaucugacauuccuguaaguugagguccugaaggagaagagaaaaagcauguggcuggaaaaguagucaaaggaauaagaacuaaaaacuucaaaaaugugucuggaaauauaaaguuacagguucaagaagcucagaaaacccuaagcaguguaaccugaaagaaaucccuauuaaggcacaccacuuuuacacuuccgaaaauuaagaaaaaauacaagucuuaucuagaaaaaaaaaaaaaaaaaaccaaaaguugggaaaagcuguucaaauaagaguagauuucuuaucaaaagucagggagaccagaaggaaguggcacaauauuuuccaagacugaaaauaagaacuguuaaccauaauucuacauccaaugaaaauauucuuuaaggaggaaaccauuacaugcucuauugaagaaaauguaagacuuuguuaucaauagaccucccccaaaagaagggcuaaagacggcucucuaaacaaaaggaaaggaaagaaaggaaaggaaagguaagaaaggaaaggaaagggggagggguugggggaaggcuagaauauaaagaaaaaagaaaaauaugguaagcaaaaauacaggaaaauacaaaauaccuaccuucucuccugaguauucuaaauuauauuugaugguugaagcaaaaauuauaaaauuacaacacugucuaguuugauucuaaauguacacauauaaaauauugacaauaacuauaaauaaagugaggauaaagggacauaaaggcagauaaauauuucuaaacuucacuagaauugguaauaugaaaauaucaauauauauaauuuauguguaaagaauguauugccuaggucaacuauuaaaaaggcuaugccaagagauauauuauagauaaguaaaacagaauuccauaaaagaaaaaaugaucaaguaauacauaggaagacaggaaaagaaaacagcaaaguaaaaacagagaaaacaaacagaaaacaaaaaauaaaauggcagacuuaagcuuuagcauaccaauaauuacauuaaaugcaaauaaccuaaauaugccaauuaaaacguauauauuagaagacuggauccaaaaccauuauccaacuauaugcucucuauaagaaaaucacuucaaauauaauaauauaggaaguagaaguaauaauauaaguagaaggaugaaaaauacauacauacagaaggaugaaaaaauacauauauaugaaaauauaaauauuauuaaugaaaaaaagcagaauuggcuauauuaauaucagauuaaguagaauucagagcaaacaaaacuaucagagucaaagagagacaggugauauuaaaguguuaaucaaugaaaaaagcaacccuaaauauguauguauuaaaaaccagaguuauaaaauaugugaagcaaaaacugauagaacugaaagaauagacaacucuacaauuauugcuguagauuucaauacuuucuucucaacaauuagagcaacuagacugaaaaacaaagauauagaagaacucaacaguaccaaucaauaagauacaauacucaaucauuaggauauagccaacacuuguagaacauuccacccagcaauagcagaauacagauucucuucaaguguccauagaaccuauaccaagauauaccauauccugggucauaaaaccagcaucaacaaauuaaaaaaaauugaaaucauacaaaauguguucucugaccacaauaaaaucaaacuugaaaucaguagcagagugauaaaaagaaaaucuccaaacaccugaaaacuaaacaacacacuucuuaauuuauggaucaaagagaaaaucucaagagaaaucuccugucccagcaauauaucauuuauauauauauaaaaugaccaaguggaguuuauaucaaggauacaaggcuggcuuaauauuggaaaaucaaucaauauaaucuacuauaauaauaagcuaguucuuugugggcaaccuugaaaugaaagugaccgaggagcuccuuuucgagguuuuccaccaggcugggccaguaauaaaggugaaauuccaaaagauaaggaugguaaaccaaagcaguuugcguuugugaauuucaaacaugaaguaucuguuccuuaugcaaugaaucuacuuaauggaaucaaacuuuauggaaggccuaucaaaauucaauuuagaucaggaaguagucaugccucgcaagaugucaguuugccauauccccaauaucauguuggaaauucaagcccuaccuccacaacuccuagcagguacgaaaggacuagggauaacaugacuucaucagcacagauaauucagagaucuuucucuucuccagaaaauuuucagagacaagcagugaugaacagugcuuugagacaaaugucauaugguggaaaauuugcuucuucaccucuggaucaaucaggauuuucaccaucaguucaaucacacagucauaguuuuaaucagucuucaagcucccaguggcgccaagguacaccaucaucacagcguaaagucagaaugaauucucaucccuaccuagcagauagacauuauagccgggaacagcguuacacugaucaugggucugaccaucauuacagaggaaagagaugauuucuucuaugaagauaggaaucaugauggcuggagccaugacuaugauaacagaagagacaguagcagagauggaaaauggcgcucaucucgacacuaacacauguuaaaagcacauuguuuuuauagggucauuuuaggcccuuugacuaaguugauauggaaauauuuuguugaaaaacuguacagagcagcuuuacaaguugucacauuucuuuauacauuuuuuuaaagcuacaguuuaauacaaaaugaauugugguuuuauuacauuaauaaccuuucaccucaggguuuuaugaagaggaaaggguuuuaugcaaaagauggugcuacaauuccuaaucauuuuagacacuuuaggagggggugaaguuguaugauaaagcagauauuuuaauuauuuguuaucuuuuuguauugcaagaaauuucuugcuagugaaucaagaaaacauccagguugacagucuaaaauggcuacugguauuuuaguuaauucaaaaaugaaacuuuucagugauucacuuuacuaacauucuauuugagaaggcuuauugguaaaguuuggggauaaaggcauugcuuaucuucuuauauaauuuagguauaauuucugugacaugcucuugagcuuuacccuaauugaacauacauguguagaucuacacauacuguuucauucuaaaauuuagacauuguucaugaaaccacauuugagguauaagucacucaggaaguuaaaauaucucuacacguauauuuuuacaugaaaaauacaguguuagcauaaauccccuuuucaggaagaauaaaaaugucagugcacaguuagauaaaaugguaaaauguuuuacugaaagcauacuuuuuuggaaaaaagauucaugaagccuuuaagugcuacuucugucagucaaacguuaaaaacuuuaacauuuucaaagugcccagaauguguacaaagacacauguaauggagacuguacagguuguuuuuuuuguuugaaccuuugaaagaauuuaaucuuaacguuuucuaauuuuaaaauuuuaaaaucuuguuuaacaaaaacuuguaauguauuaagauacuguuuucauuucauuacagaauuguuuauaaaaguucauuuguugaaaaauaaggauccuuuuuaauaccacagcguucguacuguuccuuuuuaauauacugaaaauauaaaauaauaauaauaaugauaagcuaagggcugugcaugggggcucacgccuguaaucccagcacuuugggaggcugaggcaggugaaucaccugaaauuaggaguuugagacuagccuggccaacauggugaaacccugucucuacuaaaaguacaaaaauuagcugggugugguggcaugcgccuguaauucuagcuacuccaggaggcggggagguuucagugagccaagaucacaucccugcacugcagucuuugcgacagagagagagacucugucucaagaaaaaagcuaaaggagaaaauucacacaaugauaucaauugaugcagaaaaagcaauuggcaaaagucaaugaccacucaugauuaaaaaauaaacucucugaagaauaugaauagaggggaacauuuucaaccugauauaauguaucuaccaaaaaaaaaaacuauagucaacauuauaguuaaugcugaaagauugaaugauuuuccuauaagauuggaaaccaaggaugucuauucucaccacuuuuauucaacauaguguucuagccaguucaauaaggcaagaaaaggaaauaaaaggcauagcaauugaaaaagaaaaaaacaauguauugcagaugauaugauugucuaccuagaaaaaucuaagguaucuacaaaaacuccuagaacucauaagggaguucagcaagguugcaagauacaauauacaugaaacauaauucuauuucuuaugcuaguaauaaacaccugacauggaaauuaaaaauauaacaucauuuacaaucacucaaaaaagaacacauuuagauguaaauccaauaaaacauacacagaauuuguuggcugaaaacuaugcaaugaugauaaaaggaauuaaaaaccuauugagagacauacuguguucauugguuggaagauucaagguaauaaagacaucaauucuacccaaauugauauacagguuaacacgauuucuagcaaaauccaagaaaaacuuuuguacguauaaauaacauuauucuaaaauguauaugagaaggcaaaggaacuaggauacugaaacgaauuuuaaaaaagaagauuaaagagggaagaaucuauuuaacucaauauugagauuuauuuuauaguuacagcaaucaagacugucauauugguggaaaaaucaacacauaguacaauggaacagaggacccagaaauggacacauuuuugacaaaaguacaaaaucaaccaaauggggaagagguagcuuuuuacacaaauggugcuagagcaauugguucuccauagguaaagaagugaagccugaccuacauuuuacaucuuacauaaaauuaacacaaaauagaucacagcucaaaugcaaaauggaaaaauguaaaacuuuuagaaaaaaauaggaaaauauuuuuaggaucuaggacuaggaaaggaguucuuagacuugacaccaaaaacacaaucuaugagaggaaauguacauaaauugaacuucaaaauugaaaacuuuugcucugugaaagguccuguuaagaggauuaaaaaagaaguuacgggccaggcacaguggcucacaccuguaaucccagcacuuugggaggcugaggcagguggaucacuugaggucaggaguucgagaccagccugaccaacauggugaaaucccaucucuacuaaaaauacaaaaauuagcucugguggugcaugccuguaaucccagcuacuugggaggcugaggcaggagaaauuagaaauggacaaaagauaugaagggacauuccaagcaaggagauauaugguuagcacaagaaaauauauucaacaucauuagucauuaggaaaacacaaaauaaaaccacacugagauaucacuauauaccuaucagaauggcuaauuuuuguuuaaguugugaaaacaccaaaugcuggugagaauucagagaaacaggaugacuucauacauugugaugagaauguaaaauguuacagcuaaucuggaaggcaaucuggcaauuucuuaaaaaacuaaacaacgugugguggcagaggauauagggaacauaucuguaccuucuucucaauuuugcugugaaccugaaauuuugcucuaaaaaauaaaguuuauuuaaaaauaaacaaacaaaacuaaaaacuaaacaugcaaauugugcuucugggcauuuaucccagagaaaugaagucuuguguucacacaaaaacuagauacacauauuuuucguggcuuuacucauaauagcccaaaccuggaaacaacccacauguccuucaaugggugaaugguccaacugaacaaccugcaugaaucuccagagaauaaugauaaguaaggaaucccaauccccaaaugucacggacuguaugguuccauuuguaugacauucuuuuuuuuuuuuuuuugagacggagucucacucugucacccaggcuagagugcaguggcacgaucucggcucacugcaagcucugccuuccagguucacgccauucuccugccuuaaccucucaaguagcugggacuacaggcacccgccaccaugccuggcuaauuuuuuguauuuucaguagagacaggagguuucaccauguuagccaggauggucuagaucuccugaccucgugaucugccugcuucagccucccaaaguauugggauuacaggcguaagccaccaugcccggccuguaugacauucuuaaaacaacaaaacuauagcaauggagaacagacuagugguuguuaaggguuaaggaggggaugaggcuggcagagaaguggguguugcuauugaagagcaacaugagugauacuuguagugauagacauagucuguaucucacuguaucaaugacaacaucuugguuggaauauuguacuacaguuuuacaagaugauaccauugugcgaaacgagggaaagagcauacaggucucuuuguauuauuuaugacaugugaaaugcaugugaauagaugauuaucucaaaauuuuucuguuaaaauguaugagacaguacaugguauuucaaaacucuuuaaggggguguguuugagucaaaaugcuugaagaccacugauccagaagauugauggacagaggccaagaaggaacacagaccuuggggcaaccuuacucucugaugaucucuuugguucauaauuaaucggguggaagaggcuauuucugacauuugcauucaauagcaccacacugaagugaugcagggugacgagguugaguuuuuuaaaaauuaaguugcuuuuuaccuaauugaucaguuucauauucaaaaucucaugagaggcucagcaagcuauauaguauacaaauaaaaacaauaugaugacaaaagagcuugaauuuccaugaaugggaaagggaauuguuaaauuuccugccagucuguaugcuugaucuuugauuggggagugcugcccccagcugaggcaagcacaaccucuacucaucaccuuuugcaguugcagaacugaaguguggaacaccaguaaacugcaggaaucggcaccugugacacaaaugugucaagggauagcacaugucacagacauaccauaccuuuuaaacaugucuguuuuuucucugugguugcauuaaacauucucagacacagcaaguguuagcaaauuagaauaacuaccuucccuugaccuaauucugacaguguacacagcaccagaacagcugagaaaaaaaaauagaaaccauucauuugcccaaguuccacuugauacgguuuugauaaacaaaaaaauggucacgaaucuucacucaacugaugaucagaucugaugcaacacauacacacaucuaacaggcagucaacugggauguuuccaguugucgugcacucauguuaaaggcccaguguugagaauaaaggaacuaaauuccccuugaaguucagggucccguaggacccaugagauagcuccauuccugcugggcuuacugagaauugucaaagaacccuuucucacaccaaccacgcccccgcuuuccuguucaauauaaaugacagaguggugagaaagguaggagcauuuuuggaaacuguagucuuuauuaaaugcauuuuugccucauucauccccucuuauggaggaugaaagaacauauuuuucuacccugagaugaagaggauaaccugaaaagauugaggaaguuugcaacaaggaaagaaaagagaauguuuacauucuauuccucuuugcaguguauaucuuagccagugaacuagcugaucuguccuauaccaccagagugagaaaaccagaaauagggacagaaagucucauggagagggguagagcaagaaguaccaguucuccuucucccuucuuuugaguucuucauuuuggauaagauaaaacaucagauguugcuuggauuuaaaggucugagaagguaaauuugggggccucuguauuucuaauacaacucuaguuugaggguuaagagaaaguaaguaugguucugccaacugaaggauguggccaaagggaucaccacaacuaggcagcuguucacagaugugccccucaucagcaaugcgugugguacccaccaccugucugugcugagucugcagauagugaggcugaagagcagucauggcuaaugaggagcgaagcucagccaugucaagugaggagacucuaaucuauuccuucucaauuucucuaguccacuagcaccagaauuaaaaggggacaugaugugugagcaccaaaccaaccuaccuuuuucuccuuucuccuaagccuagauugcuacauggagcaccugcccaggcacagaagagagauuaccagcuauaaggaaagugaaccuuagaaauccaaauuuguauuuguaaguaaaugcauacaacugaaaaaugauagacucucagcaaauuuuaagagagcuacuugcaaaguaggaaagaagauucaucauaccaaguucugggcaauuauuagaaaccauaaaacgaucauauuucuaacgugaggacuugaacaucuucaaguauguuggugguacaaaguguguagcggaugggauucacagugaguuucaaaugauuggcuagauuuggaagauuagccaaagucucuucuggaguaagaggcaaaucaucaagaggaauggcuccccagaggauauauauguugggguuggguuuacagccuuauaacucaaaaugugauccaggaccaacagcauccacaucaccuuggagcuuguuagaaauguagaaucucagucucacccuacaaccuacugaaucagaaucugcauuuacaagagccccaggugauucauaugcaugcuaauaucugggcaauaguggccuagagcaauggauaacagaaggccucaggcagacauggaugcugaaaguuccagaagcccaaggugaaucaucucuacuucacaucugagaacugcuuugaggaaauaguugaugugaauacaaugucuggcaaaccauggauuugaaugugagcagacagaaaaaaugccaauagaauuuuaauuuugagagggucaaaauagcccaagggaacacagcuacagcagaagaguagaugaaaaagauacaaaggaacaagaggaaggugucacacaguugcaauaaaggcagcucaaggcuugccaaucugccucagcucucccugauaucccauuuucugaaccaacuuccauugaguuugauuucaauacucuacaggucagcauuaaaaaagaaaagaagaaaaggaaaggaaaugaagaagucacuggcaagcaaguaacuggggagggaggugggaaggaaaggaaggacuaccaagauaugaaguagaugauuuuguggcagaaacaguguuccucauuaauuacuccauuuguuuucccguauuucccagccuuaauugaaguuaggcuugaucauguggugaguuguacgcaacaaauuauaagcaaaagcgacuuacauuccuucugauauuaaagagcuggagaacuaucacuccuguuuucagccacagugacuggaaaaguuuuacuucagcaguccucaaacugugauccaaggaccccugagcuuucuuaagaccauuauagggguccaagagauuguuucuuuucuaaucacauuucugugaaagccuagguuuucucuucaagcaaaaaagcauguggcaauagauuaaaugcagaagcagauaugggaauccagcuguccuuaaauaagcuagacauuaaagagaccaggaaaugcaaaacagagucguucuuuuguuuuguuuuggaaaauguggucauuuuccaugaaguguuauuuaucucaacauguauuggcuauauacuuacuuuuaaaugaguaaauaaauauuuuacaucucaguuuuagugcauaauacaguaaauaucuauaguuauaaaucauaugaacaaaugucuuguauauauuuuuuaagaauguaaaggaauuuaggaaauuaaaaaguuugagaauggcuguuauuaaagguggaggcuccaccagccuggagaucugggcugauaaguggaggagacacauaggacucaccccugcagcugcuucuacucagcagguauuaggagugagaaauaacucuguguuauuaagccacugggauggggauuagguaguuucucagcacaaucuuguccacccugacaaacacaaaauacccauacaggccuagaacacuuuaugaggccaaaagaccuaauagaguaugacuuucugucccuaagaaaauugccuuaaugucacauguuuucaggcucccuaccccucguaaucacauucaauacucagaauauauuucuuagcucgguuuauuccuggaacuuagcucccggcauuguggaaacccacaccgugauaagcuaucuccccgguagcaguagcucuucaaaaaacaucaucucauuuuucagggcaccaccugaaaauaucucuucuaauuaaaccaacgggcgauucaccuuuccaauagcuagaggcccuucugagaugccauuuuauaucuuucuaaaauaccaacaggaaaaaaaaugcuuaauagccaaaaagccaugagccuucucuagggaaaaauaaucaaaccacauaaacugcagaacuaaauguggguggcagugccuaaauaauaauuauaauggcaaauuucaggucauagcuaauauuuauaaaguacuaauguuguaucagcuacaauucuauuacauaggucuuucuuuguuuacauuuuucuaacaagucuaugggacagacacuaguauuuucuccuugugauagauaugaaaacugaagcccagagagggugaguaacuuguccaagguugcagaguuuggaaguggugagucaggaagaaaauuuguguucuuauuacacuauauucacucucauauuucagggagaaccauguaauuugaauguaauaauacuacuauucauuccuccaaugcucuguacaucucaaucaacuucacaaaaugauucaaaguuuucccuccagaagcagaagggaggcagcugcugguuuuuguuguuguugaauauuguuguuguuguuuuaauuagcuauaucauucuccaugcucccaacaucaucugcucuuucuacccuugcuauaaagccucaucuauguggugcuuguacuaauuagcuaauccauaggaauggaggucaggaaaagaaggagcagugaggaagaagagggagcugaucugaugcaaagagaaaacaggcgguuauuauuuccaggaaaagccagauccuuccuuucaaacgaggccaacgccuggcauaaucucuacuacuuuuuaagauccacugggugcauuuuugucagugugaggcauuagguuuccuggaaggguaacauaccaggagggauuaguuuaaccuaauuaaaaccacugagcaucuucuuucuuagcucugaaguaauggcacucaggcaaggcaggaugacaaauacugagaaagggcaagaccauaggcugcucccaggaugaaaagacccuucaguaagccccuggagacacuaauagagggaaacaauggcaccugcagccuuggguaugagcacccuuagcauggacacugaagcagaggagaggugccuuucccggcacaagcaucaguggcaacgcuuuccguggcaccagugaccuggaugcuaaauuuggcaccggauggugcugcaaauuucaccacgguguucugcgggagcaggaagaaaaagucaaagauccauguaguugucaauauggcugauuuuacaaacacaacuuagauccucugaggacuucuauagcuauuugggaagaauauaaaaggcugaaguucuugaagggaaggugcaggaaaauaaagguaaauccaguuauuuuggguuuauuguuacccaaaucuuaacaaucauguccaaagauuucugaacucuagcaggagaggagcuaaggccuaaguuguggcuugcacagauacaaaugucccaugucccuguccacaucaccaauauuuaaugaauaacagauuuguguuagugagaaaauuuuucugaaucuuuuuuuuuuuuuaaguacaauaaaggcaagguggugacauuauguucauuugcaucucuuugauuucucuugucccuuuuugguaacuuuugaugugcugacuggguggaguugcuggagaauauuaagcacuuuguuccuagucauuuggagcuuuuaauaauaaaaaaaauguucugaaugaaaaacaaacaaacuucucaucaaacauuuauggaauccuacagcuuggcaucagagugcaugcuuggagguuaaugugauuauaaugagaaccaaccccugcucugaaaaacuuguaguagugacuccagauacagagaacacacaugcacacauaagcacacaugcacagucucacacagggaaugccauggaauaaaaaaaaaaaaaacaucaaguggcauugguucuucuccgggaucugccacaagccuauaccaccugcccuauuccauccacuuagagguucugggucuccacugaaaagacucacagaugcugaaguguugaaaggauauugggaucaaguauucuuaacugaaucguaugaaaccacagucuagaaagaugaaauauauauacauaucccaguuaacuuuaccaaucacucacugccuuuuauagugcucugcccuguuccucucuccccuuuauuggauagccugcauuuuccaggagggagacauacaaguggccacagugccauuuggccuaggccccugaacccuugccugaugcccauggcaaugcagcaacaagacagcaggggggaagcaaagcugcagugcuggcagcaucuguaauuuuggcgauggcagcagaaauguugguggaagcagcaggaggaugaaaagagugggguuggcagcagaagaggcagcacuggcagcagcagcuggaccccagacaucaggcauggcaacccuugccagaaacauuggguagugccagccauuacacagaaaucgggaccaguaggaaccaugaggacuuuggugaugcucagcuaacagugguggagccugucauggaugcugguggcacggcuaugugggcuuacggugagaaggagcaagaaggaauaagacaauggcagagaucuuguacugccaagucaagugcuuucuaaaaauauguguuagaaacacuaggggaugcucagagcaaucugggaagaaauguguggggugccauuagaguccugaaagugcugugugaguaaaggcuauuuuguggcucuuacuguauauuucacaaucauuguacagcuauggaaaucaagccucaaagagaagcaauagcuugucauuaguguuagaacuccucaucaaaggacucuacacuccacacuagacuguagcucaagagaaacugugccuauucacuugggagaacuaaacuccauuucuaguugguuugguaugaaauugaauccagauaagacagaaggaaaaaucugaauaucacugucacagggaaggaaaggcaguguguuggcuuggaggggaaauauaaauagaccaaacaggaaggaaacauaggcuucugagcugcuugaaggcacagagccugggacgaaacugcccagcaaugaggccuggagaguggggcauaaaagagaauggggagauuaaaguaggcuuacagagaaaugccccugccuacuucuucauuuuugcccagggauggcccucuguggauucuagacagcuaaccucgugggcaacaggcugagcuuucaacuucaccugaggagaaagugaugggagacugguucccuuuccacauccagcagcuuaccugcccacgaccaucccucacauuaaaaaacaaaugguuccaugaucugccugaaaauaaaagggugauauauuuuuccaaguugaaaaaaguguacugugucaguguaaauauccauuuucagaaaccacacggggaaaacaggugaaguuuuuguucuagcauugcauacuucuguaaguaggcaauuacagggaauagugcucugaaccaacaccaguguuuauuuaaauacaauaaucauacugugugguuuuucuccccaaaugguccccugagagacuguaagcccuucuccaaaucacauguguuccaaaaucuaaaaauccucaaaguuguagcuuggaauugaaaacaugaaaaacaggcuuuacauccccuaaagaaugcaaauuccuuggugugguauuccaggcuuuucccaaucugaccccagugaucugccccagaagccucaguuuccaucacuuuuugagugggaggaugugagaccaaaguguagcaagugagcggcaugcaagguccucaaggcugaagaagagagauggggccagugagacugagacccuguggccagggagcuaaagucagggucccugagaggauguaaaguuugagauggaauugugaagucagaaagagaagccucagaggagguaaugaguagagaagacagacagagagagagucugggcucacagauggcaaaaugccaagcuguaaaauccaaaugaaagcaccaccacagcaaucucagugguggcagcaguaaugcaggcgugaccaucucagaaaaagauuuuccacaguguggcaacaaaucacuugaccauacuaaucagacccugagaagaugugcagagggccucuggagccuggggaugaccagcacaagacccaagaagccaacagaugcagguggaggugcaggagauaaugaacaggccuaggguggaugcuuuggcguucacucuucauucuucaggcauguguuuuuuguguuuaaacaagaucuugaauguggcuuaaaauuguaacuaaacauuugcaucuugggucauugucuaauaaacuuucagaaagugaauacacugugugugugugugugugugugugugugugugugugugugugauccauucuaaucgaguauucccugaaucuagaguugaagauccucuuuaagaaaccuaaucaacaugacuuggaaaggaacuagcaguuggaaauuucagugucuacacaggcaaucuccuuaguuaaugcugcuaggccuacaguuacguaaguaugcuacacaaauggugcauauuaagggguauuucuauggccuaaugccuggagcacuacaagggcuggggacauauuauuagaaaagcccugacauagagaaagaagaaacuguaauuggcuguagugaacagagaaggugacauuugggcugagcccuguuaaauggauaugaugugugugugcgcauguguauguacauguccaucuauagagaaauaucuuggagugugaacaguacauuuucuagagguagcguuucuacagacuucucauaacaggaucaaaaacauguauuuuauaagucaucccagaacuuugggaagcugaguggaaaggauuguuugaggccaggaguucaagaccagccugcgcaacaaaguaaaagacccugucucuacaaaaaacacuuuuaaaaauuagcuggauacacuggcaugcaccuguagucacagccacucaggagguugagucaggagaauuccuuaagcucaagcauuugaagcugcagugagcuaugaucaaaucacgccacugcacuccagccuggaugauagagaaauaacuugucuuaaaaaaaaaaaaaaaaaaaaaauaacaaaauaagucagaagguugaagcuuuucugaguuuuguuuuuuuaauuugguaaauuccaguuuggucagcagugcuaaugacacaucaggugaaagagauuuccauccacugaacagaggaguggagcacacaaggcagcaauaaagaagaugaucugcagccugaaguugauuuagggcacagaggaguccagugguucaaccuucucuucucauccggagaugcucuuuccagugccaagccuaggagaguuugguuuuauuuugaagaggaagacaguuuuccuuauggaaccuaaggaaaacuacacucuauauggcauacguucauaaacuuucaaagccucagagaaauaaaacugaaauucagcaaagagcuugggaaaacuaugcucguccagaaucaaaucucuuaaaauaaaggccugcagcugggacagguggccuuggugguaaggcccauacuuugcuucuggugcugcuccucugcucucucgggugcauugccccacagugcacaugagcuccugccucaguuugccccugcaggccuagaggccuuuaggcagcuauuugcaaggacuggaacaugccagcuggaucagugaucauuuagccuuuguauucuuugggauucuauugcccaccugacuguugacuuguaaauauccaguuccuugucuuucacaugauguuucccaacuucccuguacucagcagucuuugcugcugaugcuacuuuuguaacccccugaauccagacaagacuggcuaacuuuaagccuguacagaaagaaaucugccaaugccuuuaaaaagaaauccccgaacaucucaagagagacagauucuaccaacucaacugaaaauagagacauuuagauauuugcaauggaggaaagaguggagaaaaaaaugaaagccuauauuauaaacugagcuauguacauuuaccaaaaaaauucaaauccuuggcucuaaaaaaaugacauuaaaaaguuaagcaguacuuacucuuauuuaaaaugucauucuuguucaguguaacuguuagacauuuaauaaagacagaugagccacacugacuccgugaagacaaaacuuuccccuguacauccgcucuaaaagcuuuuaaaaccacucugucaggagcaauuugauggcauaucaauuguguuucucuaaggaaccacaguacugcaugugacaaaugaacaucauaacaagauugggugggugggugcagggagguaggggcugagaaguccaccccgugguauaaaugacuaacacaaaacacugcugauaaaacaggagaggaaaugcauuagccugcuacaaggggcugagauggaccauuaaauauuucauauaagaaaagcauauacagcaucucaacaggacuuugcugaaauuuagggauucaaaggccccuaaaagugauuuacaaggggcauuuuguuggaaaaucugacagggaguccuguuggaguucaucguggguggugaguguuuucuucuaaucuuggugccccucagcuaggaccauaguucccaacaacagcauuuauauccauucgccauuuuuauguucagucuuuacugcacacugauuaacaucccugugauucaaaagaaggcuguaaucccagcacuuugggaggccgaguugguggaucacuugaggucaggaguucaaaaccagccuggcuaacauggugaaaccccaacuguacgaaaaauacaaaaauuaggcugggcaugguggcucacaccuguuaucccagcacuuugggaagccaaggccgguggaucaccugaagucaggaguucaagaccagccugaccaacauagugaaaucccaucucuacuaaaaauacaaaaauuagccaggcaugauggugugugccuguaaucccagcuacuugggaggcugagacaggagaaucgcuugaacccaggaggcggagauugcagugagcugagauugcaccacugcacuccagccugggugauagagggagucucuaucucaaaauaaauaaauaaauaaauaaauaaauaaauaaauaaauaaauaaaauacaaaauacaaaaauuagcagggcguggugguggaaaccuguaaucccaguuacuuuggugggaaccuguaaucccaguuacucgggaggcugaggcaggagaaucacuugaaccugguaggcagagguugcagugagccgagauugugccacugcaguccagccugggugacagaggaagacucugucucaaaaaaaaaaaaaaaaaaaaaaaaaaaaaaaaccagaggggacuuccuacuucagaaaacgauaguauaaauugaaucuauaacuagaaaaugaucaaucuucuugguuaaccaguuaaagugagagucucgugguccaaaucuagacucaaguaagagcaagaaagaguaaguggguaaguuuuggggaauggucuauuucuuccccaaaggcaagacaauucaucacggauagagaaaaaaauggauggagaagcuaaauugaaagcccaugccagggacagucaacuaggccauuagggacuggacuuccuaaucagcagaaaguuggagagaguucagagggaagaaauuuugagaaguaacugucuuuguugucuauugaaucgauugaugaguaacaauccaagaaacaacuguggcuuaaaacaaaaaacaucauguauuugcucacaauucugcaauuuuggcagaguucgccagggacagcuaaucuaugcuccacguguuauuggcuagggcugcagaacaacuggaaaauucaaaauagucucaccuccauggcugccagugaaggcucccugcuguuugaagagacagcuagggcuguccauuggagcaccucagugcuccucugcauggcuugagguuuucacagcauugcaaugauauuccaagagaaaguacugcaaauggcuggaagcagccaccgcagaucuccuacagcauggccauggaaguuacagaguauacuccugccacauucuaugggucaaagcuaggagacuccagaagaggggaaauagacuccacugcucaauggcagaagugguaaaaauauuacacgagacaucuuuagacaucuauaauccaccccagcaacuaugaccaaguuaccagugugugugcggcaaauggagaauuuuuaaaagaaaaaugaaaccuuuucuguaaagucauauacacauuagauugcugaugauggauacuauaaaccuuugugggaaccacccugaacaguucucucugguagacuuugaucugcuaggaaaacgcucccagggcuucugaaacaagaugucccaacuuccagaauggcucauggucaagugaaggacacauaccauauucuucuuaaucuaccucacaaagaguaggcacuaauuaaauuccuguuaauugaaucgugaauuuccagaccuccuguguauuccauauggaguaggcacauggcaguuaaauagaaaugcuuuggggaggcagcaugguacugcaaaugaauagcuuuuaaaacccccaacaguggcuaguggcuaguucuggaggucauggagaaagcuaaucaaagggagaaggggaaacaagcauaacaugccugguaaccaguggacucucaauaaauauuuguuggaugaaugacuggggagaaaaaugcuuugaguguagauaagaggacccuuccagggagaauucaacccagaaaaugccuuuugcugccaccuacagccuugugggucuauaaauacccucccagccugcaguggauuuuauauagaucauuuauuucaaacagggcacauaggcuaguaacuaaggagauuuucuuaugucaacauguuauauugcaugcauuuacaguuucaagauuuucuucauuucuguauccauagcuucuagaaccgugauugacagagagcagugguucucaaccaagggugauuuugccuuccagaggauaucuggcaaugucuggaggcauuuucgguugugacagcuggggggagagguguuacuugcaucuaguggguagaggcgagggaugaugcuacacaucccacaaugcacaggacaaucuuccacaacaaagaauuacucagccccaaacgucaguugugaugagaguaacaaacucugccauagaguaaguauuccauaaauauuuucaggaugagaaauaaugaaugagaaacaaaugaagaacaacacuaaugcaguuaaugaagauugugugguuaaggcaaaauaucucagcucuguugaucaacuacagacagacaaauacaacuggauuaauaggaagugacuugggcgaaagugaaaaauaacaauggacaccagcugaaaugagugaggacaaauaaagaguaagagacagcucaggccucugacagggaaaaacccucaacaccguccucuaaguguuccagugaugacuuaggaagaagugacuggugagcagcuucagaaauauacugcugugaaacugccuuauugauaaguuguuguauucuuacauuuguacuuguuugucuuuaggaauuuaaauaaaacucauuucauauuacggguucagaucuuaacuaaucuuuuuaaauuuuuauaaacucacaaguucuauagcuuucuucugguauuguuaaggaggaggcugucuuuuaaccaggugcaucuauggggaaucuguggugccucuuacaguugcaugcugccaacuucuugcuuaggacguaaaauuuucauuuucuauguggauaggacuguaacccgcugcacuaauaucacuacugucacauuuugucuacguaccucaagcuuccuacuauuuuuauaaguaagaaacacuuguguuagagcuaaaagauugcacggggcaaaagugacaaaaaccuaacaaggcagcaucaucaaauauaaagaacauagagggucagaagccuuuuggacuuagucucauuaauugggggaaagaccucuagcccccaaaacuuugaaauuguuaaugacaacuauacuaaacaugagaugugacugcuuuaaguaccccugcagauauauuuuaaaaucuaaauucucuccaucaaagcaaaaugugaauuaauguuuugacaaguaaguugucacacuuacugggucuuuggaacaauaauuuuuccacucaaguauuuggcaaaacagaacuucucacugcaauuaugugaucccuccccugcccuccuucaggcaguuucaaguuacacuuagggcugcuuuagcuuugauguuuuugauuuuuuuauuucuugcuucuuuuugaaaggagaauguaggaauguauuuuacguaauaucgugaaaucuaucuucuacuccaaauuguucauucuuggggaggguccauggguggguaaaggggagacuuuggugaaagagugugaaguuucaguuaggacgaaugacuucugguggucuacugcacagcauggugauuacaauaaguaauaauguacugccuguuucaaaauagcuaaaagagaggauuuuaaguguucucacaaaaaauuugacgaauauuugaggugacagauacauugacuagcucgauuugaucaucccacaauguaugaauguaucaaaacauuacuuauacuccauaaauauauucaauuaugauuugacagucccaaauaauauaacacaaaaaaauacauagaagucauucugauguccuucaggaauguucacuugcuugugacuaaauaucagcguaaaguucugaggaaggcuguuggaggaaggacacuugggccguaagucaaagugcacagagaacuuucacauccauucagcacuggcaccuagcaucaaagaccugagcugcuggagaauaaggcauugucagugguaguuaaucuuaauggggcacacaagggaugaucccguggcccuuccuuacuccauacaagguuguccaagagagagaauacagucauggguccuuaguuucuguuucugguuaggccaguaaagccccuuuucaucucucuuuuccacuuaucauuaugaggcauugucaacgguaguuaaucuugauggggcaccugaggaaugauccaauggcccuuuguuacuccauacaagguuguccaagggagagaauacagucauggguccuuaguuucuguuucugguuaggccaguaaagccccuuucgcaucucucauuuccacuuaaucacuagagacagaaacuaaaaaccauggcuuugggcugcugaaagccuaaaacaaacaaaacaaagcagaacaacaacaaaauaagguggguuggacaagcuuguauggccucauugcucauaugcauuguggaacuuugggaaaauaucucagcuacacacaggguauuucagagacuugcaacugagaaacugaauguuccaucuccagauagccagcuucauuacgucuucuuuccuucacuccauuuucugcuuuuuucaucuguuaacaguucuuguugcuccucauuuuagggcuuccaagacauccucaaauacucucuugcugguguuaucaaaccaagcuggggucugcucacucagugcggcaaagccaaacacugacauagggacugcagugagagaaagugaggcauuuauggcaaggcaccaagcaagaagaggugagcagcuaacgcugaagacuccaacuucccaaugacuuacagguaaggguuuuuaaagguggggaggcagacauuacaggcaaagucauaagucaaauacaugaaggauaggcauugguuugaccuaaaaaagugggacaucuugaggcaggggcucauaagacauaggugcauccaaaauuuuucuaauuugcaauugguuuaggaggcgaagcuuucucuaaaagcuugggaucagcagaauauuacaucugaccuccaggccccucaggaagaaauucagaacaaagaacagcagucagaauucaguccucaguuccucuuuaucugaggucuaugugccagcggauccauuugguggggaucuggauuucugaaaaacaacucagggacauauguuaagacguuaucuuuagagugagacccugucucaaaaaaaaaaaaaaaaugcuaucuuuaguuccuguagggaaccaaacaucccaugauucuuucugggauacuguuuuaagcuacuauuaccuucuugcuugacaaguugcucacuuacuucucagggcuagcuagaugccugaaauuucccaugaaauaacucaagauuuuccuuuauuuccaugcuuugggccuugcagaccccuaagagugaucccugcuccaucucacugguggaacucagccuacagaaauugcccuucauggugguuuauguugucugccccaaaccuacagucaccucacuugggcuugcucuuucuguaagaugaggccggcaagaggcagagcucacaggguuggaggggguggauauuuaucuuuggugguuuucuuucucccuuuaauguuucucccucccucacaauaugccccaaguuuuccccaguuuguggauuaucucagccuuccacccuccuuugaaccuuacugcuguuaaaccucauccucugcuugguaagucuguuuauagcuaauauaagagggcucaaaaaauuccuucaaggaaacuguguuacauguugaauuguggccuccgcgagacaaagacuaauauuuauuugagggcuuucuuucuuggugaggaugucagaaagggagagcucuagacagccaucccugagugacucaucacccuucucaaauauguccauccuuccugaggcaggcuccugccuauggagcgguccuaagaagaagcacauacacugguauucuacauucuaaaacaguaacaagggagggcugaguaaaauaaauaaauaaauaaauacauuuuuaaaaaggagggagcccagacuggcaguuucaaggaugcaaacugcauugcaaaaucaaacugaaucaugaagcauuugggcuggugcacuguuaacuuccaucuguuugcagacacauuugugccugggauuugggagcccuuuguaucaagcaucugacaagggucccuauaaccuuaaucuacucgcaaucaguuugggauggauaugaugggguuucucugcuuuugcugggauugggagaaauaaaacaugcaauuuaaguggaagcaaagaaauuuaaagaggauuuucuuuugcuugggucaaucccuguuaaaagggagguggauguguuuuccuuguguuggauggcaugagauuaugugaauguuuugauuuauuaaaaugaacuacaagguuuuucacaggaaugacagacauuuaugacugcauguaauuauaaacuccugaccuccuggugggguuggagcaucuguuucaaaugugggacguacaagcaccucucacaugagaaaugagggaugggugggaagggauaggacagagcuucugucaccauggacuuaagaccauguuggauccaaaagguggccugaaacccugaagcuuaugcuucacagcugggcuguaagucagacuugaacccagcugacaugcaaggucauggcaugcccgagguggugacagugaacaaaguguauaguauguggccagugguagcaaugauaaaaaguauaccaaauggacuuugaaggaccaaagguuuuaaaagucaauugguaucaccuccacacuaacuaggauaguggggugcauuugguuuucaaauuggguacuuuuaacacuuucgugccugacuguuguucuuugcugacuugauucagucacucguagcuuuauuggucugaaccaacuccuuguucccagguuacagaccugccuauuguuccaauaauccuguuucacuugaauaaaggaaauaugucuuaaauguaaagauucuaguucucacacuguacucugaaguccaaauacugucugucaauguguaaccugaugucucaacccccagugagaagaguugauucuuugguguucaccaaugugggagacuucaccgggacaggcuuuuuuugcuuugggcucugcuauuuguuugcagaacacccaagagcaagcaaacaugcuuucuucacagcaguaccuuaggguuuugccauuguaaaugggucugaugugauaugacaagaccagagaaauuggauguaaauuuacauuuuugaaugugcuuguuguuucacaugauacauuuagggugugcagcuccuuuuguaguuuuuauuuuuacuauuuaaguuuggaaaugaugcuaaauuuuuguguuucuuuaaucaguguguucccuuugguaauauauauuguauuauguauugauguguguaucaauauauacugauacguauuacacuuacacauacaaacacauacauaagagggggugaaaacuguagccuuugcauucuccauugccuuuacagacagauccuaagcaguaaaaucuugguguugugauguacagaaauggaaaggaguauuaaaccauauuuaagaauaaaagaaaaaaacagagggagcagagacaacagagcaacauccuugaaacucuccaagagcagauauuguauaauuaaaagcaaauaccaauccauggucauuuuucaucagguggcuuuugacggcuccuugcugcaaagagguuuaaugauuucauugaguaagaggugguggacucaagacgcgugcauuggcugggagauaauugcauuuaaugaaaggcacauccauagguuuggggaggcaagugauaaaucuuccuccagagucuguggaucagucauauuccaacugaugagugguuggagaaucaauuaauaaucaugaugagaacaauacuuuucacuugcaauuuuccauaggucgcuuagagcaacuuuaaaaacaugaacauccaucuucuugguccuucugggaaguaaacauuugguagaauuaucaccauauagucaacauggaaauugagguacagggaauugauuggccacuacgacagcaaaaaagggagaggggcacaaaaaaaguggacacaucuugguauuuuuuauuggaauguugacuauguauucugcaagcauuuuuauugaucucuaaggauaauauuagcuaacaauuuuagugucaggcuuugugcuaaaugaaaugcuuuacugguauugucucauuuauucaccucauuuuuacagaugagaaaaaucaagaaugaggagaguuaguaccaugcagauggucccaggaugaaaccagaauaugaacucaggcaguccagcugcucaaccuguguucuuaaccuucaugcauaucaugugccagcccuguguugugauggguacuugggaagaugcccacaaaaagcacaugauaccuguucucaagaagcucacagugaguaggggguacaaaacccaguacuaauauuauuugcaugccagacacuauucuccaugcuuaauguauauuaacacauguaaucaucauaacaauuugaugaggcaggugcuauuacaauacucuccauuuagcagauggagaaaccaaggcauagauaggcuauguaacuagccuaagaucaacauuuauccccaaacaaugggacuguaaaguugaugcugucaaucauuaacugccuuuuuuuccaccccaagaagguugauguucuuauuagaggugaucaggcaacacuaaaggauuuuaagcaaaggagccauaucagauccagguuuuucuaagaccacucuguugacacuggggugaauugauuguuuauucccucuucugcuauacaagauauuuauggauuuaauagaguccaaaggauugaagguuugucauacuuccaggaugcucuguggaauuccauaucaauuuuucuuuauuuuccacaccuaaucuucuccuuuguaaaauugacacaaaacugaguuugaacuuguccauaugccaccagaaugaccuguagcucuaacagcuaauucuuccaucuuaugaagccaugcugggguggggcaugugucccccagcaaaacaguuugagaaacugcagcccaagacacucuauucacaauacuuuguuguuuaaaaucccaacaauggaaugaucaaguguccaaaaauacacagaagucccaauagaaaugcccuaguuuaucugaauggcuaaggaacuuagaaaaaaaaaaaaggcaggagauccagcuguucuaaaacccaucccauggauuccuaugugcaugguccuacgucugaguaucagccaauguccaagcuccuaacuuauucuaucccauugccugagagcaccuuuccagugcuuuccacuuaacuagccuuucauuaguuaacgggaccucaaagucccauuucuucaaagaacuuucccauuaccucccuaguccagggagucuuaagucucagacucccaggaauucaaggagauuuuuuaaauugccuugcuaauucacuguuaguucguaucuccuaucaaaauguucccaucagguauuuuauuaccaccuuugacagggaacucaccacuucaugaaacagcuucuuaugucuuugagcaacucugacaguuuuauaguucauccuuuuacugagccaaauucaauugccuauaacuuccuuccuagcagccccaaacuccuaucccucaauuaggcucaguguagagugaaauaaacccuccuuuaccaccuuggacugugguagguuucucaaaauaucuguauucugccuuauaagauaacagcccagauuauauguaacucccugugugcuguguggucucccucaguaaacuauaaacuucucaggaacaagagacauaucuuuuauuucugacagcuguugcaauuccuggguaccacaggcacuuccugugcuuggagcacaucacugauggcugaucaggaaagaagaucuuuucacauaaagauaacauaaacauguuguacggagggaggcaaugaagaggccaccuucaugcagcagcaguugugugcugcuauuguaaagagauaaacaugugucuauccauuugacugaccuucuguccaguaaagagguugggcagaggcaauaaagccaauuacacuagacuuuauuaccucuuaaaugguggcuucauuaauaaacauaguauguggccaauguacaauuuaaucaacagacucagcgaaaauaaaauaagaaggguauaaagaucaauggcccugcuuuuugcaagaggccaaagaguacagacaaaaagaaagucaccaaagaaaggaacaggaaauaacauacaaaagaugaaaguguccacaguagcaaaaucccugagaaguaaggcacaagcucagaacgcaacacaaaagaacuauaguugugaggauaaaggaugacuagggugcucacugggaggaaacugcauaagaaagaggucaaguuuuggaaaccacaagaaggaagaguccaagcaggguacauugacuauucauagaagaaagccaacaaacuuagcauuggcaaugguugacuauagcaaucaauaaaucacaagaccuuccugccaaaggucuucuaauccaaauccucauuuuacaaaucagaugcuaaggcugagagguugaguacuuugaccaagucacagagccagguuuuggcaaaguuucccagauccuggacaaugauacaaugcucuugccuccuccgcaggccuaugcaucaagaacagucauuaugcaucaagaacagucauuuauuaacguccaggcacuucucaggaacuucacaacuauuaccucaucuaaaugcugcaacuacuauacaaaaaccaagaaucacguugucauugugcacaguaggauacauaagcccaggagauuaaguuuaccuacuuaguaucucacacuaaggcaggaaauauuugggauuccagaucgcucuacuucaaaauccuccuuccucuauaccacacugccuuuuaccauggguuagcaagcauggacagugaguauguuuuauaccaccauccuccuaccccugggguuauaaggagugcacaaggagaaaaggagugcaauuucaagccacugugagcaguauccacagcauuugaccucaaggcaggccaaggauauaacucuuucagggagccaagcaacucauauuuacagaggucucccaaugcaguuucuggagucuagacuguaaauuccugaagaacaggacugucuucccagcacuuagcucugugaaugacacaucauagggggcccacaaucagucauuaaacuggaugguucucaagugccuaucugaggucaggacagauuuacagacaacucuccuccagucaagggcaaaaguguacaaugaugcuucccugcacccugagagggcagaaaagagacgugggacaucugcccaaccucaguaaggcaggauuccucuacagaccucugaauucugucuguaacaaacacuuaugauuucuggucuacccaccucaaaacucuacgacaaagaaggaagaggcuguaucuccuguccagagcccuccuuccuuugucucuagauugcuccccaugaguuucaggccugcuggcuuuugagccgcugacaucugucuccuugggaaaacuccauuugucaggccuuccugccagaguucauggccuguuggcugcuaggagcaguaaaguuagguccugcugguuggccccuagcccaagucucucucuguuggcccugaacugcaucacccaagccuaauccccacaccagaccacaaauccucagacugucugugaaacucuuuucaggcucuuuaaugcagagcauuauauuuaacuuucugcucuuguacagauaagcaguacaugaaaagagaaaaauaugcagaucacauuuuaauaaauauggaauacugcaccuggcaucuaucuaaaaaaaauaauauuaccugcacugagagaacagcaauaacaccaccauaacaauaacauugucggaaugcagaaaaccaagauguuuugaauuguguuauaauuagaaagcagauaaacaaauaggaacaucauuuauucauuaaaauugugcaaauggaaaaucuacuuaauuaauuucuuuguacaaugucuguaaacucuuucggggaagaaaucuaaggaacaauuucaagcccagagcaagugacacaauaacggcuuugaagcacaaccggaaaggcagaacaggggugguggcuuuuuggcagaagugcucuuuugagugagaugcugaagagacaaagcuggccucaugaauggcauggcgcaggcacccagucaucagugugccuuaauuccauuugcccugugcaucugaauaauacccacuuccucuucugucugcccucagaaguggggucucagggucacauggaugaaguugaaguuuauuaacggguuuucugcaaaccccccuggaagguuuacaagcugggucauuagcggguugcauauccauuauggugaucauuuaccaaccaaaggguuugggggagggucagcacuuagcguaguugcacagcaaccaucaauuggccuugguuccauuugucucaucccugccuccucccuccaugccccucuucuuacucuuauuugcucccuucauucuuaggccuccuucuugcucuguguuucucagacacuauccuacucuagcuugcaaccuuuucagccuacucucaucuuaaaacaaguccuguauucaaguuaguaaugauuguugggugaagcuagaguugaagaauacuugauaauauacaacacuucuauugauucucuggguuaauuuucccaacaaucuguaaaauaauaauagcaauaauggcaauuauuuauugaacaccuugagccagucauugucacguacucugagugcauuaucucauuuaacccucaccaugaccuaauagacaggcacuaauaguauuauucccauauuacuaaugaggaacaggggucacagaguugauuaacuuucucaacuaucacaauucaguacauauagucugucuuaaaucuaauuuuucauucuuuuucauuucuucuucuuuuucuauaaugagcauuuguauugaaggcuuuaaaauuguuuugcuuagucauauagagaaaauuauguaguucaguagaaaacaacccguaguuuaaagaacaccugucaagguuaucugauucugaugcaacaggagcuauuuugcgacucuguaaauuguaggugaacugagaacaaugcacaauuuuuuucuauacacaugcaaauuauguucuguccaguagagguucaauugacuuuucugucccauuguaggagaaucuaguuuugcuuccauuugcacauucauuucaacauuccuuuacucuauauacauuugggcuuauuuuucacuucuuuuuugaauugguuguaacaccucaccuauuuccauauuaugaguuaaauaaaauauuuaacuuguuuuuuguuuguuuguuuguuuguuucacagggcugacguaacaaagugccacaaacuggguggcuuaaaacaacagaaauuuauuacugcauaguucuggagacuagaaaucugaaaccaaguuguuggcagguccacgcucccucagaacccucuaggggagaauccuuccucgccucuuccagcucagguagccccaguuguuccuuggcuuguggcagcauaacuccagucucugccuccuuauacacaaggccaucucuucccugcuuuuccaacugugucuucacauggcguccuccuuguaugucuguguccaaaauucccucuucuuauaagggcaucagccauauuaaauuaggucccaucuaaugaccucaucuuaacuugauuaaaccugcaaagacacuauuuccaaacauggucacauucucagguacugggaguucaggcuucaacauaucuuuuaggggcacacaguucaauccauaacaagguguucauuuuuauauccauaugagucaugauuuuaccuucuuuugaaaauuauuauaacaucuaauaaucuccugacaauacauuggaauacaaaaucacuuauuuuuucuuuuuaaauuuuuuucuauagaacaugucaaauauacauaaacaaaauagagagaauaacaauguguccccauguaccugugacucaaccucaacaauuauuaacauucugcuaauuuuaguuuuacucacaucaaugccugcauuuauagggguucugcucuugacucucacccccauucuccaauuccaguucacugcugaguauuugggcugccaagaguaacuuguuacuuuaaauagaaauaaauaaucaauucaaagguaguaacaaugauaaagcccuuacaccacccauccuaggagggaauuauauugcuucuagacuuugcacuuggauaguauaucauaaacacguacucggauuuuauggagagaaauuaaugugucucucuccugugauacauuuauauuuuaacuagagcauaucuggaaggaagaugcaugaaagaaacuuugaaacagauggagaccagucuugucucuacgacuccuugaaguccugcuuaugagacagcccucucucccaccugcaugcaaggacagcccaagguucucauguaaggcuggcagcaugaagcuuucaguagcaaugugucuacucuucuccuccaaagugcucuagcuaacaguacgugcuaagacgucuucacuuccacaaacaucacaauagcaggcauaucauccaagcagaaaauuaaacugcacaagauauauuuauauauacauguuuuuugagacagaguuucacucuugucacccaggcuggaguacgauggcaagaucucggcucacugcaaccuccaccucccagguucaagugauucuccugccucagccucccgaguagcuaggauuacaggcgccugccaccacgucuggcuaauuuuuguauuuuuaguagagaugggguuucaccauguuagccaggcuggucucgaacuccugucuucaggagauccaccugccucaggcucccaaagugcugggauuacaggcaugagccaccgugcccggcugauaguuuuuaauaaccuacacaagacaccuguuagaaggacugcucuugaggauuuaagaacaugugagagaauguauguacaaguuuaauaauugaacacauggugaggcuuagaauuugggguggguggaaaaaaaucagagccauggaaucugugggcugucuuggaagauucuacccccuaccugauuugucacuauuagagagcuaugcucuuuaguaaauuuucuauccucauucuagguucuagugcagugaugauaaaaauccccucuaagaacaaaaaucucuuagaaauagauagaauuuuauaccgucauuaccauuuuauaaacuuuuaauuuugaaauaguaggagaccuauaaguuguuacaauaguacagugaguuucuguguauguuuccacccagcuuuccucaaugauaaugucuuacaugaccauaguacaguggcuuaugccuguaaucccagcacuuugggaggccaaggcgggcagaucacuugaggccaggaguucgagaccagccuggcuaacacagugaaaucucgugucuacuaaauauacaaaaauuagccaggugugguggugcacgccaauaguccuggcuacucuggaggcugaggaaugagaauugcuugaacccagggguguggagguuacagugaguggagauuacgccacugcacuccaaccugggcgacagagacagacucugucucaaaacaaacaaacaaacaaacaaaaaaacaggaaauugacauugguacaauaaaaugaacuaaaccauaugcuuuuuuggauuuuaucaauucuucucuuuuuuuuuuugguauagcugugacauuuucucucauauauagauucaguauuauucuuuuuaaucacaaggcgaauuaauauauuuucuuagaguuggccuacucuuguuguaagccucauuucuauuuccauccccuauuuaucugggcuucaugaauucuuuuuuuucuuuuuccauuaacauuuuaaaaagcaacuuuauaucagaaaauuaaaaaaaaaagaguacaagaaauaacaaacacagucuucaaagcagauuugcuguuuacuuauauaccuguuuugaguuaaaguauucucuauucucauucuagguucuagccaccucccgcauucagauacaaccaccaucgcagguugacuguguucccugucguuuaaucuuucucuacuuugacagguauguuuuauguauacauaacuugcaucuuuuuacuaaagugauuuucaaacauuuucucucacugauauacaaauggcagaugauauucauguaggagagugggagacauacucccaacugcagcuccuggagcaauaguuguaacucuaucucuuuuucucccacucaugaaaaauaguuggaauacgugacagacugcucuauaaugggaauuaccuugaaugugcuccaauuuagagaaacaguaaagccugcagaaauucuagggcuuuaauuauuuguaguaauuacuugaacuacaccuuguaacugaucucuauguaacauaaugguuuuaaauggcugcuuuaauaaacauaagcuuuccaggcaaguagaucuuaucuuaaaacagcagagcuugacuagaacacugaauggaaaaauugugagcaggugaaaggguuauagguucucuuuggcaccaccgugauuuggcaaaugcacuuuggucugccucaauuucucuucuucuuuugaucagguuaguaauccccucucauccugcaagacugagcuccaguuuaucucagugcucugagcaauucccacacugaccuguaucauaauuuuuuauuuagauuucaguucugacucucaucauaaucacaaaauccccaggacuuagcauaguucugagguuacuugcacucccagauuacuugggagacuugcagacuugcacuagaugggcagaagcacaguagaguagccaggugaccaggccgauccagguuccaaaggaauuuccaucacuuaccaguuauguggaucagaacaagugauuuaugcugugaguuucaucugucaaauggggauuuucacaggaguuccauuauagaguuguaguuaaggaugagaugaucuuauaugcguaccaguuagcuuggcaucugacauguagcaaaaauucacuaacaguggugauuggugccuagaauauuggugacugcugaguuaauuggguaacugaaccaacaguagauagccuggccauacagcaaagccaccuggcccuagaggugucuagggauuccaacauagggcugagaagugcaggauaggagguaucaguaacacccgugaugaccaugaaggugucuuacucaucucucccugcaagacaaccugcugugaagagcaguugacugacagcuuuaacucgcuacuccuuugaagcugccaugguauuuacagaggcuacugagcauggaggcuacagugguaauuccugcuuaaugcgggaccccuguaauagacuuuguucagggccuucccaucagccugacugagacagccaggacugcaauucaaggcccuuccuauauaauccuucuuucuuucuguccauccacagauguuaggcuugcaucauggucugaggcucucccaaacaucaugucuacucccaucaucauuuacagguguguuucccaagaucucuuguacauuuaauuccaucuuagaaucauaucuuggcaugaacugacaauaccuaaaagaagcuucauacuuucuuugaaguguagaucauaugauguuauuuaugcugucuuauauccccauccauggauugcauuacagaagaggcuagcacaucuauuuccauuuguaggcaauauccaggagcaaagcauaauguuaagguagugugugaauggacuuuaagacauucuccuuuuccacuugaaaauggccuggugacgacucccaaaccuggucuaagacugaucuacccauggaucaguaauuuuggaaucguuuccggggucauauagauggaacagauaaaauaucaaaagacacaaucucaggacucccugagcuuauagagaagaaaaauauaaacaggaaaccauuuguacuuggcacauugucgcugcuacuuggacuucugaucuuuguggguuuaauuggcacuguuuuuuggguaaauuucugguguuuagaguuggcuaaaguuauacaaacugugcuuuacauuggcccauuauuuauccgucuuuuaacuuacguugcuuugaaaacacccaugcguggcagaggggcagauguuauuauucugauguuguucuuuggaaagcuguggcccagagaggauagggacuagacugagcucacagaggcuggcugugucaauccucccaaagcccucagcugugcugacucccauuagagguuaagugccucucauaguaccaagcugaggauucucuaacacugaucacucaaaugagcaaaaucacauuuggaguaauugcaguuaaauuccuuuccaccauuagagcaccaggcuucgguuuucacagccugacuggcucuggccuuugcauugucaaaaacauuucaaacccaaucacaacuucugccaguggcugauacccugaggcaugauuugcuuuuccuguagcuuccuaaauuucuucuuuuccccaaaaaccuaucuucuugaucauugcccccgagaagaaucugaugacuuucaucagcauauuuuaucaaaaccacugagcagagugagccaugacaaucgccuguccaaaaguuugcaaaacaugucagugaauauaauugauauuuuaggaaaucaaugacuuuagagauuugugaccaguaagaacucucccacagagaucauacugagcuaagaauagcugcccccuguacuccaaguaaaaaugucccucuuuaggcuaaugaucccugcaaauccuacacuaauugauagcccagaguuccagagaguugcacuucaguaaauggucaaaaugacacauuuggcauuagugucuugacucugucucccucaggugcaaucuccuuuucaaaucacuccagcaagacaaccauccuaacugcuaauuugcagucacagaucucuacuucauuuucuauucuccuucuucaggggcaggaagaaggggcuaggguauggagucaaauauuuaaacaaccuggguugaaucucuuccaaauaacugugcguguccauacacuuggcuauguccuagcuuuuacaugcacaccuggccauacagauuuccacaucugucauguuagaugguuggagggaaaggcugaucauuaugaaacuaguagucaguccauaguguuaaccacuuucaugucaguuucccuaucuauucuucauagcauauucuucugccccaaaaggcauagcuggaguuccucucucuacagggacagcaagcuaagguguauagggaauaacaaacauauaugcagcuaaaauuuaacaaucuauuguuugcagguccuauacaaaacaaaaaaaaaccuuuugaucuaaaauaguaaaucauuaugauaaagacuggcuauaaaguugauuuggggacagacacuucuguucagggcucccuaaucacaaugcaaacaucuguuuaccugacuaacuugcaaggucagccuugucaaagaaugcaaccuaguccucauuucaguuuucuccaaaaauguuuccugucuuuugucugagaaaacaacacugaugaaucauagcaacaacccacacuugugacuaagagccguauuuaaaggagaagagcugaaggaaacacagaacagaguucccauuccuacaccuccuccuccccaugugguuuucuuaagcuuguuuagcugcuucauccaguccauucucuuucuccaaguuucucuucagguuuagaugugacugcuggaaggcaagagaaagaacagaacaaggguaguugagauuaaaucagacagccaugauuuaaucaagcccugagggaaacgggaaaagaaggguaggccaugaguugguagacaagggaagcuggggaggaaggaaggaaagacgaaagggagggagugaggaaggaaggaaggaaggaaggaaggaaggaagggagggagggagggagggagggagggagggagggagggagggagggagggaaagaaagggcaaagcagaauggauggaggagagaauaaagaagaaaguaaccuaagaagaaauaaaggggauugggagagggauuaggggagagggaucaagacagagagagagagagagagagaaugguaggaguuggagguaagagauuuagagcaaagagaagcagaagaugggccagagaagaucuccccuugaggauuccccuuaacuuucacucuauggggaggaucauuagggagaggagggggucaugcaauggcagugcuuuaaaacagucauuuuaaacccucuaugucuauaaccauccacccaaucuaacacuugugaugcugagcucccacuauuaaccagacaccaugcuuuagauuugaguuuugcaaauuuuauaauaccuugccucauuuuucuuuucagaaaaaagaggggaaaaacacagaagaaagguaaaaauguaggcaaagaagcaggagcagaaacagcacaacucuacacagggcaaaaaucuauauaggaguauggggaaauguuuauaucaggcaagagagggaggagcuaacauuuauagagauagauggcugagugcgaguuauaguacuaagcacuuuccaaucauuauugcuuuuauucuuuacaaaagugaaccaggugcuucgguauucccauucugcagaaaaguacaauagccuuugccucccugggcuuucuaucaugugggguauuauuggccuguguguggauaucauuuugccuuacacaaaaauuuccauuguagcaggcugcagagauuagggauggugccacaaagcauuaagaauuggccugaagaaaauuagaaagauaucucuaauuucagcaccaggcacuagagcagaaauggcaaauggguuucaucucacaugccaacuccaauugauuaaagccagcuucaugaaggagucugaugagaaccauucucuugccaccugggaccaguaggaggaggcugugguaucuagauagugacaucugcucuaugcacaggauggcagagguugcaugugugccuuagagaugccuuccuugcaugagauggaaugaucagcuccaugaguuacugacauccaugugggcggccaaaugacugguaaaacuaaucuauccauauccaagagcugucuacagucccauugaaaucucugcaucagagauaguccuugucacuguaaucuucguagguccccagacugaggacaccaucaguguugcucagaucccauuuggggaaggcuccacggugcaguggagccagcaauggacuugagagccggagccugugauugagcccagacuugucaccucgaaugacacagaguaacuaacuucacacuuaacacaucuuccucugcuguaaaaugucauuugggccaaaugacaccagauauaaaauucuaagauuuugaugccccagauuugcuguacuucaaucguuucagacaaaaccuagauuugguucucauccaaacugguucacugauguucuuuccaaaaacauuuuguuaaaugucuaaaaugguacugguguucucuuccaagcuggcaaaucagcaccgauugucccuugaauaggccaugcuaaaucuuccccucugccuuggccccugcuccacucucagcuccuccgugugccuuccaagucuauucauucuccugcucaacuuccuccgcaaagcuaucagugaccucgacauguuucuaaaacucuccugcugauguccaaagcuugacaggggucuuugaggacucucaaagauugcauauuuauucagaggaagaggaaggggagggguaaccucgcucaaccccugggaaaagcaaugcauggcaacgcuguacauuuagguaauggauuuaaauauucacaauuugaccaggucucuuugaugcaacagaauuugguucucaagaacuuuggguagggaagcaaauaccaaugucuucacacaacuucaaccuuuguacuauauacgagaaaauauuuaguaaacuauguuuggaaaaaaaugaggauauauucuaauagagagcauauuuuauaaagaauaugaaguuauauuugguugcgaaccccggaccgcuacuuucuugauucaugcauuugggaaauucuuuuaaggacucuguuauucaaugucuucacugguaaaauggggacaaaaaguaucuuagauuaugaugaggaucuaaugaggcaagguguguaagcacuuaauccagucccaaggguaugguucugagucaaagauggcaccugggccuagauacucugcauaacuucaaucagaaaugcagggcagacaucgguaaauauggaaacagugucuggacauagaucuggggcauaaagcucaaaaaggaacaugacaugccaccaagacuucgcucagugacguuuccugcugaaguuaaggauuagucucacaguguggcugguucuaagccaaaacuauagggauggaugugagaggcagaagagaggggagcuugugaacagcagcaacccugcuuccuugccuuucuagccuauuucaaaagcaucuaucucacaguguacaggaggaucacagccccugcugggcugugcugggggcuuggucagggcccaaaugcaaaugaauguggccaguccuaagaaucuguacccuguuuucccucagacaauuucuuuacuaaacuagagagacggauaagguagccaccaucacaagccccauauugccauaggaccugugaaaacaucuaauggaagaggaauccaguaacauccuagugaaaucagauuuugccuucucugggugguuauuucacaagugcuuguuucacugucagucuucaaagcccuuuuuaagaccuauuauaaguacauuugucacaaaaauaggaaggaaagcagggcaagggaauacauacugaacaagaaauaggaaagucagauuugagaaacgauuguucacuagcauucugcagaccuucagaaguaauauuuuagcccagugaugccuagaccaguuucuggaaaauuccuguugaauaccauguguuauuaaugucuccaggccuucuuucacaucaggccuggaguauuuuuuuuuuuuuuucugcaccacuaacaauucaaauguucuccauccucuuuaaggacaagcugaagauguucuuccuugcccuuucaucacuucugcagcccauucuggucauucuuaaaccuguaauauguguuucugcauuguuuagcacuugucugcuucauuaagcuguuuucuuucaggaaggguguaaggacgacccgguuucuccauaaacugcagaaaauaagaaaagaacgaaaugcuugggagcugaaugaggcaaagcccaacgacuggcuucuaaagggcuuaaugaaaucagccagugaauaagcagaaaguaggcagcagucaugaauuaagccucucccuguucuuuucacaagugaaagaugaccggagacuggaugaacuuauccccagaggaaaggagguggugggacccacaccauaucacccucagagacagcagaagugagacgguuccauuugaagcugaugaguuuugcuuugguuuuuguaggcguagugcagggcuuugccuuccuggaugagggaagguuccaggaggugauaagcugacucugcagucugcucaggaaacuaacagaaauauucuccuugccucugccaaccacucacagcauaugucuucacucuccagugucauguaagccacccaacggcagggacuguauuaucuauucacacacauaugcacaugcgcacacacacacuuuugcauagguaccuauggcgauaccuauacuauaacuacauaauuaucuauaauucacuaacuuaaauagcagacauuuauugaguguggacuguauccacagcccucugccaagcauggaucaaaaucuugggucaauuuccacagaguaaugcauauguggaaaaccaauacguaaaacagaucaacucuggaaacagcuugaaaaugacugcuggucuacuucaacccuccaauuuucagcaagaaaaaaaguagauucagucugaugauaucaguuaaagaaguguuuccuaaucuugcuugaaaguagaaauuauguugggcaaagagagaaagagagaaagggggcuggcugggagagagagcaaaaaaggaaggggggagagagagaaagagacagagacagagaaagagggggaaacagagagagggaagagagauugagagagagacagagacaaagaaagagagggaaacagagagagggaagagagauagagaaagaggcagagacaaagaaauagggagaaacaggacgggggagagagagagagaaguagagagagaaagagagagauuccaagcuccaacccagagccacguaauuccuuacagaaaaaaaggugagccaucugugaauuuaucaagcguccugagugauucuuagcagucaaaccagggaaugaagucauuuuccaagauucugcauuugugaccaagccgaggaaacugagugcuaggcuguggcaauuucccuguuacacccacagccucgccacccaacaguacuucaugugagguucacacuucauucuugucaucccucaucuuuccaaggggcaugucugaucuuccaaacagaugaacggcuccucuaggucagcagccaagcguuuuuauuucccaucggaccagguuuaccauauaauggauauucaguaaucuucuaugggguugauucauccggguuagauuuuacuuuggaauuacaccauucaccuucccuacagguucucucugauuaaugaaaccuugugaucaagaaggaauaugucaugaacaguugaaggcacugauuuuuacuuuugccauuucccacaaacccugggagaaucacgaaacuccacugaacaucagcuccuucaucuucaauacgagauugccauuuuagguuuucuuagguccuuuucaauacuuuuaaugauucuaaggcacuuacuauggaaaacugccucccaauauaauuguuauuuuuuauugcugcaugguucugauagacguuaauacuaaucucuuagauuuacaugauaccacacuguuuucaaaacuuucauaugcauuguuuuacucuucaaaaaccagcuggagaggauaaaaguaauaauaaugauuauucccauuauacauauuaauaaauugaaguacagagaacauaugugacuuguucaaggugauauaacuaauaagugguagagcugaaauucuaaucuauaucuacguuguaaaaaucuaaaaucuaaucuaaauuauaaucuaaucuguugacucugugguauucaauggucugccuuugagagccugcuauuuucacuuaagggacaauuauuugcuaauaguagcuuuaaaagcagucuagccuuaagacaaaaucagaauugggaaauggcuuccaucagcauuuuuuguaaacgcaaagccauaccuuuuggauuuucacaugccccagagaguagaugccuucauuagccauguuguaccauguggaaaaaaucuagagaaagcauucgauuuacaccacacacuccacuuauuuauuaguuuuauccaagauggccaucauugaggcacaugggacauaacuguuccaaggcaauuaaaccaaaugucagugguuccuacucugaaccaaccaucccaccaaccaacugcaaucagauuaaauagaugagucuagguauacgcccuuaagagcaccucagaaaaauaugauccggagcccugauauccuguccuacuugccaucaugauuuguggccaauaugauccccacaccauugccauaacuuccuagcagcugaguaaaagaaaauacaaauguccuuaaauaauucauucacccaaauagcaaacacugggugacugccgugucuacagcacuaugccaagcaaggaaggcauuagaaagagccaguuaaaggcagccaccugauccccaugcaacucuuaaccuuggaacaaaaauccuuccuuagucucaaguucauccauccuaaaaggaaaaaggaggauccaaugagcacucgguuuccuucgguuucuauuuuuccagauucuuguuagaccacaggguaucccgaaggaguuuuccauggcaugucagcaaaauccaaauaccacucuucagaagguaauauacuuaaaacagaaauaaaacaguaaaauugcacccauauauucacaaaauuuacacuggaaauuaugugcagauauuuagcucagcaaauauaguaagcuauuacuuuuaaugaaugaaagucuauugacugucaucagucaauuuaguugugaaaggaaguaaaaacuaucagacaaauuaaaaugauuguuaaaaaaagcacugaggaacuucgaucuaguucaagaaagagaggaaaauuuaaaaaguuccuccucagcaaugcagagccuauuaguaauuacgcauuguguuaucagcacagugacugaccaaaccuuuuguggguaaugggcacuucagucaaaaccaaaggcuauuguuuauagauugccagaggcuuuuaauuuccuuauagcacauuaaaaccuaguccaucuuugccacauuuuaaccuuguuuagcauaaauuguugcacuuuaaauucauugucuuacauaguccacuggagaucacauuaagaagugucaucauaguauucccaugaccaaaacuuuuuaaucucuccuccccuuacagcauauaaaaauguaguuauagaugacuaccugucuccaauuauuuuaaaaauuuuucugaaucauuucacauugaggauucagaaacuauaaaguuuucaggaagccucgauagaaguaaauacaauuaucuugcaugaacuuccuaugccuuuauuuauaaaugccagcugacauauauguuuucaaagucaaugaggcugaucuugacuuauaaguucauuuaccuaauaguuucacaccuacaugaacauaucaaaacuaaugauggacaucauuagugguaugacagacacagauauugguuuauccaacaaccauuaucuaguccuugcauauuccucccauaggugcuuucuuugcaagaauaacuugccagcuaugucuccccaaucccugucccucugcauuucuuccugucaugucauagucuggugacccaaucuagcuaaugaaauaugucagggagagagucagggaaaucugagaaaucugauaucugucugauagauaaauggcagaagacacuucuccuuaucaaauauuguuggccucuauaagaugccugcaaccgcaacagccaucuugccaccaugacaagccaaaccuaaagaucaagccuaugagcugagguuagaaaaagucagggucuuugaagacuuugcuaaaacaaccgugguucugcccacuuucgggcuucugguugguuaguauuugauugcuuccauccuaacaccucuaaucugauuaaaaagaggguagcguauugcauccacauuuaacucaguuuuuaccuuugauauacccugagaaguagacaauacaagacagaagagauaggugagauggaugguggugaagaaucggaguaaaggcuaagaauagagaugucuucccagugcacucacaucaggccuggauaggcucuucugcagcagacaagcugccucggcugggccccuacaggccuuucugccuggggaugccgaccuguggccugcuacuucucaaaaaaguagccaaaaaguaaccagcucuguguuaauauucaaaggaaaaauagcaaauuuccuuauguuuucuacuuccuuuguuaaagaggaucaugaauuggcuucauagaaauaugaucuacuuuaauuaaagccagugacacugaguaaauuagaacguaauugcauuuuccaugaauuucacacagcuugcauuuuaccaaaagaaacccaguuucagucaacguuugugugcugauaccugcaaucaaagccuuauuaaacuaaacaaaucaugccuucauggaaguuaaggaagcauaaauacaaggcugauucauaaaguuucugauuucugcuauuuggaaaggcagaguuuggaaagagcuauuuggaaaggaaaacuuucuuucaaggaaaauggaaagccuggacuuccuccauuccaaugacgacuugcccuagaaggcuuuggucuuccuauaugacuauucaugccccacgucuauuuugaauagacugauacaacuucaagagaguagauguuuuacaaaaaauguucagguaaaaggaaaguccuaaauuugagauuuggucaucaaaagaauaccaauuuuuaacacaauguauuuuucaaaacaaggaacacagauaaaaaaacaaaccacauuugggugauagguaacuguugagagagagggaggagccugucuugguuaagaacuugggcucuuagcaacugugccaguauccucucuuuccauguacagacuauguaacaaccuucccguaugucacccugucucuaaaauaaggaugaagaaaaacaguagucaccucauaagguuauuguuacgauuagacuauauauauaaaaugaugguaauacaaucagucuucuuuccagggucagaggcaagauaauagucaaacacuaauacuaauauaacacccaaacuauguguuguaagcugaggucuuauuugaacauuuugguagagugaagugcacucacuggaggcugccaccagcaugauccacauugccuauucaauccccccaguagaccaguuagucucacugcuuuucaaugccccagaugguacucuuaccuccagccaacuggccuggaaaagccagcugugacuucacaggggguuggggcaugaagcuuuccacaaaucagcagaaauccacccacaucaaaagaucagugccagcucagccagaauugugcauuucagcaagucauuuuuggaaucaguugcuggggacacauuguacacacacacacacacacacacacacacacacucacacaggaaccaucuaugcugaauaaaauacaauuuuaaaaaaccuaaaugagaacucaaaaaaagccagggaaacucuagguaggugagucagugagaucauccacauacauacggaauuuauguaaacuaugugcccuugaggucaaauaaaaagauuuuuauggaaauccuccauuagaguaaagaacuacagucugaguguuauaugcauuguuuucuauuuucuucucuccacuuauucacuaaaaacugguccuucugucuugccuaaagguccaacauaaagauauuucuuuagcuucuacagacucuuacagauuaggaauuaaauagcuugugaguaucucgacaacugacaccuucauaguggaaagguacucuugaauuugagcaguauuuugagaagaaaauuuuaaaucuucuuucucccaauucccagaacuuccaaguguguccauguaugucuagccuuauguuaacacaugaauaaguuagccuaaauaccuuugcauagacacacacacacacacacacacacacacacacacuauuuucuucuauuuucccuucucugggauuggauuaggcauguauuagugcuuuccacaguuguaucuacacaccuugucucuucugaacucaauaugcccacaagaaaacuuaucugaugggcugaucaaacucacccucuccucacaugaauguagcaucuucccugagccuguucuuccaguagcuguuaucucaauuaccaaaguagaaaccuggcugucauccuaaaauaucuaaacacauugucacccaagggugcucucuucucuauuucuaaugcccuaucuuaucccaaguucucauaaucucuagaccaugucagcagcuuguagauucaucucauuucugccaaugcuaacacacacauacacauguacaaacacaaauucccacgcauaugcauaugcacacaaacauauacagaaaauugcacacuuugguaacugcaccacucuguuaaaagagugcuaucuuucuaaauucuaaaaucuaauugugucguucuuuuuuuuuuuuuuuuuuagcuuuuuaggggcuauuaauguaaaaacuaugaaugaguccccuacacccaacccuguaacacacaugaaccuguaacagccagaacacaguccauauucuaaacacaugguaaacuauagcccacaggucaaauccaucccacaaccuguuuuuguuacuuaaguuuuauuggaacacagcuauacccacuuguuuauguaguggcuguggcugcuuuugugcuauaaugauauugcugaggaauugcaacagagacuauagguagcccacaaccacagcccacaauauuuacugccugaccuuuacgggaaaaaaaaaaguuuauuaaacuugauucuauaccauaagacauucuuuacaauuugucuaauauaugugucgauagcuuaauaugugacagcccccauuucgggcugauugauauccuauuuccaguccauauggguagagaaacaaaggcacggagagguuaacuguccaaauacaucucacagcaaugaagcaaggaccuaaacccuggucaacagguuucagaacuccuuccuuaacuguuauaauugcccucaucuuuuuucaugucuccuuaauaaucuagaacuauuuuccauucccagaaccuugcccuuccacguggcugugcucugcacauacuguucacucuugaaauagcaccguacccaggacacagcauacuacaagcuauauguaugcccucccucugucccaaaucuuuagugcacaccacguuauucaugagcaacagccucuccccgucucccccucucucucucguuaccaugcuuuaagauugucaacuugcuuuuacuggcacaauuaauuuugauauuuucuauuccagccuuuagggaaugaagacaaugguccuaaagaucuuuuuaaaauuaucagcuccuugagagcccaaucuucagaagauggaguguacugucuaccuccauuucuucacgugucagguagauaacgucuucuucgaggguuagguuccauucucucaaccaauuaucauaaguguauaccaugucuguuaaaauagucucacagcauacagaaucacaccuugcaaaugcagguacucauuugcagagugaaugaaugaaugauucuuaggccaaugaaggcuggcccacacagcaagggaaggccuugauggaaauagaaacaguacuaaaacuggcagcucacaaagcaugaagccucagucaggccucagcucuugcugaauuaucuaacaaaucguguguguaaguaucacuggcccccagacauccaguacuaccucaaacgcugaucucauuacauuagcugcuuauugccuucacuuuugcaggcugcucuggaagaagcagaccauuuccugagguguaaacauagcuucugauaaugccaaccucaugaggucagucugcucucggaaguccacuggucaacuacagagcucagauacacauuuccucuucaagguuucuuggaguaagaugaagauaugaacugacaucuuugauggaaaccauggagcaaaaaucaggccguuugugaggauaucuucagacaccuugucaagcugaagucacagcagagugguaucuggcccuacccaaaaaucucagccauccuuugagaagguagguuagaaaaugcaauucuguggaaagucugauuauggggauaggagcccagugcaauguagcuucuauccaacuccugaacuucuaugugagugcccucuucccucagaaagccagcgugcuccucuaacuggacacugcaugugaacauuugcugcuucuuuauuuuuucuguuucuacuccaaauauggaaagucuuuuggugucagaugagcagaggauauggccaguggguauggccacgaggcuggaacacagauccuggguaaaaagcuuagaguaagcagagaaaaucuaccaucugcaaauaaaaucuagcaaaaccuauguauuugauaccuguguuuucauguuuuaaaaaugaauauuuucuuuacaaaauccuaugucccaggguuuuucuuaauguauuugaauaaaacucuggauuugauauccugaaaucacaauaguuuucccauucaggaacccaaccgauuccuauugcauaaaagaggguauaucugaguuuucaagcaacacaaguuaccagauauuuuucaucuucucugaggacugaggaggaagagacagauauacccagaggauagaagaacaauguacauuauuuagacgacggaauuuucucuguguucaaauuauuaagcucugagaucuucucucagugcccaucagaaagggggcacccagaaacaccucaugaugcagauaauaaaauggucauaaacacuggaagaguuugcccugaaaaacaaaauucuuuuaaguagauugaauaaauagguggccauagaggcaaaggaauugccuguauaaauaaugaaauauucuuuagcuuuguuauuccagaaaugcacacaauauccagaauuaauauuccagaaucccaugaauguuuuuaucauauuuucuuccaccuuaccagauaguacuugcauauuuaugauacacggggauuuaaauaucuuuuuaaaaacccacucuuguccaugagaaaacaauaacugaaugcaagggucccauacuuuuucuguaaagggccagauaauacauguuuuuuggcuuacaugccagaugguuucugucacaacuacucaacucugccauuacagugcaaaagcagccauaaacaauaaguaaacaaaugagcguggcuguguuccaauaaaacuuuauuuacuaaaacagguggugggccagauuuggcccacuagcuauagcuugcugauuccugauccggaagaaugacucccaaucuauggacuacagacucauggcagaucugcaauuuauagaaaagaaaauucaaauccauaugcacaccaagaacuguuuacugaauaaaaauaacuuguguacgccuguacugcucuguccucaauguacgucaauacaauugugauuaacgcauuuaaaaauagcuuuuuuugccacugguuaucugucauuagaaguuaaauguacaguuauucccacaugaagauccacugaauguuucacaguaucaaauuauauguauaacccaaaagccuacaucuccagauuuucacuuaaauucauuuacuuccuacauuucccugacuuuccuugucuuuccucuuggguaaaaugugguacacuccucgccccagaaauaugccugaagaggcucccagaucucuguaaagcacaccucagcacuggggcaugacagccacacagcacuggcugauagauggcaucggcuaaucauugcaccagccagccuuuacgcaacucacagguaagauacugcuccagucacagucacagcuggcuccugauuagcucucuaauggguggaguacugaggcagaaaaucccaaacaacaggugauccaaauauaauuuauauuuggcucagcaaaugaccuuauuuuguaucaguuuuaccuucauaauuauguuuucuuuagacuaauacaauuuguuggcacacaccaucugacaacagaauagggugcgcaaaaaugcagguagguggcaaagagaagcugggaaggaugaaaauuuugcuggggauacuuaaacaaauauaacaacuucuaacagagagaaacuugacuauacaucauucaaagggucacaaaaucaagcaggaauuuaaaguuuaucuguucugaaugugacaaugauggcuuaaauaguuugucagagauuacucaucuagaagauauaaaauaauaauuaugaugaugaagauaauaauggugaugauggaaaccuguaaagccuuuuucugaccaaccuagacaaauuauauccccaucacaguccaucacagcaaucaguaaaucuuuuucuaugaaaggucaaauaguaauauaaauaguaaauauuuuuuaugaucucuguugcaaauaauucugccauugaaugagaguauuuguguucuaacaaaaauuuaaguaugaauaucaaaauuucaauuuaauauaauuucacauaucaagagaucuuuauuuuuuaaauguuagccauuuaaaaauguaaaaacaaaucucugccccaaggcaguacaauaacagguagccagccagaugaggccccaccccuacuuuaucucaucgcccugucuuacuuuaaauccuuauuauuauuugaaacuauauuguacauuuauuucuuguuauaaacaguuuacuaaauuuuuauauuguaucuacccucacucaaauauaaguucuucaagaacagguaccauuugcaucucuuucaacuagguaucaucagugccuagaacaguaccugugaaagauagaucuuaauaauacuuauuggauauccaaaaugaauggcuaaauauuauuauuagccauauagugauaagcauuugccacuagcaaacuucaaaacaccucuacguaaaaauauauuuuuaggcuaaacacaguggcucaugccuauaauccuaguacuuugggaggcugugacaggaagguugcuugagaucagucugggcaacauauugugaccccaucucuacaaaacguaaaacaauuagccuagcgugguggugcaugccugugguuucagcuacuugggaggcugaggcaggaggauugcuugagcccaggaguuugaggcugcagugagccauaaucuugccacacugcacucuagccugggcaacagaagcuagauccugucucaaaaaagaaaagaaauauuuuaccucaacaucaagcccuucauagguaaagggaagagauuauuuuccacauucuauauauaaguaaauguggagagcugaagugacuggccagagaggacagcuggucaugugcagggcuugcauuggaaugugaguuuccugccacauccaggccucuguuuauugcagcaaaccaauuucucauguagucauagcccccaggcaggcacccuugcucacagaaccauauugccuaaacauuuuaaaugugagaugcugaauaauaaaacagaauguagaagauuuuaaaaguauccuugauauguuuuggcuguguccccacucaaaucucaucuugaauuguaguacccauaauucccacauguugcaggagggaaccggugggagguaauugaaucaugggggcaguuacccccaugcuccuguuuuugugauaaugagugaguucucacaagaucugaugguuuuauaaagggcuuuucccuauuugcucagcacuucuccuuccugccaccaugugaagaaggacauguuugcuuccccuuccaccacgaucauaaguuuccugaggccuccccagccaugcugaacugugagucaauuaaaccucuuuccuuuauaaauuaccuagucuuggguaugucuuuaucagcagcaugaaaauggacuaauacaauccuccucuaaugaguuucaaccaaaguuucaucucuggguuccagagaguuucuaagauguuucaguuaauauccaccaaguuccaaucaaccuuccaugcuacuacaguggugccacuuccacacaggggaagaccuggaaauucugaagauguaagauuggaugguaaguccugaugcugaggcuccaaguagcuauggguccacaugguccacuucaguauuuuuucucucaccuacaccacaggaaaggacagcuaaacucuacaggcuauaaacaaaacccugaugacccaugaacugcucucugcuacucuucuuuagcuaauuaauucucauagcauuuauugagaauccacagaggcaugaucccugugccauauauacuggggacuaaugggauaugaggcaaagaauguggacuuugaaaugaggaagauuggaguucaaaucaaugcucugucaugaucagcuacauaacugaaaaaauuacuuacauuuuaaccucuaaaauaaagagacaauucucaaacuuuauaauuauuaacagaaugaagggagguaacauauugcccagcccaguuucuggaaaccuaauagauacccacucaaugauuguuuccucuagaccucaaggugugugcccuguagagaagaacaagauaauucccagggucugacugggcaguuggaacugguggguagcucuuucacuauucaauauggcaccgucgugugcauuaacaaaguaccccuucuucaaggcacucuccuauuguaugcuggaaugauguagugauaacuauacaaauuuucagugacaacacugugaaugggauccuacgguaacgcagugcgcacacaaucaaccauaaaaagcagcucuuaucaaaauguacacuguauuaauucagauuaaaaaaggauuaauacagguuagacuagucaacaagucacauagacaaccaugacuugaguuagauuuuaagaugacgagaacugguggaggaaguaaaaaaagcauuuagugagcaccguggguggggagccaggagagcccugggaguuggccagccucugaguuccaacucaguucucagaagagcuccccaugaauagucccauauuggguaauuugauugaagagccacacacagaaaaacuugacauacagaucagagcauguguuuccacgccaaacagaagguuuuugagaagcagagaacauuaugcuguacucggccauuuccuagaauucagaauaccaaauauuuugaaaguauacuccccagugacaauguagugcuggucuggagaccagaggcucuguaugacagaggcuauccugggagucaauaaguucuuguuuguuuguuuguuuguuuguuuguuucuugagacagagucucacucugucacccaggcuggagugcaguggugcaaucuccgcucacugcaaccuccaccucccagguucaagcaauucuccugccucagccucccaaguagcugggacuacaggcgcucuccaccaugccuggcuaauguuuuuuguauuuuaguagacaugggguuucaccauguuggccaggauggccucagucucccaaccucgugauccaccggccucagccucccaaagugcugggauuacaggcgugagccaccaugcccagcccaauaaguuuguucuuauagcuuauuucaauuugacagugcaaauaaaacacuuuguucauggaacaauccuaaaacuggggcucacuuggacuuuaucaucaucaaaaccaguauguuuauucuaaugaccagggucccagucgguggaggcagcuuuucaaagggaaguaugugaugagguaugucagauaauuccuaauuuuuauggggucacacaugaauccuaagcccaugccauuugcuaagcaaauaacugguguguguuuuguuuagugaaaaucuacacccuugggagcaguaccuuuguguuaacaucucauaaaguguguaaacaaaaaagcaagaagcacuugugauuucaaggaaacagcuacacggaguagacaaguguaggguuugaagaggucagaucccauuuugaggugucuuucugccauaaaccaccggaugaccuugggaaagcugcuugccaucucuaaagugaguaaaaucagcaaaaugggagacaacauugauugugcagccuacuuuaucuagaaugugcaaaucauagccugaggaaggcagaucgauuuuaucgcauuaguaaaaucugaugaaacaauaauauuugccugggacacaggguugagaaggauccugaaugagcaugggcucagcaggaaagucaacugggauggaggaguggcaugugccaggcaugggagacagggguggcagcauagcuauuugccauugcugucacugagaguggacuucucuugagaccaucugccaaaggaauaggguagggggcagcauagugauuuuacuggguguucugguuaauguggguccugauauuuaaacacuagccuauaccuacauacuugcugcauaaggaacaaaacuguuuccaaugugacagccuucuuagguaggucaguggagaccaccuuccucagggccccaaagccuaggcuacccaaggcugcuccccucugggcuccucuuauuugauauuccacuacuagauguuucauuccuuugguuuuuuacucugcuugauucucauuaaaaugaaaacucucugggaagaguaacacauucaaccaagaagcauaaaccuuauuaaauguccuuuuucuucucucuaucaggacuggcucagggcccaggaaaggcacugggcccgcuaggugaaagcagugcaggaguuuuucucgaccccuucaucagacuugugacaggggugccaacuuacucugcccgccccacucaaccucuugugggagggaucacaugagcaagcgaguucagaauccggccagcagcuuuggacuccagcaggagcaggcuccaugcaggccccaugguggugcccagguggggugucugcaacccccaaaaccccagaggguguguuacagugcucuauuagcucugccguccauggacaguaguguguuaucagcucaguggggcccuugccucauccgguggggugacggcccucugccagcaagggcaaagugccagugugacagccuuuguugggcaccacacuccgugaguccugagcucuguucggcauccaagaagaaugagguugcccagacacuugaaggauggugaggcagagaauuuuauuaagugauggaaauggcuaucagcagagaggggagcaggagaggcgacaggaugggcagguaaucuucccugauguccggccaucucugucuggcucuuuucugaaguuaagccaucucuccuccuagggccaaccaucccccugaaaucaagagccaucucuccuccuagggccaaccaucccccugaaaucaaguucccucucucgagucaagcuguuucucucucuacugacugagucuacggucuuuauaggcacaggauggggagcagggugagccauagguaguuugagaaaaggcaacauucaauugguaaaaaagacauuauucagaaagaaccaaucaggagagagugggcacacagggauagaaguucucacuuugggccauggguuucacgcuuuacggcuggaaggugggacuucaccagggaccugcccugucugccuagaguuucucugccuucugucucuaucaacagggcacuguugggagugaugaauggucagaaaagaugaacaguaaugacccauaauuuaggugaagaugagucuucuaggcuggugcucaaugucaugcucagcacagcuuuuacaccaguaccugcucaaauagggaaugagaaguaacuuuucccugccagggcccccaaaggacaagcguugugugucccacuucaguacugagacuccuacuagaaugccugggauaaccugacagugaauauccuggccucaucuuacgccaggcgccucuccuggaguucccuccuggagagccucagcagcauuaggaaucuggaguuucaagcaccugccagcgaauggcaggcuccagaauuuccuaagaauuguuaaucggagaacauagagauuaaagguggagguucuuggaaugcacgaggccuugaaaugugcagucugggggccaccucuuacagagaacgaggauaguaagagacuaggaaagagcuacuacuuguggaguguguucugugccaggauuaaacgugcuacuucaccaccacagccucuccacuuggcagaguuaaccauccucuguuccaaaaaaccaaaauucagaaaggcuaauuuaugcacagauacacauagauaguguaacccaggguugcuggguuuuggagaugcauuauugugaaaauguauccacuuguaacguugcaccuugaguucuuguuucaaaaaagcucuaggaagaagcucagcccaggaaaaaccaaacugaugggauccagagaugccugaguuggagaugaacuuuggcaaacuccacucauuaccauacuaaccuccaaacccagggagaagccuacuugccauuuccuauacauuugacguguguagaggcacgaucaguggcugugccugugcugccuauaugccaccucuacauacaacgacucaguuaaccagcccaauaaaagcccuguguucaccuuuguuaggggaggcauugcuuugggaccuauccccgguauccuccuuaccuguggcaaguaauaaaacccccuuguuaaauccuccuucauugucauuggacuguuaccugccaagcgauugaacccaccuguuguguggguaacacuaguaagugagaacaugugugacucuaaugucccagaccaucuucuuuugccugcacugugcugcaggcagauugcacgguaaagccuggggugaaacacacacaugauucuagcacaaacaaacagaacuaggggucucauaaauggauuugucuauuauaauucugguuucuagaugcauuuuaaguucaaucuuuuuuuuuuuugagacaagaucucccucuguugcccaagguggagugcaguggcaugaucgaucauggcucacugcagccuccaccuccuaggcucaagagauccucagccucccaaauagcugggaccacagccaugcgccaaccaugccuggcuauuuuuguugcuguuguuguuauucuuuguagagauggggucucacuauguugcccaggcuggucucgaacuccuggucucaagcaauccuucugccacagccucucaaaguguugagauuauacgugugagcuacugcacucagccaaguuaagucuuuaacagugauagguaaagcuuuauguaccugauaaacccuuugccuaggcaauucucaacuucuggugccacagaaggagaacauuggcauaaguaauucacuagagcauuucuuguuagauuuucucauauuuuaauuaggacugcauauaguaucacagagaggcaugaaauggccugucacguguaggccuggagagccgaugacucacucucuacacauguguuagauucaacaugaucaaucauucuguugguguauuuuacugaaaagaauuccacagagaauaguaaggaacugacugaaauuauuucauuuaggcaacuccugguccugacggucccauuacaauugcuuuccuuucauuuugaagaagcacgaaacuuucaagaacaguagcaaaacuguaaaacuguugacaaucagcaaaucuccaagcaaguuuaccaucauccauucugauucauuacaaucauugaaauuuuaggucacacaagagccaucugugaagcagccuccccagaugauuaaaacacuccuguacaauguacauuuacaaauucaaaauuaaugaggaaacauguuuaaaaauugacuauagcuacccaaggguuuaaaaacacuuuaaaaugcauaaagaaaucacuuggcuaugcaguccuccuuagugacaaauaaguugcauuacuucucagaauuacugcugcugaauuaacuuuucaaugugcugcuuauuaugguugcauaccaacaucauaucucaaaaaauauuaauacaaaucauaucuccccacuccuggccucugggcuaauucauuucgcaucuuuccaacucaagguaaaugacccagaacaaagcaaagauauuccucaugaaugacuaguguaacaacaaacaaaauuguauucugccagugggaaugguuuauugucgguuagaaguuuuuuuagcguucuuggcugcaaagaccaaacagagacucucuguagcauuuucuggacaauaggggcuucccuguaggcugcuccuuuuugcuguuuggauuuguucucucuccucucucaucccacuuugccuucagucaggcauuccaucuaucugccuuugggacaggagucuuuauuagaaagauagagggauaggagaaagcauaaguauuguccuccaaaagcuuagcugauaaauaagaguagcaagggcaggauucgaguggagaaccaacucuugagcggagcuaaguacauguuugaacacauucuagcgcuuugcauauguuauugaaggcaauccccccaacaugccugagagauuggcaaucuaguauuacugugagaaaagugaggcuuaaaaacauuauucaggccaggcacagugcuucacauagcuguuauaauuaacaguuaugagagaucaugccuauaaucccagcacuuugggaggccaaggaggguggaucaccugaggucaggaguuucagaccagccuggccaacauggcgaaacccaaucucuacuaaaaauacaaaaguuagccgccaugguggcaggcgccuguaaucccagcuacucaggagacugaggcgagagaaucacuugaacccgggaggcagagauugcagugagccaagaucacgccacugcacuccagccuggguaacagagugagacucugucucaaaaaaucaaaaacaaaacaaaacaaaacauuauuuaagcugccuaggguuacagacaacacugggacuguguagaacucacucaggugugugcacacaccaugaaaauaacaccuaugaauugguaguagacacacagaagccaaggacugcucaucugguuagauggggauacuaacuugcaggcagucagagcugauucauauagcaggugccuuacacuuggauuguuauagacuaaauuauaccccucuuggaauucauauguugaagcccuaaccuccaauaugccugcauuuagggacagggcuuauaaaaagguaauacgggcaaaaugagguaauuaggguggggccuuaacuuaguaggacucguguccuucuaagacgauuaagagacaccagaauucuauuucugugaacucaugcagaaaguaaaguccauaugaggacauagcaagaaaauggcuguuugaaaggccagaagaaagcugucaccagaaaccagauuuucugacaccccaaucugggacuuuucagccuccagaacugugagaaaauaguuuuauucuuuaagcccccaagucugcagcacuuuguuaugguggcuggaguggacuaauaaagagguacuaaaaaucaaggacaggaaacucaguauaugugacuguaggucaaugccagggugggacagugcagagauggcccccacauaugagcaggagcuacugaagcugcucuccgaccucacucacugggacucuugcagcacugguagugcuucuggaauagaacucacgucacauugcaguauuugcucuaggucugccccccacuguccugaacuaugauccagucuguggaagggccuacgucacgaucacccuuuuaucccaucgucccugacacauaguugcuuuuuacauuuauuuaguggacuagggcagggugcaguggcucacaucugaaaucccagcacauugggaggcugaggcuggcggaucacuugaagucaggaguucaagaccagccugagcaacauggugaaaccccgucucuacuaaaaauacaaaaauuagcuggguguguggugcaugccuguagucccaacuacucaggaggcugaggcaggaaaaucacuugaacccaggaggcagagguugcagugagcugagaucaugccacugaacuccagccuggguaauagagcaagaagacucugucucuaaauaaauacauaaauaaauaaauaaacaaauuuaguggauugcagguuggauugcugagaaauagggcaggccuugccuacaggaggaaucaaagaacgagggaagcaccagggaccuguaggggugaagcauuggccagauuguccuggagagcaauaugaucaaaacaguuuggagaagaugagucuggcagcagcauaugggacaaggccaagguggaaggauucuccuucuggaggcuacugucaacaugagucaagacacacucagagggugaaucagacagcaauucugggaagaggaagauaugagaaagauuggaaugaaacauuaguuguaauacugaguggaugccuucaaugauucaacaaauacucauugccuacuaaccuuauaucgggcacuagguacugucagagagacugcaacucaagagggagcaaagccacacacacauggugccugugcccaguuugcugauaggggagccagaaaugaauaaaauaaccacaaaaaaauuaaaauuaacagcuaugagacaucacaugcagaaacauugcaugguccuauaagaaucuacaagagcagacuucccuagucuaggacguucagucaccccuagaacccuagggugagacucccucccuugccaaccuggugaagaggaagugaaccaacauauuucuacacccuugggaaucuauguacuugaaacucaagaacaaagaagauuccauugucugguguaucucuaaucaauuaacugucccuuaaauacacacugaucacaggaggagccagagaggagauaugcugccaugcugccuugccaugauccgccucugcugcagaggacagauguaaagcaagcaucccgcugauaacacauuucuguacaugaaggauggcaccugaauuacugcccaaaccauuuuguuucaaugauucuuccuuucgcuauuaggaggagaauugggauuaggcuaucacgcauagacuugauuaaacaaauguauucacuucagguuucugaaugaaaguuucagaagaagauaaaaauaauaaaaaagaaucagcucaagugaaaauugccauaggugugauauuuauuuuuaauuuuaggagucagugugagaugguuuggcagauuaaaaucauaauguacagugucaacuguuucaauguuaucaauuuggcucuuacagaacuuagguugacagugugggccugucaucuggcaaucacaaagcauuuuagaauguucacugugaauguauuaucaaauggaaaugcaucaaaauggacauuuuccaaaucuuuuuguugugguaguuaauaugcuaaggguagggaaacauaagagcuauuuuaaauccucugaaauauccacuagauauuucucaaaaaaguaaaaagacaacauuucacuuggauacuuuauuucauaucaaacaauccucuccuuucuaaucagacuuacaacagccagaagucccauaaacacaucagaagaguaaguuuaaugaggcuuaugagaaacaaagggauguuuuuauagcagguauuuaugaaauauguucuaugaagacuuagcagacuccuagacugacaacuggaaguuagagggaaaaaugaucuuugcucaaaaugaaaaaaugucucagguccaacuucuccaaagcuggagguggaagauguaugcucagaagguugaagguuuccaccaauguugaugagagugcugaacuuugauuaaccacuugauacaagagauucaagccucagacgaagaguugccauaaacagccuaaaauguggcuuuaagcaccaaacaccuggaauaccuugagcugggcacuaugccggguguuucaaagaccccucuuaccuguuggagagagaagaccugcaugccccaagugauaguggaacucacaaaguucaagaguagucucaugacauugacuaggaggauuucagaaugugugaaaaaaaacaaauauaguaaauagaaaaugcuugaagacguucugugaagauaccaagacuugaaggacaggcaagaugguggcuggagagaaccuuaaaaagugagacagacaagauuaucaaggcuacuaaaacuacuggugaggaauuuaaaccuuagaaagcuaacaaguaaauuguugaaccaggaacgaaagcaguauuugaagaacgaucugcuugucagaauucaggauguauuaccuauagugucugcaaacuuuaguaagcaucaguaaagccuguuuaaaauucagaugcaugguugggagcaguggcucacaucuguaaucccagcacuuugggaggcuaaggcggguggaucaccugaggucaggaguucgagaccagccugaccaacauggugaaaccccaucucuacuaaaaauacaaaaaaaauguagcugggcauaggggcaggcaccuguaaucccagcuacuugggaggcuggggcaggagaauugcuugaaucugggagguggagguugcagugagcugagauugcaccauggcacuccagccugggcgacagagcaagacuucaucucaacaacaacaaaaaaaauaaagauucaauggccacagacccaaagacucugauacuauaguucuagggucgggcccaguaauaugauuuuuuacugucucucuugguucuuccaucuuccaucucuccaccccgugaaucuguagcagguugucuccagaucacaguuugauaaauguuuuuuuuuuuuuuugaaggaaagaguaaaaacauaagcaaacuuggcaauuguuccuauaauggaggcaccagaaauacgaaguuuagaugaaccugcugaaaauucucuaaacugaucugcaaucugcauuuuggugaccacacaccacauuggaacuucuucagccuucugacauuacauuaauacucagccccuugccuacauaccagucauuuaaaacuccaaagguauuuaacaugguucucccaaguaaauucaucuccaggaugaaugaaauugguugcuucaauuguuucucgcaagagaggauuucugaccacuacacaacuuugcucacuuucuuccuauaucugccaguuuaucaauguauuccaacaugcaggguuguaacuaagcagauacaggacuaucuccucccuuggucugcccacuuuguacuuauuaaugcaacccaagaucucauuagcuuuuucugggguccagaaaacuaagcuacuaaaaacucagcuaguaaaugguaaaacugguagaaaaagaaaacuaacuaaauuagucaggacuuauucuuaaugaaucuguguuuuuuaaccaccauaagaauugaaacaauucgggggguggagucaagauggccgaauacgaacagcuccaggcuacagcucccagcaugagccacgcagaagacgggugauuucugcauuuccaacugagguaccggguucaucucacuggggagugccggacagugggugcaggacagugggugcaaugcaccgugcgugagcugaagcagggugaggaauugccucaccugggaagugcaaggggucagggaauucccuuuccuagucaaagaaaggggugacagauggcaucuggaaaaucggguuacuuccacccgaauacugcgcuuuuccaacaggcuuaacaaacggcacaccaggagguuauaacccgcaccuggcucagaggguccuaugcccacgaagccucccucauugcuagcacagcagucugagaucaaacugcaaggcagcagcgaggcugggggaggggcgccugccauuuccgaggcuugaguagguaaacaaagcggcuaggaagcucgaacuggguggaccccaccacagcucggggaggccugccugccucuguaggcuccaccucugagggcagggcacagacaaacaaaaggcagcaguaaccucugcagacuuaaaugucccugucugacagcuuugaagagaguagugguucucccaacacgcagcuugagauccgagaacggggauacugccucucaagugggucccugauccccgaguagccuaacugggaggcaacccccccgugggggcggacugacaccucacauggccggguacuccucugagacaaaacuuccagaggaacgaucaggcagcagcauuugcgguucaccaauauccgcuguucugcagccaccgcugcugauacccaggcaaacagggucuggaguggaccuccagcaaacuccaacagaccugcagcugaggguccugacuguuagaaggaaaacuaacaaacagaaaggacauccacaccaaaaacccauuuguacgucaccaucaucaaagaccaaagguagauaaaaccacaaagaugaggaaaaaacagagcagaaaaacuggaaacucuaaaaaucagagugccucuccuccuccaaaggaaugcagcuccucaccagcaauggaacaaagcuggauggagacuaacuuugacagguugagagaagaagguuucagaagaucgaacuacuccgagcuaaaggaggaaguucgaaccaauggcaaagaaguuaaaaaccuugaaaaaaaauuaggugcauggcuaacuagaauaaccaaugcagagaaguacuuaaaggaccugauggagcugaaaaccauggcacgagaacuacgugacgaaugcauaagccucaguaggcaaugcgaucaacuggaagaaaggguaucagcgauggaagacgaaaugaaugaaaugaagugagaagagaaguuuagagaaaaaacaauaaaaagaaaugaacaaagacuccaagaaauaugggacucugugaaaagaccaaaucuacaucugauugguguaccugaaagugacggacagaauggaaccaaguuggaaaacacucugcgggauauuauccaggagaacuucuccaaucuaggaaggcaggccaacauucaaauucaggaaauacagagaacgccacaaagauacuccucgagaagagcaacuccaagacacauaauugucagauucaccaaaguugaaaugaaggaaaaaauauuaagggcagccagagagaaaggucggguuacccacaaagggaagcccaucagacuaacagcugaucucucggcagaaacucuacaagcgagaaaagaaugggggccaacauucaacauucuuaaagaaaagaauuuucaacccagaauuucacauccagcaaacuaagcuucauaagugaaggagaaauaaaauacuucacagacaagcaaaugcugagagauuuugucaccaccaggccugccauaaaagagcucaugaaggaagcacuaaacauggaaaggaacaaccgguaccagccacuucaaaaacaugccaaauuguaaagaccaucaaggcuaggaagaaacugcaucaacuaacgagcaaaauaaccugcugacaucauaaugacaggaucaaauucacacauaacaauauuaaccuuaaauguaaaugggcuaaaugcuccaauuaaaagacacagacuggcaaauuggauaaggagucaagacccaucagugugcuguauucaggagacccaucucacaugcagagacacacauaggcucaaaauaaagggauggacgaaaaucaaccaagcaaauggaaaagaaaaaaaggcagggguugcaauccuagucucugauaaaacagacuuuaaaccaacaaacaucaaaagagacaaagaaggccauuacauaaugguaaagggaucaauuaaacaagaagagcucacuauccuaaauauauaugcacccaauacaagagcacccagauucauaaagcaaguccuuagugaccuacaaagagacuuagacucccacacaauaauaaugggagacuuuaacaccccacugucaacauuagacagaucaacaagacagaaaguuaacaaggauauccaggaauugaacucagcucugcaccaaguggaccuaauacagacaucuacagaacucuccacuucaaaucaacagaauauauauucuuuucagcaccacaccgcaccuauuccaaaauugaccacauaguuggaaguaaagcacuccucagcaaauguaaaagaacagaaauuauaaaaaacucucucucagaccacagugcaaucaaacuagaacucaggauuaagaaacucagucaaaaccgcucaacuacauggaaacugaacaaccugcuccugaacgacuacugaguauguaacaaaaugaaggcagaaauaaagauguucuuugaaaccaaugagaacaaagacacaacauaccagaaucucugggacacauucaaagcaguguguagagggaaauuuauagcacuaaaugcccacaagagaaagcaggaaagaucuaaaauugacacccuaacaucacaauuaaaagaacuagagaagcaagagcaaacacauucaaaagcuagcagaaggcaagaaauaacuaagaucagagcagaacugaaggaaauagagacacaaaaaacccuucaaaaaaucaauguauccaggagcugguuuuuugaaaagaucaacaaaauuaauagaucgcuagcaagacuaauaaagaagaaaagagagaagaaucaaauugacgcaauaaaaaaugauaaaggggauaucaccaccgaucccacagaaauacaaacuaccaucagagaauacuauaaacaccucuaugcaaauaaacuagaaaaucuagaagaaauggauaaauuccucgacacauacacccucccaagacuaaaccaggaagaaguugaaucucugaauagaccaguaacaggcucugaaauugaagcaacaauuaauagcuuaccaaccaaaaaaaguccaggaccagacggauucacagccaaauucuacuagagguacaaggaagagcugguaccauuccuucugaaacuauuccaaucaauagaaaaagagggaauccucccuaacucauuugaugaggccagcaucauccugauaccaaagccuggcagagacacaacaaaaaaagagaauuuuagaccaauauccuugaugaacauugacgcaaaaauccucaauaaaauacuggcaaacugaauccagcagcacaucaaaaagcuuauccaccaugaucaagugggcuucaucccugggaugcaaggcugguucaacauaugcaaaucaauaaacguaauccagcauauaaacagaaccaaugacaaaaaccacaugauuaucucaauagaugcagaaaaggccuuugacaaaauucaacaaccuucacgccaaaaacucucaauaaauuagguauugaugggacauaucucaaaauaauaagagcuaucuaugacaaacccacagccaauaucauacugaauggacaauaacuggaagcauucccuuugaaaacuggcacaagacagggaagcccucucucaccacuccuauucaacauaguguuggaaguucuggccagggcaaucaggcaggagaaggaaauaaagggcacucaauuaggaaaagaggaagucaaauggucccuguuugcagaugacaugauuguauaucuagaaaaccccauugucucacccaaaaucuccuuaaguugauaagcaacuucagcagucucaggauacaaaaucaaugugcaaaaaucacaagcauucuuauacaccaaaaacagacaaacagagagccaaaucaugagugaacucccauucacaauugcuucaaagagaauaaaauaccuaggaauccaacuuacaagggaugugaaggaccucuucaaggagaauuacaaaccacugcucaaugaaauaaaagaggauacaaacaaauggaagaacauuccaugcucauggguaggaagaaucaauaucgugaaaauggccauacugcccaagguaauuuauagauucaaugccauccccaucaagcuaccaaugacuugcuucacagaauuagaaaaaacuacuuuaaaguucauauggaaccaaaaaagagcccgcauugccaagucaauccuaagccaaaggaacaaagcuggaggcaucaugcuaccugacuuuaaacuauacuauaaggccacgguaaccaaaacagcaugguacugguaccaaaacagagagauagaccaauggaacagaacagagcccucagaaauaaugccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuauaccuuauacaaaaauuaauucaagauggauuaaagacuuacauguuagacuuaaaaccauaaaaacccuacaagaaaaccuaggcaauaccauucagaacauaggcaugggcaaggacuucaugucuaaaacaccaaaagcaauggcaacaaaagccaaaauugaaaaaugggaucuaauuaaacuaaagagcuucugcacagcaaaagaaacuaccaucagagugaacaggcaaccuacagaaugggagaaaauuuuugcaaccuacucaucugacaaagggcuaauauccagaaucuacaaugaacucaaacaaauuuacaagaaaaaaacaaacaaccccaucaaaaagugggugaaggauaucaacagacacuucucaaaagaagacauuuaugcagccaaaaaacacaugaaaaaaugcucaucaucacuggccaucagggaaauacaaaucaaaaccacaaugagauaccaucucacaccaguuagaauggcgaucauuaaaaagucaggaaaaaacaggugcuggagaggauguggagaaauaggaacacuuuuacucuguuggugggacuguaaacuaguucaacuauuguggaagucaguguggugauuccucagggaucuagaacuagaaauaccauuugacccagccaucccauuacuggauauauacccaaaggauuauaaaucauacugcuauaaagacacauacacacguauguuuauugcggcacuauucacaauagcaaagacuuggaaccaacccaaauguccaacaaugauagacuggauuaacaaaauguggcacauguacaccauggaauacuaugcagccauaaaaaaugaugaguucauguccuuuguagggacauggaugaagcuggaaaccaucauucucagcaaacuaucgcaaggacaaaaaaccaaacaccucauguucucacucacaggugggaauugaacaaugagaacacauggacacaggaaggggaacaucacacaccagggacuguugugggguugggggagcaggggggauagcacuaggagauauaccuaaugcuaaaugaugaguuaaugggugcggcacaccaacauggcacauguauucauauguaacaaaccugcauguuguguacauguacccuaaaacuuaaaguauaauaauaaaauuuaaaaaaaaagaauugaaacaauucuuucaagaauaacuuaaaacaaaugccucuauccuuaucuucauguuagcauuuuaaauuguuuauaaaauaugcauguauaauuaaaugaagauuugaguuuuacaauaagcuaucuaacccuuaaugcuuguuuuucaaaucaucuaaguuuauuuuaucccauccaagggaaccucuggauggaauagaagcugucauggcaaugggagcugaagaagaagaugcauucuccucaaugagagaccuuggcagcagcuaggccaguaagcaguggcugcuacuguuucccagacuauugauuaagcaguuuguaaccauggcaaugaucuugucuuccuggaaagguuagcagggugggaugggcagucuucuauguugaaaaaggauauguugaaaugaagcaaugcucuuaacaguucuuuucucaugucacugaacaggaauugucaacacaccuugccaguuucuuacccuaaaccuuucaucacucuaaagaaaauccacccagauucuuaaaccgcauucucaagggaaagcuugagaacaugggaaagcuucaagauacagggaaggagaggacugaggugacggguguaugccuguuuuuuucuacugaauuuagaacauuguuuuuacuugcuauucacuacaaagggagcuaucucuuugacuccuacugaugaggaaugcaaguuuauucuugugacaaauauuugcuauacaacuacuuauuugcaccugugcagaguuacaacggcugaacugccuuguucuaggaggccacugucuaauugucuccagaggagaaacccaagagagaaaggcuuagaggaacuccacuaaaagggaaucccagcaaacguggaggcaguucaaaugcaaggugagccauaauuuacacacacaucuauuaauaaugaucauuugucgugauugcuagagacacaaaaguaaauaagauacauuuccugagcacaagaaagcuuuuuggcuaauaaaaagagaaaacaaagguaacaaacaugggguaugucuaagagcaucaaaauuaaaacaaaaauuuaacuuaaaacaacaguuuggauggccagaggauccuguuucacagagguuuugcauaaauugauuaggaaaugcuccugucuuguccaguccuucuucuugaaaucaacugauugauuuggcuucauagguccaauauugucuugaagcucaaaccugaaacuauuucgugcuccauuuuuucuaauguuccugguaucccaucaccucacagcugaaaugaggcuagggaggcucaccuugcucuucuggcauuuccuucugaugucauuggcauaauaccccuucagucugacuugguccccgggacucuguccuaacucuagccuagguguucaguuuuguccugauuuauaccagacugcaggcggagaguauccugcuggcucuagcccaaauccccacagcuaucaucagaauucucuaaucguuuuuacaaccuuucucuguccuacacaucuuagcauuuuugacugauaagacagggcacaaaccaucauaucagcucauuuuccaaaacugaaucugguccugcagaccuuggaaaacuaauuaugucuuuucauaacagccugugacuaaaccugaugugugaguggacaauggcccuuaaaccuucaaagaaggcuagaaaacaagucgaauaguaaugaguccuauugauaaauuguagcucuuagcugcaaaagugcuuauucacugaccaagagcccugcaauuuauuuuacuucauuagaugcugaauccuucaaaaaacugcuggaauuccaaaagcuuugaaucuaauuauuauaagcauguuuaaucaaacuuuaaaacuacuuggagucuaaugcugaaauuuagaugagacuauaccucucugacacucauauguuaauacaauuccaaaucucugugaagacaugaaauagaccaaacauuuuaaacaaagcaauauaguacuuucaauuuuaaaacauucucugcugauaauucuucucgugaccauuacugacauucucuucaucuucuccagaaaauccaauguaaaaaaaaugagaaagagcaucuuaaagauagagcuacauauaaaaacuagaaucuuagcuuuggaaaaggacuuacaggcucaauucauuaugugauguuuggauuaccucuacuauacucaugcagggaaucauccaaccuagacaugacuauuuucagccucaugguguugucaauuccaucuuugcauaucccugaaaaggcuuccaccuuuucuaauauaaacuucuuuuauggaaauuuugagcucauauucacacacaagugcacacugcauaagaugagguucaagaacugaacacacauccuaacucaauuuggaaagagccccaugagccacuugcuacguauuucacaagcguccucaugcucugaagcuaagaagaaaugaacaacagcuaacuuucaaauucuuaccagaggcacccaaagggaguguuucccagacuuuucaguccaggacagcccuguguucacuguacuguauuccuuugauggugcuuguaguagcaggaagcagacugucugucuauucuuuaguuauuuaguucagucaugucuucuugaccacaggggccugcacaagcacucauugagcauaugcaaacacauacauacaagcacacagacuguguguuccacaagcaaaacucacauguaggcaugcacacacagacacacacaugcauacacacaaacacacacacacacacacacacacacacacacacacacacacagagagagagagagugaaacuuccuuucuuucucuacuauggucaccaccaucucuauacuuuaacuucuaaguuauaauuugacagaccucucuugaggacacccugaaugaacaucccacauccuggcagaucaacaauguuuuauagagacccaacauuuuaacacccugacugggugacagaaaacaccugaaggcaucauucuuggcaaaggcagagaacuggggagagcuggggaaaugaaaguccuccagcuuggagggcccuagagagccacauuucucacuugacacaaaauaauuucuuuguucauuugguaaaguuuguagcugcuggcuggcaagaugaggacacugggaaaagagucccuuggaucuucccuaaagcaaggucugaugagaaagcagaauggggugguaaguugcugacaauacucauagugaaggcagugggugaggccaaaugaugcuuucacugcaaaacugagucagaaacuacaggucaagcucaccgcuagauaaauuucuuaaucuaauuuuacuaauuuuuuuugcauuuuguuguuucuuuuauuucacuauggugaaagaagugaaaccguuaaaauaaaaaaaaaaguaucuaugagcguaauugguuggaaggaagagagagcuuucaaggucaaguuuagcauacaggccagagaacccccaaaaugcaaaagggagcgcagguuguaaggggagggcacuaaagaagaaaccgagauucuaagacccugguuuuccuuugacuuaugucuuugcuuuauuagggacuccuuucuuuggcuuccagagaagcccucaaugaaagugagaauauagauugucuuuagcgucuagcucuacauuuuccaacaaccuucccacuuuugcucccacaauucuagaagauuccauuuuaaaaacuggcacacacugugagauccagaauuuacaggaagcccccaccaggaaaauuagguucagaaaaaccagcuaaggagggggaaguaguuccucuaaagugguacacgccaaagaacuuuucaugggccuccuggagaggauaauaggucuuccacgcaugaauguuugucugguguaaucaggaugggaaacacugagcuaaacacagugaaauggguuuauuuuccccuccacugaucacacucuccaauuugcuguugucuauuauaaauuuccaagcaggaguaggaacgucauaugcacagaaaccucugucugacaggaaagaaacacuaacagaagagcuguaggucucaguuaacagcgauuuaagccaaagucucagggucuuucaaacauguugaguguucuucuucuucuaaagauaaagugucccaagugacaacucuugcuuugcugaacaacuucaccuuucaauccuucuuucuuucuuuuucucccauaagugaacaaauaccaauugagcaucuaugugcauauaauccuucuugauuuaaaacaaaaccaaaauaauaaccacaguaccuauuugaggcaaauauuuuuuuaaagaagaaacaaacaacagaaaguauauuauauuuauucccaauauaauagcuuauauuuaaagauacauuauagacuuguugaauaaauaugucuacucccacuaauuccacaaacauaugcuaaacccauaguauuuagucaugcaaauaaccaauaagggacaagacagccuuaggcuaaaagguggccuggucaugucaacaggaaggguagcagugagguucggaggcugggcuuuaauuccaggcucagacgucucacucauaaaauguagauaacuacauggugucugccuuguaggaaucauauauggguuuaauaagaugauuucaguaaaacacauagcagagaaugagcccugaauaaacaacaaguauuauuauuauugguuauacuuaucaacucuagcuuaaccaggaauuuuauuucuccuccaaaacagugauauuaggaugauuacaucuuaaauagugaguuuuucugaacuuaggggcacuuucugagguucaauguuucuugugcugcuggaauagcacagucaccuuuccaugaacaagaagggucucagaacugguaguuccuugccccugagaacuggguggucggcaagggcugaagugauuaauacgugauucagcccauucauauuccuucuuguuaagacuucaggacuauuuucaguuguaucaaagauagagugauaaagugagacuagggagagaaaaagagagagagagagaggaauaaaccaagucugccuuacaccucugugcuagaacuggaauuaugacagcucccuugcuacuccaagagggggcuguaaaccagccauaugggcaucaccuuggagcuuguuacaaaugcagauaucaggccccagcccagacguacugaauaaaaucugcauuuuaauaagaugcccaggugauguauaugcacauuaauauuugagaagugcuaccuuagagaacuuucauuuuccucaggguugccaaaccugcucacuccagagagcagcccacacaggcuagagaacuucccuauacccagaaggcuacuuugaaauagagggaaacauaaaaauccucagacccacuucacaagaaaaauccaucccguauuuacacagaccugcauaccugcuuauggauuaagcuguuacacuuucugguuugacccguuuccuuguaacuagcuuggaccucaguuucuuaauggaaacagacauauauugcacacaucaccuuccuaccuguuuucucaguauauaauauucaacuugaugggaguuguccagugauguucuguaccuguguauuccuauaucacuuagguuuucaguuuuauuucacucauuucaggauauacauagaaagugacacaacugucuacacccugaagguguagacaauuagaauuugcaaggcuauaauugcugacucacugugaaaugccuucccacuguucagccugccuuuuauaacaggccuaacaauuguuacuaucagucaaaggaagguugacauagcaaaauaagugguaucuggucugucuuauaauaggauuagggcaugcaugagccggugggucugacugcuuuguaauagcugcucuguuaguaauccucaaagcaucaucuggaaacacauuugagucacugcauuuauuuugaaaagucucugauagagacucugguaacugcggccucccagugguauguuuauguugcacaaccaaaucaguuucuugaggccauuuggaaaaugucuucauaaugcuuccuaucuuuguaaaaggcuuugcaauuuacccagugcuuuccuguacauuaucucacuuagcucccaccacugcucugugagguuggcagggcaggcuucaccccaaucuacacauuucaagccuuugccuauagauaaacuuaauaaccuaaguuagcuagggcuaauuuaguaacuucaguuacagggaguagaugccuugcccgggguccuaaggugaguaaaugauaaagccuaggcccaauuccaugauuccuaagucagagcccuuuugcccacuguguugcugcuucccaaauuuugauuccacauaucacaaggagguguccaaacaaucaagucucugaccaagaauuucuggaucaaauuaauugggucuuauaaugaccccaguuuaccaucucauuaguuugcuuguuaucuuggugcauuucacuuuuuucaacacuuuaaaucagcacaaauagaaauauguugucuguguggccuuugguuauuuagaacaaaacugaguuccuccuauagaaggaaggaacuuuaacugcccuuaaacaugaguguguuacguuuggaaaccuaggaaauacuuguccuuguuuuaauucauuuauucauuuguuugauacauguuuuugaguacccacuaaugccagaaucugcaacauuugggucaaauucauuaaucaagaaaguauuguuuuuuuagauugccaaaucaccuuauugucuucuauuacuuguaacaacaugauggcucugaggaggauuuagaaucacugauuucaagucagauauucccaaauaucugcacauauaggugauuuacaaaacaucuaaauacagagcuauacuuucuugcuaaguuuaaccguaggcauacaugucccaucaagaucaauuugaauuuugugcuguauuaacucucugagccagucuuuugcguuacauagauuuagucagcaucagaccuccccucacccuucucucuuuucucuacuuaauacaagucauuaauacaaauauugagcacaacugacacaaagagggaaccuuaaaaguggucauuaaagccccuucuccauaucacuccaacauaacucaucaauauaggggaagccagagaacuugaaaaaaagauccagagacagacaacaugcagaaaauaggaugaaauaauggcuuuaguaaaucccucuaaaauuuuaaacaaacuaugccuuuucaaaaucacucagccuuuagaauucaaccauuauacaugccucaggaauacaggugugcauacauaacugugcaccaccauuggccuuauuuuuuuccccauaauuuaucucuugugcucugaagugaaaguuacuagaacuauucggaaauguuuguguucucuuuuugcaccaugguuaagauuugauguccuugugcccuuuuaacuucggcauggcaaugugaccugcuuuggcuaacacaaugugaacagaggaaauguuugacacuuucuggaggaagcucugggggacaagugcauuaugggccauauuuccuucucccacugauugcaggaacaugaguugaggacauaagacuacacugagcaacugugaugagcagagcccuuaccaaccaauauuggucauggaaaaugaauuaagaaggcaucugcugcaucaaaacuuugaaauuugaaagauuuugguucaccuuaacuuggccuauucucacugacacaucuagaauguguuuuccaugcucauaaaaagauaucugaguuccucuucuaccauuuaaggucuucuaucaauuuuaccucaacuuaccccucaaacguuuuucacaacagucacauacuacuaucugcuucuucuaggaaucccacuuuuaucaaaacuccaccuuguaauguuccuuuuguucgucauaguucagugcuaugucuugggagccaaacuagccuucacaauuuuuuuucaucuucauuccuguaccuaaaacaucacagaacaucacaggcggaggcaaaauauaaguaauuccccugaccauuuccuuugcuuauuuacauaagugccucaggaacugccaaccagagaguaaguaaaauaaaccauaaucaguuagaaaauucccuaaguaguuaauuaauguauucaugcaagauugucuuauaccauccuggagguguguagaaagcaugauuucuccagaaauuugcuuucauuaaucaagucaguaagcaauauaauaacuacuuauuauaauucccgaaguuuucuuugacaaauucaauacgagcugauuguguguucccggacuuagaagaguacugucauauauaaugagccaagggcaauggguuggacauccuaaaagagagauuuggagucaauuaaagauaaaaauaaaaaggacuuuguuaaaaauuagaacuccacaacaaaagaaugcagugccuguaagaagcauugugugugcucugagucaaugaaaauguccaacagaggacaucuaucagaaaugucacagaaacaguuccagcacugggugguauuucuaccagaugauuacuagagugccuuccugcuuucuuguucugugauuucauuucuauuucccugugucaacuucucaauaguuccugucacuccuuucugaguugcuccuaaaucccauuacaaacaacagauuaagggcaaagaaagagacuuuuaacuuguccuugguaaugcaggucuaccuaaggagguacuuagagaacgugauuccaggggagcccaggagauuggguuggugcagaggaaggcagugggugaagagcugcaaauaaacccuccucuacaaaugcucuugucucaucaagauacauuaccucucugugggaaagccaccgagcuagcauuuacuauuuugagauuaugauccacuucccaaccuacuguuagcaucccuacauaccucacaaaguaauuucuucuuguaagaucuugacaggaauauuaaaaauucauaaauguauugccuuuaacccacaaugaaaaaauacaguguagacuuugguaaagaagccugguauaauauaggaaguaagaaauagcaagguuccuuacucaaauaauaccacauggaauuauacacauauugaaguaagaauauuccagcaaggcuggugacucugacaaaguucucaaaaaugacucuucaagaacauccucauugaaaaugaagagaauacaggaaugcuuccuucuuucauguuucucugacauugccuuauucccuagacauuaagccaauauguucaauuugacuggagaugcguagaauacccaugcccaucuucugcaugguccuaaccccugcaggcaaacacagaaacuuuaaugguucuaacucucuucugugacccagagucuugaagaucucuucucagcuugcuacuguggcaaccaagcagccuacugaagcaguuaauagaaccuaguagauuaaaacaauguucccguaacaaaauguuucagucuagauccauucuggcuugggaauuucaaaacuaguacugaggaaacuaguuuuaaaauucccaguggcuauuugcaagaugagacaguuugauacagauugaaacuuugaaugucauucugccaaugacuucacagccccagucuauucaugauaauggaguccagagaaucaaggcaaaccaugucuugaauguccagguuccagggguauuucccacaugagaacagaaggagggagguaacugaaaaccuuauauuuuuucagugauggaaaaaucaaaacaccuccugaaacaagaagcuauaccccugcuuuuuuauaagauagggacaaccuaauaauaauuguaauacaauucaauauggagcaugggagguuaccuuuugagugcaagaaaucacagggcacagucuauuacagcccuguaaugcaaaugugcuguaaaugaucuaauuaagauacugguuacaacacccaauugucucccaggugacacaguggaaacuccauugcuuaaaagugauuuaaagcuauagcauauaaagaaguaaagaaaacaacuugacccucacagagacaucauauucuggucaucuaauaaagauaacuuuaaugcucaauuuuuucuuccuguuuggagauagaaauaguuuuuaauaaaauacauccacuuauuuugaauuuuaaaacucucccaaacuuaauccaaauagauuaccaucucauuuauccagaagucacccaccgaccaaaugcaccugccuggaguuuacccaagaaccuguaaguaaaaagcacuggacuucaggcaaauagaugccaaaaaaucuuuuuggcaaaacuuuugaauuuucuucuuagauuguaaauuccuuggugaaauguacuguuucauguauuuguucauucaacaaaacauuaugagguacauaccauaaguuaugcucccauucugcuagguacuggggauaccaaaucagagaagccaauacugacccuccucagucuguuuagaauacuuuuuaaaagaauggaaaacaagaaaccaaaauaaacgaaaccaccaaaaauagugaacuauuugaaacaaaaagaaaucccauuaauucucuaaaguuauugaacuagaaaaaauagcaucagaugacaaaauaugacucaaaaagcauuuccauuugguuugaaauggaaauuucaccaaacguucagagcaaccagauauuggaacccucuggagagacacccuuuaauuccuacacuuagguccuccaacaccacaauauuaauauaaucacccagcacucaaagaaaaccagacuuaaggcuaaauagaaauuucauauacuuugucuccugcaucuagcugcaauccuuuagugucccaaaaucuagaauaaucaaucuucaaauauggauuugguauuaauuauuuccucagcuaauaaaagugcuucuauacaggauacuuggcuauguuguugguuuucaaagaugagagaggagauagagagagagagaaacacagacacacacagaaauagagaaagagagcaagagagagagagagagagauugucuuagcggaguaguaacuuggauggaaaauagagaaaaaaagaaagugaaauuaaacaauaaagguaagcaagaaagagcuuuaugagggaaaauaaaguuucuccaggccaaaucaauuuuuuaaagcaacuuauaucaugucuuuugcaaagcugaaguucauuggaguuugagauuuuacaggaaaagaacaaagugagagacagaaagggagggagggagggagggagggagagagagacagagacuuuucuuaucacauguuucugaagggagccaccccagcguuuauagauugccacuuauuguuggagauacauaccaucagauaacgaaaacagcccccccauguuuuaaaaucccccauuuaaaauuuaaauucauuaguuuaugagcugcugggaauugacaguuuuauaccccaauccuccucgaaauuuauguaaagccugcuauaaaauggaauaggggagcaucucuaagcgaaaacaccaaacacaaauugcuaaauaaaaacgcagcugaagccgauuugcugugggucacauaaccaagaauguuguuuuuauuaaggggaaguucuuuaagcauuugcuccucacccgaccacgcuuuuuuuuuuuuuaaccaacauuuaaaauauuaauguacuguuuuuauugcuuccuugcuucccuccucaaacggcauuucuauaacugguuccacacguauaaaguaugucccauguaucugcaacacggcaagcauuucuuuuuuuuuuuuuuuuuuuuuuuuaagugggagaaugugugcgccugugagugguuucuuucugacaguuuauuucacaacuagacugcuguguccugauuuuggagauuuuaauuauaauacagcuugauauauacuagagacuagacuuuaaaauacauggagguuugugucugacuugucuucaguguugaaauuuaguucuugcuuuuaaaagcuuuuaaaacaaaggucacuggggacugugcauaugaauuugaugugcuacaaauaggaaagauccaggaugaaucaaugaaucaggucuccaaauaaaauauguguacacaggcucgcaacacaguucucucuaaacagggaagucucaaccacacuuuauggaucauacuuucuggauuaucccuaagaaaucuuugccuaucccaaugucacaaagcuauucucccauguuucuuuuacuagcuuuguagcucuggcuguuacacuuagcucuacaaucuaccgugaauugauuuuuguacauuuaguaaaguacaggucaaggcuguuucccuaucgaauugucgagguguccuugucgaaaucauuugaccauguaugugugggucuauuucuuggcuuuccauuuuuuuccauugauccauuugugucuccuuucgccaguaccacagugucuugaguauggcagcuucacuguaagucuuaaagucagguaggguaaguauccaacuuugucuuccuuuuucaagauuguuuuaaugauucuguucuucccacuccaaauuaaacuuaagguuuauuugguuuguaccagccacacuuuacaaugcugccaugcccccacacuucaaagaggcagccuggaggacacugggggaaccagucuccgccacacuugaaccuucagaccaaccuggagcagugaacuucuaaaggcccauugacgugcaaggcucaaaucauuauuuuaaucaaauccugauucuacaacgcagauggaucaucuuaaacuuuaggcaauaaagcaauaauaacugaaauuaaagaggcuggccucuauuuuauuuuauuuuauuuauuuuauuuuauuauuuuauuuuauuuuauuuuauuuuauuuuauuuuauuuuauuuuauuuuauuuauuuuauuuuauuuuugagacggagucucccucugucgccaggcuggagugcaguggcgcaaucccggcucacugcaagcuccgccucccggguucacgccauucuccugccucagccucccgaguagcugugacuacaggcgcccgccaccacgcccggcuaauuuuuuuguauuuuuaguagacacgggguuucaccguguuagccaggaugggcuccauuuccugaccuugugaucugcccgccucagccuccaaaguacugggacugcgggcgugagccacugcgcccagccggacucauuugauaagacuaaucuguguccuggagcuccuagaggcagggcuaucucucuuucuucuugguauucccagcacauaacagaaauuacagugcuuaguaggagcucccaugguauuuaugaaaucuuuucucugcaggggcagccaggccaauguggucacuacugccugggugagcuuucuucuucacuuguaacacuccaccuaccuccuucuaccucuuuuauauugcuuuucccauuuugcuuuaucaggcagccauauugucuucccuuuaauauuauaugucaggugagggcagaaacuaccuuuuuauuucaaaguguccucacaguccuuugcacaggagaacaauaaucaucuguuggggagugaaagcagagaaguaaggggacaauccaucacgccagcuagcaaauucaccagcaucucacagcgucccagacacagggcagagacuaaguauauaucaguucacuggaagaguaaguagacuuucuauuguaaaugcucucaaagguagggcaaagcauaguuucuuugcaucaaugaggaaaucacccauggcagcaguucuuucaaaggaggaaucaaauaagacuccuguuucuucuaaaaccuaaaaggaaaccaugucaucccccuagccuguguucaggacaagauaaaagggagggagaauaagacaugccuggagaauaagauaugcuucacaaaacauaggggguaagggcugagcaccaaaugccccuggcaaaaugaaacaaacaaauacacacaaagcaaagcaaaacaaaacaaaacaaaaaagcagcaccagauggagcuggaagauguuuguuagauuucacaaagagccagaagaggccaggccucaaauguccuauuuuuucauucuuaccaccacuacuagauuacguuagugguuugcuacccagccucugaucauagcgacaucugcaacccauacaccauacagaugcccgcggggcuguucuaaagcugaauggauacauaccauccucuugaaaugcuuaaucacaugacccauguccacuuuucugcuccucgcuggucaccacacccaccauggcuuugcaggagcuauuuccucuuccuggagcauccacauccccuucucuaucuaguacucaaaucaaacuucaccuccuccaggaaccuucacugguccucccaguuaaaugccccucucccgcacacccaugguccccugcacuuccuguugaaguucugcguuuucaacagaaaaugguucugcaaccauuuucaagcucgucagcuugccaaaacugcaaacguucugugguuacaaagucaccuuugaucucuguauguuaugcaccuaacacuggacuuagcaucuagucaguuuaauaaaugguugaaaaaaugacuaagagcaaaacuaaaugcgucaaauaaacaccggauagauucacauguuucuggauaucuuuacuguaggacaaguggaaucuuucccuaccuuuuauuuucugaauugcuagucuuguuuuaauauauuucauauauacuacauaaaaauuuacuauguuuagcaaguuauauaauguacuuauuuuauguacccauucaguuaaguuuugaaaagucuacaugccuuuauaaccacaccugcaaccaggauauagaacacauccaucuuuccaagaagcucccugugcccucucucacgagugcuccucucgcuuccagcugccagugaguacuaaucuaccuucugucacuacagacuagucuggauauuuuuaaaaaauuauauaaguaaaauaauacaguauauauucuuuugagacuggcuuguuuagcuuagcaaaauguugagcuucaucuguuuaauuauguguauccguagguuuuguuuugcuuuguuuuguuuauguuuuuuuuuuuuuuuaauagagacagggucucacuuuguugcccaugcuggucucaaacuccugggcucaagcagucuuccugccuuggccucccaaagugcugggauuaaaggugugggacaccacgccuaaccgcuaguuguuguuguuuuucuaaaaauuguugacuaauacuucaucuugugaauacacuauaauuuauuuauccauucauacuuguugaaguuacauggguuguuuccaguuuggagcuauuaugaauaaaggugccacaacaauuaauguauaauucauucuaaauauauaguuuuuauuuuacuuucuuaaaguguuauuuacuuucuuaaaaguguuauuguuggguacuacgguaaauguauguuuaacaaagaaauugccaaacuguuuuccaagaagguuguaucacuuuauauuucugccaaaaauauaugagaguuacaguuguuccauauccucuccaguacuuggcauuaucaagcuuuuuaacuuuagucauguuagugagucucuaacuuuuguuuguuuguuuguuuugagacagagucucacucugucgcucagacuggaguacaguggcgugaucuuggcucacugcaagcuucaccuccuggguucacaccauucuccuaccucagccucccaaguagcugggacuacaggugcccaccaccacgcuaauuuuuuuuuuuguauuuuuuaguagagacgggguuucacuguguuagccagaauggucucaaucuccuggugggucucuaacuuuuuaaagcaucuccuauuuaucuuuuagcaacucuguuuucuuguugugaguucuagaacauagaggggcuauauauuugcauuagggagagaaugucuacuugguuauaaggcuuauaaaauuauuuagcaagaugcaguaugaacaggacccaagucagaaguaaugagugagaggggcaaagugauaugcaagggacaacuccacaaagagcaugauuaaggaaaaaaaaaaagccaagugcaguggcucaugccuguaaucccagaaauuugggacgccaaggcaggaggaucgcuugagcccaggaaugcgagaccagccugggcaacauagugagaucucuguuuuacaaaauaaagaaagaaaaacuagccaggcaugguggcacauaucuguggucccagcuacuagggaggcugagcagggaggaucacuugagcccaggcaaucaagacuacagugaaccgugauugcaccacuguacuccagccuuagcaacagagugagauccuaucuaaaaaagaaaaaaaaaaaaggaaaaaaugaugcaaaaagucuguagguaaguugagaaacccaaaaccuaugccaucuuagaagcccaccuccauucccuagacccggcacaaggcuaaacaccgaagaggccuucaaugaauacuuguagauuuccuuuuugagaagguggggaggacuuuguggcauugaggcuuuuugaaaagagggcuugauaaguucuuaucagggagccagauacaguaagaaaacagcaaaaaaaguuguauuuauuucuuaugguuccaaaguagguccuuagcuggcagaagguaaaguccuuaaacuaccuagcacuccuuuccucauugucuccagccauucgguacacaugcuuguaacuagugaugaguaagcauuucauagucaaugaagucuauuagagugauggccuaagacacaggugguuucagcauauaauaaaaauaauuaauuuauaaauauuauuuuuauaauauuuauacauguauaaauauuauuuuauaauauuuauacaaguauaaauauuauuuuuauaauauuuauacaaguauaaauauuauuuuuauaauauuuauacaaguauaaauauuauuuuuauaauauuuauacauguauaaauauuauuuuuauaauauuuauacauguauaaauauuuauauuuauacauguauaaauauuuauauuuauacauguauaaauauuauuuuauaauauuuauacauguauaaauauuauuuuuauaacaguuauuuuuugaugacuaugugcuaugcauuuuccuaagcaaguuauacacagugcaucauuuaacccuuacacagcccuaggagguagacgcuauuaucaccuuauuuugcaauggaggaaaaugagacacuaagagagaauugaacugccaagagugaaauggcuaguaaguuggagagcccagaguagaauucagguacagcuaacuccucuugaccacuguguucugugcugagauagaguguauaucaaaagccacuuugcccuaacaucuuagaugguacaggauggauggcuuaggaauaugggauacagguaucuugauauggaugauagaagaaaaagcugaaauauuucaaguuccaauaccuaucugaugaccuucccaggacagacaaaaggcagaaugaaggggcuucccaucacacagggauagaagugcaaacaccaaaggagaaacaagaacaacaacaaaaagaaaaaaaacaguaagggaagggauauggacagaccuaauagaaacgaaucaaggucaaauguucauguacacaguaguuuuaacggacuucccuaauugacaaauugucuguauaaucuuuuagaaguagcacagauuuugaaguuucagaucuaaguucaaauaggguucagccaggaucuugagaaagucacuaagauauuuguaaggcuuaguaaccuaaucuaaucugaacauuggagacauacaauuugcaguauuauuuggggugauuccacugaauuauguagagaaauguguuuuguaaguugucuggcauagaccauuugaaccucaucuuguucucuugcuccuuauuuccccuuagguuuaagcagcgucuaauacacaaauggucacugagggggaagagcucugagaaucaccacugcaacugcauugagaguacaggacucagguuguuugaucagguguuguuccugcagcauaucuugccauguauaagcccucuauuucaccccacacacgcauacagacacacaaugaagaaagugggagucacacugucauucugccaccuucucuagcucaucuacucuucuugcaaaugaacuucagauguuaaacaguguuuuuacuuacaucuuucaaaauggggaaaugccauuccuaauacaacuacugccucuuuaaauguuuugugucacggugauuuguugcagauggguaacauguagccagaugggggucuguucuuuaccucaaaacuaggauucuucagggacccaauaugauggagugugcuuugcauaaugggcuuauuugaugagcacaguuguuuuuugacuaaaaccaaucuauaagcuuaggccauacaucauguugcuaaauaaauaaauacuaaauaaaucaagccauaauuaaauauuuuagaauuugaaugaaaugucuuuuuccuaacauuauuuucaaaaaucauuuggugauuccccagcuaaacaguugcuuaguaaagccaagaauccaaaacagguuuggaagcaaaaagccccagacuccaucacuacauacccguaggucaauauuagaaauacuggacuaucuguuagaaaauaucagaaauagaggauuaguuaaucaugagagaagcucaugauggaacaauaugcagccauuaaaaaagaauguuucagaagaaucuguaaugacauugaaaaaugauuaagauauuauugcaaauguuauaaaacaacauaugugauaugaccccaauccuauaagugugugugugugugugugugugugugugugugugugugugacagagagagagagagguuuguuuuaugaacaaaccagagagcgccugcacacuggcacuuggguucuguguuucuucaccauaggcugagacccauuagcccaaaagccugcuggcaucaaucucaaauuuuuacacaucuaauuaucuuaaauauugcccaaauaagcagauuuucagugaauuggaguuugcuugcuuugcacacuucacaaaucugugcccaacaccuguagccacagauaacauaagcucuggguguaaagaucucaagcugcugcuacccuucugagcacucagacacagagauccccugcugugcugcccagugacaucaccuagauacacaaucucugaugaucucugcccuuuuuccuuucugaacugggaccucugcgcuuacccucaggacagacuuccacagcaaggaaccucucugccugcaaaccugucaaagugccuaacacagccuguguguaccacugccaccuuguggucauauuuuuuucuuugauuaguccccaaauccuuugaacuccuuaaaaugccacccggcaucuccuuuccccaugagauguagagaagacuggcugcaaccuuaugccacaaacccacauuucuccaaauauuuucagugcuuacuauuucaucuuuacuuuuguagaaagcuucuggcuucuacucacgauaauugcuucacuuugauugauucaaauaugaaaaccaguuuuuuccuuuaauuucugcacgaaaauagacucauacaucacaugugugauacugacuuaacagaagguuugacucugaguugggggauguucuacuugcaacaauguaaacaauaauaucaaauggaacaucccucguuuuccccucguuuuccugcuuggaagucuuucucuguuaccuaccaucacagguuucucaguggcccuugacccucccuauuuucuuacagauucucucucuucaccaucgcugcucugcuccaccuucccuuuuugcauugcccacaauaauucacugaugacaugugguuuuaguuggaauaggugggacaggaccagcacugcaccuugaaugguauuggaauaguggauggguggagggcaagcuccccagagcccugucuuaguggcagggcuuuucaacuuccaaaaauggaaaugaaguuacucuauguauuuacaguaagcaugcaguuuuugagaaauaugugacaggagaaacagagacaaaaucuuaaacauuaaacaaauagaaaauaaaagugauacggagcagugggguaccccagaaggcccuuuuccaagcuuaagugcuacagaaaucaggagagagaguugagcaccaagaaacuggcagaaccagagcagggcuuggaacuuuuggcagcggacauacugggggugggggagggaaaagaggagaaaagguaggugacauuuuaaagcaggaauaugaucugugcaaaguaccaaauaugagaugucuuguggaaugcugaguagcccaaauuggaaaacuggaggcgagaaaaguagacuaagaggggcagauggagcuagauuugggagacauugagauaucaggcuaagaguugacacuauuuuuaaagccaguguuucucuaauugagaauuuguggagcucucagugucuaucuauagacuccagcuuaagaagcauugcaugacucugaaaagggucaaaaucugccaauauguaagauccccuugccaaagcauuuggaacauuuucuccucuuaaucugagucuuagugccucccucuuguucucuuccaauaacucugcaggagauaaacuuuacuauuuucauuugcaaguuuuccccaaauccgagaauuccucuguuaugucugcagcagacauuacaugugguaccaccuuugccaccaaaugugccaccacuucaacaaccauucuccaaccccugccgaugagcucaucuguuaccaaguacucuguacaacguugaacagcauuuuagaaaagacucuguccucccucaguccucucuccccuccgccacacuaagugcaagcugggaaucagcucagauuuauuggauguaagggccuguaaugacuuaucagucugggugagagaagucuauuacccuccaaccacacaucaagugguuuucaucucagguccacacaccaccucacggggcccacagcaggaguagaacaguaaauucacuccaggguuaaauaaaacuuuguagugggcaacaaugacagacaaggucuugauuaaacaugugagauggcaauuucugaauggguaaccaaaucuacauuucaaaguaaaaacuuagagaagcuuucaaaggaagacauucaacagagcgggaugcuacaauugacggcacggaauagggaggagguauauuucagcaaaacuuuguuacuaucucuccuuucuuucuuguuacaauucuuccauuuaaugaguuuguccucuaauuuuucaaaaacuuuuuuucuuucuaugauauaauaacaacuagaauacagcaccaaugaggaaaauauugaagugcaguagagcaaggcuuaggcuuuggaaugaagugaugugaaacuuuuuguaauaggcugaauaauggcccucaaaucuaucaguucuuaaucccuggagccuguaaguguuaccugauuuuuaaaaagagucugugcagacacaaguaaguuaaggaucuugagauaggaagauuauucugcauuauuugguagggcccuaaauauaaacacauguaucuuuauaagaggagagcagagaaacaguugacacaaagagaccacagcgaaggcaaugugaccaugggcagagacuggaguuauauggccaaggaauguagguagccaccagcagcuggaagaagaaaggagaugagauuccccccuagagccuucagggggaguaugagucugcucacaccuugauuuuggcccaauggaacugauuucagacuuuuuuuuuuuuuugagacagggucucacucuguuugccgaggcugcagugcaguggugugaucauggcucacugcagccucgaccucccaggcucaagcgauccucccuccugagccucccaaguaguuuggacuacaaguacacaccaccacacccagcuaauuuuguuuuauuuuuuauuuuuuuguagagacaaagucucacuguguuucucaggcugguguuaaacuccugggcucaagacauccucccgccucagcucccaaagugcugggauuacaggugugaggcccaauuugaacuucuggaugcuaaaacugugaaaaaacaaauuucuguugcuuuaugcaaccaaguuugugauaauguguuacagcagccacaggaaacuaauacacuucucacucacaauccccucauauagaacauuuuuggaaaccauccagguaguauuucuuccugggcaucaucccgcuuauuguaaauuagacucaaaugcaaaacuaccuuuucaggaaaacuggagcacccaucucugcuuuauugcaaaguuaguuagaucaaauuagaaucaucucacccacuacucuaaaggguuaaaugugccuaugagugaauagacugagaagggaguuacaguguuggcugggcugauugauccagacuaaccagggcaaauuguagcacucauccacagucaggguaagaaagaauaugucuggaauauagaagaucucuuaguuuaguauuaccaugcccugugauuaaagugaauugaagacuacaacacauuccagacagaaguacgaauagcccagacccuucaggcauaaagauuugggucaaccuaccacauaaaaaugcaugacagguuaaggugcuugcugaaggcaaagggaacagaaugcauaguagaagaagguagcuauaaauaccagccauggccauuuacagaaaggaggacugucacugacaugaguauuucuuucuuauuaguuaugaauuuauacacacacacacacacguacauauauuaagcaaaucucuucaauuuauuuccucucuuauucccuuaucacauaauauguuuugacuuuauauaaauauuuaagcauuguuaauuucacaucauaauauugaaguuaugguguaucaagagaaaagaucagacaaagauuucaccuucuuuuuuggggaaggaauuaguacauuuucaaucguauggcggaugguuguaucauguuagauggaauuauaaauuucuauuauuuuuauuuagagauaaaguaugauuuaaaaagaaguguuugugaguaccaugcugacaagcgguagauuugugaugguuaauuuuauauggcaacuuaacugaguuaagggaugccuagguagcuggcaaaauguuauuccuacuugucucugugacgguguuccggaauagauuagcauuugaaucgguagucugaguaaagaagaacuaccuuuaccagugugcacaagcauuagggcagcuuccaauaugcugaggguccauacagaacauaaagguggaaaaagggugaauucucucucucuucucaagcugggacaucuaucuucucugcccuuggacauuggagcuaaugcuuuucaguugcccccagccuuaggcuuccccuguguuccuaguucuuaagccuaucaggggacauuuuggccuccuauauaauaguuagucauaauaaaucuccucuucuauaucuauucauauccuauugguuguuucucuggagaauccugacuaaugcagugccuguguuagguccuugaucauuccauuaggaaaauguaacauaucuuuucauccauccauggaccacgcaucauggcucauuccaucugccacuagucagggguauaagaacagagucucauacgaaaacaugugagaugucuguggugguguuuuggaaauaacuaucagguuccugaguccaggaaaggguuucaaacuggccagucacuguuucugacuuuuuuccuuuuuccuacccucacucuccaacucucaaguuauuaagagaaaaguuaaaaaugaacagucaaaaaacucaguaucaaguaaaaaauacauuguaauuuggcaauggucuccaaucacauacuugggcuuucagcaucaaagggaacuugggcuguuuuaauaaacauuaagaugaaaagcagugagccaacaaagcgugacaggauuuaaaaaaauucaugcaaugugcaaggaguugcaauuauauuuccaguuaaagagagaugaaggaaauucaacuccauuuucagcaauuugcauguuucccacaaagagcuuugcucuaguuaauggccaagaugauaaacaggagaagcaugaccucccuguuaccuagugccacucccugcaggcucucuagguacuucaaagcacuuagugcacuccauucugcugguccucuuccaaaaacacuggccuccaguacugugcuuauaagcaacagugugagguugugagguugcucuuuggcauccucagccucugccugcuggguccuuuuccugccucucuccuuccaucugccagcgcaucuaugcuuucuccucuuccccauaucaaaacaagcauauucguuauuuaucacugcaugucaaauuacccugcgauuuagaggcuugaagaaacaacaaauguuuacuaucucucauaguuucuguggaucagaagucagggagcagcugacuaguuguggccuggggucccucaucagguugcggucaagaugucggugacaguugaagucaccucgaggcuugacuggagcuggagcauccacuuccaagacggcucacucacaugguuggcugguuuguacuugcuguugacaagaggccuuaggaucuagacacauggaagucugcacagcuuugcuugaguagccuucaaacauggcaucuggcuguccccagagugagggauccagaagaguagggagaaagccgcgaugucuuuuaugaccuagccuccaaagucacacuucccuucuuuuauucuccuuuucuauacauuuuguguaaaauuuugaauaucuugacauuuauuuguguaguuaaagauagcagugaggaagaaauccaucaggaauuguguuggaaauaagcagauaaaaauaauuuuccuuaaacaacauuacggcaauccacauuugaaauucuguauacguacuuuaagaaagauaaaacaaaucacaccagaauaauuuccagauaugauuuuugguguuauuauuuucaguugacaaauaaaauuauauauguuuauauauaaaacauguuuauauucaaaacaugauguuuugaaauauauauauauaaaacaugauguuuugaaauauauauaaaacaugauguuuugaaauauguauacauuguggaauggcuaaauuaagcuaauuuacauaugcauuauaucacauacuuuucauuuuuuugugaugcgaacacuuaaaaucuacuuucuuagcaauuuucaagaauacauuaacuauagucaccauguuguaugcuagaucucuugaacuuauuccuccuauauaacugaaauuuugcauccuuugaccaauacuuucccaauccccacugcccuagucccuggucaucaucauucuauucucugcuucuaugaguucuauuuuuuuagauuucacauauaagugagaucgugcaauauuuucuuucuaugccuggcuuauuucacuuaacauacuguucuccagauucaucuauauuuuugcaaaugaaagaauuuccuuguuuuuaaaggcugaauagguucuauuguguauauauacaccacguuuucuuuauccauccauucacugaugaacacugagguugauucaauauuuuggcuauugugaauaacgcugcaaugaacauggaagugcauauaucuuuucaacauacugauuucauuuacuuuggauauacagcuaguaguggcauuguuggaucauaugguaguuugauuuuuaauuuuuugacauaucuccauacuacuuugcauaauggcugcacuaauuucauucccaccaacaguguuaaaggguucccuuuucuccaaauccucaucaacacuuauuuuucauuuuuuauuaacagccauucuaaaaagugugaggugauagcucauuaugauuuuuauuugcauuucccugaugauuaaagauguugaacauuuuuucauaaaccuguuggccauuuguguguuuucuuuucagaaaugucuauucaaguccuuugccuacuuuguaauuggguuauuuguuuuugugcuauugauuuuuuuuuuugcuauuguuugaauuucuuuuauauuuuagguauuaaccucuugucaaauguaagagguuaagguuugaaaauauuuccucgcauuucauagguugucucuucaaucuguugcuuguuucguuugcugugccaaaaguacagacaacaaaagcaaaaccagacaaaugagguuacaucacacuaaaaugcuucuguacacuucauuucuguaauaucuuuuugaguuacacaagucaacucuacucaaugugaggguaauuuuaaacaaaagucuggaugccauaaggcagggaucauugguacccauccugaacacuggcuaccacaguagcuuuucccuuaaacuguagugggaguacuagucaccaaguuccuguagauaacaggaacaaguuuggguaaagucauucucuccuauucucaugaaauaaaaaguguuggucaaucuuuaaguuauuucaggaauuggaaagaggaaagcaaggacuucucugaguguacauucuuuagguagcuauccacuccuaagguggguaaagagagcuaugguaugcuagcaauacuuuuuucuagaaugaugauaaugaagaugaugauagcugaugcuuugugagcuuuuacaaugugcauaauuuuauuuaaaucuacaacaacacuguaagguauggagaaaugagguaauuuauggaacgaaggcaaacaguuaaagaauggaaaaguggggccaggugcgguggcucaugcuuguaaucccagcacuuugggaggccgaggcgggcagaucacaaggucaggagaucaagaccauccuggccaacauggugaaacccugucucuacugaaaauacagaaauuagcuagguguuguggcacgcaccuguaaucccagcuacuagggaggcugaggcaggagaaugaacccgugaggcagagauuguagugagccgagaucaugccacugcacuccagccuggugacagagcaagacuccaucucaaaaaaaaaaaaaauagaauggagaaguccaagaauggaaccuaaacaggcagauacaauggccuuuaccacuagguauaucgacuucugccaaaagcagugaaccagaagauccucaucugucccccuuacuuaaucuccccccagguccccagagccacaguacuuaauuuuuuuuucugacaaguaauucaaggcagauaacauuaacagggcuauaguuuuccaugggucuauucaauacuaugcacaauucccaucauacuggccauaaguccacugaccucuuacucaaaaaaaauucuuuuugagugaaauuuacaagucagcaaaaggguuuuuacuuggaggauaaacuugcauuugcacuaauuuauauauuaaaguauaaauucuucauaaaaucugguucuucaaccauuaucagacacaauaguuuacugaucuaauagauguggaagauuguuggcaaagauggcccuguaauccugcuauuccucucaaugugacuuuaccaugcuuuccauuaagagguacaguucauuucucuucuccucaauucuauacuuagccacaugacuuguuuggucaauuggacauuagaaaacauaauacaaacagaggcuuggaaagugccugcacauuggggcaugccuuuucuuccuguuggaaauauugagaccauccuauaaagaaguccaggcuacccugguguggaaaccacauggaggagaaaugacgugccauugaccaacagcuggguaccuaccagucaugcgacuaggccaacuuuaaccauccagccccagcugagccaccagcuacuuggagcuucaagagcaagcucaggcaauaccagugaaaggaccauucagcugaaugcaguuccaauugccaacccacaauaaaacaugagcuaauauaugccuguuguuugagcauaaaguacuaauuaaugcagucaggcuaaaagaugguccuguaguguuucucaaagugugguucacugaucagaccaccucuaacagaaucaucuggggccuugucaaagagguaaauucccgagauacuccucagagaaauuaagucagaaaucagcaucauggcuaggaauccaucauuuugaacaaguuaccacaugacuauucugcacaugaauauuggauaacccagcccucacauucuacugaaggcuucagugagcaugucagcuuagaaugaggaaggcugcauggaagacugggcaacaaagauuugaguacuaagacaacuauaauuuuguuuuguuuuguuuucuucucccucucccucuccucuuuuucccucaucuagucccauacuuuucauuauugcuuuuuguuuucaauaaucugaacaucuuucucuuuauuuuauuuucaguuuauauacuggugugacagccugcagccuugguaguguagccuagaccacagaaugauccccagggggccaucagaaaagauccauaucaaauaacuagggguggguagagugugaauucuuauacuuuggaaaugauaaaaugcuaaauagucuauuauccugggauggaaacagcagguguuacaaauauaaauucaguguugaagcucaagagaaacaagaauaaaacaggcuggaaugaauguucagguuuaucaaugcuguaagauacacauugucaugauauguaucuaauuaauaguuugcauguucucuaaggaguaucagaaaaguuucaaggguguaugcauuccagcuuucuacuccucugaugccuuccaggcaaauacuguuaaucagguauaguccuaacuguagacaguuacgugaagggugcuuaaacagguacuacgauacaaaaaacaaauucuccuuuaccagucugccagggauuucuaaacauugugagauucuucuucuucuuuuuuucuuuuauuuuuuacauuucauaaauguuuuugagaaucuauugcauuucaagaccauugaacagugaagauaggaaaacaguccuuaugcucaaagcauuuacaaucuuauuagaaaacaaugggauugauaacuacaaggcaauauggaaaacauugaacugguggcaugugaaguugccuagagaaugagagaaagagagagagaaaggaggaagaaaaggggaagggaggaaagggcaggaggggagcaaaagggagaagaggagaagauuucacaggcauaaugccuggacuuuguuuuaaggaaggauguguaggcaucuuccaaucagaaaaagaaaaaaauacaaaggcaagagagaaugcagcuuacuugaagaaguuuaaguauuugagcauaccuuaagaucacagugcuuuggccgggccacagugcuuuggccgggcgcgguggcucacgccuguaaucccagcacuuugggaggccgaggcagguggaucacgaggucaggagaucgagaccauccuagcuaacacggugaaaccccaucucugcuaaaaauacaaaaaauuagccaggugugguggcgggcgccuguagucccagcuacucgggaggcuaaggcaggagaauggcgugaacauggcagguggagcuugcagugagcugagauagugccacugcacuccagccugggcgacagagugagacuccaucucaaaaaaaaaaaaaaaaaaaaagaucacagugcagugcuucauagaagaggaaauggugaaagcaagggccagucuacaaagauucuuauguauauugcuaacaaauuugaucccauauccucaaaaugauagagagaauaaaagaauuaaguuaguucuuugaguuaagguaucaaugcucuuauuaaaauguaaauguauuacccaggagcauuauugcaaugucagcucaauagaaccuguuaaugccuuugcaaaaagacuggcuaaauugucacuucaagaagccaaacacagggcaaaaaggcaacacuaaguuguacauuuuaaaauggcuaaaguggugaauuauaucacaaaugaauuuuaccuuaauaaaagaaagagacuacuuauuaguaauuauagaugaggauggaaagggcagagaauaagacuacuucaagaaaguuucaaaugcaauuuuccaaaauuaaaauuggagaaauuugaaaauauuccagaagaaacacuggcauuuuuuucuuuuugagaaugacaggaauuaaaaggaccauugugaagcugaagacaauauucaucacuguucauuucuucugaacccaaacugaugcuuaucuugaaagccucaaagcuacaguggcaaugucagcuuuuucccagguuccuuuguaagcugcacagaacugaaaugcagacaggcugaaagccucucauuuuacagcauucuauucugaagcaaucaggaaauguuaauugggauuucaaggcuucuuucuacauuuuuuugcuuuacuuucaguaguuugcccccaugcccaucaaauucuuuaugcuuuuagccucuaaauguuacuuuauugauucauucauuuauucaugcauucccucauucacucaucuauaaaauacauugaguguuuacagaguggaggccacauccaaggcauggaaaacaugauuuucuauccucauagaacucucaguguauuauaagcgacaaauuuaaauauuugcaguaccauuugguaaaauguaaugauagaugcauauauauauauuugaacaaaaaaggaaguauucaacuuuauggacuuggacaggggcagauaugauuggaacauagcacagagaaugaccauggaagcugaaguuuuucauuuguccccugauggugaguuaguuagacuuuuguuuauguauuuuguguuguggggguucguuuaguaauauuaugcccuuuuacuuuuaaaugacuuaauuaaaucuuauaauguuaguugcucauuguagaauguuuaaaacaaacagaaaacggaaacaaaauucuaaagagauacacaaucuguguucuauuuuaggaguaguucuuccugaaaagauacaguuuuuuccuuuuuugucucauucuuuuugucauuauauucuuauauaaucaggaacauaacgcaugcacaguuuugccucuuguuuuuguauuuacuucauuaacuugagcauuuuucuaugucaugaaauauucuuaacacauaaauuaaaaauuuuaaugauuacauauuauuuuuuccuagauuugccuugucuuuagguuaccugggaaacauacucugaaauagagguuuacaugcuggggaggacgcuuugauugcugccuguaaggaagcaagacaggcaggguugggcagagggagagcuuaggauguggugcaguugaaauggaggcuucaggccauuccaggggguaguucucagcugggguggcccuuuggagcugugcaagccucuguacccuugcacgaacuggccacuggauguggguucauauaacccugggcaaagcagcuuccuucaacccaaggcucuaagagcagagggccucagcugugaacagucaguggucaacacuccugacagcuggugggugagugccuuggcccugacagggagaaauggauggcaaaccacaguaauucauguauccacugucuucuuguuggacauuuaggguguguuuugaaggaugaaaaggaaggaaagaagaaagagcauuccaggucaauagaacuguaagaacaagguccaggcacauaaaaagagaaaaagagagaaaacaauauacaacucuucauagcagagggagaagauuacaaucacacagugauaagagaugcuggggagagguaggcacgcgaggagccaggucauggggucuugggguuuauaugguaagaaauaggagauauugaaugguuuugcccuguuugcaccagaaggguaaugagaucagcugcuucugcuccaaggcaugccauuaucuuuugguucugggcugggaggcuuagagauggcaaaguugccgccagaaccgcugccaccucagccacaauuugcaggagccucuccagcuguguccgccuuuagccaucuauggugagagcccaguuuaaugcagacagccuccaggccuugacucagcucucauccagaugucuuacaagggugguuucugcagagguauagcaguucagugaaccuaugggaggggacuaugcagugaagucaagggcaagaggcuaccagacagaagcaaauauauacugugcucugacuggaagccaagcauccuuggcaugacucucccaugcucauucuuggacucagugagaucgagaaauccuggucuagagagacaaaauagcaaauuuuauucaguaccuaaauaguuuaaucuuuuccccuaauagaugaaucaauugauugacugauugauuuuuggaaagggaagggcugagcugauacuaggugguaggaaucaaucaugguggggaauuuguuccugaaugccaagcaaggccagcucaaugguuacggcugcuaugaauuaauaaagaucuuggccuuaaggccagaaauccccauuguuuaaguuugucaggcuuuauuaagccagcagcucuguggugauggagagcagaguggggcgggcaagagagcaaguguguugccaugguuacaagaagagaagcaaggugugugggugccgccacugucuugacuccaggaaguuuauuuagugauaggcucacacgcugauggggagaaauggcuuugaaucucucagaaucauuauggaaucagugaucuggacccacuauccuaacagugugcuaguauccaagcgacuaaaauauuccuugacaugcuugaagaauccgggagacuccaguaaagcugucaguugugaaggaagcaaaauacuaguggcuuagucaaggaggcuaagaugcuguugacucaaauuccuugcaaaggcagaguuucaaugugcauuuauucauucacaaauauguacucuauugggcuacaaguaucagacacuguucuaggcccaggguguuguaagcaucucuuuucaccugucaugccagguaagacagguaagcucacugagucugcccuguaugagagucuugcaauuugugauaggagaacccagccggggcaacugaacuacaugccaugaaauauggugugggucaaaaaccaugagcccucggguguauaugugcugggcuaacaggaauguaucccuaaauccaagagucuaccuuauaacuacacaaaugcagugucauugugauucucagcagauauuuuuaaaauguguuauuaacaauaauuugauacauuuuaaagaauaagagcaaaaagcagaagaaaagaaggaagacugguauuaugucaauuagggagcugcuuaguggauaacuaaaaauccuuugcagauaucauguaaaucaggaaaaucagaaaacuuggcugacacgcauuuccugguuggcacauuuaucaguguuuuuuuaaugcaggagaaaaugccugaggaagcaucaggaggaaccccaugacugggcuuuguguagugcuuagcagggggucugggggauucauuguaccucugugguugcgguugcauuugcgcaaugaaagaguugaguuggaagaucuucacuuccagcuguaauagucuaagguucuauggcacuuaaaauaacaucuacccaaacaccucccaagauccuacuucucuggccaagcagcugggugguccuuaguguguaguuaaaagguaggauugcuuuuacgccuauaaguaacacauuuugcuggguuggcaggccuauggacuccuucagaacaaaaaucauuuuaaaaguuucuccuucucacgucacuguuuguggcaaacucucagaaaauaacuggaaauaucaaaacaauauagcagaacguuuauaaaaggcccuugaucaaaaaggaggaguccuguccuuaucuaccaugugaucaguugacagaacuuucuaucccucaguuuucucucugcaaaaugggauuaaugaaaacuacguaugaucuuuaaacucuguaaacuaaaaauaaaaagcuauauggguauugcaagaccaguauuuuauauggaauucccuaaguauucuucccucaaaauaacucaucuuacagaaugacaagaagacccaguauccuauuacagcucucaagagaaacugcagagcagauguugaauacaacaagguuaugcuugcagaugcagggaaacagggagaaaguuaaacagcugcuucuggaggccacucacuauacauacuuauucuuuucuucuuuaaaaauaaaugugugaauaaaugucucucuaggagcuacuauggaguuuuaauuuuuuuccuagcuagguuguuuuuuuguucucauuuuuaguaugaaagguauuguuuccuuuuauuucuuuaaaagcaagagggguaucugcguaucugcuaggauagcaagauccucauaccguauguuuccauuuuguggcuuguugcaugaaaguaucauggcccucuccaaaauacacaaaagaaauccaaauguuuuuguuagagauguagcuuucucaggaguucaaguccaguuugaagucuugguccuuuccuuuguccugcucauggggauaugcaaaaagacugaaaugaucaagggacaaaagaaaggcugggcucagaacguaggcugccuccugucccccuuaaauucuuguguucccuaauacagcauccgaggacugccugugagugggagccagagagaaaaggagagauggaaguacugggcccagaugcaaagggcaagggucaucaucagagcuggaugcucugcagacccaagaccacccucagauaccugcucccaagaagguuugagacuuucucuuuuaauuaacauuuagggccuaaaaauauuauuugaagaaccaaaagcauacauguuccaucggaaugguguauuucagaagguuaguuccggacaaauuauaugcuauucuuauugaacaacaagugauuucauuaucuugucccaguugggaaacaaucaguuauauucccaauaguuugaauagaguaucuauuuggguauggcagggggaggucuaaucuugaaucuacagaguuaugucucagucuuccuuaaaaaaaaaaaaaaacaacuuauauacuucuuaucccauggauuuacuuuuaaaaagcuuuauguaaaccuuuguaaauugauuaauauuuaaacagaaugaggccuuacacauauucuuugacaaaaauauaaagaaugaauuaauuuuuuaaaugaguuaacuucacccguuccaaaagugaagauauguaaauucaaauucucauacaacuaaccacaagaggaaccuuuucuaugcucauuggccaggagaagaccauuaggcugagagcacugauuccuaauauacuguggagacugaguuuaugaugaagauuaacagagauauugccagaguuggugaaguuccaggaucaaccaugcacaucagcuugggaaacugcacuucauggugggugggaguucugaugagacacuugccuuuccaugugggaaggagccccugucucuugauacuuucauaguaccuugcauagcauuuaaacacuuggcuaauuacagaugaaacacuugcauugggcgauaaagcaaagcaaaauguacaggaauaaagaaugaaaugaaagauguauguaaaggaaugaggacaguauauaugguuuaugguaugguaaccaggaguugaguguaaggaucgcugaggcuugaucccuaucuuuccuuuaccccuaccauauuuaccuaaugcccacuaugggcaacgucugggaaaucuuacagccacaagacacaguccaugcaaagacugccaguagcacccuaauauucauugucuccuugcuuaucuuuaguuggaaacaaggucacccagaauaaagacucuuuucuagccuuccuugcagcuaaauauuagguuggugugaaggaaauuguguaaucaccaugugacuaaguucuggccaaugagauguaggcagaaagggaugcaugcaaugucuacaggguuuccuuagaaggagaaggcaugccucucucaugcuuuuucucuuuccgccagcaagagaaggcuagagacgaagcauucaucucaacucacagaagagaagcuccaucuugaagcuguacaauccucaucagaaauguggauuucugaugguuguggacucauagcagcugugacccaugcauccagacuucuaugacaguugaacaugcauugcccaguuguuuaaaugacuauuauuuuagauuuucagccauccacagcuaaacacaaucucuguacuaaacccuuccagauaacuuaaaucugcaccuguacucucuggcuuagauggcugaagucagaagucagaaacaugguuuugcacguauccuggguuuggccaguuugggacgcacuuagcucucuugagcuuagucagcugcacugaaggcaugccagaacacuuauaugaucucaagcuuuugcaaaagcuauucugcauuaggggucacaaacucaaaugcaggugagagcagaggaccaagcugaugagugguuaagacuggcaaacuggagaguguacucucagccuaaagacgagugcagcucugcagucccagcuaugggcagcuacacagcaaggcaggccccagaaagaggagucuccaaguuuuuaagagucauuggaaaucuggauuauuauaugaaagugcucaauuuuuaaauuuuagcaacuaaaauaauaauaauaaucaacuucguggguccaauaauaugugguuucagucaagauucggcccacuggcuagcuacucucaacuucuaguaugauugcuggggagggcaagggauuagaaacugaagaguugaaauguacaugcucccaacacaagcaaagucauuaccauguagacagaauuuaagcuguuagagauggaacagacaugucaaaagugccuguaaucccaguacuuagggaggcaaaguugggaugauccuuuggggcuaggagcucgaggccagccuggacaacauagugagaccccaucucuuaaaaaaaugaaaagaagugagcugagcaugguggugugcgccuguagucgcagcuauuugagagguggggcagaaggaucccuugaguccagaguucgagguugcaguucgaacuaggaucccaucacugcacuccagccuggaccacagagugagaccuugucucgaaaaauaacaacaaaagaaaugucaaaaguaccaaaaaucagggucauaaauuauaaaaguacaguuuaauuuaauuuuagauauuauaaaaauagcaccauucuucccacucacccccuccacucucuucacccuauuaagaugggaaacuaaaaacuaagauauuucaggugagccauguuuaggagagauuuacaguaccccaccuaccucaccucagguacuucaguaaaaagccacuauugccagauaacagguaaucucuucugcuaccaguauaccucaacccuggcaacagaagacuaagggucagagccucagguccuccacuuuugcaaagucccuuuucucccuuccuagggcagcaaguucucugguucccacaucuccuugcgauauuaauuaaaccugcccacuaguccuuaugccuaagggguggagaggugggaccaguagacuuggcugugcuccagaaaccacauauucauccuaccccugccuggcacccaacacuccaccuuugcaauuaaccuugccauccuguuccuccaggccaagaaauaaugccaaaggcaugaguguacaacaggcaaauugcggcauggcugcaggguuaaggagucacaguguuucuggaauuuucacucucuguacaauucacucuguaacaaccuccuugagcuuaagcugcucucagaaucacuccuacauaguuuugaccuccuaguuuagggucucucagaauugugacuaaagcaaaugcuaacacaaacccgcuggaguuguuuuuauuucaauuaaguaaauggcucccuagaggcuuaaagcuuaacgcccaaccacuuaggacauagccagcaaggucgggcccucagaaucaaucaaacccccaucugauuucauaaacugagcaguggcauacaacguaaagagugaauagguacuuuuuauuuucuuuaugccucuaguuugcagccacaaggggggcaaagcuuugcagagcacuguuugcccacuguaugguucacuuaacuaaacuuaucccuguugugcuacucuguaaaaugaauacuuguaaacaaaaugauuucuguuuauugauacugauuacaauucaaauauuucuuaagauuuaaaacguacguaugaagaugcaugcuuucauaucuacauacaaauuugcuaagaaaugacaguuaaccacacugaaaaaauaaagacuggaaaauguaaugaaauuccagagaaugugcuaugcuaccucacugugugaacagaagauuguuaaaagccuuaugauucaauguguguucaguggaccagcauucagggagguuguaaguguggaauuucaggcaucaagggcuaggaguuugcuagaagugcauaaucccagaccugagacagaaucagaaacugcauuuuaacaagguuuggaagugacaccuuugcacuguugacaguuugaaagaggcagaacaaugauaacgaaaggcgucauuaguccauaguccaugucacuuagucuggagaaaggacaaauggccuuaaguccuaauuacaccacguaacaaaauuacuugacgucucaguuuuccucauuuguaaaacgggaaugauaacagaucucauaugauagagauauuuacuuaguaaacuacugaggauugcucaacuauaaaguuguguugccauuauuuaccggcauuuucaugcauguacacaaccaucuuggggccacuuuuugaacauaucuaacuggaagaagucaccuugaaacuccccuggaaauguuggcuggaacuaaggacaaauggacacuuacacaaacaggaaaagcuagaauaaguguacgugaugaauaauuugcuuccgaguauaaagauaggccauaaagacaaguccuaacuuccgcugaagucugugguaacaaauugaauguaugucaaaguaaagaaaauacugaaauuaaaacuuuaaaaaaucuuugauaggcauaauccuaaaauacuacucaugcaucaccaaagacauaaggaacaaaugaagcaggaaaaaauggaaaugaugacaaaaaagaaaaagauauaaagucaaaaucuacccgacauuauuuaguucagcucuauuaggugugcacacccaaaagcuauauagauccucucucccaucuguacuuauaaggacaccuccgaagcugcuuccuugaguuuggauucuuaugaaaggacguuugucucaaauggucagagcaaacuguucauuucuuuuaugcaaacugcuucuaucuguuucaaauccucuccaccugaggaguuaggucaacaaagacuucuacggaugauaauucauaguuacacuacuucaguuacuaaauguaccugguuuuaagaaaauuguuuaaaaauauacacuuaaguuuuacucuauuugaaguaagaagagcuucaccaacacacuauaccaauuucauuuuauagaaaguuuucaaaugcaugcauugcaaucugcaauuucaacuggcaaaugaacucauaucuacuaaauugauaaaucagcagcaacaaaucacagagugaaauguggguugccuuauuugauauaggaaugcaauauggcuugaauuaguagcuauaugacaucuaagaugcauaauaccuguaucauacacacuuuuguauaugugcauguggcugggcaagccauguguucuaaugaagaaagcugucaucaucauuaauuacuugagauauacagaaggacacauggcuaaauguauguagcuguaucuauuaucuaguuuauuacuguuguuucauacacaagguaaugaguuugggauaaauguccacaacucucucaacauaguuucuuuuuuugaaaauguuaguauuucagaucauauuuaaagucccaaacaagucaaacacuuugugagucuaugcuguuaaaggucacauucuaauugaauaccuuucucuacccuugauguauccguguuguccuuaaaaucaagaagcuacaucaacuacuuaaaacacccacuugucuuagaaauagaauuaguugaacacaguuuuguuuaggggaaacgggcacugcaacaaaaugaaauuuucaauaaaccaaaaagaaaaugacgagaguacuuuugcaucuuugugcugggggacaucagagacauggcauugcucccauggaaagggcacuuuucugcacaucuuauucuugaggagcagcacacccaggccugggcuucgcuugaaaugcagccauugucuuuucauuuuccucaggaauucuucagggcaagaaaauggcaugagcaauggccucugugggggggaaaaagaguuccuuuucuuccuaucaacucccuucacugcuucauuaucuaaacuagcccugauuuuucauuguugcuguuuuucaaauugauuuugggauccagccuguuauucccuugcaauuuugcuaauauccaagaauguaaauuuauagacaaaugugcugguauaccacuuugcagcaaaaauuauuauucacuuuucuaaaggauaaacaauaugcuuucacacuuaaaguaugaucuaucuggcagaguaagauuuaccuaaguccauauugcuauuauuugcuugaaucuacauguguuuagaaaccauaggaaacauguuccaaccauuauuuuuccuuugaaaugauacacaauacaacagaauucagaaaagaagaauuggaugcaccauuaugugaaugacguaagaguuccauccaacaacugcgaaacaacacauuuaaccucaaaauagagacguucucaugacuagaggaauaauuaccagugacaauccuaugagauccuaaauauucucauaagauucccaaacauugcuaguuggcacucuuuacaaaaucccuuuguuucuagaacaauugugaauaguauuucaugguaacauuauaccgcccucauaaaaaacuacuaaugggucacauucucuauacagaagucucggcuaggugucauggcucacgccuguaaucuuagcacuuggggaagcugaggaggcaggagaaucgcuugagcccaagaguucuagaacagccugggcaacauagugagacuccaucgcuacgaaaaacaaaaaauaaaaaaauuaguuugcuuuggugguacaugccuguaaucccagcuaaaggccugaggugagaggaugaagcugaggcaggaggauugcuugaucccuggaaguugacgcugcagugagccgugauuguaccacugcacugcagccugggugacagggugagaccccaccucaaaaauaaauaaauaaauaaacaaauaacaauguucucuucaguuaggguuugggucuauggcuuguacucaucagggucacuaugauuuggaaaccuguuggccucuccccgcaggggucuguuuacucuugcucagguugcuggccaaucuguacugacuucucauacacccagcacugugaagcaagggcccgcuaucucaacagauggcacagauagccugguagcugggagcacaaugcaagggacauguggcacgcugacuuuguaaauacacugcaaggggaaaaugauuagccacauaugucugugauuuaccggucagcuggaagccacagaccccgagucuguugagucucuaagaaaaaggaaggaacacgcugacucaguaagugaaacaaauacagggcagcccugcucauacuuggacuuagugcagccucacccuguaaugaauauguuguggcuccauaguuuaggagggugguagagaggugugcaacuagguuuuaaaaaugugacucggccuccccacaucaccauacacccugugugguaauacucugauguagcuauuuagggacaaauggcuugucaauagguaacucgaaugggcagcaucagcuuauaaagggaagucauacuggauccaugaucccuacucuaucuuaguguguugggguggugggaagaggaaggagagggcacggcaggagagacaucgcuccugguagcaggugacugagaguccuauaggccgcaagccaaaaccccucagcagguuggucuuuagaggggaggggcaauucuggagacagcuugguucuuuuucugccaagcuccuaacagacacaugucuggguuauauaaagagcagaauuggaaaaaaaauucaaaaagagcaauuucauuaaacucuggaacacacuagaaacaaaacuacuagcaaagacaauaguacagcuucaggaguccuggggggccaugaauacagaagugcccucagcagaagccagggagccucccaugcccaguggagcagcagacauucugaugccagaagaaauggugccacaaaaccuggugccuggcaaaggcagcaccggccaugagugaacuggaugugaacaugugugaagagguuccuggguuccuaugaacagcugaguucacaauguucaaggggguuggagguccuaaauuagccagcuaggugcaugagcuccagguaaaaaugugaaauaaaugaauucauuauuucuaucaaaauguaugauaauuuuuacuuguugagcacugugucaggcauuuuauguguuuguuauauuauuuaaaacucacacaucccuaugggguauggggacuguuguucugccgucuuucagaugacgguugaugucaaauguuaaacugaugacuucagggucgcagagccaagauucaauuccagcaucaacugacccaaugcacauggucuuaacuguuauucucuguugcuccccucaugaaugacacauaaacuggccaaaaaugaaaugauuuuaaagagauauuaagaagauauuuaacuacaaaguuucauccuacaauuucaaaauauuuuaaauauacugccauuuaauguucuauuguuacuauuuuaaauuacagauuagaucuugcuacuucccugcucgaaugccuccucuuugccccuagacuguagccccuaaugacuugguuccagccccagccugucuuuuaaccauauuucaaucuuccugcccaccugucugcaccccagauuccuaccaucacugaccacuggccagguuccugaucacaccuguuccuucacaagucuugcugugcacucuugccugcauuccugaaagucuagcuucagcaucacuucaccuacacagucuuccuuuccuucaccuacacaguagaacuucccauuaguucuacugaccccuagcagaacuaaugguucccuccugcauauuuauugugcauagcuuuagauucacuuauacgccaguuuauccccaaugucaauuugcauugugugauuccuucacaagauagcaaguuacucuggggcagugauuuugccuucacaauuucaguucuccaguguauggcaucauauauuugcuauacaagagucacucaauacauucauugaacugaacuuccuggcuuugguuauaaccaaguguaccugagaauuaugcugacucucauuuucucagcucugauaggaaauaagcaaaaaucacguuucucuugugucuucagacuucccuuaucccaauuaaagacuuuauauucauuaaauuaaaugcacuuuccuuucuaucaucacugccccucccuucucacugccugaagauguacauuuccucugcaagucuuccacuuucucuuaaggccgccaaauaauauacaugucucucaauuaaauuuaauuuucagauaaacagcaaauauuuuaguauaaguagauuccaaacauugcauggaaucuacuuauacuaaaaaucauuuguuguuuauaugacauucaaaauuuaacuggauacucuguuguuguuguuguuguuguuuaauuuguuaaaucuggugauccuauuuucuuuacaacugucuuuaaaccauuauuuucaucaagugacccauagcggccuccucuuugguuauaacauagggcucuacuguuaaugaaaugucuuugugccauaggggcaauaaaacacacaaacaugaauuuucagugacccccuauuauuuguaggauaagaugaaaggcacauaucuguaacaaauugugaggacuacaugauugcucacgcuccugcaucugguuguugucccucacguuucaaauuugaccugggaaauugucuucuauguguguucuuauauucuuuucaaccacuuuucaagcucucuuacuugcuaauuuuccccaauucuagucagacccaggauuccuuacccugaauccuuccccuguggguagcaaaucugcuuaucuuugaccuuuaugaagaaauuaacaggucuguaguuucccuucaaaagggucucugcaauuuuucugcauucaugaaggucaugggcagacacugagcccauguaggcugcucucuuccugcauacacuggagaauauccaaggaggggaggcuugcugauugucagcagagucagcacagcaaguucuucagggacugucuucuucccuaacccccuaaggaaucauaagggaugaaucucccacuuccaaauaccagauauucacuuguguguuagcagaguuuugccuacaucagugcucuccuauaguacuuagugucauaauggaaauauucuauucugcucugucccauacgguagccucuagguucuggacuacggacaacagauugauaugugguaagugugacugauggacuaauauuuuaauuuuguguaguuuuaauugauuuaaauuuaaauaauuacauguggcuagagacuacuggauuggacaguguaagccugcagaauuaaauugccuaaaggaacugaaguuacuuuauuuaggagagguaaugaaucccuacagcucuggacaaggucuaggccagagauuuucaaccagggcugauuuuaccccaggggacaucuggcaaugucuggagauguuuucagguaucgcaacuggggguagcagugccacuggcaucuagaggguagaggucagggaagcugcuaaacauccuacaugcauaggauaacauuccacaaaaauaauuauccagcugaucuagauuugaauccgugcuauaccucuuaaccugggcaaauuauuaaucuuucuugagcuacagcuuccuuauaaaaugguguuaauaauaccuagaguacauguugguuaugagaacuaaaaauuaggcaaaguuucuggcagaaaauguacauccuguaaagugcagcuauuacugaauugcucaacugacaaaacaaugagagcaucuucuucgaguccuuugguggacaaauccuaguccuugguugcugaggcacuccugaucgccuggaggugagugguucugaaugguuccuccaucuucugcuagaacaaguagcugcuuuuuauaauggguuuccaauuaagauauuguuugaacauagaguucuguaaaaaaaguuugaacaccacagcucucagccaucaguaauucuaaugugaaaaacuggauccaggcaggaggaagagagcuauuuggggggauacuuaccuuuguccucuuuucaauuauacuagauaguaggucucaucuacugagagccuauaaauagagucuucgucacuuauuuuuccuguggauggagacauauauaccuccagagucugagugaguuaauaaaggcauuuuugggcauuuaaccucucuugggcuggugaccagagaauuuuccagaaacaauugauggcaucaaggucaacccaguucaggagaggcauggcacacuucucagcaacuuccucaauugcucucaaaucuuccuuguguuaucacugucuuuacauuuguggacaagggacugaugauggaacuuguuuuauucugcaaaagucuuggaaauaagaaugcagaggaaagggcagauucuacuugcugccuuggggaagcagugggacacuggccuuugcggaacugguuuaaucucucuuuaaagcaaauaucaucugucugaugcucugcugagugaucuacucucacuuuucgggaugcaggcucauuuaacaacuggcaaucaaacccgcuucggcagccacaauagugacugucgagguugauuaaacugaaaaaauaugccaucuuuauuucuauucuauuguuucccaaagauugacaaugcacauuuuuuuucaauggccuguuuucaugaaauuucacucagauauauuucuaagcccucgauccugaugguacaacacaaagucaaauaugaauggugcuucuuaugcugcuauuauaaagcaugacccuauucuggacaaauucagaaaaaaaauggcaucaggaguucaagagaagaaaauaauaggagacucaagaauuuaugaugugggaguagggaaauguacucuugauuuagauagugauuacugauaaugauuuaaugguaacuugcgguucacuguaauuauuuauuuagugugacaaaauucuugcaaaauccuggugauauguaguggacacuuaauacgcaucugucaaggaaaauauuaaaagaguuaccccuugugguacuuuggggaagcuuaaaaaaugggaaaccaacaaaauagugauaaacuauuacaacuaaaauuuaaaaagauaguagaaauaacugauuuugagaagaugagacaaugguaguuuuaaaacauggcucacuuuuuaaaaagaguccuccuagugauagaugaggugucugucuccuccucuuggguacaauuaggacugcuuuaauggacagaucacagauagauacagaaggggcacaguaugacuuccaaggcuaggucauaaaaggccaugaaacuuugccuggcccccuugggacauucuagggaaagccauccaccauuucugaaguccagcugcccugagaccauuacucuggagaggccauaggcccauuauucaacauccugguugagcguucagccgccaaauaaacccucaugcaaccgaguaagccaucuugggugcccagcucaacauuuccaauaacuugaguguacugcaguuagcauccauaccccauaucucccagucagaaacccuccauuggagguuagaucaguuuaugacauagccuccuggggcccugaaauagaguaaagaucacugaucucauucauacaugugacaaauacugaugacauauguagaauaaauuuuuuauauguuugucuuucuggagccaaagaaaaaaaaauaugaccaagacauagugcaugcaaagagcugagucuuauggggcaguaagagaauguucuuauccagugcuguaaguuccauaaugaaggaugugccaagcugaaggagaguccagaguggggguacaucaaucuguagggaaguuggggaaugcaccccaggagagggagagaaagacccagagcuugcuaauugugguucucaagcccauaccagcugcauuugguacucaggagacaauauagagguuuuuaacaucuguauuuuuuucauaauggcauguauuuuagaugacuguuugcuuuauaaaaccaugguaauauaugagucaguauccuggaugcauuuagcauuuaauuuuuuuuuacaaauguggcauuugcauccucauaaaugcaaauauuuuugcaaagugauacccuuugcaucauacagcaaaaaccuauaguucaaguaacaaaaacaaaacacuuuuuugagcaccuaguguuugaaaggugugcggcuauguuaucuuucuauacuauagaaaauaccauaguuuucccuaaaauguuguaaauuguauacuaauauaucagccugucuucuacuauccauuuuauaaauuaccaauaauaaauauccucuggacagauuuuaaauugagucagaaauccuguuacuuugugaaaaggccuaugaggauauaucuaaugcaugaacauuugaaguauuuuuaccaccaagggaauagcucuaacaauuugcuacauguuuccucucaccccuuuucauucaaacauggguguguauacaugcacaacaugagugugcauacaugcacaaacacacacacacucacauacaccauucuaauuaguauauaaaauucuucccagcacuuaauaaaagugcuuugacuuugacagacgcauaauaaaauaaagccucacuucucuggauacauugcgaagacuuguuugaccuucucuuccaccaguguuagcacaugaggugggaaaaaggcaugggcuuauaucugaguuguaugauuaacagacuguaugacaucauauucaauucucuaggcuuccauuucucuaucaauaagauggggaguccaucugaaccuucuaaggguauugugaagaaauaugagaaaucaacuccauugccugugagagcucugcauucaacccgcaaggacuguagguuugaucuauauucagagcccaucugagggacaccuuaugaaaacaugaaugcaggggcagggcgcaguggcucacgccuguaaucccagcacuuugggaggccgagacagguggaucacuugaggucaggaguucgagaaaagucuggccaacauggugaaaugcugucucuacuaaaaauacaaaaaucagcugggcgcgguggcaugugccuguagucccagcuacucaggaggcugaggcaugagaaucgcuugaacccaggagguggagguugcagugagccaagaucgcgugacugcacuccagccugggugacagagcaagacucugaaaaaaaaaaaaagagagagagaaagaaagaaagaaaggaaggaaggaaggaaggaaggaaggaaggaaggaaggaaggaaggaaggaaggaaggaaggagaaagaaagagagagagagagagagaaagaaagaaagaaagaaagaaagaaagaaagaaagaaagaaagaaagaaagaaggaaagaaagaaagaaagaaagggaaagaaaggaaggaaaggaaggaaaggaaaggaagggaaggaaagaaagaaaacaugaaugcagagugagucucuugggcuuccacagaagaaacuacaggcuccaaagucucaaccccagucucaaacugacccuaauuuacccaaggcuguaaggcauuucacauucccuaugauuuuauaaacaagguuuugagucagagaaauuaggucaacaaagccaacagcuuaagucuguaacaaucgaaaagucauaauagcauaucacaaaucccucuaaccccuccaaaugaguuuccuuugcucugaguuggugaauguaccacaugaguauuguugcucuucucacaccuaacuaugacagguaucaugaaucggccaugguccauuuucccacagagacaggacagugccucaagauccuucucgacacauuguuugauugauuagaguuaacccuuuagaugaagauuugccauccaugcucuagguaaaagaggugccagauaaaagaugccaggaaggcuuggcucagugcaauucucucucaccuucgauguuucuuuaggauaaguuaauuuccuuugucaauaaaaauaaguauauaaauauuauuaaacccgauucucaacagcauucauuuagcuaguuuaagccuugacgccauucuccauuccgcaccagaucauuaagaaugguuaaaaaacaaauaaacaaacaaaaacagaacaaaacaaaacaaaaaacaacuaggucaaacgcaguggcucacgccuguaaucccagcacuuugggaggccaaggcagguggaucccuugaggucaagaguucaagaccagccuggucaacauggugaaacgcugucuccacuaaaaauacaaaaauuagccaggcaugguggcgcaagccuauaauccuagcuacuugggaagcugaggcaggagaacugcuugaaccugggaggugaagguugcagugagccgagaucaugccauuucacuccagccugggcaauagagcaaggcucuguuucaaaaaacaaaacaaaaccaacaaaaaaacacagaaaaaacacuagcuacuagauuaucaacugcuguuauuuugaacccaugagagaaccuauaaauggcuuucucuaagccuaugugcuaccugugaucugucccagggaccaccuugaugcuaaucucuuaaauccgcaugucuagaagcaaugcuucaguuauaaauaucuuccaggggguugacacugucuuauuacagaugaaaaucgugcuuugaguauagcguuuuacccucuaauuuguuuuauguauuauccauucuauaaauacauacuaugacuaugggaacucauuccucuucgaagacaggaauguacugaaaaauauuucacaauuauucuuuuccuccaaacaagucacuuaauuaacagcaauagcauuagucaugucagggggaaaagucauuucaaaauuuugcuagguagugucuuuauauacaagcagcugcauuaucauaaugcagcaguuauauugggugcuuucuauucaaccucuguaccccccaucccagucuaacgaacagcacaaagcaaauagauucuuguguauacagcauccauuaaauagccuauuucuuaaacacguuaagaauagcaaauauucuuugucauaccacuuccauuauaaaaacuuuuaacuuggaaauauuccauguagccgauaaguaaaaaaaaaaaaauaaaaauuacucugccuccuuuccuaccuuccucuaugauuauaaaaaaaugaaaguacauuacaaaaauaaaauguucaaaacuuuauuuggaagaaaauuuaaaucacucaugauuuucucagccacaguacguaucauaaauauauauugguauaccauaaauauauuauauuguuaaugacauauauauuuuuucauuuuauaaaauauuguggagaucuuuagcuguggauaaaccaaaaucuacauuacaauuucaaagaauuauaccauauuccauuguguggauugacuguaauucacucuaccaauuccuugugccauuaguaauuucuaauuauuuauuaucaucaacauacuuguuaauguauuuuuugacacauauaucuuuuacucauuauuugcauuauuuccuuaagguaaauuccuaaacaucaaacuguuaggucaaaaguauacacguuaaauuuuaagaccuuuaauugaaucguccaacacaaaaucauugagacaguaaaaucuucguagccuagggaaaagcacagagccauucacagaggccugggagugaauuauuccugacccucugcuggccuguggggaaugguacugcuggcuuugggaugcaguauuaugccaucaguuuauauuuuuauuuuuguuuuuuauuuuaacagaugaaguaccaacccgggcccaacaauguaaauaacugaguugauuugaauaauggugaaggugaaaaugcaguguacaggaacagccccuuuaaaaacugcaucgccaaaugacagcaugaccaagaaaaaccaauuagaucugagagcucugucucugccauaaacaugcugugugacccucagaaagucacugaaccucucugugccuuaguugacucauuugucaaauaucaaucaagucugcccacaguauuuuucagagggagauuaaaaaacagaaaaaauacuucaggaaaauacaaaccuucuuugaauaauauuuaagagucauuauucuggagaggugauauugcuuauaaauaauacaaaauuaaacucagcagauaaauaaaguauaaaaugauauaaugugugacagucuggaaucuacugauguguuagaagccuagaauuuggcaaaaagauccaacaaaaugguacaaacugccagaguuugguccaauuuucaaauaaauugaaaagcuuugacauguagaaagaucaacaagcuuuccauaucuagauaauuuuuacguuuuauuuuuuaauuugauuguucauaucuaguuuucaacauauaguacuuuaagauucagcauuuaaccagaaguuaaagagaaucucacuuuuuauuuuaaguuugcgauaaaucccaugaaauuaccaaacaauuauucaccuuuuuuucugaccacaucuagcuaagaccaagccaacauguuuuucugaauucagauaaaaagaaacuucugucuuucugauagccuucuguuuuuugaguucaaaucauaaugcauaggaaacuguaucuuccuggcagagaagcaacagaagccaaugaacacagaaauaaaaaucaaagggaagauuaagagauggguugggagacuccaguaaaugucaaagcagcagucucagcguuuaggaccaauaucuuagaaccacccccacuggagucagacggaagaugggcgguaggucagccaucccuccugggucccugcucuuuuaggcaaagccuuuacccccaugucuugcucaguguagaagucaggagagggcauuacuggaauuucacuuuucuucugagugagaacauauucccaagaaaccacaugagaagacggacugauaaaaagaaaaugguaguaacugcccgugggcuccacauuuccccggacauucugguuuuagccaaaguaaaaucauucuagccuagccuguguccagccuuguggcugcuccagucacccagggcucuggguaucucuuaugcuuccagaaaaauaguggcacagugguggugggggcaggggcacucuaccuaucucacuuacugagcaauggauuaccuuccauccucccuacccuccaucuacccugggcuuucugguugguaauuugcaucaagaauuuuaaaagaaacacacauauaaaacaugcccuugaauucuauccucaaaaaaugcccaagaaagcaucuuguacuccuuuucccaccuccacucccugcauuauccauuauugcugaugcuucuccagcccuagaaccugacugccuuccugucucagcuaccugagucuuuccucccagcccugaggccaucucuuuacaguacagagacuuugggguccauguguugauaaagugauacagaauucacauuuuaucuuauuuuauuuuauuauuuuauuuuuugagacagagucucacugugucacccaggcuggagugcaguggcacaaucucagcucacugcaaccuccaccacuuccuggguucaagcaauucuugugccucagccuccccaguagcugggauuaaaggcacccuccaccaagccuggcuaacuuuuguacuuuuaguagagacgggguuucaccauguuggucaggcuggucucgaacuccugaccucaagugauccccuccccaaagugcugggauuacaggugcccgccaccgugccuggcuaauuuuuguauuuucaguagagaccagguuucaccauguugcccaggcuagucucaaaccccugaccucaggugaucugcccgacucugccucccaaagugcugggauuacaggcgugagucaccgcgcccggccucacauuuaauuuuacuuuugaucagcuagagagaacugugauucuccagauacuccaauaauacuggaauccucagagccccaggaagccccaggcuaagaaugaaacaaguuuuuuuuucuuuaauuauaaaaacuucuccccaucucccauuucuaucuuccuucugacaagaagacugcaaugaaggcaaaguguuugcuuccaaaggacaaacauuacaugcugugcucaucuuagcaggaucccgaccuucuccaaaagcugcugacaguacuaggcagaguccaucuccuccaugccagaucguacuggagugcaaaaugaaauuuuuaaguccaugagagaaucaggagucaguuuuuuuuuucaauuuucaaaaccaacuuguauaaauuaaaagucaaugucauaggacaaguuuauucaugucaucacccccaauuaggucucuccacccuuucuaauaauaaugacaacauauauuuaaugaacauuuacuauauuucacacaucauucuaagccuauuuuauggcaucagauauaaugaaugauuuucauuacccgauucugacuucauggguaucaagaaugaaguggucaaguucauccuuccugcccaguguuugauaagaaaacuaauuuuuuuuaguuacagaaugaaugacaauaaagaagagaauaagccaaguuuaacuuagauuuucauaaaaagcuaacauuuauugaaccauugcuauugcccauuuuuguauauacacuaucucauuuaaucgucacagcaaccuuggaggugggcaucaagucaucccauaaagucaugaugcucuuguuucuucccagcauucuuacucaauucuccagacaaaccacacagucacagacuaggcauuacccagaguucugugucacauuaucaagcuauuaaugucauuaacaauuuccuccucaguagucaacaaaagaaggaucacuugccuucgaguaguaauaaaauuaucaaacuauuacgaugaugcaguaacugagaccgaguugagaacagaggaucauuuuuuuugcaguagugaacugacagcaccacaauuagaaggacaugguuacugacaugacaaauuaagaacuuucuaaugagaaaauuuaccuuauuguguuaaaaauaaggccaugauuucccugggaugagaaaauaccaagucuucuuuacauuagagggcucuuuggacugaagucaaagcuauuugugacccauauucccucaccccuucaucuucuuacaacaaguccagaaucugagcuaggacagcuagcaaaagagaaacugguccauccagcuuagguccucauauucguaucuuugacucaacaguaacauucauuccuccuuuuccaguucuacaguaauucaauggacaaguuucaccaauaucuacaacgaaacuuuccaauaucuauaugauccugaagcagaguucccagugugagcuccgcucuucccaccuucauaacccaauaguuucucacaaaacuccuaauugagauuucaccuccuuccucuucucucucucucucucucucucucucucucacacacacacacacacacacacacaaacacacacacacaaugaaugagugagugacugugaaugguauucucuuuuguccauuuuucuuuacauccucagugacauggaggugcuuggcuuccccacccaccaggaucuucccuucccaugagaagcucccugcugucaacauagucucccagcucauguuuaucuccuugaguguuucuauuuuuauuuacuuuuguuccuauuuuuuucacuaagacagggucucacucuguugcccaggcuaaaguacaguggugcuaucauagcucacugcaaccuagaauuucugggcucaagcaaucuucccaccucagcuucccaaguagcugggacuacaggcacaucccaccacaccaggcuaauuuuuauuuacuuauuuacuucuucuguagagaugggguauugcuauguugcagggauggucuggaacuccuggccucaagcaaucuucccaccuuggccucccaaauugcugggauaacaggugugagcaacugcaccugucugagugucuuaaccuauacuuacagucuccuaauccuagaaacuuuccacacauucucucugucucugacucucucuuucuuacucugucucugggucugcauuaauuucaccucccucuaucccuucuaucuucucugucgucccugacaugcuccagucucuaguagauuaucgcacugcuucuauccagcacucugcuaggguugggugacgcugguggggguaggaggggccccaguuccucaaacccugauuuagacccaauccucagaaagcccugaugagaccgucaugugggacugaaucaaaagacuugcuguggcucauguagauuacaucuauugcuuuucuccuaucucugugaccugucauucugucauaggaggaaauugaauuggcccacacaguuuucucuuuacaauaccaugcugguugcuacccaguuccucaggcugcacugaaagauggaaaauugauugccagauguuguuuuggugucuuccuagguacugaaggugacugaugauucgauacaggugaaauucacuuuauccaguuccuguuucucugagaacuugugcaaaucaaauuucauacaaauugaauuuuacuuccuucuuuuuuuuauuuuuuaaagauacuugauuucagauggagccuuaauggucuguaucucuuagcauuagagcugugaugcuguccccuuucaauccucaggcacucugggacuucaugagauauauauuuuuaaauguacaaauacacugggugaacuauagcaaauaaauauuaguaggugcuaggcugucagauuaguuucuaaaguuuauaaguuuauauagagaaggcagagccccuuagaguaguaacuguccuuuuuacaacaauugugaaccaaauaccuugcuaagugcuuuguaaauauuuuucucauuuaaucuucccaauuuuuuuuaggugguagugauuaucuucguuucuaggugauaccauugaagcccagacacaacauguaacuugcccaaauuuacccagauguaagcgguggagacaggauuagaaaccugcaaguaugaacauauguuacuauuuucccuuuguaacacaaaagucaaccugcuacacacacuccucuuuauguugaauuguuucugaaccguaucccugggagauuuacccaaaauaacacauagggaggggccacauucuuuuucucaauuacauaauguucauuuguauggauggaccauacuucauuuaaccaguccccuaaugauggacacuggauuuuucccuaaccuuuugcuauuuuuaaaagaaugccauaaugaaauuuuacguauuauuucacauaauaugaaggauaaguuccaaggacagcauuucucuguauucucagagcgguauaugaauuugaaauuuuguaauuuuuguaguuguuucuaaacagacuucuucuacaggaguugugcagauuuaugcucccuuccucccccacugcauucuaugagaauguccauuuccucacgcucucaccaacagaauguuuuaucaaauuguggauuucagccaauuugacaagugaaaaagaaaaaccaaacuaacaguaucucaauguauuuuaaauuugcauuuauuuuauuaagaaugaaguugagggugggcgugguggcucacaccuguaaucccagcacugugggaggcagaagcgggcggaucaccugaggucaggaguuugagaucagccuggccaaaauggugaaacccuaacuccaauaaaaauacaaaaauuagccaggagugguggugguugccuguagucccagcuacuugggaggcugaggcaggagaaucgcuugaaccugggagguggaaguugcagugagucgagaucaugccacugcaguccagcuugggugacagagcgagacuccguaucaaaaaaaaaaaaaaaaagaaaaaaaaaugaaauucagcauuuuucauaugguuaagaacuguuuguacuucccugucagugauuauuuguuuauauucuuuuucaguucuauugaguagaaaaucuuuuuucuucaugauuuccaaaaucucuuuuuauagggauguuuuacggaaaauuaggccuguuauaugaauugcagaagcuucucccagucaaucaguggucuuuugacauguucccccguagagaagguuuuuauuuucauaugguuggauuuauccuuuccuuuaaugauuaauggauuuucagucauauuuaaaagccgccucucuacuucaaguucauaaaggaauuuguccauguuuucuuucagugcuuuuuuuuuuuuuuuuuuuuacauuauaagcuuugauuuguuuguaaucuaugcugguguguggcucaagauaacaauccaacaguaauuuuauguuuuuguugcagacugcuacaauuuuuacugaaugaucuauauuuuccucacugcuuuaagaugauacauuuucauacacugaauuuccauaugcauuuagaucaacuguccagaauguccauuauuuuccagagaucucuucauguauucauagaagcuugcaguguauucucaauuucuaaccauagauacuucauuaaucuucuuauacgguauuuguucauucauugucuaauuugcugauuuuugcauauaaacuucagaacuaaugugucugauucuacgaauuuggugaguguuuuuuguuuuuguuuuuguuuuucagagucucacucugucauccaggcuggugugcaguggccugaucacgggucacucacugcagccucaaccuccugggcuucauugauccucccaccucacagccuccugaguagcugggccuacaggugcaugccaccaagccuggcuaauuucuaauuuuuuuuguggagacagaguccaccauguugcccaagcuggucuugaauuccuaggcuugagagacaccuuccucaaaccccaucauggucucccaaagugcugggauuacagguaugaaccaccaugcccaguauggugguauuuuaacugacaccauuuuacauauagaaauugacuuaugaaucugucauguuuuugcuaauguguuuuuguguuguuguuuuuuugggggguuuuuguguguuuguuuuuuuuuuuuuuuuuugagauggaguccgcucugucaccaggcuggagugcaauggugcgaucucagcucacugcaaccucugccucccagguucaagcaauucuccugccacagccuccugaguaucugggacuacaggcgcccaccaccaugcccaguuaauuuuuguauuuuugguagagaugggguuucaccaugcuggccaggauggucucgaccucuugaccucgugauccgccugucucagccucccaaagugauaggauuacaggcaugagccacugcgcccggucguuaucuuguccaagcacauggugguaugucuuuccaugauagacuuccuuuuugguuuacaggaaugguggaauguuucuucauacaggccauacauaaaacaaaaaguuuuaaguauuucaauuucuguggacugcuauuuuaaauugauguuuuucuaucauuaaaucuucuaaccagcuauuuuauagaagcaauugauuuuugcauauuaaucauauacugcuacuucacucagugaucuuugcacuaauuguuuaaguauuaacuuuggggccaagcuugaaauauuuugucauauuaguaguguauccaugcauacuuauuuugaguguguguguguguuuaaucaagaauaauuauuuaauuuugccaaauuuucacuucagugucugugaugaugauugaucauagaaauuuuaccuuuguacauuauuaguaugaugaauuuuaucaauaauuccuuuguauugcuccaauaaaucccaccucaucaacaguauuauucccuuaacugccagcugcuuucuguuuagucauauuucaugcaggauauugucaguauuauccacaaguaaaaccuuuuauuauggccaacagguuggcacaucagggaaagacuucccugaagaacguguauuuuugcugaugcucucugacaccugcugccacuggauccuuucaaaacgcuccucauguccuccgcucuuccucccaggcagcuucugcuccaucuuagccuuggucuccuuauacauucuuaugaaagcuauaaacuucauggaguaucaaggaaaaggguuuaacauuaauuucuuucuccuucuuguguuuguauaauuucuaagaggagaagaagaaaaaugcuguuguacacagucaccuucaaaacagauuucucaagaauuauuuucgacauuuaaaacaaauuucgucuuuuuuuacauuccauuaucacaauuacauguggaaucguuguugucugcauauuuaucuaaucccuucuauucuagaaugcuuagucacuaucuguagacagauguaaccaaaaucaauuagaauuauuuaaacaauuuuccuaaacagauuuuaaaauguauguccauggcuaugcauguugaauuauauaggaauucauguauauguuuucacuguaaaauaguuaaacaacauagaaauuuauaaaauaaaaggugaaaauuucccuucuuuccuuaucugucauauucacccugauauaguuuggccguguccccaacaaaaucucaucuugaauuuccacauguugugagagggagccacugggagguaacugaaucauggguacagauuuuuccugcuguucucacgauaguaaauaagucucacaagauuugauucuuuuacaagggugaguuucccugcacaagcucucucuuuuugccugcugccaucaauguaagacgugacuugcugcuccuugccuuccaccauguuugggaggccuccccagccacguggaacuguuaaguccauuaaaccuuuuuuccuguauaaaugaccaaguuucagguaugucuuuauuagcagcaugaaaauggacuaauacacacucuccucucuagggucaacaauguuaacguguuauauacuuuuugagguucuacuuuucuacacugauauauacacauguacaucauauauacuuuuuuuuggcagaaaugagauccaauaaauauaguuauauauacaucauugugcaccucuguauaucucugggauuuaugccuggaaaugggauuauugggucaaaagauaugcacauuaaaaaauaucuaugcauauuaucuauugccuuccaggaaagcuguaauaauuaaugauccuaucaugaaauuagcuguuuuucuacaucauuuccaucacuggauagaauaaauuuguuuaauuuuuguuauuuucauuuuuagcuuguauuuccuccauuauuauugaaguugaccacuuuuuuaugucuauugaccauuuauauuucuucucuggauuuccuuuuacauuuguguguccauuuuucagauuuuuauugauuuauagaagcucuuuaugugcacuggagauuaaucacuugucuguuacauauccuauaaaugauucuucccaguccauuacucaguuuucuaccuuaaauuuaugauacuggaaguuauuuuuauaaaaucaaagaucgccaucuucauuuuuuugauuucuuuguugauuuuguuuauuguuuaauuauggggaccaaauauaacuacacuugguaaaaagucucuacauccugcuuugucuccuuagcucugaagacucaggacaacgaaacaaaacccuaaugcccugaauucccaaggugagaaagcacugguuaccuggaagcucuuguuguuacugaaaaucuugucgaggugcuugacacugcuacucagugucaaggaaaaucaagucaggauaaucaagaaauuugaguucuccuuugcugaugaaagacugcauacagacauuaugcuaaccacaaacuuucaguuucaucauuaagaauuggaggaagaggagcuagugcugggacagucuaagagacacuuagcaguuuuuuucuuuuaacaucuuuuuuuuuuuuuuuaacaauaauucucaucucaaaaaugugucuguguuuggaugaaaaacagcaugcagaugauuaacugaagaucuuaaacaaauuacauuuaaauuaauucuaauuuuccuucagucucuguuuuccacuuagaugccuuucucuauuguuugcaugagcuugcuguuuucagcuuguguuuuccaauuuuauuucccccaaacugggugauuucuccaagcaccccuuggggucuuagccaaauugcuuccuuuuuuaugccccucccauuguccaaggcccacacuaaugugggugcuugcaucauggaagcauuauccagcucgaugccugcucaacuuugugucuggauauuuuugcuaaaugggcaauacucuguauuuaaacacuuguugugugcuuuaguguguuuuuauguucgguacauguguuacuauucuauaaacacagcagagauagaugaugaugcacuuauaaacuuggcaucucaccuccucuaccacauaaugcagauguagccaaaguagauucuuaguagaaucuuaacaaaucuuaguuugugaauuguuaaaaaaaaaaaaaaaaaaaaaaucccaggcuguccuaaguucucucuuccuaucuuucuaccuccuauuaacuuuuacaacucaguaagcccuucaucaagaaaugugcaccuaaacuggucccuugguccuaaauguuaauuaacuuuccuuaacucucaggaaaugaccuaagguucucuuucugucgugaagcuaggagaccucugagaugggagucagugugaggucuccagagauguaaauuuauaauugaggugagugaacucuugaaaacauacaguucaaguuguccuuuccacccucccuuucaccugcaaggugcuagcaagugaaacucucacagaggaagaaguaaggucuucauugaaaagcuggugucacacuccuugggccagaguccuaguuuccuauuuuguaaaauaaggaugacaagggcaguuaagugucuaaaacagugcaaacacauaguaaaugcucaaaugcaguaguaguaaucguaguagcaguaguagucauaguauccauuauaauagaccucaaaaaagauaaauugggaaggcuagauaagcccuuuccauuaacaacaauuguuuggacucaguucaaaggucccuucucagagaauaauggcagaaugcaaauguauucaucuccuauuguggcuaugacaaauuaccuaaaauuugguagcuuacaacaaaacaaauuuauuauuuuauaguuccagaggucagaauuccaaaacaggucuagguaagcuaaaauccagguguugauagagcuacuucucuuuuggaaacuuuacaaagaaaucuauuuccuuaucuuuugcacuucuagaggccaucugcauucccuggcccuuggcccacuuccucugucuuugaagccagcucuucacaccucucucuaacucuguuuuucugcuucccucuuccacauuuaaagaacaauugugauuacauugggcacacaccaauaaugcagcauagucuucuuauuuuaaggucagcugauuagugaccauaauuccauuugcaaccuuaauucacccuugccauuuaauauauuacaggugucaccuguuaagaugugggcauauuugaggggccauuauucggccucuccuagccagaacugcaucugacaaagaauccaaagaaaauaagacauacucauaaagaauccagaguaugaaaacuuagaaaaaauucagugcucuaaaagcucuccauguuugaaguuuguguugugauuuuucccagugaugaucucaaaaauaaaaauccucaugguuuauauuugagggccacaaggaaucagggagcuggaggagacugcguuccaccuggcaucuaguuuugcugcgaaagcaacccauggagauaaucaaacaacuuggcaacaagucauauggaagagggaggaaaaaaagacuaacuucccagagcuggagggaaagcagaaagccaugcuuaagcucucaucagugggagccauuccaucccaggauccuuucagcaaccaauuuggaagucuaggcuuuucaguaaauaguuuuaucuuguguuucgaaaaagccacacuucaucuucugagccucauauucucuuacaugaaguuacuaaauaaaucuguauuucuuuuauuucuuuuacuuuuuuuuuuuuuuuuuuuuuuuuuuuuugagacagggucucacuguguugcacaggcuggagugccguggugagaucacggcucagugcagcuucaaaauccugggcucaaaagauccuccagccuuagccuucccaguagcugggacuacuggugcaugugaccacgucuaccuaauuuuuaauuuuauuuuuuuguagaaacagggucuugcuguguugcccagacuaguuuggaacuccuggccucaugcaaugcucccaaccuuggccucccaaagugcugggauuacaggcacgagccacggcaccaggcauuccccgccccacaaugauuuauacggcuaaugguacuccaaaucugauagaaaagaauccagucugcuccuacuucuucacuuccagugcuaaccaagcauaagccucaaccucucuugccggagcugguaaaauuggcaucuaucuaaucuccucacuucgucuuuugucccaacauaguccauucuccacacagaagccagaucuucugaaaaaugaagccugaugucaacauuucccuguugaaagcuuucugacauuuucguagaccugucuaaccacagucuuuaagaggccccaugugggcuggccaccuugcaccucuccacacccaucuuacauaucacaccuccauuacauuucaaccaugcgguuuuuuugucuguucuuugaacacagcaagcucgggccuuugugcuggcuguacccucugacuggaaaaccugguccccuccccaugccauucccauaccacuaacuccugaagguggaucuguucucugcucaaaguucaccuucucagagcggcacugcauggccacagcucugguacuuucuaauucuucugauucaucacugugcuuugauugucuuuauaucacuuaucuuucucugaaauuauuuuguccauauauuaacauacugguuugucaucuauacauacuacucccagcucucccuagcccuacucccaccucacagcacaauguaaaugcugacugaguagggaugaaaucuaccuuauuaauuguggcugaauucccagaugccagaauagugucaaauacauaguagggacuucauaaauauuuuaaaacauuuuugaaacuauaaauuuaagggauuauauauauuuuucaaaagauuccuuaugagaauacuguuuuaaauagugaauagauuuauuuguaauaguauuucagcuacacuucauaccuuaguuucuuaagaaacuauaaaaugagagcuggguuagaugacaaacaagguccuuuccaguaauuauaguuccgugauuaugacugaaauaaaaaaaauuaaagcuaauuuucaaaaggacaguugcuaaguaaagugguguccaccucuguaauuuaaaaaaugacucauuucugucugauucaucuagaguagaaaguaucucuuaacucuuuugcugcaggccucucuguucaccaagacucucuccacagccagcaggaaaacuguccagcaguaccaauaaauacauauuuucacaagacugaaagguuaagucacagcucuacagaauagaggaagauuuuauuucacccugccugucacccugcuuucuaccuaagaauacuuagggucauugaauccuuggaucgaugaaugcuuguuauucauuucaaucacuugcaacugaauccaucccaucucauucuucucuuuacucagacuguccagucauaccggccucucuguuuuucugcaaaaucauucaaacgcuccucccucgaggugaagucuuugcacuugcuuucuuccuucugccuagaauguucuuccucauggcuugcugccucaccuccuucaggucuuuccucaaugucaucuccuuagugagaucuuccccaagaaccucaucugaauuacaaacauaucccagcucacccucuucccccuuccccgcugugacacacaucccuguuauguaauacuuaucacauaacacacugcacacaugcuuacuuauguugcuugugucuuuuugccccuacuugcauguaagcuccaggaaaacuagguuuuuguuuuccuuguugcuguuucucgagcaccuugagcagaaacucacagcucauagcacagcauauaggaggagauggugcaauagcuacugaauggaggacaaguacgugcugcuuugugauuccugguagcuauaccucuccauacauguugcaacaacugagagcacaagcugucacuacuuccuuauauuccauuaccuuaagcccauauugaaaucuuugccaacagacuuaauuuuaaguguuugagaauggucauuuuggacucaggcccuccugacccaccuccauagacucccaacaguuccugucauguucccugagcacacaccauacaguaggaaacaacuuauuucccuaaauacaccuuguuuuccucuaguucaugacuuugcaugagcugcucccuuuuccugagaugucuucucgcaucucauuaaugaugacagcucuaaaagccaccuuuauuaaacuugcguuaguggaagaggagauagcuguuccuuccucuauguuccuuccuaugcuuccuuacaucuagcaggugcucucaucccucugauaccgacaggaggcaggggaaugcuggguagaagagggugggucccuggcgaggguuccacccucaagccuggacccauggcccuaacugagaacuucacauuucuguuuucccacccaaauguugccauuuccaaaaccacccuggcccaucccgcuacccacccuguacccauaaaaaccccaagcuccacuggcagaagggcaaaguggaguggcagaggagaagagaagaaaauaaccagcuggaugucggagagaagcagcuugacuucagaggaacggcuugauggcaggacuucagagaagagcuuggccggggauggucgaacucgaggggaagauuaucuucccacugccuugccccuuccagcuccccuucccucugagacccacuuccacugcucaacaaaaucuuccucauacaccaucuuucaauucauuugcaugaccuaauucuuccuggacaccagacaagaacucagguaccaagugacagaguguaaaauaaaaggcugucacucugaucuuccacugaacuggucaacacuuagcuguccauggacaucgaaugcuaaaggagcacugauuguaacauacacccucuggggcuccaggggucgcagacacucuuucccagauggcagagcuaaaagagcauugcaacacaguuggacacugcugcggggcccacacagagccugcucccaccagagcggagugaccagccaguuccaguguucaucugccccggcaccugcacccgcucaccugcgugcuuccccucccaugagggguucagagcugcaggcuaagcaaaugagccuucaggaauccugcagaugggucaagggaacuaucccaucucaccuucaugccuuugcucaugcugugcccucugccugacacccccuuacuccuucucuaccuagcuagcuuguccuccucaagacucaaugcaguguaaucuuucccaauaagccuguucuaauccucuacucucagugaggcugccuucuacaugcaguccuguauccaagcacucgucacauuuuauugaaaagucuuauuuauguguguaaaacucauagaggcagcauucccucuuacauauuguucuauucucuaucacaaucacuacauauuaaaugagauaaauuauauaugucuaugaaagcaaucaacacaucugauuuucauuauuuguaaaauauauuucaucaaaccuuaauagacuuuuuuuuuuuuuuuuuuuucugagacggagucucgcucugucgcccaggcugaagugcaguggcgccaucuuggcucacugcaagcuccgccucccggguuuacgccguucucccgccucggccuccugaguagcugggacuacaggcgcccaccaccacgcccggcuaauuuuuuguauuuuuaguagagacgggguuucaccguguuagccaggauggucucgaucuccugaccucgugauccgcccgccucggccucccaaagugcugggauuacaggcaugagccaccacguccggccaaaccuuaauagacuuuaaaaccucugggggcagcaacuauaauuuauaauuuuguauccccaauguagcacacauaguaggagaucaauacacauuucuaaggaaguggauugugggcccuggauuuccuaguauaguaauuugcacaaaaauguugccauaccauaaagaguuacuguguagcugauuauauguuauuaggaaguauuuuacaugcaaaaacaaauuccccacaaaguccuacguacuuuggaaauagaaccacuuuaaucauucugucuuucguagcucauagaacagaaagggauugccugcuguaggaaucccugaaaaaaaacagagccugaauccacaguccaaggaaauaaucacuggccccuuggucaguagaaacuucaaucaggaacuaauugcagaaauaauagucacauauacacacacuuuguagaacagaaaaagaacauuuuaggugcucaauaaauccaucaacuuuaguaacaaccaccaccaauuuucuuuaaaaagccauuagcucgcacuaaugcucacucagaauauuagaaacagugacuuuuuaacauaaaaacaagaagaaaaacaaguuagagauaaaaaugcuaaacuagauuacauuugggaaaguaccaguuuaggguaauuuuuucugagucauggaccacuuuugagaauccagugaaaguuuuggaugacaucugcccaaagaugcccacgcuuaccauauuuucuauaauauaguuauuuggagcauggacaagcugucauugccuuugacagcuaccagcagauggaaucugaugguugcugggucauuagcaagacaacauaguugucuuuccauuggagggagaucuuaggcuugguaaagcucccaacggaccccagaucugaaugauggcccucuaaauccuucaaggcuuugucauuaggaaaaagagcaaaaucuuucaaaaggccugccauacgagugaucucuggacuuugacuaaucucucuugccuccacaugaaaggccuuccuccucacagacuguauuccaguugcacuguucuuuuguuucugagaaagccugucaugagaaagacaacauugucauguuguuuccuuaccuaggauuuuuuccuuccacuccuucccccaugucucuuccguuaguucauccuucuuauuuuuuaacuuuauuuuuguaaagauaaggucucacuauguugcccaagcuggucuaaacuccugcccccagcaauccuccugccucagccucccaaaguaccaggauuauaagggugaaccaccacaccuggccccugaauaguucauucucauuugcccuucagcucucagaucaaacgcuuucccacccuuguuuguguuuaaauaaucacccuuuaauuuccuucacaauacuugcuagaauuagaaauguauaugugggguuauuugaauaauggcuacuucccucaccugacaauaaaaucccugaggaaagaaucauaucuguuuuacucagccuuuuaccuccagggcccaccuccaugucagccauuaguaggugcucaauaaauaaacgaugacuaagcaaaagaauagauaccuaucaguaucagugcugucauauaaacccacaagauuaauuuucaaugaccggugcugucagcacuauagcugcagguuucuuuacacuuaugcuuugaaaauucccauuuuaucaagccauuugauuagcuuuaaugucacaagaucuaggauauuggaggcagaucuaaaggaaagaauugcagacuguuugucuucuacugggaauaaagguggggaauauuuuguucacuauuguaaacuguaguauaauggccucaaauucuaauaaguaauucauuaauguaaaguaaauaauuuuuguggauauauggcacauauaauucaguuauuuaggccaugugaccauucaaagaauacaaaauuuucauuaggaggaguaaguucaggagauguauuauauaacacgguggccuauguauuguauacuugaaaauugcugaguguagauuuuaaauguucucaccacaaaaaaaaaugauaagugugugaggcaaugcauauguucauuagcuguagucauuccauaauguacacaucuaucaaaauaucaugauguauaucauaaauacauacaacuuuugucaguuaaaaaaauaaaauaauacuauuaggccauguaaccauaaacugucauuuccauuugcagcuccuagaguguggaaugugguggucuuugaggagggucuuugagguggucuuuguuaagguggucuuugaugagucccaagacugcauucuucugcacaccacuuacaauccuaccaaucaucagcagguaaugcagucagggauaauugaacaaaugauuccagucccaccauauaagcuccuguaucaugaauauacauucacagauaaaaauaaaggauuaguccgggcgugguggcucacaccuguaaucccagcacuuugggaggcugaggcgggaggauugcuugagcucaagaguuuaagaccauccugggugacaugaugaaaccuugucucuacaaaaaauacaaaaauuagccaggcaugguggcaugugccuguagucccagcugcucaggaggcugaggugggaggaucacuugaguccuggagguggagguugcagugagccacgaucaugcagugagccaagaucacgccaccgcacuccagccugggcgacagagccagaacuugucucaaaaaaaaaaaaaaaaaaaaaaaaaagaugauuggucauuccaaaaauuucaaccaaagagaagaggauuuuagugagacuugcuuggguggcacugaggaggucaucucacuuuggcugguccacagcauaccaggucaaauagcaagucaaaacaaaguucauagacuaaggaaaacuuuguguucaugcuuuccaaauucuuucuucuccaauuuuuuuuugccaguagauuaauugugcaugcaguaauuggugggauaugccaaauucagaguagaaaugagcaagcugauacaaagaaaccaaaagacgagaacacaagaaacccuuuauuuagaaauugauuauuuuuaucuuaauaccugaaaagggguucucugcauaguauagaagaauagucuaauaacuagaaugguguacaugacuuuauugucaacuacuuaaauauuauauugucagucacuuaaaaauaaaucuccugugagcuugauaaucaugaucugguccuucacaucugaucauuucugggugcacugaaaaaaagcaucauuuugggacuugcaaaaugagaacuuuaucuucaacacuccaugccaaugagcagauuuuucuaccucuccuuucccuuucuagaucauacacuguuuauuuugcuaaccuauaacauccugggagauacaagucauccagauaccuccacagacagcaacacccccuuguauacaauaggccuuugauuggcauagcaugaaacagacuccauuccaguguccucauucacuuccccuuggucuuuugcaaauuacuuaacauugcugcuugaugugcuugguuuguacaauaccgcaaaugaaaauaucauauuugcaaaguguugcauaagcuauuguuucauuguuauuuuaauuacugugcucucuaguugaagcucuuuacauaauggugcaccuggcuaauuucuagcauggagagcagugccucuaucuuuuuuuaacuuccuuuuguaacagugcgugacccaugaccuaaugaucuacuugcaacaacuaaauuuacaggaaauaaggagugccuuagaggauaaaaacguagggaacuacaggggucuaaaugucugcucguacagagacuauaguuacuccauaaaaucccuguguuuaaauccaauuagauauaucacuuaguuagaucagaacaagagagagagaacagaaguaugaaacagucuucgauucaguggggcuucaucagauaagccauucccacuguguugaugacaaggaugcuacuuuaggaauuugggagcuguuucugaggggcaagagauguccaacugucaucagggugaugguugacaaagauggcaauccgucagucacaaauaaaaguaaauggccugacaagaaaauaaaagcuuccuuagggcagaagagauuuucuuuaaaaagaaaauaaaucacauuuuggcuugaaaaauucaaauugacugguuagcuucaguaaacugacuagucaggugauccucuauuuuagggcuagcaaaugcuguaugcuuuccugguuucuugaguacguaggagaaaaagaugaagguuuuggcccauuguuugcuuuugucugggugaaguagauacaauuucuccuuaauaaacuaauacuuggaauugcaaacuauauuucaaccauugcaagcuaaaucucaaccauugcuguguuauugguuucaaccaugccucaacuuaaauuauucaaaucacccaguauuacugaguacagucagucccucaguauccaugggguauugguuccaggacccccacucagauaccaaaauccacagaugguaaaaagucccuuauguaaaauagcauagucuuuucauauaaccuacacguauucucccauauacuuuaaauaauuucuaggucacuuauaauaccuaauacaagguaaaugcuaugcaaauagugguuauacuguauuguuuaggaaauaaugacaagauaauaagucuguccauguucagcacagauacaaccauccuuauuuuuucauuugaacauuuucaaucugugguugauugaauccaugaugugaaacccacagauaaugagggacaauuguaccuacucuuucgcuuucagaaugauagauaccuuuagauauuggcuaugguauauagguaaacuggaucuccaaaaaacaaaaggucccaauuuuuuuuuuuuuuuuuuuuuacacagagucucgcccugucgcccaggcuggagugcaguggcacgaucuuagcucacugcaaccucugucucccggguucaaacgauucuccugccucagccucccgaguagcugggacuacaggcacgugccaccacgcccggcuaauuuuuuguauuuucuguuuaguagagacaggguuucacuguguuagccaggauggucuugauuucccaaccucgugaucugcccgccucggccucccaaagugcugggauuauaggcaugagccacggugcccggccaagguccugauuuauaauauuuacugacuuccuuuguguaaauacucccgccauggccaguuucaagucacugaauuacgaguggugaaaggcacaaaaucaaccuuccugaucuaaagggagccguuuccagcaaacgaugagugggauaaaaauauuauaacaacaacaaaaacaaaguaacaggcuuuuuuaauauaaugcuuuagagcucacauagcacucuucugaaauguguccaauucucacagcuuuuugagacaggagguaucuuugaaauugaaguucaaagaguuuaaguaguuauauccauuaugaauagaagcuaacagagcuaggacaucuuucuuaauuuaugaagccgaauucuguaacauuccauaacauucucagguauuuucaaauuccaucuccuuaaaauuacaaauuaaucaugaacauauuuaugcuuuccuaaacacuaacaauugcuuaaauuuuauaauauuacauuuuauaauguuuuaaaacuuuuugcaucuauuaucuuaauugaacuucccaaaaacauaguaguguaggcaaggaagagauuauauccauuuucuaaauucugagguucaaguaaguuaagugacuuguggaagaucuccuaguagguagcacuauuuuacaauguaggugaaaugacuucguggcuuacugugacagggaggaauaaaaaguuaaaccagaagcgcuauuucuuaucaagaucacaaauauugguaggucaaugucuaugaaugaaauugaacagaaauagaggccccaggccuuccgagacaaggauaccacauugacuccaccuagaccugcacauuagaacccugggaagacuuauaaaucccaacccuugggccaaauccgagaucaauuaaauaagauuaucugggggcgggacauaggcaucaguacuuuuuaaagcuacccuuguugauuuacauugguaaauuuacauauauacauauauauacacauauauacauauauauacacacauauauacacauauauacauauauauacacacguauauauaucucaauguaaaucaguauauaugucuauauguacacaucaauguaaaucaacaaggauauauauauacaggaagaacuaccauuuguuuuuuuacucuuuuauuauauucacacacucauccauccuuucauuuauacaacuaauauuaguugcacaccuacuagugccuaauagugccagguauuauuuuagauacugaggcugcaguauggucagaggcaggaucccaccccacucccaguuaaguuuacacucuagaagggggcuuacccacuaggcaaaggaauugugcauuuugggggcuggaagaagagcacagcaaaauacagaaaacuucagcauaagcccugggcucccucccaguuggcccaacguuuuugccuuguaggcuuuuagaaaaaguuacuuucaaauagaaucaggauccuguuccuuauaaugauauuucaccuugcauaucaaauuaaaugagaggcuuugauaguuugagguuuaaucauauauucaccuuaauuuaugcacuagaaaggcuccuaaauuguucuguguaaaucauuuuuaagguaauguugaauacugucuuccuauuaacucagauuaucauuuaucuucauuacaaaugaacuuuaauuggaaguggcuccuaacaaauuuagcuacaaaugucucacugggccuuccauuaagcaccaaucaauaaaaaacaaaccaaccaaaagacaaaaauguuccugguaaauacauaaaaggaguuaguuauuauuugaaguuaauuucuacaaagagacagagauucccugauccucuaagucaaccacuugaaaaggcagcuuuguaaauauaauaaaucuguauuuauuccucauggucaggaggcaaaaucucuuuucaggacugauuuccugaaauaguuaauauuucuuaaagugucauuaauuaaagaggccucacucucugacacuuugcccugguuccacuuucucacuggcugacugggcuugcuuagaauguuccuauucuccucgucuccauagccaagaagcccacaacucaccccuccuuccuucugagcagccuggcacuccguauugacccagcgcucagcacugucgcccugccuuccaaagcugacucucuaacuagacuccauagcuuaacaaaauagcucuguuaucucagggccaagcccagcguguagcacuuacuuguugcccuuaaaagguaauaaugaauaaaugaaugcuuuauuuaaaauuuaaugcaaaauauacuucuacacugcagaaaauuuucuuggucacuaaaugcucagauguucuuuuuuaaccaauaaagccucuuuuuauuuauauacauauuuaaaaggguggaggaaauuacuaguuugguugcaauuccagagacuuccaagugcugaaaugacucuaaauugcugaggggggccaucuuggauuuucuuaaagucacggcuguccuuugaagcaaauacgaauucuguaaacacugaucaucaagucugcagauuagacuuucccuuuacaucucucuuuccuccuuacauuuccuuuugaccacugaaugcuaucaggaaauggguaugaaaauuagauggaacccaaauugaauacauauuuccacucagcaaaggaagcaauuugaauggcaaaguagagacgccuaacaaucuucaaauccugcaguacuugaguguuuacaaaaacugcuaguuuaggcagcacguggauuaucauaucugauuuauagauaagaauauugagaaagacauccaaaaucaccuagccgguggagggggagagcuaguaagcaaaucccaacuccccauuccacgucccguauccuucugcacacaccaaauucuauggaggcaccaucuucuccucuacuucacccccucaacuauggauaauggagaaacaacuguaauuggagacaguaaguaccccaucagagagcgcuucagggugacagcuuucaugguguuaggaucagcgaucugaugguuccauugcuugaugcaauggcugugaacgagcccugcuuauugucauaucuauuacugagacuaauuaaaacagaagcucuuucucucaauuauagcauuggguugguuuaauuucaaauacagagagaacagguacacaagcaggccaaaagaaggggggaaaagggauauuaugugauuaucagagcagcaccaaauaaagcuucaucuagaacacauagggaaggaaauucaagcaguaaaagaugugaggaugagaaaacaaaugcauucuuuguuauaaaccagccagaaagcaugucauuacuguccauccauuacacuacugcuucuaaaaauuaaauagacucccccauauaacggaaucacugauugaaauaacuuuuugguccaguuuggcugaggaugguggaauauucuaagaaaaccuagagauaauuuugaccaccccacaucauggcaucuccagauuccucuucuaaguauuauacuccuuccccaucuugaggugauuaaaggaaagagauucugagcauaaaaagaauguacacauuggcugaauaauuuaaugauucauauaggguaauuccaaagucauuaucucauucagugcaucuauuuucagaaaagcacauucugaugucagauaaagucugcaaauuucuuuguuucaugacuguugacaaauauuuaugaaagaagaaaagggugagagagggagagagaaaaagagcaccagcuugugucuuugugucuguguauugcugaaguuugaaagaaugugcagggcauagucugggugucagugaagaaagcagguugguuguuggcauggagucuuuuaaggugacuuacagcuugguguauucacuaugguucaaaaacuuuggugaggaucaaaugauaugauauaugguagcacuuugaaaaacaucaagaguuacauaagcauaaggcuuuauuauagaaaauauaugucucaaaagauuaggaaaacuuuaaaaaaaaaaaaacagaagagaucacagaauaaaacacuuuuucaugaaacuucuugucuuuuuucauugucgucaccccuccggaaccaugcccuuuaccacaccaggaagaaaggcaucuuucuagcucccuuccuccugcagcuucugcucauacuacauuuaauaucccauuucagaaacuguuauaaaaaugauuauuaaaagaauuaaauuuugauaaaaauaaugaguacagugauacaaugaaaguaccagucaaugagcaauaaacuauauguacaaauaauaauaaugcuacuuagcaauuuuguagauauauaacuugauaaauauugcugucuucuaugguagaaaauuuuagacuuggguccuaguccuacauuguaaauccuaacugaguuuuaagcaaucuaauucuccuuacugaacuucagauuuuuuccuccugcaaauaaagagacugcacucaacaagugccuagaagcccuccuagaccugguaggcugugagccaugaauuacaugcuacuggaggaggagccagcagagagaauucguuucuagaggcaauccucaggaguaaaauaccuguucacuuuagacuuugacuuucauaaguaaguaggaugcuggaagacagugucuggccaauagcauguacacguaaugugggagagcaugcuugacccaucaccccgcagauucuacuuagggagagacugauuuuuccuggugaaaugacuggguaaauuacguggguggaagagaacaacaggguuagauggaugugcuaagagccaaggcaaccaaaacuguucugcagaaggcacagaaaagguuuugguuuuacauuuggguagaugaggaagaaguauggauaaagcagguuaguguaaguucagugugauguaggggaaauagucaaugaaugccugcuaguuuuaagguagcugaagaacaauuuaaaaaguggaaugcuuaauguucacuuaaaagauagcugcaguuuugcaguauaacuccucuuuucuccuccccuaaaauacucaggaaagaguguuauauuccuguuuugaauaaauguaaugguuaguucuuuugacugucccuuuauggaaauaauaaaagggugaaaacucaaaucuggaucgaaauguguaggacagagauaaccuugagaauguaaacuaccagggguuugcaggccucuuugagacuguuuuggacuuuuuuuucuuuuuuaggcaagaucuugcucugucacccaggcuagaguacaguggcaugaucauagcucacugcagccucagucuccuggacuuaggugauccucucccaucagucuccugaguagcuaggauuacagacgugcaucaccauuccuggcuaaguuuuaaaaacuuuuuguagagacagagucucauuauguugcccagaauggucucaaacuccagagcccaagugauccucccagccucccacaaagugugcugggauuacaggcgugagccacugugccucgucgagaauguuuuaaauuuuagaagagcauggaacaggaagaauaucugaucuuacaaggccaagaaauauccugugaucauuuauuuuaucuauucucaugaguggcagauaaggaaagacuaaauuggaguuuaagagaacuuugugaaacuucuagacuauaagcuagaagaggaaucgacaaaaacuaaaacccacgggccaaauccagccugccauuugacuucaaaaauaauguuuuauuuaaacauagcuaugcucauucauuugcauauuaucuauggcugcauucaugccaugacaggagaguugaguaguugugacagagaccauauggcuuagaaagccuaaaauguuuguaucuaguccuuuacagaaaauguuugcugacccugggauagaaagguacuuuggugggcagauaccuuuggacagccugacucagaaucuuaggaaauguagcccccuuuuucucaagaggcaacaagacagcuuuauaagauuugccucaagaauugcuaugcucuuucuucaucagccucucauggaccauuaucuugacagaaugcauucccaauaagacaacacauauggcaauuggaaggaacuuuugaauaggaaacucuaacugcuggguuuccucucauuacagccaucgaacccucauguguuuaucaaacauggacaaaguaucuucucucugcuuggcaccgucguaggcaaugagagcccugggaccaaugagacacugccugccuuuagagagguuacaaagggagggagacuggucucaaaucacuggaauccagagcagugguuacaacagcagaggccuguaaacguacaucugcucuagcaauugcuuaaguguucaaguuaucgccccaguaaucagaagugguguaugacugcuucaguuguacugaagugcccccauccucugcugccaacaucaugguuaaucuuauucaaacauggcacaccugcaaaaaacagguaaagauaaugcugaucacauuuucaacuacuuuaaaaugaaaccaaugaguguuucuaaaaaaacauguuaucacaaaacauagauacuggaacaucguaacaccuaaauccauauuuguugaaagcauauaugggaaaaacagagaaagaacucuuaacaacuuuauugcuuauauguagguaacaaagaugaugacuugaugaaaaccaauaauuuaaaacaaaacaaacaacaacaagaaaaaacaaaacaucagaacagaggaccauggagaucauucaucuaacucccucacuggacacucaucucccuaguuccuggcagaacuagcgcuagaauguugauguucuuuuuuugaaguuagaucucuuucuacucuacugguagguucucuacuauguacugugugacucucacuuucugagguggugacucggguguggauaaagccaggaugugccaaggcagcaagaaaaaggccaaacaguuaugggccaagccuccaacuucaacuagagcaacucuuuauuuucugucauauuucuauauacguagauucugccugagauucggcuugaaaaagaauaacauagccacaaaauuuuacaacuauagcauuuuaccaagcucugccucugaguugaaaauauaaauaaucuuuucucaauauuagccaugaugugaaggcuuuuauaaugcauuacauuuuggaaggacucuagguuuuuuaaauaauaauaagcauggacuauuugcucuugagggguguaaaaaugagucuguaagagguguguuucuucuguuuggaguggggaggugucccuugugacaggcagugaauuccauguuuuucaucuggcaaucuaauucauagcaaggauuauaguggugauauuccacuuaagccuuuaccucaaugaugccauugauuccacacuugaaaaucuauauauggagacccucaauuuuacagagauuucgaagaucuucaauuuuuguaugaauuuugaacaagagcaaagauucuggaaaaaguugcaaaaauguauuccuccaaaaauguauucccacuauuuuuccaaaagacaaugcugaaaaugaaauguggagaauuuucauucuaaaacugcuuuauuggugcaaaagugauuguggaaaaaaaaaaagugaauggcaaaaaccacaauuacuuuugcaccaaccuaacuagaccauccagagcaacuaugacaauuucaaaaucuuuaggaauuauuacacuugcuaaaaucacuuaauguuccugggcacauggcucacaccuacaaucccagaacuuuggaaggccaagacacaaggaucacuuuagccuaggaguucaagaccagcccuggcaacagaggaagaccccuuuccuacaaauaauaaaaaaaauccaggcaugguggcacgugccuguagucccggcuacucaggaggcugaaguggguggauuauuugaggcuguagugaaccaugaucacaccacuguacuccagccugggcaacagagugagacccugucucaaaauaauaauaauaauaaucacuuaacacaauuggccuacagaauaguuaaugaggacugcugaaagguaaucuugaguucugucucagucuucuaaccuguguccugggaggugcaagugacacucaaauuagggaacuccauggcuuuguaagagggaauaugugagaagggugagaaauauuucauuacucugcucacggauaaaagaugagaagggguagggagcuauuauuucucaauguuugucaaacauugugcaaagaacauuuauuuauauaaucacauuaaucacauuuaauucuaagaaaaguuauuggagguagguggcaauuuuaucagugaaggaguauaccuugaugagucuaaucaauuugcccagguucaugcaacuuguaaaguaacaaagccaacaucugaaccuaggacggucuguuucccaagucuguccucuauaaauaaucucuuuuauaaaauguuuccaacuauccaacguagagaucauggcuuaagaaguuagacuguaaauaaucuuagaugagaguguauugucuuaaucucugucucucucugucucucucucugacacacacacacacacacacacacagacacacaccagcuuuguauagucuacauuuuuucuaguauccucaaaauugcucaggaugaaugauaccuuuaauugugcagaaucuccucccauaauaaacaggcuuucauuuaaaaacuuuuaaauauauauuuaaaaagcguauaugugugaaugugcauauauuuucauguaugugugcacaugugcaugccuguguguuuugggaauauugcgaaguacaaacacacuagacagcugcauuucacaguugagucuucaggcagcaauauuuuagcagaaugaacaucaaaucuucccaaugacuugcgagcugugaaagacauugcagcuaacuccaacuguaaaaaauauauuggcuucagaagagaaauggcauuuggaaagcuaugcuuuaaaaugauguugggggagagaaaaacagaaggcugcaguucucagaguaaaauaaucacauugaaggcccagaugcagagcuggagguguggggagaagcucaagaucuccuuuucuguuuaucagauuuacugcagauccugcaaggauaugcaguuauaaaaguaccauauacucagguaagcuuuggaucaugggauguucccugccuuucauucuguccucugaauucuaacaccaugucagacaguaaaagacaacuuccaucccacccaagaugccuucuccaaugccauaguuuguauguaugucuuucacuuuguuuuguuuuaaacagaaccagcuuccucuggcauuucagugucucggaaagucuaaaauauuuucuguaagccagcuccuccaugcuaacaucuuguucugcacaaaaguugauagucaguaucaugugcuaaauaagggacugauuaaaauacccacagaggccaguuacugagaggugauuucacacgaagcaucuuguuguuuacauaaguuaucucaucugguacccaaaacagccccacugagggugguagugccauuuccauucuacagguggcaaagcugaguauuaaagaacauaagugacgugcucaaaaacacacagacagcggcagggcuaggauacaaacccaggcagucugacuguagacccucuaccuaaacauggagggaaacugaguccuacagcuacacuguccuuuccuugaaucuggguccacuguuuccucgguuccucccaugcaugaauacucacggagaguuaagaagaagaagagaaguugaugugcaagugaugaaaagaaucgcagaacugcuucaguagauaucuaccaaugcagccaccccuccucuuaauuaguagugagugccuggggagaagguuagcuuuccaaagagcugguucaugcaaaagcuagggaaacucauuacuccucaccacagggguucaguucucccucccaaauccuccuuaagagcacaguggggugacugcgggagcgauaaggaaacauaaauaacaacugugcuuucuaaacugccuagucugcuucacacuucuuccaaagagguaacugcaaaaguacauaagcuuuguuuccagaccacacaguaugucaaaauaagaagucagaaggacucagauuuuccaucuguuccugggacagcaagaagaggagcagggacuuuacauaaggcuguagaucugggucauagagccccaugaucauaaccauuccuuagaguucuagagaauuuuacaguucauaaagcauuuucaaguggcugcucucagcccucuuuugaacauuacaaguuaaugaagugggucugaggcucucauagaguacgaaacugaggagagguugaggaauugugcaagaaucucccagcacguguguaacuugaacccauggccugaccugcagaguagugguccucucacuguccucaccuccuccaauguugggagaaaggguuguugcacuggaccuucuaggacuccauuagugaauacaccuccccuuaccccuucucucacuucuggcuauagaauaaaaggauuccccaagccuccuaaaucugaucucuaaugagaacuguuaaagaaagcugauacagauauaaggacuuuaauagaaagagaagguugcuuuagcucagaaaauuuucaaaggcaucuuccuaauggcuugggcagggaaaggggucuuguuuccucucccucagcaccacccaccaaacaggcagaggaggcaagacugaacacaugucuacauggcauguuuuugagaguacaggaaagucagucucuccaaaaacaccaaauuaguaguaguugcuacuaaucagauuuaaaguaaagcauguaaacucauauccuguuucuucucauggauaaauauguagauauuuauaauaucuucaaguuagaguaguaauaaaguuuugauggaauuggaaaaggaaaaacuuggauacacuugaguucauuuacaauuaacacagucucucgguuuugaaaauugauuauguuagacuauauguauaucauauccuucaaucuucucgguaauccuguaagcuagauguaaccauccccacugcacagagaagcaaacugaggcuuagagagcuaaauaacaagcucaauugagauguggaacugacauaugaauucaggcuuccaaauagcucuagcuccacuauuucaaaugguaauagaugugaaaauccacauuuagagaauuacaaaguaccagauuuauaaaggguaacauugaaacauuacuagccacaaaugcauugucaaaaauucaguaugaugcugaugaaauaggacucaagaacgguaagauuucauaggcaagugaaggggaggguaaguucucaacucuugggugaugcuaagaggcagguuggcauggggauuccaauaagaacagagugaaaauauaaggaaggcaaggagguagcgcaauuaaugggaaacagacauuucaaagcaacuuaccaaagugcccuggacuuuuagucauuccaguaaauaggguagugcccacaagaagaacacuaacccagccucagcauccacacccauccuggaaacucuccuguuagauguuucauuucugggaucagauaccuagcgcaguggaaauuugcacgggcugaagcagaaggaguugaauccaauagugccauguuuuuguaugaguguggucuucccugaggucaggaguucgagaccagccugaccaacauggagaaaccuggucuccauaagugccaugguuuuguaugaguguggucuccgagguugugacuugaagcacaacucucuuacaaaugagcuguaggguucuagacaaguuauuugaccucucugugcuucaguuuuuguuuuuucuuuuuuuuuuuuuuuacugcacuucucauagggauguuaugaugauucugaaaugacauaugcaaaauguaucauuuuaaauauuauuaugacugauagacuuaauacacuuucugcaaauaugcauaucuagaaucaugauucuaaaaguguguacaggugaaacacccaaguuccauguuaaaacauauuugucucuucaaaaucaaacaauuaaauacuguuaaaauaauuuaguccauaaguuuuuccuuaaauauuaggaagcuacuauaucaagucuaaaccuacuuuauucacaaaauagguuucuguuaagucacagaaacacaacagagcaacuucuaaauagcaauggauuauggaaacuuauucuuuaguggauauaaauguucaugaguauaauuuuauauugcuccauacaaagcaaacauagcuuugcuauuauguguagcucuaguuuauggcguuaaauauaaaaaguaauuaaauaucucaauauuguauuacacuccagauguuccaccaccugaauuagcuugaaaaccacugauaugaaaauguccucauucuuuagcugugcuuguuuaaaaaaaaaaaacaaauaaacauagugauaaacuugaguuguuugaguuauuucuaaaugcauaguaugaucaaauaaauugagcaugcagcugaccuauuaauauaauuaaaaaaucuauaaguagaacaacucugcccuuccccauagcugaucuauggugauaggcuuucuaggauuuucuuuccaaaugccacuccuuggccgacccaggcuggugguuacuauaccauuaagugccaaaaccaagauuucuaccauagcaggugagugaaacaaaugaagaacagcgaauguuaguugccaguaagugcucuaaaaguuuuuuuccccuuaaguugucucuguuaagcucaccaugauaaacuuuugugauaggaacucaugguaggagaugguaaacaagagauuugaaagccucauucuugcucaacaugagcagggccacuccuaacccuuaggacauuuuuaugugaauuuuaaauaugugaauccccuucuagaucaacguagccccuaucugccccuccacagaaugucuucuacguuguaaaaguacacagcuauaugcacacaacugcaugcagggcccuaaacaugaugagucugugcucuaugccagauucucaagauuuccugcaauccagcacuucucagucuuuccuguguuacuuccaaccaguaccauuccagccucccaauuaggguaccuggcuaucucccugggcaagaccuuuuaauaaagagcagaguuuccuguguuagaaaaucaaaguuaaauguugccucuguuugggcacgguggcucccaccuguaaucccagcacuuugggaggccggggccagcagauuacaaggagcucaagaccagccuggccaacauggugaaaccccaucucuacuaaaaauacaaaaauuagccagguaugguggugugcaccuauagucccagcuacuugggaggcugaagcaggagaauugcuugaacccaggaggcagagguugcagugagcugagaucgugccacugcacuccagccugggcaacacagcaagacuccaucucggauggauggauaaauaaauaaauaaauaaauaaauaaauaaauaaauguaaaauaaaauaaaauaaaugcugccucugcuccuuaguagcugcguuauucugaacagauuauccaaccucuuuucucuuccucucuaacauaaagaugaugauagccccuaugucaagaagauaaaauuagaaaaugcagguaaagcauugacccaucugccuggcccauagugaguguucagcagguauuuguugcuccugaugucauuauuuacuuauuuacauuuguaacaacgaucucugacuuguucauggcuucucuucugcucuccaccuuucuaaauucccuggguccuuugaggacuagucccuuucuccacuaaccuuacucuaggccauacucuuaucacuuacagcaugcauaccacacauuaagcauugaauuaugcucucuuauuuccuagcaacaaagucugcaaggaauauuacuccuaugaaaugcuccucagaaauaguuauugcgcccaaauaaauauaaaggagacuguacauuguuucucuuggaaaucuacaagcauuccagcauaguaaagguucugaaaagucuugcagcaaagagauuaaaaaaaaauuuuagccucuauuuucucaccaguuuuaguaaagaagccuggcuuacuuaugaagaguccacagagcaaacgugccucaguuuacacuauagaaauuucuacccuauugcugaauccaguggagcuguuggauucugggagaugacagggugaugcccaagccuuacauccucauccuucccuuguucuccuaaagcugcccuccugggacuuuccuggcauccuagggaucuauugaauggaguuaaaaaauaaucaauauagauucccucaugugauccccagaagccaggaucaauauuauuaucucuguuuuacucauaagaaaucugugauuuagagugaccaggauuugaugaccacaucuugaccaaccagcgugggcagagcugcaaaucuucccauuccaaauucagugcuccuuuuacugggccuugcagaguucauuaaaugugcaauuaacauauggaauucuaaccacuuccacguacuuguggacaacuaagaggugaggacagaugaaaaaaaacucauggcuucauuuuucccucugcuaguaaaaauggugucccgaauaugguccuggauuucugaggcacagugcccauuguguaggcccagugguaccuaugggccaggggaagcugcauuauugcuauggcuuugcauugagguaugcaagaguggcaucaguucuaccuuccagggauacuguuggcaguuaagucuauuuggccuugacaccugacagaguuuagucucagcauuaauauaaaaaacagaaucaaugaaagguagaaguaauaacucaauuaagagaagguggggcaaaaugaaaugcauacaaugguaaagaugaauccuccuaaaaacccaaucagugagagguuagaggaaaccucaauaacagaauuuucaauauaaaccuguccugguggcacaguguccaacagcaguggugacgaugguucucccaucucacaggcugcugcugcugcugcugcugcuagaagcaccaccacuccuaucaucacuaaucaccagguaaggcuuuuaaaacacguuuuaccacuuaaccuaaguggguagggaaugucuuacagaugugaaaauaucugagcccagagaaaucaugccacauggggauaagcaucccagcguguauaaaaugacacaggcaggaggagcauuuaguucguguguggcuggaaauaaagggagggagggaaaggaagcuaaacaggugauuuagauguugguuugacagggccugacauuauccuguaggcagaaguauaucagugaugagcguggaaggcacagcucugcagagucugauggucaggaauauauacuugauugaucaggggguggaggagcacagcugcuauuaagugaauuuaguagagcuuguuggugucagcacugggcaagaacuuagguuucccuguuccuaguguaggauucucuccacuacagcccaccgagucuacagaauucuuucauccuuccuuucccugcccccucccucuccuuuuuauugcacaaccucagguucagaauuaaguaccucuguuaaauuaccucccaggauuucacaaaguguaauaauguacauauuugaucuagaugucagggaaauacuguagacaacgauuuagagcauccauuuuccacuuggucaaacucauuuugauguacuucucucagaccugacugagccaagucccucuugccugaggacauggcuuuaguaaaaucaaaacacuuucaugguggucucaauuuuccuuuuagaguaagagcgguccacgugguaccagcccagcuccaacucuaaaucaaugcuuaggcauuaaaaaguugcucuuuaaagagcacucuugugagauaguguguccuuaacuaagaaagugaaccuaugaggaaauaucauaaaugcaaauuaucaaccauugcauuucuuaaagaauaacaucacaaagucugucugagccauagaaccuuuuggaaauauuuuaggguugucacuaagcacuuaaaaaacacauuguuuaaagcuuuuacauuucugugugugguaacgagauaacuuggaaguacagagagguauguucacaaaugaguaaauucugaguuauuuaauauagcagaaucugauacucagaacucugguaugcaaaaaaugaacaguauucuaaaacgcagugcuaugguuuuuaaacuuuucaaaaagcuagaauagcacacuuuauguuuuccaaaugaaaucauacagggagucaccuuauguaggacagaugacgacagcacuguccugguagcagugggggugaggcacaggaggcuguguccggccgccuccucuuucuccaaggcauccuuccucaacaucaggaucccaaagaauucagucugcaaauugcucagcuaguucuucucucucccuuugcaauagauugcaaacacuccuugguuaaacauacacauuccuggccuuuauucuuaucucugccaauuauuagacuaauccccaggagaaaaauuucuuaaauguucagccuccauuucuccuauaaauugugaagguacauauaugcacacauauuauacuucaaagguuuguuuugagaucaaguuagauuuuaaaaugcuuuuuaaaacucuaacacuuagauaaauguacaaaaucauuggccacacaguuaauucauagcuaacuucaaaagaaaauaauagaaugauaagccuggauaucaugauauaaggggaagagaagacagaaaaacaauucugaguuuggccauaacccuagagaaauauuucacuuuggacaccuucacugaacauuuaacugauuguaugggcacgaaaaacuaaugcagaguuccacuggugacacagacuccagggaagaaggaaccaccaauuaauuacugauaguuuaaauauuuuacacacauaaacaaauauacaaaaaaaaguuguguguaaauggaaaucaagcagucaaaucaaaacaaggaacaagccacaaguaaaggcagugguuugcuuacagccuucuagagcauccucauuuaggucucuuccaaaaauggguguacccauacuggcuggaagcaucuacccugagccuaggaggucagccugcucacaucccaaugaggccauuuggggcaaauacugaaaucucaaugggcagauauccaaaucaguugcucacucacccuuccccgcuuguuggccuuuucucuucaaccucagccuaaguucucuuucaacaauuugcccuaaaucccuaggcaggaaugcagcacagcacagcaaaagcccucuugacucaggacaugcacagagagagagaacuucuuccuugcuuggagaauucaagaucaucacuguacacuacuucuccauggacaugugaccucggggguuugggaaacaugcaaaguuguaucucuuuacccccuugcaggaaguauaauaucaaugauugauuuggagaggauguuaauugagggaaguggcuggcagugaaggccaauaugaaaacaaggcaaaagcuaucagaaauugcagagaaagaguuuuuuaaaaugcugucccuaaauauuaaaagggugagcucuacuaacuguagauuucugcagugauggcuguuuuguuuguuuauuuguuuuucaucaucucccacucccccagcagaaauuaauucaccuuugcgucaaagguucucuuuguauugucagaaacugcaaauacucauuucaugccucaaacaaugcuauagaccagugugcaauguuauagucgugucucucuaauuaugugauguuuuaagucaauaugauagcacagaaaucaucuuuuuccauuucuaccacucggcaaaacaugcucuuaaagggaacuccggacacccaauucuuuaaacuuaaaaccagggaguuguuuuugaguuucuuuuaacuuugcucuccacaucccaucaguggccaaaaaacaaggauucuucaucuguaaauaacuaauauucacccuuucucauaauucccacugcccuggccuucuccagacccacacuaguucuucucugaauuacugcaguuccuccccacaggucuucuuuccuuaacucuucccaucucuuucucgucuauacauucugcugaguuaaaauuuccugaaaacaaccaugaacacgucaguaagugacuaaaaguguccuguggcucuucucugcuuauagaagacuuaaaugagaaauugcagaugcuaauacugcuuaaugcccaucucucuuacuagaacauaagcuauaacagagcacgggcuuugauuuugagcuguacugggcucauaggagaugcaauaaauauuuguugaaugacuaaaugaguaaaaauggaugaaugguuggauggaugaauggacagaggaaggcugaguagaugaacaaugcccccugcacagguuuguuuacagaauuaaauaaauaaaauaauguauagaagagcgucaagcacagaaucuaggcuugugaaauguggggcuccuucuuuauuuucucuguuauacuccuuguaccauuccaugccuaucucucagccacagaagcucagggcccaacuguggaaggaacauguuuccaagauguugaauuugcaccugccacugugggcagugggggauacucaacuuugaggcuuuaguauaggagagauaaccaguugcuuuguaaggaaacaacuaugguggcuagauggaaugaagaaggcggcuugcagaugucagaugggcagugagauggcuugcagcaggacaaugguaaagacaccuuagggcugcaccaggaugguauggagaagaaauaagguugaaagggauuuccaagggagguuuaugggggagcuggugagcugggauagagacagccucuaccaccagaucucaaucucuaaaacuaggccuaaggccaaggcucagauguccuucauguuuuugucuuuuuuuuuuuuaauauggaauuagaaacaauuuggcuuuuuagagcugaaagcuagaaacaacacauccaggaacaguagacuucuauugucuucaaucccuaauguccuagugaguauguacccuauggagaaggcagaaaugacguggaccaggacuccuuacauggagaguguuuuaaaggcaguuuuuaaaaagcccauuuugugaaagaaaccagaaggcucguaauugcugucugcacugugguuucuccuggggguuggggaggggaguggauuaaauaaaaaguuuagaaggccauaggcauaaauaucgaaauaguaugaauuuuaauauauacuuuuaaagggguuaggcaaugaugaaaagauaugacugcuuuccuuucauuucucuauuaaauuaaaauucccacaaaagugcaauggcuaucuuuuugaaaacacugcauaauuuuaaaguuugggaagguuuaucuuucauagccacaaaucuuugcaaaagccuuuggcuacaggaaacacaggcuccaagucugccauauaaugaaggcuuuauguguguuucuaaaagguagccggcuugaaauagcuacccuuccauuuaugagugaaaccaccugauuauuuaaaugaaacagaaagaugcaugaaacauucuucucaucccaacuagauaagaaggcugagcucucaaaacauuauucauugucuaucauuuaagaauuaucugauuaugaaccacaguauuucaaaaaacaaguagucccaaauaacacuguaaaucucauucccuacuauccaugcuucugaauagaacaggcaacagacauguauuuaaauaguuucaacgaaaugaauccacaauuuauugcuacuauucaucuuggcuaguaaauggccuccauacuauucuucauccauuaaaaaugguucauuuccuuuggccuuuauucauugccuaauauuccuaaugaacuuaauguagcaagugauguaaucagacaaaagaccuguaagaaucccuuuucugccacuauaagcagaauuaaaucauauuuaauuaggauuuuaguguucaccaaaagucucgguuaacuauuuaucacccacacugcugucuauucuaagcagccuucucuuucuaagcaggaaagcacuaucucuuuggcucaguucucuauguuggacaccauaaucuaccaggcagguggcuaacuuaguucuagccaugaauuagucauuggauuaagguucgccuuaauucuccauggccaaggaggugcaacgcgguuuagaagacaaaaugaagucacacuaacaguggccgauuuauaagcacagaagaggagaguccagcaaacuugagaagaguucugagaagcaguggcuucuguguagauucuucuggaagucuuugcuguguuuuagugaggaugaaagaguuguauacgcagagagggaaauugagaacacacaaaguugggggaaaagaaaucugugacaagaaagcauaagaaauuaaagaggagugaaccacugcuggggcacuggagggcaugucagcuucaagaguuuaugccagaccccacagaaacagaaaaauccugcaggguuuguuugguuuggucuggcuucacuuuucuuucucuuuucuccuuuuuccucuuuccucuuuccuuuccuuucccuucuuuuucuuuuucuucuuuucuuuuuucuuuuccuuccuuuucuuuuccuuccuucccucccucccucucuuuuuuucuccuuccuuccuuccuucuagaaauaaacauaguagaaaagguguuuugaggaagauuauuaggcaccauacuaaauagugcagcuagaaaaacaacuaggauugauuuuucagcuuucuguuuaggaggcaguguggucuuagaccaggguguuagcagagaugcacccaaaaggggguuuuggugccuuucaagagacuuauaaaggaagaguuguugaccaauuggacaguguuauaaaggagaggugaagaagagaggggguaaaauuugcugggcggauuuugaccugguucuuacucuggccccuaccaugucugcccuucuuucccauccgcuagggcacaguuccacaccaccuuuucugcuuagucaucucugagcaagccaacugaucacgacucucccccaacugaguucaugcagccuauauggccagugucuuccccauggcagccaucuuagccugccuuggauguuucugagcagguuuccuaucgcuccccagugugacaaguucucugcagcaugucuguaaucaccacguuccagggccugauccacacugcauuguagugccacacagguauuuguaaaaagaauagugaaaguugaucacaauaguuuuccucaaggcuuuuccaaaggggcucaauucuggcuaagugaauaaaaucucuccuuuguauaagugcucaagugcucuacagugacucaaaaaaggaucaucuucuguccagagcugcuuucugauaaaggucaagcaauuugaaaacaaaaauguccauuugauuugacauuucaaaagacagcugaggaucugucaaugauaacccauaucuucuuuuuucugcuucauaaucagaacaccaggcagguauaauaaacuucucauggaucucaaaucagaauuauguugaauuuucucacucagucagugcggaaggcaauucuuuauagagaggaggccaaauaucaagcagcaauuugcauagaggacaaacucacuaggaugcuguuuaugccgugugucuaauaacaugcucugucuuauguuuaaaggacacauuugcaaaaaugauuuuaugugguacucacacaucaauaaacuagcaauauagcauaugcuucugacuuagucaaauaacauuuuaagguuuauuaagacauaacaguaauucacaguugcaucacccaccaucuuagguguuucacugacaucucaacaccuccuacuuaacuucaaggcccagagucuuuuggacuuccaaaauuacuacucauguccaauccagaauaagccugcaaaagagaaaucuugaauuguuuccaagaggguugggcaugggaaguauaaagcaaaaauagguagcuucuugaaaaaauugagucuccacccaauaguuguaucacuuuuuuuugaauuaaaaucaaacauuagcuacauccauguucgaauacagaacauauuccaaaggacaaugcauauuuuugagaaaggguuucacucgguugcccaggcuggagugcaguggugugauccaucauagcucacuccaaccucaaccuccuggguucaaaggauccucccaccucagccaccaacugccugggaccacagggaugcaccaccaugucuggcuauuuuuaaaacuauuuuugguagaaauggggucucacuauguugcucaggcuggucuugagcuccuaagcucaagugauccucccuccugggccuccuaaaaugcugggauuacaggcaugagacacugugccuggcccagacuuuuaaaaacuuaugacucacuuuggauuacucagguuauuuuauucuucuguguagauaaucuggauuugaccaucauagggaaaaaugauucuagaauauagaugcuagauggcugcaaagaagguaggcugcuuccucacagguacaaacccuaggagggaaugaauaaagaaaaaagccccaaguaacugauuaaugaacaucccuuccagggugauucacacaccaccccugccugugugaccauuauggauuuauuaacauuaaggcaauguuauucaaacagguaucaaaacauuuuaaugcaauggaacacugagugaaauauuauuccuaccucucagcagacugaaacaagcugagauaauugcauugccaaggagaacugacucagccuccagaugccauuuaaggcucugagguuuaucuucuaaaacugcaguaguuaguguaauaaugagcuaauggcaugcacagaaucagcuguccccauauuguggugcccaauggauacuacugauugcaucccucugcuccaauuauguuuucagaggauuaauaccagaaucaaugaggaggcuccugucagucaguggcuugaauuuacugggcaccuccugguacagccuugguucucugaggccaugguggggguaggaacaucagggcggaagucagggugauaucuccugaaagcaucaagagguauugcaugaaauuauuaaagagcagauguuaagcacaagagcaaaugcggagugccaaauaaaaauaaagacauauuuagaaaauguaccaaaagcuuuuuuuuugcauuuuucauuaaagcuauuuuucauuucugaaaauaaaaauuaauuuccucuucccugauuuuagcgauauccuuauucuuuuccccauuuccccuagacuucaaauuuuuuuuuuuccuaugaaacagaagaaaaccuagcagugccugccuuaaguaaucuugccaccauguuggggauccaaugacugucuggaaggugagcuagccauccauagcagccagcaaucaccacaaggucgcuuucaaaaagccacucucugaaggugauaggguguacaagaaugucuaugagcugggggaaaagaggaaacaagcgacaaaguacagcagguaaauucaggaaguuuuauuugacuaugucgcaacucgugguuuaccacauuuaguacuaaggccauuuauugaauguucccaggacgggucuguggcucaagaagacaaaguuuuaaggaacaugaggugcuuuuaaaccauaauaaacucuuuuggcuggaugcaguggcucaugccuauaaucccagcauuugggaggccaaggugagaggaucauuugagcccaggaguucaagaccagccugagcaacauaguaagaccccugucucuaaaacacaaguaaaaaaaccccaaaauagcuaggugugguggugcacaccucuggucucagcuacuccagagagaggauaaggcgggaguaucguuucagucuaggagguugaggcugcagugagcugugauagugucacugcauuccagccugggugacagagagagaugcugucuccaaaacuaaccaacaaaacaaaacaaaaaacaaaacaaaacaaaccaacaaaaccaaaccucuuuugcuuacuuaguccugcaugcuguaaaagcuuggcacuggcagagucaucacaccaggccuacuuggcuccccagagccacuucuuuuuauucuccccaugcccaucugucuccccaauuccugagcauuucuacucucagacccuccuuugcucugucugccccaguaacuggaacacccuucucaucucuucucccucuucacuccacacuaccugaucuguagacucuugcucaagcaucccuccccuaacagugccacugccuuccuauucuaguuuccugaaacauuugucauuuugucacuuaaucauuuacuaccuuuguuguuacuccacuucuucaugugacuguauacugcaucuuugaugagaucuuaagaugcccgagggcaacaaauuggaaacuccuggcaagguuuccauucuugguuuuagaccaaacaaagucugaagaugugccaagagcuguggcucacuuugaagcccacgugggagcccaaaaaauggagagggagagagaacaggccaauuagcagugaagugacuucagugcauaccaugcugcaggaaguuguuggaguuccagagcagguuuaaagacaguuuaaccacaaugcucauguacgcuucuugucagcaggggauuaauuuaaaaagcagauuucauagauaaaaugaacaaaccucugugggucuaaagcugcagaaguagaaguuaggaaguaaccacucugugacauuaugcaagaguuugagucguuuuuuuccugcucuuccccucaaauaaauugcaagaaagccaccuguugaugguucuugguagauggggagaaucaaagaacccagaaagaggaguuugaaggggagaaguaaugaaagcaaaauuuugucaauuuuacaauuuagccaggacacuucuacaugucaccagauccucacagagugaagagccagaagauaguguuugguuauaguccuacuuucccuuuucaaugucucugaauauaaagcacaucuucaagaauucaaucuaguuggaaauuuccauuaguucaguuuuauacaugccuacuauacucacaaguuuaagaaaaaagcaaaccauaaucuuagaagcuacaaguacaacaauacucauagcauuucuugaaauaaagcaaaauauuacauuuauacaaauaaagcaaaauuucgacaacuacuaccaccuucacaaggaaaauacaacucccauauaaacgcucuuagcauagcagccucaauccuuccccagaucuuacauuaggucugagcuacuauucacacagugaccuuugcagauuuuauuaaacuaagacaaggaaguuauacgcaaguauuuaaaaagguuuuuaccaacaacuguaaaaacauuacuugcuuaaauacaacaaauggaaagcucuauuaaccaaaauauaucauuccucacacauuuugguucuuugggguuuuacugccuccauuucaccauaugcaauauuaaguaugucuaauuuucaaagcagaaaauauaaucauuucuuuucuuuuuuuuugugauuauuuagguagaaauaaucacuaaugugaacguugccauuccagguuguuaaauucaaaugaauauaaaugugguucuuucuaaauuauccuucuaauuugaggcacaaaauggcuuuuugcccucaccuucaagguuugccuuuaauauucucugaaagauaaauuacauuauuaucuuaggaaagucugcugaaaaucauugaauuuuuauuucuagcagcugcagauauuucuuguuugacaaaguauaucaauauccgucacugauaccaagauuggauuuuuaaggcauuuguggugcaaaagaaacaaaacaaauuuuaccuuggcauucuuuuuaaaacaaaacaucuaaauaaaucagaccuggcuaagaacauaccugaggccuuggcuggauuuaauuacacaaagaauuggcaaauauacagucguaaucaacaagcagacuguggcacuccucaaaucaucucaacacugacaugucacaggcuguugauuuuccaacaaacgggaggcuggagccauuuuggagccaaaguggaugaauaaguauggaggccaccagugcaucucacugaucaugggcaacuuuauucuagauuuagucuuuccauuacaguuauguaaaaaugguugaauagaaauuaagaugaguacaaacaauaauaacacaaacacauuuauaguuuguugaaugcugcuugcaugccgagcacuacguuuacuguacaucucauauucaauggauucauuuguuuuggaauucacaacaacucugcgagcuggguauguuguucauuucacagaugaggaauuuucuucucuaggggagaucuagagaaauuaagucaccugcgcaagguuauaaggauaguucauguaucaaaaaauuaugugaaguaguaaaugaaaagcucauggaaaaaaaagggggaggugguauugaaaucuacagaaauuuaucugaauacuucaauuccauucacuguagcuuuguauuuccuacaaguuugggaaugaggagacucuaaguacuagucuccaucuucaaugaauccaggagcugguuuuuugagaagaucagcaaaauuuauagaccgcuagcaagacuaauaaagaagaaaagagagaagaaucaaauagacacaauaaaaaaugauaaaggggauaucacgaccgaucccacaaaaauacaaacuaccaucagagaauacuaucaacaccuauacgcaaauaaacuagaaagucuagaagaaauggauaaacuccuggacacauacacccucccaagacuaaaccaggaagcagcugaaucucugaauagaccaauaacaggcucugaaauugagauaauaauagcuuaccaaccaaaaaaaguccaggaccagacggacucacagccaaacucuaccagagguacaaggaggagcugguaccauuccuucugaaacuauuccaaucaacagaaaaagagggaauccucccuaacucauuuuaugaggccagcaucauccugauaccaaagccuggcagagacacaacaaaaaaagagaauuuuagaccaauaucccuagucuccaucuucaaauacaggugcaugagaaauguacuuuuucuccuuuucauaaaauguaauaguaacaauaauagcaaaugcuuauaaagcuuuuauuuuauggcaggcucuauucuaaaugcuuuacuauuauuuauaccuauuuuacaaagaagaaacugaagcauagacagguuuauuugccaaacaucacacagcuaguaaguggaggagugggauuuugagcaucuauugucugacuccaaaguuaguuuucuuagccaccguguaucagugcgacucccuucauccacuuucucuaauaucugugaucacuguacucuuccugguaucaguagggccacagaaaaccuggugagguuaucugggaccuuucuuccccucuauccuacucucaggugcacaaaaaucauucuauucugcugcaauuuauggacacagggaguucuaaggggcugccucagcucaccuucaggacggauucugcagucauuguucccugggguugcgcugcuuccugaguucucccuagagcgaggcacacaucuuucuaaaucuaccugccauccccuuguuguccuaucccuaauccucagccugugugcaagaagggcauggagccucucucagggacacaucagccucuaaucacucuuuguuucuucccacagcuagaagaaucuuauucuuagggucuauccucaugaauuugagauccaaguccaaauauuacaucagcugcuagggguaugaaucggaagaccaaacuccgaauuuccuugccuucauuuauauuucagcaaaggcagauagauaucuaguucaauccaacuuauucagcuacuggauuaccaagaagucuggugaaaugucacccugucacugacacacccuguagaccccuuuggaucucaggagagagauuugaucugauccaguuuccauagaaaacuaaaagaaacaaagaaauuuauaaggaagccaggccuagagagucaaucaaagauugucagaugcaugcauaucuuagucacuaauacuccaauucuguuguuguuguuguuguuuauuugaggcagggucucacucuguugcccagaccaggcuggagugcaguggugugaucaugguacacugcagccuugaccuccugggcucaaugaucuuccugccucagccucccaaguaacugggacuacacaggugcaugccaucauguccagauaauuuuuuuguuuguuuguuuguuuuuguauagacgggauuuucaccauguugcucaggcugguuuugaacuucuaggcucaagugauccacccacuacagccugccaaagugcugggauuacaggcgugagccacugcgcccagccuaauacuccaauuuguagugguuuccauggaagaggaagaagugcuucuaucucaaagccgagagcaggcuaagagacuuagaaacaugcauugggaauagacccaacauuuuuguuuccuuugaaauguuuguauuuuggguuauauuugaauuaugaaaccguuacuuguuaaggguuucuuggaggaauacuccaccaucagugcauauuuuaauucauaaguaucacaaaaaccucuagcauccugucuucuuuugccuaaaggacuaugcaauucucgagguuuccguuuuauccaacauacuggaaaaaugucaauccaucagacauuaaccaaacaaugauccacaguuagaggcuaaaguauuccuguaauuaaauccugaacaaaagcuauacaguaaaagaacuuuuaucauucaacacaauacaaauuacaguagacuuuuucuaaaauguauacuuaggguuuuauuuucucaucuucauucaugagccucagauaugcaacauuugaucgaaagaaaccuucuuguacauaucacuuuauccugggcucaugaacugauuuuucauuccuuagaguugcagagauaagcaggccaauuacauauagcuucuaacaaauccacuaaaugcaugaaccuuagaauuccaacucuggcaacugugggaaguuacuuucuucaaugagccuuaguuucuuugguuguaaaauaagcucuugcaaguauccagaauucucacagaauuacuugagguuaaauaaaaauauagauguggaguucuuagcacagugccuagcauuuaguguggcuccucacauagaagcuaauacacacacacacacacacacacacacacacacacauacacauacacuucauauagaagagcaacacaaagaacacuaacucuaccauuucuuuuuucugauguggccauuuuaacaugcccucuuggucaguggguuugaggacaagugcuaaauauucaaauagacacaucauagaggcaccuggccuccacgaugauagugcugaugguggcgauagucuaagcucuuaccugugcccuaugacagaaguaccaagaguaauccuaucuuaaaaaugaggaaacugcguagcugguauauggagcagccaggauugcaaccuacaugauuugaugccauauucuguacacuuaaccuccacaaaaugaaauucccauuguguccuguccauaacccaauucuuggggguaauacaggcagaagcuacuaaacaaaaccagggaagucugccauucagucaacucucaagaaucaugaacuaauggacuccauuuagaaagucugucccaacuucccuuaaaccacacagauuuauugagaccugaacaggguaacuguaggcucuaucuaacagaccgugauauauuuuaggcaggcagaaauuauuuguuuaaucugaauaugaacuaacauugaaaacaacguaagaauuacuggugucacuguauucugggcauuuuccacuuaacaguacuuaucucaaagugcuuuuaagugggugcauauagcuuuuagccauuuagacaugguugugguagauguauuauuuuuuacaaugucagagagaaugcuucauaaaacaagugccacauaacaacucuacagucaugaauagggagaaggacauauaaaguuuauucauuucuaucauuuauugucuuaaauugaggaaauuagugaaauucuacaugccugcaacuuauaccuuccauuuacuaaagucccaguaugugucaaaguaguuuucauuccucacagccauguuaugagcuaaauaucacuaacuuucccuuucaaaggugaaauaaacugagacucucgaagauuaacuugcccaaggucaccuagcucguuaggaggcacaggugggacuugaacccaguucuuucugaauucaaaaccuccaaaaugucugucacaucaagcugcuucaaugagaugcuagaaaaucaggacagugagcaagcuggagauaaaggaagauauggaggaacacgggaagugugauccucacacacagacccugcagauuucagagcauuuuacuccaugauaaaggcucacccugacaaaaaagauggaggacacaggcugacgcccuggcuggggugaggggccagugcugggcuugaccuuccuggagaauuguggacuugaauuuuggaagagagacagcuuccaguggggaaaaaaagugguuccacaagacaccaaacaccacacagcacucugggcccggggcugccagucaagaaaagcauccacaggcccaaucaacccccagacacuuccaccuugaggcagcaagauccaacuuuguguuuccuuuuuauguucacugaucuuuguaaacucagggcagaucaagaugucuguuacauucuggauuaaauuacuucuuaaagacaacauguaaacagaggcccuggaaguagcuucuuugagaagcaguuugggcuacucuucauguuggaacucugggacuccuaccccaucuuauccaucuaaccucaucuuccuagaaucuccaucuucuuuauuuccacucaaccuuccucaacaaugucauggaggaaaaggugaacggaauaguaguguaugcuuuuggugagcagaaaugucaugaggccuaggcagggagaagaugauggcagugauuuuggaaguguguaagugguaaguuagccccuccaccugcauaaaacuuccugcagaagcaacauuuagggucacacgagagcagaacaacgaaaagugcagcauuauauaaugcugcagaauggauccuuuguugagacuauuacagcuuagggaauucacugauaagacuaucaguggucccaccaacaguucuccagaggaccaaagaaaaagcaauugcuaugucacacagggugccguagguagggccaagaguuugcaguagggaugggcaagugaugguuacaaaguaaagaggaauauccucaaagaacauccuuggggauguucagcagcuacuggggaaugucuguuuucaaaggaagaagcaaaggcaaucauuccacuauucagcucauuaaaggcaucuuagcagcaaucauguccaagcugcuauuggcauuugcugaaaacuuaaagaggucuugacaauuuuuaccaacaucucccgugguaaauuaaaguuaguuguuaaaauuuuggcaaaaggauuugucccucauagagucaaaauaugcccuucaaagcaaacucaccuaucccauguacuuccaagaauacauauuaaaacagaggcuggccucuggggcaggcacauucggaaagcaaaugucuauuccuguuguugccuggggugugggcaagugguccccuagagggaauaaggacagauauuugcuuuaugauggagaccugggacucaggcaucuauuugcacuugcccugguaugauaucuggcaguuguucccacuugccuggcuccaggucugcuacaagacacccaggagguuggaugcuggcugcuggcacacucuaggcaggcaaggccaugcucagacuucccugcugcugggccugcugcuugcagcuucuguuucuagugcugucuguuuccauugacguuaacauauacaguagauuaguuugcuuaaugagcaacauuaaugcaucgauuaaugugaaaaugugacaacauuugcuuuaccccaucauguccuuuguuuaguuuauaggcaggauggccaccuuacuuauugucuguccauuaaacaccuacuuauugagcacguacuguguguuuaggucuagacuggacucugaggaaagcaugcaaaacacucagaggcugccacucucacugaagaggcaguuugcacacauaaggaaaaggcaccuaaugacuguagggauguacccugagcaaugcugaaaggcugugacagaauucaccuacaggggaagcuggugaggcaucaguguaaaggaaggugguucagagccccugggguugaggcagugccaucgaaagaauucugaacagugaguguaaaggcauggagugugcagcacuguauaggaauaaugaguuaucuacggggggucagaguggaggaugcaguggaggaguuggcuacagaucagccugcagggcaggcuggaagcaucuugggaagugcugugcuuuggguuugaacccaaucaugcaggcugggggucaguaaacauuuucuguuaagagccagaagguaaacauuuuuggacagucucugcuucucaaccucucagcucugccuuuguaggccaagagcagccauagacaauauguaaacaaaugggcauggcuguguuccaauaaaacuuuauugagaaaaacaggcaauuuggccuguggcuauuguuugccaauccuuacuauaggugaugggaaaccuccuaggauuuuuaagcaggggauuaugaccugacacagugaguauauuagauaggucacagugcugcugaucagaggauauagugaagggaaaggagguaggaggcagaaggaugggucagggagcaauaauggcagggcugggcauuucugaugccucugugagucucacucugugguucacuccucuguacagugccccucugcccucagcacacugacucauagccacacuucacuuggaaguucuacaaacuaaggcaucauucucaacccgguugcauuuccuaaaguacauuuuggcaaagaugucucuuaaauuaauuaaguauagaucagcacaaagguaacuuguaaauuugacaggauguaggagaugaaaaggaugccuuguaaagaaaaauguggaaaaucaggguuuaagguaaaacagagaccagcaugauaaaugagcacaaucagcccuuuuaucuuuuaauauugaagugagaagaaggacuuggaucaaugcccccaucaauaacuaacucuuuucucucuucucagaacaacacuaacuugcucaauguggagacaguggggaaaaaaauccuuucuuaggcauuuuucugaagaggguuuccaaacagaggcccugguugccagcacuacuuuuaugaacacaugaaaauuccguggcaauuaacaaaauccaucugcauuaauguguugaaguuucugcaaacccagaauuaaauugaacaugccaauucuaaaucaauuauuauggggaauuguguagcaagucuucauaauaggacaaagguaaucuucggcacagcuugaguagaaaccgagguuuuggaguaaugaggcuuuaugauaaaugaggaccugcuuuuauuuuuuuuaaucacuccaguauagguugucccuaucugaaaaagaacuauguuccaaaguuuucagugcaauuuggauuauauuuucucucaggagcaugguauaaacgugagucaguucccaggcuagcccuucaacauucauuuaaacccaaagagaaaugacauaaaaacaguaagaagcaauggcuuugcaguacuaguaauuaagcaaaucaaacacaauuuuaagauuagaaaaucuuuuauuuucaaguuuucuuaaaaacagagaauuuaaggaaauacaagagagacacaggauucauuccgagguucuuaucaguuacagcacucuccuccuaccuguucauuugacacaagacgcacuggccucuauucuuugaagacuccaagcuuguucuuaacugggccuuaaugguuucuguugcauuagucugcaacacauuuccaagugaguuuuaaaugucuacauccuucuaauuaccaaguucucuuagagaagcacgcaccaugaguaucuaaaggagacccucccuauccuagucagcaucuguacugucgcacugggucaguuucuucacaguguuuauaaaaauguuuauuauuuauuuuucuauguauuuauugugugucuccuccauuuggauauaaguuucacgcaagcagggacuuugucuucuucaucccacaaguguugaauuuuauauguauaaaaauguauauaauguuaaacuauaaaaauuuauuauuauauuaauauggauauguuguauauuaauauagguauaugaauauauaaaacauauauguauuaauauagaugugauauacaaaauauauauauauauacacauauauauauaaaacuguugacuggaccuugagggguuauauaguugcuuuccaggguuguguaauuugggggcaggauuucucuauuuucuccaauuuaauuccaaaaccaguggccaucaauuauuugauagagagacccaggcugagaaccauucuuuuaaguucauucacagacaucaaaauagcuugguuccucauaaaugaaauaaucuguggucaagagagagagaguuauuccuuuaauccaucagucaaauuugaaagagagauagaggaaagugaguuuuuaaaaaguuuacauauguaucaauaaguaaaaacaguaugauguugacucaacuaauuguaugucuguaaaagcacaaaaauggagaucaauaggugaaagcaaaauuucccagagaaaaaaacgcaagcacugaggacgacagaccaaaauacugucacaggccuccagggggugccaccggcauagcacauaguugucauuuuacacugaguaggaaaggauaugcuaauaggaagcaaagagcaauuaacagaaacaucagaaaccuaccaugaagacugggcaacauggagagaccccauuucuacaaaauauauauaugugugugugugcgugcauguguguguguguguguguguguguguguaguuaggagucuguaauaagcagauucuguuauauauauguuauauauguguuauauauguguuauauguuauauauguuauauauguuauauauguuauauauauguuauauagguuauauagguuauauauguuuuauauguguguuauauauguuauauauguuuuauauauguuauauauguuauauauauuauauauauguuauguguguguguacauauacauacauauauauauauauauauauauauauauauauauauauauauauauauaguggcacaugccuguggucucagguacucuggaggcugaggugggagaaucucuugagccagugaguuugcggcugcagugaacugugaucaugccacugcacuccagccuggauaacagagcaagacccugucucaaaauaaaaacaaaaacaaaaacaaaacacuaccaugaaccaagaacuuggcuguuuuuauauauaauccuuacaacaaucuuuugaaguucauauucuauuaucuuuauuuauccuaaugaggaaacugaaacucaaagucguuuaaucaagaaaggcuaauucuggguuacggauccagguuuaaaucaaaguuugccaggauuuauacuuuuuuuuccuauuucauuucuccagaaaggacauacauuaguuagguauuuacacuuaaaaaucugaacauaaaaaauuuacgaaauaaauaaugggcaaguuugacuggacauuuucuuuucugaaaaaguaagcuuuugcucgauaaaauugcuuuacauuaugauaauaacugauuuuccuaggguccauaagaaugacuuuaauuacaaagcaagucuauuguguacuguggccguguuuuccaacugucuucuggaauacauguuagaguuaggagucuguaauaagcagacucuguuagcgaguuacaggugucagugucacaucauaguucuuuccuauuuucaugguaagugaacaaauaaaauagcugaaaaauuacacccagaaaacacaaagcagggaaaacuaaaagaucaaauaaacuauucucccaccauaacuugggaaaguuacuucucuuuucauaucuguauccacaagaauugaagacucacuguaauagucaggaugcaaguagguaaccggaucaauccuaaaaaaauguagcuauggacauuuuauuuuaucuccccuuagucuaaaaaugcgugcuuaaaaaugaagcccccuauuuuuugguuuucugaguccuguuuuuuccccucuguuuacuuaguuuuguaucauuuauuuccaugcuuuacccugcaaaauaagugcaacucaagcucuuucaaagaaaccaggacagaagcgaauguaucauuuugacaguggaaaaugacaaaacaucuuucagaaucucuccauacguggcugauaaaugagccgcaucaaccacaaauucuaauaccaagcaaagccuagugaaaacaagugagcccauucagaauauaucgaggaagacagcacagaauguuugacuguuaaaaaaaaaagaaagaaagaauuguuucuuuguugauuuguaaacgaugagcaaaaugaauaaguaauauugcaacuuaaauauuucaguuaauuacuuauuuacuaaagugugacuacaaaaugaugaucaugcagcuuuuauuucuaaauuaauuucuaauugcuuauuuuucuaaaacaagcagugugaaaaacuugaaaucuauccaaauuagcaaaacaugcauaugaugcguguaagacaaauucacacuauagcccuuugcucuuaacauuauauuuuacuuuuaaaaaaucuuaaaaacgauuuuaaauauguuuacauaauuauaaugagguuuauaaauauccauauaaauauuacaaaugagguuucaaaauguaauuguagaaucaauaaaaacaauuagaaauuucaguaauaacugcuauaauuucagaggaaaugcaucacuaagagccuaauuuuugcaauuagagggcuuuggaguuaaaaauauuaaaaccaaugagguugauauuaccaguacuaaucaaugucauagcccuguuucuuuucugagccuucaaaagaauuagaugaugucaugugacaaaucgucccuaugaaauaugaguauaugcauuuacucauaugagcaaguuaaaaacuugcauuuuuaaacuugcauuuaaaaaugacaaugucauuucaggaccaauguagugcaaauccucuuugugauucuccaggaugcuuuucuccugcauaguuuacuuaaucauagaacaacaagaguuacugggucuagaagaaaaagaaauuaggaugagaaaaagaaaugcaaaucuaagaaaacacagauaauuuucccuuuaaaaacuggaagguguucauuaaguuugaauaaggcaugagucuuagauacuuagagauggagaagcacuuagaggucaucggaugcaacaucuccaguuauagaugagaacacaaagucucagguuauauuucaugucugcuucaaugucucaguaccaugaacaauuaaguuccuacugcguaaaagguaaaagguuuugcuuuauauaagucaacaucuagccaagcuccuuucucugcauuaguugcuaggaauugauauuuaaauaugcggucugauacuuguaagugugcagggccuuaaagccugauaucucuggcuuuaucuuaguauuuuuuuuuuaaauacuuauuuucccauuccuggauuuucucacuuucuuuuugucuugucguacuguaguuuuaucacaaaccacuucaaauccuuucuguaauuagcuagguauaaauaaauuaacaaacaaaauuaaauaauuucaaagccccauccaauucugguauuuuauuuucuagggacuaggggagcuaaacauuuuagguuugaaacuugcagcuaauuuuccccaauauguaaagcaaccaaccaaucaagaauguuggguucugugcugggacaccgaaaugauguucuaaaucucauacuccacaggcccacacucauguuaucaggguuuuccuuuuuuagagauagggucuugcuuugucacccaggcuggaguacaguggcaugaucauaguucacucuaaccucaaacuccugggcucaagcaacccucucaccucagccgcaugaguagcugggacuacaggcaggcaccacugcaccuggauaguuuuuuaauuuuuuuggaaaugaagucucacuaugcugcccaggcuggucaaaauccuggacugaugugauccucccaccuuagccucuggagucucggggauuacaggcuugagccacuguguccggccuaucagaaaaucacacugcuuucauccaagagugugauucccucagggauguaucacugaauaaucaacaggugagcagguucuagagccagacuccuugaauuaaaaucugaugaacuuggccauuuacaaaagucuugacauugagcaaaugacuuaaccucuuugagacucaguuuucuuuaugucaagagggcaugauaaaauagagcauugcuggcaggguauaaaugagauaauacacaaacuauuuaaaauuguuccuguuucacuguuagcucuuauuguuaauggaagauuaugaagcaccaugaaaagaugaagaauuagugaccccagaauuaauacuauuuugcucuaggaaaagccuagaggcguguuuccaacugcuccucaucaguaguugguggcucuuacagcacuuaugagcaacuguguagacugggaagcaaauggacagauaugaaucaaacucuuuucuccccuagcauccuacuuaaggcuucuagacugguaacaauggauugucuauugauucuggacuaaaagaugaaggcaacuggugacuaacgcuuuacaugacuugaucuucagaacuauugguggggaagggggaguagugucccuugaugauagucauuauuauaugguacccguggccagagaacaauuuaguucucacagcacagguuagaugcaaacuucuaacugccagagaugacagaugaacaaggcuuaaauucuugauggaacacacaucccaaacaaaggaaaugggaaggguggccgaugucgaaagccagggcucuccugaugaauaacuguggcagagcuccuucucccuaacuuugacccaaguaauccgugcaagacaaauauacggucaaaauguauggcccgaaugucuuaguaucauuauuaugaaaugaaugcaacugaauucccuaaguuaaaacuauccuucucuuccauaagaaaaaaacaauaugcaucucaaugguaaaaccuuacccuaugcgaacuucagugaaggccuguucauguggaagugggaaucaaaguagauuuugcauuuggcaguuugaggccugagucaccacccgcugcugcucuguacuaguauuucagcuggagagucccugcauuacucccuucuuuccacuguacucaccacccaagcuugagcacccaacagguacucaguaaaggcugacagaugaguugaauugaggcugagaaggauauaauucccucuggccagagaaagauaauuuuacacaucacagacuggcaaggcuuauugagucugaaagcucacaaaaugaaagaaaaaauaaagaaaaagagggggagggaggagaaaucuaggaaaacaaguauuuuuaagauuuuuuaaaaagcguuauauuuuagguuuccaacagagaaaaaucuacauuuuuccccaauuaguguuaguauguuuguauuauaaugcacuauuuaaaacuaugcauguaauaacuguauuuuuaaagcauuuuugauauuagaacagaaauauuuucuaggauagcaugauuccaaauucaagcuuccaguaaaggugguaauauuaaaaauaggcaagucuaaauaggugcuguugaccuucugggcuggaucauucucguggugggggcuguccuguacacuacaggguguuuagcagcuuccuuggccucuacacauacaugccaguagcaccauugccccaguuuugggaaccaaaaaugcuugacguuuaccacaugucccuuggagugcaaaacugccccugggucuacaugauaauuacaucucucauaucaaagaagagugagaaccagugugugugugugugugugugugugugugugugugcaugcauaugcaugugcacguguguguguacguuugcaauuacaucacucaugcauuuauugauucacauaaauuagggauaaauuacccccaauuauuuaguaagacuauccuauuaauacauuucugugaaacacuauuuuaaauauauguagaacauuuaaguuucaagcucugugugaaucagaaagucuaaaccacagggaggaaagaacaaaauggcaguucuacaguggauuagcauaggauucauuguauaacucugagaacaagucucauauuuaagaaacaauuugaucacugaaaggcaggaagccaugaugugccuaaaugcacugcagaaauaugaggcuuucccuuuuucuuuaagagggcaaguaugauugcuguucucugcauuaucguggcugugccccaaguggggaaggaacuggccaaacacucuacaccuacaagcaaacaccuucaccaaggaaacaguggcucuucuguacuauauacauuuuggaagaacguauuaaauuucucaaagcuuuauugucuaugcaaugggacaauauaccuuucaggucacugugagguuaaaauguaaucguaaugccugugccugauacaaaagcccuuaaaauucuuucaaaaucuuaaauguauggaacaaacaaaucaacaaauagaacuuuuaauccacugggacagcaauauuugaacuugcacugauggaaaggccugaagaagacacuuuugcagccaucuagagaaagcaaaagugcucucgaauggagacauaauccguuuacaucucaauaaaaaggaaggagcauucugcagaagguaguugugugaaucacauuccauugaaauucaacuccaggguauggugucuuauucagucacaauccgucuccuguucaguuggccugaauuucuccccacaguuuagugaggaauggcaagcaaaaauccuuguuauaccagagauaggcauuaauuauauuuaaauggaauuauuacagacacaugcccacagauuagaaaagcuuauaaaauuuuccucuugugagaaugugaaauacauauuugaucuucuucucuguuuccugacauguaguuccuaaaacccuuagaauuuccagagugaugagugucuauuguauguuaaugagguggcuggggaucccuagauaaauucagcuugggagcuggucaccagaagaccaaggcaugauuagaggauugggaguuucagccccaacccccaacuuccugguaggggauagaagcugaagguugggcgccucacuaacggccaaugguuuaaucaaucaugucuacauaaugaaguucccaguaaaaccuaacaggacugaguuuggaagagcuuccagauaauuugaacuuguguagcuuccuuggaggguggugcgccuacagagggcauaggagcuccacuccccuuccccguaccuugcccuaacacaugucuuccaccugguuauucaucuguaucuuuuguaauauccuucauaauaaacuguaaauguaaguaagguaugucuccaagcucuaugagccacuuuagcaaauuaaucggaccugaggaaagggucgugggaaugcugauuuauagcugguuggucagaagcacaggccacaaccugugcuugcuauggcaucugaagugagggacagccucaugggacugagcccucaaccuguaggaucugacacuaccucuaggucagaaccgaauugacguagaggacacccagcuggugucugcugaagaaucugcugcaaaauugaucucuuaguguguggggggaaacucccacacaucuggggucucagaaguguuuuguguugacgguguugugacaguagaguaggaaaaacugaguuuguuuuuccaaauccuuacaucucucauauacaugaagggugaacaaugauuugaugacucugaaugaaaccaacugugaggaacagcugaagaccaaguuccacuggaaugauaccauggagagaacccagagucugccucuaacucaaaaucauuuuguuucacgaauaaggcaagucacuccuuauccauuuauuucagauuguugguccaagugcuccguaccucaugaaggauauucuuagggcagaaaaugagaaaacaagccuccuccucauucaccguguuccaagcucaccagccucuugauguuccugaacacucugggccucagggccuuugcaccuguuauccccucuacuugguaugacgcucuguucuccagguaucugcauggaaagucaccucaaugacaccuuucagagcuaccuaaucuaagaccucaagcucagucuuuaccccuccuacgcuucgucugacuccuccccaacuuaauuucuucucauugauuaaugucuuagcauuuucacuuuauaacauugcauguuuuauuuguuuauaauuuguauuaucugucucccacaccaaaauuuaagcuccccaauaauggggauuuuguccauuucauucagcuuuugccuagaagagugccugacccuucaaccuauaucugcucuaaaaauauauaugaaugugaaucaaauaauauuagaaaaaauaucauaacuuccuccaacuuuaaauccuucuuugacuaggaaugcugcuaagggaugauguugaagacugaagaugaagaacuuuacuuaaauguggucaguuugagacuugguuagagacaggaaauuauuuugguagcagaaguaaguacgucaauguccagccuuauggucaaguccaaugucuuaaguaacacagaaaauggugccugaaauaagaaacguguugaaccuucucgcuaaccuuuuaggauuccacauaaacccauuugcuucuacagggcaauuagcauuuauuugucuccuucacgacgggcauugggcuuuaucuuuagcuccacuucucauauauuaucucuacagcagacuucuauuauuauccccauuuuacagauugguaaacugagacuaaaagaaaucaugcucaauaaguuuccuaaguuucccaaggugauacaccugcgaaaguuuucagauucaaaauguaguuaucuguguuuaaaaaaaaugacaaaaagaguugaagauggcgacaaagggaaggcucucauacaugaaugccugauaacaaaaaguaucacaaaagucucugaaaaccccaaccuuggacaaaggccacugcaacauuacucaaaaacaaaacaaaacaaacaaacaaacaaaacuaaagaaacuccacucuugcuugucacuuugauugacaaauacuuuguuuugguuucuguuugaacuucuggacuaucagguacuucugugaagacacaagcccagcaacugccuguccaaccuuacacugguuucgcccuugguacugauccuuguagcuaaggauaauuaccucaaaacaauuauguaacacuccucaguuuuuccuuaaaauccuuuggcuucccuuaccucugugaauacauacauaguuuacuaugccacagguuguccauugcaaugcccuauuccugaauaaauaucagauuuuggugaggcucuguuuguuuuuuagguugacacaccuuaggaguauguuuucuacuuauuuucaccugggcaaaaccuauuccuccuguuaacaggcuucaauauuuuuuuccaauaaaucuucucuguuccaccauuuucuggcuucaggcaacuuaccucaucugugugacccucuguuuuucucuccucuacauggaagugauaauaauaucucuagcuugcaaguacccaacagauaguaccggccucucugccaacccucaacauuuccucagggccaacuucgcuucaggaaagaccugagaaucccagaggccauccaucagccugcaugccuacccugcuuuguacuugcagcaugaaaaacgugcuaacaucagccauugauuuugauuagaauagggaaaaaaauaaccaagagaaagggaaauuaaaauaucugauuuugaaagaaaaugccaaagacaucagaaagacaguaaucuuuuuagcauuacauagaaaggaaaauagagaauuuauuucagggcaauuaaaaaaaaacggauuguuuuuucucuuuugaaugaaguugcugcauggccucuuucucucucucaauggaaauuugaaaugggaaaguuucccaaauaauuuuagaucaaucaugaguucauaugguuuugacaucauaacucuugucacguuaccaugccaacaggcagagaggagcuaaaagcuuuccaaagauaugaaaauuacgagcuuagaugggauucaguucuccaccgggugaacacuaacaguauugccaaacuauaaauaacgagggcugccauagcacccugucacccacucucccuuguuucuuucauugagcacugaaaauaugugcucuauuuuggaaacaaaaccugaagauccacuucccuaaauggaugcccugcugcaauagaaagugauaugacucuuuauuacugcucuuggaauaaaccaccacauuaauccagacacccgcagcucuuacuccacuuguaaccuaacuccagcauaucuaauuuuuacuccauuugcaccuagacguaaagacgugcauguguuugagugucuuuucccugucuugugaagaucaugccagucaaagugccuaaaauaaaggagcacacauaccacgaauuagaauaaaauacuauuuuggauguuguugcucuuaaaaauaucuccagaaugaaaaugccaaauuuuccaaugugcagcauguuuauacucaccacucuugcuugucauuuugauuggcuuuguuuugguuucuguuugaauuucugggguaucagguacuauuauagagcacaaguagaagcuguaucuucuucucuauccuuauuguagcgcugcauaaaugguaauaaaauggguacuuaauagauuuuuugcugauaauaaaacaaugaacaaagguucugcuccuuuuguguggcagacucuuaacuuugaaccaugacgaugaacugugccugccaguauucauguucuuguaugguccccucucugagucugguuggccccgugaucugcugcaaccaaagaaugauuuggaagugaugcugugccacuuuggggcccaagccauaagaagccuuggcauuuccugccuuuguguugcaagaaucccaacucacuaggugguggagcaaugagguuuucaacuuacagccccagcugagaacugagccagcaacuagaaccaacuuguaagacccccuuagaugggaccuccagcccaguagaguugcuccagcugacacacaguagagcuauccuugcuuagccuuguccaaacuacaaacucaggggcagacuuaggagcaaaaaaagaaaauggugcuguuuuaagccacagcguuucaagaaaguguguuccaaagcacuaaggcaccauuaaguaucacauauuuacuaagaaaaaaguacaacauagcucuucaugcaaccaaaccugaguucaaaucccucugcucucacauuuuugugauguaagacaauacguuaaagccauauuucccacuucugaaaagggggauaauuauaaauaccaaauguaucaggguuugaaagcaguaaaugaggucauccaugcaaagugcuuaacauagcaccugccuuaggauaaguagguaccacauaagagcuagcguucauauucuuuaucgaggcacuguggagauaaagacccgccucagagaaaaacaccauuaauucaggaaaugagauguauauaugaaacuauuaauaaacgauauaaggaaauaugaugauaauagugaugauaauauguuauaugcgugucuugaggaagggaaaauaaauuaguucaaagaaaguauauuuuugaguggaaggugaggggaggaaauagcugacuaugucuguacauuugcuuuugaguuuacaagaaacauugaacaaagacauagugagguaaaauucacaguccuuaucagacagccuuagguagaaggauagaaacaaguuaaggaugccaaaauggggcugucucgccuccccagcauuauacgucuuucaaaacagaagaaccugaauucuugggccaguguuucuggccccaauaucagcuagacuacagaagccauuuguguaaauguccuugcuaaauugauaggacccaggaauaaggccaaguaguuccacagacacauuaaucuuggaaagaaauaauguugucaaaucacaguccaaccucaagucuuuucccucucugaguagugauuucgccacacuccuaggucucccccucugagugugacuuucaauuuuuuuagacguuuacaccuagauuucacauuuagcuuucaucaaaggaugaaaggaugucaaauugcuuuccucacaguaauuuacuggugcccuccauucuccaguauggccugccaccuauuauuauuguaucuaauacccgacagaauaaaauuccugaggaaacccucccaguugcaaauggaaggugcuaauauacuuaacauagaugcugugaauccaggaaucagcuuggaaacgcuuuuccucuucuccauacggagcaaaacaugcagccccguaggugguagcaauggccaccguggucuauucaggguauagcagaggagaauaacaggcugagacugacaugacuaaguuagaauagguacaguauucuagaaggccagaaauauuuggaauuauguuucagaauuaagacaggcucuuugacacaaucagcauaguuagaauuucuuccccaaggcauuuuugaaaagagguuucaagcagccucauacccguggaguagaaauaagccccugaucuagcaagagguuggccugguggugaagcagguugacuuugggggagccuuuccucuugcucuccauuacuguccuccuaccauugcuugcuccucccauucccaucugaauucccuuucucuauaacacuguucccaaaggcuguucauucaccaugccccaagaaaggcauuaguucaugagggcauaaaugcuuaccccuacuaggaguaugcaccuauuuacuguaaggaucuaaaccuuucacauguaguaacaguagaauaucagucgcuuucacagguggugggagugcuuuggucacuuucaaaucgugccaucuaguaaguuauuucuaccuccuccaccuccuccaaagcugucuugcucuuccagcuaaauguauucauuugucaauaaaaccacacuuuuggcauggaauauaucuuagaaaccacaaagccaaacaauaccuugaacagaauuguaaaacccaaaaaguguuuccgauuuaauugaucacacacagagauaaaugcuuuauuucaauaaucacuggccaagagugaaaggaaaagcaaccaaaggaagacagagaaggcagaaaaaagcacagugaguccccuaccaccacuguuuaaguuauaagcuaaagacucaaccaaaguaucuaucugucucuauguggucuccuuaaguucucauauacagguaguuuacuucuguucuucucucaauuuauuuggaaacauuccuaugucuguaauaaggauuuuaaaaggaaggugaaacaaaccuguaauuucuuuauuucugaccucuuucuuuuaaccgcguuauugaaauccaguggauggaaggacaguccucucuuuagccauguucuuaugcaaagugcuuagugaauuagcuuaaucaggaacaaaugcauauaauuugcuguccuugaauuucaaaagagccaucuuuagagcacggggcuccaaaagaggcacaagaaauaguuggcuuaguuuguuguucccccaaaauauugaguuccaaucccuggccagcuaccuaauaaaugugugcucuucuuguucacauuaaaauuuuuuuguuguuguuguucuuguuaauuuagucacuuaaacuggauuuaauauugguugguagugcacaaggaaagccagcauaauuuagucauuagauuuggucccugaagucaacagucugcacuccauaaguaaugaugucucuuaauagauggugugaccacagacaaacugcuuacccugagccuacuucaccaccaauuaaauaaggauaaucauaguaucugucucauagggcuauuaagacgaaaaaugugauuauguucaacaguuucuuuaacacaaauggucucaauacaaaaagggguaguuggaagaucaguaaugaaaucuggaauaacacuggagcaacgaagggauucaaaguaaaaaaaaaaagaagggucaugccauguaaacacuugaacuucaacucucuaaauaaggcgaagacaaauaacuaacauacagauaucaaguaaccauacgaaauggaauuuuugucaaacagguauuuuuuccuuguauaucuuuauuuuguguggggggauuguuuauauuuuguuuuuuguguuguuugguuuugcagaguugagggucuuacaauauugcccaggcuggucucgaacuccuggccucaacugauccuccugacuuggccucccaaaaugcuggaauaacucucagccucuuaaucuccucugccauuuccugaauggaccacggagacuauugcuaccagcuacuggguugcauguuuugcuccauauggagaaaaggaaaacuguucccaagcugauuccuggguucauagccaccacugcacucagccuauuuuaaaacuauuuaaugaaacaauuuucuguucucaugaauuuuguauuuuacaaagaaugcccuaaacaguggcuacucugucagccuggguucugagacugaaaaugaccaacacauagagcaggaauuucagcuacucuagaugagggugugauauaaaugagcucuguuuuuuuuuuauugaaguaaaauuaacauaaaauucaucaauuuaaaguaaacaauucagugguauuuaguacacucacaauuuugugcaaccaccacuucuaucuagugugaaaacauugccaucacuccaaaaggaaacuccaggccuguuaaaauucccauuucucccuuuccucagcccaugauaaccaccaaccuauguucuuucucuauagauuugccaauucuggauauuuuauauaaagggaaucaugcaauauauaaccauuugcuuuggcuucuuuuauauagcauaauguucuugaguucauccacauugaaguauauauugguuauucauuccuuuuuaauggcuagagaacauuaccgcaauuuuuuauccaaucaucuguugauagccauuuggguuauuccaccauuuggcuauugugaacaacacugugaugaauauguguguaccuguauuuguuugagugacuauguucaauucuuuggaguauauacuuaggaguggacuugcugggcuauacaguaauucuauguauaacuuuuaagguaaaucuguuuaaaucacugaguuuuauggauuguuuguuggagaaauuagcucaucuuguugauccaucaggguaaggcauuaggauuuuauucgagaaggcucaaacagaaaaaugggauguuuucacgugcauuuauaaaagaucacccuagcuacuauuuggagaauuggucaucaugaggcaagagaggaaacaaagagacacauuagaaucccuugcauuaguugaggaggugaaacuuguugggcuagugagccuguagagauugagaccuuuugaaggagaagacuacaggaccugcaggugcauugaaugugagguaggaggcaagcacaacuccuaaguuugggaccuagacgccuggaugaucagcggugcacacacugagaugaggaugguugggguaggaacaguuggagaggaagcagucuugauucaaaaaacaaugauucuaguuuacacauauaaaguuugagcugccuguuugacauugcacuagaaagcucaacuaugcaguaacauacacacacacacacacacacacgugcgugcgcgugugugcacgcauaggcuugagcacagagaagucagggcugggguuauaaacuuggaagucaugaauggacaggaggaauuuacagccuuggaaacaaauagacaggaccugcuaaagaguguguuuagaaggagaagagccaaggcacugcgaauuuuagaaucaggagcagaagaaccuccaggaaagugguucuggaaaaaaugccugguaugguuaggggaaaaaacaggaaggugugugucucaggaggaagggaaggaagguaggaaggaaggaaauaauagaauaaaaaaaguugcaauaaaggcauaguaaucaccugguuugaauguugcuaaaagucguaaaagauacgacauuuggauuuggcaagacagaagucacugaugcuuugaaaagagcaauuuccauggaguggcgaggacaacaaucauucugaauaucucuucauuggcugccuucuuucuuuucuucccagcuuuuuuccuuccuguuaugaucacagguaugcucuugccccagagggcuguuaagguuaaugacguagguguaaaggucccaguuacaggccaggcacagaggcuaaagccuguaauccuagcacuuugagaagccaaggcgggaggaucaauggagcccaagcauuugagaccaggcuaaacaacauagaaagacuuuaucucuacaaaaaauaaaaauaauagcuuggugugguggagggggccuguggucccagcuacuugagaggcugaggugggaggaucgcuugagccccaugguucaaggcugcagugagccaugacugugccacugcacuccugccugggugauaaagcaagacccugucccccaaaaaagauucuagucacacauauauauauauaagacggaagcaaggagaacauaaccaucaagugcuagcaacauaaauaaauaccuuaucuaauagaggaaauaaaauaccugccuguuugaauauggccacaaacuucaauaaaugauauuaaaaaaacucaccauagaaaaaugaauggguuacgagcaucucuuuuggauaugaaggacagcaaauaguaacauacccagaauuuugugggcaagcaaaaaauauacguauguauuccccucaccuaucaccaguaauuauuuuauuuuuagauguuucaagauaccaauaucuugauuauuaaaacuugucaguuucuuuccuucuuugucuuuuucuuuuucuuuucuuuucuuucuuuucuucuuuuuuuuuuuuuuuuuuuuuuugacauagucucacuccaucacccaggcaggaguacaguggcaguggugccaucuugucucacugcaaccucugccuccuagcgucaagugauucucaugccucagccucccaaguaucugggauuacaggcaugcgacaccacaccuggcuaauuuuuguauuuguaguagagacagcguuucucuauguugaccaggcuggucuuaaacuccugaccucaagugauccgccccccuuggccuccaaaagugcugggauuacaggugugaaccaccgagccuggcuuguuuuuauagacaguaugcauuagaaagauccaccauaauugauucuuccaauagugugaagccauuuacuuagagacuaaagucuguaaagucauguucaauaugucaaauuuuuaugguagagcucaagaaaaaauucauuugaaauugugaaaaauguuuuagacauuuuaacuaaucacgagagaauucugacccacauauuccauguaacauucccaagggaucugugcuuuaaaauuuuguagcuuagcauaugucaaggcaugcuaaauaucacacagccuggcagaaaaagguugcauuucacauccaaugucauucaguuugagcucucuuuuagcgggugcccucccacgauguguuacagggagugcuugucacuuacaugccauaaaauccugaacagacaggcaaaugaaaaugacuccucggagugacuugaacagagagaaaaauucuuggaauuaacagugcuucgaaaugccauucaagcacagggauuugauucugccaauuucuuaaaaguuauacuuuaauggaguguuauuuacauuucagguaucccuugccacuuaaugugguuuguagaggugaaauauuggcaucccaccuacacauaggaugaguuagaccaugucacuuauuuuagcuuagagaaacuggaaaaaggggaucccuggguuaucauguaaguuucacacaucuaauucccaccuuuucugaaaagaaucagguaaaaugaagagaagcaacgaggcuggagggguggggaagaaugaggguuggcaccauaugaacugggcaauauugcaccaaaucaaguugcauaggaauucuauucauuauugucagcacauuuacccagaacuuguguaauucgucuaucugcauccuucagagaauuaccuuaccucucucuaauucauuauuuagaaggaaaucacggaauaaggcacaucuuuuuuucauaaacuagaacccacaaagguuuggauuauuggaacaaaaacaaacuuuuaaugacauuuuucaaagaaaaauuucauaaagacuucuuuuucucaugaguugcuaaaaggggaaaaguaauauccuucauuagauaaacagcuuggcuuuuuuuuuuccaaacccauauuugaauguuggcucucccauucauaaauuuaagcaauauugugaagaucaucaguaagugccuuaaacucuauuagccuugguugucucaugugaaaaaugagauaauaaugcccaugucucaguggcauuauauggauuaaaugaaauaacuguaaagauucugacaccggucaggacaugugaauuuccucuuccccuucaauaagaucaaccuaguuuaagugagacaauaacagaagauagaggaaaaucaagaugugggauuucugagacgaaucaacuggccaugcagguauucuaggacaugcucugucugcagaauguguggucuuagagcugauaaccacuggaacaccccaagguauguuucacagguuugauguuaaauuuuacuccauucaaaggcaauuuccacccccaaccccuuccugaaauuaccagcaauaacaaaggauuagauaggcagagcuccagauagauacagaaauagaaacauggcuagacaucagucagaaagauaaacgcuacuugcuugagaaucaaauuuccaaaggucuaccuggcagggguuuggcugugcuuuguuauaucauuuaggucauuucuaccagcuaagguaagaugcauuuagcacugacucaaucacaagggaaacggacauuuuguggcaaaguaauuacuuagcccauuguuuugcugggauaaugugggugggcuggcaggugugacguguacccuguggcccacauuaaacucaugucuauuucugcuggcagcaaagcagcucugcccaguggccauuagagugaucuucuaggguaaggguggcaaaaggcaguuggauuccuguugguaugacagcagugagugacugacaugggcuaucuggaaugcaguguugagaugcauuuugugguuucagaaagaaagcucucaucaagcagugauggcuggcaugaaaugcugcuggauguauacaucguauuugucuacccugguuuaggaaccuuugcugcaagaacuuaccuagacuguggcgcuugacuuagccuuccaucagcaccauccuggcauaacaugagaauguguguaacacucaucugcucuuuauguacauguuuccacuucacuuacacaagacuggcagucauacaauguaaacgaacacacauaugcauaggaguaaugugagacuucagggcauuuuauuugcaaaaguaaauuggacccuaucagauauucauuuagaacacaaucuuuaggcaauauggcaauaugugagacacaauuuuguguaacauuuuuuuuuuuuuuuuuuuuuuuuuugagacggagucuggcucugucgcccaggcuggagugcaguggcgcaaucucagcucacugcaaguuccgccucccggguucacaccguucuccugccucagccucccaaguagcugggacuacaggcgcccgccacuacgcccgguuaauuuuuuauauuuuuaguagagacgggguuucaccauguuacccaggauggucucgaucuccugaccucgugauccgcccgccucggccucccaaagugcugggauuacaggcgugagccaccgcgcccggccaauuuuguguaacauuaauucauugcaagaacagucaaauuucugcaccuggcuccaaugugcaccaacaugugcuccaaucauaucuaucaaacuaaaagagggaccuaccagucggaacuuagcaccucuuugacccccauccuaaccucuccagcacaguugguucuccacuguguuggggauuaauauggcauauuauaugcaacacauaauaccuaaagcaaaaugaaaaacaaauaaaucugugguuaugguaaaagugacaggaaagacaaauuugaauuuaggcuccaaaaaauaaaagaugauaaaugcaccugcuauggucugaauguucguaucccuccaaaauucauauguuaaaaccucauccccagugugacaguauuaagaggcaugccuuugggaggugaauaggucaugaauaauacgauuagaugcccuccuaaaagaggcugcagaaagcuaucuugcccuuccauugugugagaacacagcuagaaggcacuaucuaugaggaacaggccaucgccagacuccaaaucugccagugucuugaucuuggaauucccagccuccagaucugugagaaauaaaagucaguugccagccaauugugguauuuuguuauagcagccugaacagacuaagacaguaccuuugaaagauggcuacuugucuagcauauggcuuugauuuaaggccucaguggcuucagguugccucgucauggcaguaacagacgaagagcuaguuauugugaauuuacuucccacucuagccacccccagguaugugauagcagucaaggaugccuuuaaauuauaccuuuggagacuucaggucacuuaucuggaugaauuaaaaauuuugcuagcuggccagggaaagguccaucugaaucacuucuauaucaauuuacaaaaauggcaacagagccagcuuuuuuuuuuuuuuuuuuuuuugagacggagucucgcucugucacccaggcuggagugcaguggcacgaucucggcucaccgcaggcucugccccccggguucacgccauucucuugccucagccucccgaguagcugggacuacaggcgcccgccaccacgcccggcuaauuuuuuguauuuuuaguagagacgggguuucaccguguuagccaggauggucucuaucuccugaccuggugauccgcccgccucagccucccaaacugcugggauuacaggcgugagccaccacgccaggccgggccagcuuuaagguagaccucgccuacuuuuucgcuaauuugcauacugcucucaagccuucaccguugcaaucagaacuucacuuugcuggguagguuucagagcucuuucccacuggcucucuauuguacuugacugaugaggcugguaauaagggaaucaugccucaagcacugggugauagagugauagagugcugggagcugcaagggacaguacuggggcuacagggagacaaagguaacaugagcuaaugguucgcaugccaagaauuuacuuaagucugugcccagcacauaguagaggcccaaaaaauucuagucugucacagaacagcacauuauacuauggggagccugcaacucacacaaagaaagaaaagcucacuaucuuaaauauaauacauccugagauuugcaaacaaaacuuccuauuuuccuauucuacuuuuuauuucagaaaucaaagaucuuauauccauccacaauuuuaauucgcauaaugaaauaucuaaguucuauuaaaaaggcaugguguugauuuuccaugucuaaagagccucuuugugaaacuacaguggccauguaaaggucacuguaucacccagugauuacugaacugggagcuccuacaaauacaugccuguccuuuaaugcacagcaggcuguaauucacccucacgggccagagaaacgacuuauacugcucagaguucaaagccaaguccuugcuuaucgcuccagucaaacaauuucauuuguaucaguuggugguuguacuucagauuuuauagauccaaugggccuagugaaauuuuauuacccugcaauacaacaagaagaaaaaaagcucugagaaaaaaaaaucaauguaauguuuaaggucuuuguuaccuuuauaaccuccaguguucuuuuacauauaaacuaauaaaucaaccuuuuaacggaagaugcauucuucagugguugcucaauacuaggugcuaagucuauucauaaaaacuaucaagaaguagcuaauggcuuugcuaccugaacaagcaacauuaaagcagaaucaaucgcagcacuauaauauuguuugcuuguagguguuuucuccuaguuagcacaugauaaucaguagguaccaaaugaagguagcaacuuaugaaaauuagagggcuucuauaaacaauauuguguuuccuugaaauugcaaauguaugugaguuauauuaaacaugucaaacaccaaauuccuuacuacuggccacuacucaauuguaugagauguacucauuguaacuuuacaguugagucagcagaauugcaagacaaucuuuccccaaccuucaagagaauggcuuuuucuuuugucaggaucuuagaaauaugaccugagcagauuuucucuaguggauuuuaaaaguagcuaugaagaugcuaaauauuaaaauaaaacuaaaauuaaguucuucuacucaucucaacaauaaauacaccuucucucauaaaccucuuuguccugacauacucuaaggacuugaauuccaaacucagacacuuuuaaacaugaauuagcaucauguagccaauuugaauauucuccauuaaauuaaauuaaaugagaaacagggauggaaaagcaguucaccuauuuauuaagaacagagcuuuauagcucaccauauaacauaguaaguaccauucagcagcugagacaaauugauauggaucccauuccaaccaagugccuagcagaaaauacaaggcuuucugcgcaagaagaaaauaugauccaaugaaaagagcaaaucucacugcuccuacuuguguaaauggcuuagaaggggccacaaaaccacuaaugcccaaagcaaaguagcacagcaguucaggaguuacccucaugacacuauuagcaagguagcugauuguuuacuugaugaccacuaauacaugaaguugcuucugcaaguucccaaaggauugcgccuuccaggaauccugcauuuucacauagaggcaaggcauuaagaguggcguaagacaaacccacucuagcuauugaaaaaggagauguaaaaguaauuaauucuggcaauguuucuuguucuucuuuguguggauuaucaggcuacagaauggucauaaguaaugaaauugggauuuuaauuugaaaguuuuuucaacuguguucuaaauuacucacuagacuacucugauaucaauuuuugauagaauuacuagaguaguagauaggggagauggcaaauuucucuaaauaugcuucucaugaaaaaaaaguaacaaaucuguccugauggucugguggauaauauagacaaauaguagcuaaaggcccaguuacucaggaggcugaggugggaggaucuccugagcccaggagguuaaggaugcagggcuacagugagcugugaucacacuacagccuggguacagacugagacccugccuccagaaaagaaagaaagaaaaaaaaacggagcuacagucgaguaagauacgguuacaaaugguguugauuaauacauccuugcgaauuuagagagaaaugccaaauaucaaaccuuuggacuuuuaucaggauccagcuguggccaagaccuacauaaguaacaugguuaccaugcagaacaaauuuaggaaugaaugaauccucaacagacacuuaauccaauaaauaauagaaauaugaguaaagauauucucaacaaccuggaaugauagggccaaucuuaugaaaagaaaaaaaaaugagaucaauguuucauacaaaguguauuguuuauucuugugcuaaaaaaaauuaccacaaguucaguugcuuaauacgacucaaauguauuaucuuauagacuuauuuucacaggucuauaagacaugggucucacuggacuaaaaucaagguguuaggagaccggcauuccuuucugggugcuuuagggaacaaucuaauuccuugccuuuuccagguuuuagaggccucuaacauuucuuggcucauggucccuuccuccaucuucaagcccagcaacagcaaguugagcucucauauggcaucacucugaccuccuuuucugccucccuccuccuuuaaggaccuuugugauuaccuaggggccacucgaacaauccaggacagucucuccaucuccagauccuuaacuaaauuacaucugcaaagucccuuuaaccauggaagauuucuguaacauacucauugguucacaaguucuguuacuaauucauagauauuagggcauggacaucuuuggggggucuguucugccuaauguacaagguuaaaaaagaaaaaggaaaaaagugcugcagagaagaggcugauagacaaacgaaaaggaaaaaauaguuaacuccugucuggugagaugauaucugggauauugagucaaguucugaacauuacagaggaaaugaucuggaacugggaugugcgcaacagaaugacuacaauggaggaaaaacuuaaaaccaagucaugugaauaauauuugaaguaauuuugacugauuagcucaaagaacagaaggccugggugcaaaugccacugucuuuaagaaucugaagagcugucaaugauuacauuuaaucccuaauaugaaaggagacaucauauuaauguacaagcaaguuuaagauaauaaguaugagagcucaaugaaaaagaaauggcuaguuugguacaauaagguugaaaaguaacagcuguaaaauucuuaaaaagccuucauauaguacugcauuagaacuucucaacaaaucugagaaagacuaguuacugggaugagacaggguccugacaggaaugagaauccagugcaggugguucaagacacuuugaaugguugacacagaggucagagcaaagagaacaagagacauagagauucucagagauugcaacagcaggaaggaaggagaagacuuuauuacuccuggcccugaagagguaugggaaagaacuaacuuuacaggagccaggaaagacccuguugacauaaaaccaaagcagcuguagacagggaaggauacagccagaauacacagcccagagcagucagagaccaguaaagaaguacuguguucucucuccuugcgcccuccuccaucuccugcuggugccuuccauggacacaacccaacaggaugcugguaagcaaagagacauggaagaugcuuucuguagaggucaagccuccuagggcaaagagaaggacagagauaaggguaaagaaugagggacaagaugcauaaugaccagcacagcacuauauguuuauuuuacaaaugaagacaucgggauuuggagaagcugaaaauuuucucagggucucacucuagaaggagucuuguagggccagaacucaaaugugagccuuuaaagcaugagaugcuaagcauuucccaugacagugcacugccuaucucucaggggcuucucuaucacugaaguuacagaagaggaucuggggauguugaaaaggaauucacauuaguaaucaguguuuggaugagauuuuguuacuuuucuccauggaauucucugauucuccguuuccucacucaucauucugcacuagauccacuuuauuuuuucauuuccuuucaaaccuaacugccuuaaauagcuucauacacugaaaaaaaaaaaaaaaaaaaaaaaaacccacacguauucauaguaaaugaaaacuacucaagauucuguaaacucucuggauaagacauuguauuacucuuucugucuuuggaauagcuaucuuuauuugccugcccuuccauccacuaagguggccaggggaauauucugagguaugcauugaaacuggaugacuugagacuuucaagauaccuuugauaguucagaaaaauggguucgauaaauucucucucaucgcuaaagcuuaaugcuaaugaauuuuguguucauuauucaaccccuagaaauugacaauaauuaugaaauaaaacucuccugccuuuuuugcccaaaccuucaaauaagggaauacuuuauauugauaaaggaaugguucuuaaaaguuguaugaaagcacuuuuccuucucagaguucauuuucccaucagcuuucaauauacuguugguguguuuucuuuaaacguaaauauuguccuaagguauuauaagaucauguuuauaaucgcaaaauucauaaguauucuguuaaaaggaaaguauuuuguauaagacuaaaaugcaaaucauaaaacacaagcagaaauugacugauuagggcagaguaaaauuuuaagcaaaauuuucuggagucucaguguguaaaacacauaaaaguugaguugcuuuggaugagucaggaguggaggcaacagggagguucccauucaaccucucucuggcuacuuauuauagccugaggcuccacagcuucuuggguugaaacuacuaugccugguuuuuguauucagucauuagccuaaaucuaugcagcaguuuaagcauaaacaggaauugcacacauccuguuauucuggugaacugaggaggacagagguggccucuuuuacuucuuaucagaaaccugguauguaagcauuguccucagaccuccacuuucaccagugacuggcagguguauacucaucggcuccuagcagaggccaggugauguccaugggagcagccuugugugugaacccauagguccccugggggccgagugugguggcucacaccuguaaucccagcacuuugggaggccaaggcagaaggaucgcuuaagcccaggaguuccaaacaagccugggaaauauaggcagacuucugucucuacaaaaaaucaaaaaaaaauuagcugggcaugguagcaugugccugugguucacuuaagccuggaaggucaaggcugugguugcaccauugcauugcagccugagugacagagcgagacucucugaugucaccuggggaacuccagaacuguuugcagacaaacugcaaacaacugaaauccugaccaagcaggugagggucagauagcugcauuucaacugccccuguuaccguggucuucucuacacucugaccuguggaaugaggacacggguaucaugaagcacaucagacuuaaagaaauaaagucauccucccccuuucuuuuuagaucccucucagagcacuacaaaagcauaacacgaaacuccccuucauuguuuuaauuuuuuucuggcuucuaaaauuuaaucuauuaaaccacaugaagggaagagagaucuugaaucacaauaaaagggagguagcagaauuggggagugggacauuuaucaagaugaagagaucuaaacauauggugcugcagauauuuaauacgucauacugcuccauacuuucagauucugccauaauaaaacaugucaaauaugaaaauaugugcuuuaaacuggugcagucagacugaggguaaccucugguuugguuugaaaugauguccaagaaauuacaacuaauguuaaguuugaggcagcauuccuaggaacaaaagggcaucauuuuaauuuucauuuuguucaaagagaaggguauuucuucugaaguugguauguacugcucccaaccaacucugaaacagcagauuuuagguaaaauauaucacaaguauucaugccuuugucuaccucauaacucauuuauguucucugaauaacaacgauauugaaaagaaaaaaacccacaggucuaaucaaaauaagauccuugaaaaccuggcauauacuuugcaucucugcaugaucaccacagauuuuagucuuagacucauaugacuuagaauucaugggaccagugugcacaguguaguugacucacagauucuuuuuguuccauuuguauugcugcuugaaccuuacagugaaaaacacacaaagauaaacaguuugcugagucuaauuaugcucuuggaaggguuuagguaauuugugcagccaaaaauuauacguaacaaucaggugaggucaauggcuuuacaaauaggaagacauuuauaugacagcaacaucuguaacacagagaaaugaaagagaaagagacaaggagugaaacaagagaagacuggauuugagaucugcaguccagaguagaagagcugaauuuauuuuuuaaucaugacaaugaaguaagucauaccccuuuuauggaccaauuauaaauugcuacguauuugauaugguuugucucuguguccccacccaacucucaucucgaauuguaauccccacguguugagguagcaaaaucacuggauuuuuggggugguuucccccaugcuguucucaugauagugagugaauucucacgugaucugaugguuuuauaaaugguaguuuuuccuguguccucacucacuucucuccugcugccugugaaggaggugccuugcuuccccuuggccuuccaccaugauuguaaguuuccugaggccucuucagccaugcagaacugugagucaacuaaaccucuuuccuuuauaaauuagcccuuuucagguagugucuagauagcagugugaaaaugaacugauacaauauucuauuacuucauaauauucuggaaguguaaacuaaguggagaaccauaaccuaugauacuggcccucauucuaacuaccugaccuaaaaauuagugaauaagcacugagcuagaaaugaaaaaugaaauaauaauggguaacauguucugacaguuucauacauauccagcaauguuaccaaauaucauucccuucaauccacaugauaacccaaagaacuggguuuccauuuuacagauaaagaacgugagguuaaguucacacaaaaguuguuggaggagccaugauccagaagcaggcacaagauggcaggacccauacuccuacccaauaaucgccugucugugugucagucguacuucaccaguggacuuagaaaagugcuggagcgagggugaaauuuugacaaucuaccugugugguucuuccuuguugaugcagaagaaagcaaacagucauacaaauuggcuacagguaaugcagaaaggagagggaaagugggggaguccaagaaagcuggcugccuucaugaggacaggagugugaacucaggcguacauaccauaucacauucaucucugugccucccucgucuggaacugugcaaagaccgguauuuauuucagguuuuuggagugaaaauuaugcaaauaauuuccaaccaagguacagugaaagaaaugcuucagggagaggugccaaacguaagaaggguuaaaaagugggaaucuaccuuccagaagagagugagggucaacucacuaggaagagugguguuggagaagggcucugaaggacagaggggauggaagugagaauugaacgucagcagaaggacccacaugccucgaugucaaucgcugugcuugaauuaacaaaaacucugaagaaagggauuaucuucauucauaggauguuaguuucacagggcuacauccugagacaucacaaaaaccuugucagcaucagaaagacuuuguuaagaauuuuagcuucucaugaguaugcuguauaaauaauacaaguuaacauagcuucacgcauacauucuaaaguagggauaggcagacuguuucuccauagaaccagacaguaaauacuuucaucuuuucagggcagauggucuccaucaccacuacucaacucugcccuuguagugugaaagcagccacagacaacauaaugaaacuuuauuuacaaaaacaugcgccaggccauaguuugccagcccuguucucaaguuucacauaacaagaaacaccacaaaaacugccaguccucagaauauucccagacuaggauucaauuucguucuuguauuauuguuuuauaucuuuucuuuugcuagaaaaguaaaauucacauuuucaaaaugucuuucauaaaauuuuuuaccucauuuuuuauaacaacucuauugagauguaauuuauaugacaugaaauucaccccuugaaaguguucaauucagugguuuuuaaauagucacagacuucuacaagcaucaccauuaaucuuuaccucccuuuuugagcacaauuauuucagcaguuauuaauugagcaucuagugucuguccaucccugugcaaaguuucgguuguuguuguuguugcuuugcuuugccuguuuauuuggguuuggacuggcacggugugggguggcuugguagaaggucaggcuaguggguaguagguaacaggacaaauauaagacaugacaugccugaagcaaucagugaagacuauaaaaaauaagcagugggagugcuaaguuagguggccuggagagaccacaaauacaauacaaauuuacuuuuacuaggguuggguggggauccuaagaaugugauuuagagaccuagggagagaacuuggauuuggauggagguggcaggcagcaagagcaaagaaugcauuccagggagaaggcacagcugugagcaaagaccuagagacugcaacagcauggccuaugaaaugagcagccaugguacagacuuaacuggggaagugcccagaaaugcacaugcaauugucaaaagaaaaugauccagaagcuguaggacuguaggaagccgaguuuagaguugacagcauuggcaucaggaucaucagagguuccuggggaaaugaaagacgauucaaggagugcuuuuggaaaguugauaguuguggguaggauaguuugaauggagaaaccuagaaacaaagaugcuuuuauggguacuuauuuuauuuuauuuuauuuuauuuuaacuuaucuuauuuuuuaauuuuugagacagggucucacucugucauccaggcuagaguacuauggcacaaucucggcucacugcaaccucugccucccagguucaagugauucuccugccuccguuucccauguagcugggauuacaagugcacaccaccaugcccagcuauuuuuguauuuuuaguagagaugggguuucaccaugcuggccaggcuggucucgaauccugaccucaagugauccguccaccucagccaccgaaagugcuggcauuacagccgugagucaccacuccuggcaauguguacauauuuuaaaugcagggguaaauuuaauuauugggaaaagauuacuaacccuggcuguacauuagaaucaccugaagcacuuuaucuuugggcgggguggcuguguauauguuuugauaucuguacuuuuuuaguaagucccacagauuauucuaauauauggcuaaauuaagaacuauuauugcaggagaauggauaauagacuuuacauuguuugugaaauuauaguuagauauguaguuuucugcucuuuugcuagaauauuuccauuaauuaaaucagaauccuuuaaaaauucucugaugauuuggauuuuacgaaguagccaacagaggauaaugauuuuaaggacagaggggcugaauaaauuauauaguauauuuuggcaaacucuuagaauaucucccuaaaauaaguccuuaaacccaagcauguuuuagagauuucaaacuuuuagacugacucuacaaaugaugcugcuuguucugagucagaagcgcagugcaacccaaacaccuguguaugguggguaaauguuaauguauucugucaacaacagauuaccuuacauggcuaaauuacucaaugccauuauaugugccagccaucuguaaagcuaauccccucuguguucaaaaaucccgagugccugcuacacuauuuuuauuuuacauuccugcauaaaucugguaagcucaauauguuaccacaaauucucaaaaaucaaaggcaaucugcuggccuauaaaacacugguugcugaaaaucgaaggguauaauauguuagcaaaucaagcagucaguaaacauucuuuacaggaaugggguugaaccacaagcugacugaaccccuuagguaaggccugccguaaagucagauauguucuuucaauacacagcgaagccucugaacccauucauguauuucauaucuaacaaaaaucugaacaguuggccugauuggauuuuaagugaugcaaauuugaaaaucaaauaggaaaacucccuuuagacuucaucuauuuaggccauaauuguaaagaacuacaaauuacauuuaccacacuauugaauucuccugagauucaauaugaaauuuacagaaagggacaaauauuugcaggugugguuuuuuguucguaaugaauacaauuuuucucucacauaggaugcuuucucucuuaaugucacuacauuuuucuuaauacaaggauuaguuuaugguuuuuuuuuuucacaaaaucuguauugaucuuaaguaauaaugcuaaugcuuacauguaaugccaacuuauauuuuagcuaagauuaaauuuuucuuuacuccaguaacuaugcagcauacauuuucuuuuccauguacauuuucagucacauaacuauauugcuuaaagaggaaucuacucucuggaaagauuucuauaaacguucagaaaaaaaucaauccuccaacaauuacaguuaauauauuaaagauaucuggcugaugguauucaaauaacuaaaauauggaaaagaauugaaaaguuagcauucugacuucaaaauagcacuaucaaguauuuuagaagcuaauuagucuccauguuuuuuuuucuuaagacaggcuuucacucuuucacccaggcuggagggcaguggugugaucaugggucccuacagccucgaacuacugggcccaagugauccuucuauuucagcuucccaaauagcugugacuauaggcagguaccacaauguuggccuaauuuauuuauuuacuuacuuacuuuguagaggcaaggucuagcuauguugcccaggcugaugucaaaccccugggcucaagugauccuccugccuuugccucccaaaguacugggauuauagggaugagccacuucgccaggcaucuccucauuuuuaaaaugaaccccguuuucuugaaaucugaacaaaucugaauaccaguucugaaaguuaaaauggucuuccacauaacauauguacaaaguuaacauuuucugcauaaaacaaucagucuagaacauuccuguuucauuugaaguauuuucaaauaugaaagacauuuacacaauuacagaggcaauaaucccacgcacguuauuccuucaucaaaucuaaacaaggccuugggggucauaacauacuugcuccuuacaauaugaaauauaagugauuauccuauugagacuugaaaugcaaagcaaagauaauuaaauuguguauacuguuucuuucaaaugcaucagcauuugaaaguuuauauaauaucuuucuuguucagauaaacaucuccaacuucuauggcucauauuuauaaacaauaugauagggauuaucaggcugacagguuaaauuuauuuauuuauuuauccauuuauuuuauuuauuuauuuauuuauuuuugagacggagucuggcucugucgcccaggcuggagugcaguggcacaaucucaguucacugcaagcuccgccucccggguucacgccauucuccugccuuagccuccugaguagcugggacuacaggcacccgucaccacgcccggcuauuuuuuuguauuuuuaauagagacgggguuuccccguguuagccaggaugguguccaucuccuggccucgugauccgcccgccucggccucccaaagugcugagauuacaggcgugagccaccgcacccagcaacaggugaaauuuaauagguugaacagucauuaauauuuuccuggaauagacauggacuguccucuuggauaaauugucuccucuuucuucuaacuaauugucagagcuuagcucucucacaucaauaucuucucuuuuaacaaaacaaaaaucauaacgcuaugcgccaugcacuguuugcagcacuucacugucauuaauccauuuaauuaucacaacuacgagguagguacuaucauuauucccauuuuauagauaaggaaucuaagucaugaaggcuauuguuagcaauuaguuuauacugccaucauaaugacgugguauuccucuuagucacacuucaaugcaagaaauaccaacauuuuaauuucaugauuuaggugaauuugaugugauacacugagauauaccagccggcaaccauggauguacugugagcauccuuuguaugcagcucugugcuagggaagaugaaugcaaugcagggcaggacugcuuuccauagggaucucacucucuuguugaagaaacaacuccuuaauggcuauggaaauaacuauaaguccucuuccuuuuauucaccuagcacauaugcauugagcugcuagugugcauaaggcacucugcugugugaugaggggacugcagacauuaccacaugaccuagccagaccuuucuugcagggcagggacgggaacacugggcaccucagucaucuaggugaucuguggucacuguugccacacaguccccugaguugcugccuucauuuuuuaccgccuuaucaaaucugccucuuuaaguccauagcaaacauuaccucuuucauaacacucuuuuaguccucuuuaccucuccuugccccuuucuuuggggcacuuacaccacuucaugacauggccuaugugcacucaucuucuaggugcugaauuacuacagacucagggaacagaggguguauccuauaaaaccuuaauacacccucaucucccugcacccaguauauggaaaauacuuauuuuaauaacaauaccaugacaaguagcaaacaucugacaagugcuuauuguaguaacuuauuugacuaaaaggaacuuacacuugaaaccaaucuaaugguuuaucuguucaauggcaaugcaaauccuagguauuuuuugguuuuguuucugugucuacuacuuuauaagaaaggcuauuaccuuauaauccugucuguuauaugagcacuacuuugcaucauuacaauguaggguauuauuuuuaaaaacuuagaaaacaaauaagcauuccaacccucaauuucaagaaaauaaaucuucuagacccaacuggacacacaaucuaugaaaacauaacuaggauauuugacccaucuauguguuauauauccuaauagaacagaaaccucucuaauaaacaugaauaaagggcuuuagugaaaaaaaugugcucauuaaggagucagauuuuccacugaaauugauaauaaauguuuuccugaauuauugcaauuuauuuuaacauacuaaauaugaucccagaauuuugaaaguuaucucuucuuauguaggauuuaaaguguaacaaggcaguacuuuuagaccugagauaauauaaccacugugaaaauauaauuuauauaugccagagacuuaauacaccagaauuuuuaguguguauaauucuggauauuugauuauuuucaccuaaauuagucccuuuaucuuuggaucagcagaacauaacgaugucugucuccuucuuggagacuggucucuuccacgccugaaggccauugcugugaacaguuuuuggugcuuuugcagaacaacagaagcuuuggcucauugugcugacccugaaagugacuuucugaaauaaaucucugucaauucacuucaacuauaugcucccaaugggcaccccucuuacugaaaguaacaaagagcuuucaacauaucagguagcccacugugggggcucagaacacagugccugacauaucuucagcuuguugucugauaacacaccucuuucauaugauuuccucucugaaaggaaaagcaagauuaaauuauaauggagggcugugaaauuuuuauuuggcuaauugaaauuuugcuguguuuaauauuggacuacaccagacauuucuauuuauaucauuuagauauauacuucgauauucaaccuuaagaaaaauaccacuugaaaaaucuccuucauggggcaaaguaaugacucaguguucgguuuaaaguaauagacucucaguucaguucucaguguaauuaacauggugagccaaagggucuccaaauauuucuaucauugugaaguauagaucauuccucucacuuaguguuaaauaugaaacggaauaaggaggcuuaauuuagccuuuguuccuggcaacagcucccagucugauaggauagagucaagagacauggcucuaguucccauuuuggcuuucauuaguuauuugauguugagcacauuaaccucucugggccucaguucucuccccugggaggggagagcauuagacuugauggaugcagggggcucugaccacucuaaugagguauuaucuuuuaauuuccuucuuuugccauguacuuccuucugccuagaauauucuuucuuaccuuuucauguaacuccuucaaaaauuagccaaacuauuaccuucuccuugaauuauuucaccccuaauucacuaggucuaauuuaguuaccccauguuuucugcucccauagcaccgugugugcagcucugucuuagcaagcaugacacaauaaaaugaacacugaagcacuugggagccuccccuaauagaccgucuugaccauuggauucuuggugccccguacuuuaugaggacauaauggauacugaacuaaaugucugcuggauaaauuaauuucucuagaaucucagaggauauggcuugugacuuauuuuacuauucaucuccaggacuaagcaugauauuugacauauggcagauacagaaguaaauggauauaauuuaaccaauaagucaaaaaccuagugcuuugcugauuucaaauagacaguuaaauggucaugucuauuaaaaaggagagaauuaaacacauuggucaaugaacgcacaggaugcuaacuagguaggaaaagaauauuaaaaccuuugcauagaaaaauaauggaaauauuuacaucgaauguuaaaaguaguuguguuugagugaugagauauaguagucuuuuucugcccuaauuaauuuuauauauuccaauacaaggaguauuauuaccuuuaagauucaaauaauuuaaaaaaacaaauaacggcaaagcacaguggcucacuccuguuaccccagcacuuugggaggucaaggcgggaggauugcuugagcccaggaauguaagaccagccugggcaacauagcgagacccugucucuacaaaaauaaaaaauuauccaggugugguggugcaugccuguaaucccagcuacuugggagacugaaguggaaggacugcuugaacccagcaggucaaagcugcagugagccaagguggugccacugcacuccagccugggugacagaaugagacccugucucaaaagacaaaacaaaacaaaacaaaaaacaacaaccaaacaauaaacuuauuuaugagaaaagguaaaugaaaacauuaaguacucucauuuuugcccuucugagaauggcaauguauauuccugcaaacaaauguugauacaugaaauacaaggaacuuauaugaaacauguguucauaaacugucuuuaaugaaccuuaacaggcuuaaugaaauguuuaaaacaaugcugucauuguguauggaggacacugugugagcccuuuuucuccuucucuacuuauugaauaugacaguuucuuaugauuaaugaauauaauuugaaguguuucacccuucuacuccaggauucuccucaugugcuuagauguugguauauuucaaagauguacucauggaucuccuuaugcuaaaacuuuuguugcaaucacuuucaagcuuagauuuccaggucccuacccccaccccgcuccacacugcacuguacuuuguggucacugauuucuguaccaugccccaguauuuguaguccccauuauacuggagugacauaguggccuaugugaccauuugacaguucacugagguauaagugaaaggacagacauuguguuugaguaaacuccuagaaguccaaacuuuuuuucugaauaucugagucaucacuuuaaaguuggguacauauaugacuuguuuacugaauuaauaaaguauauagcuccuaguuuuuacaacuuaaaggaaacaaaacauuuucauccaaaaacacuggcuacaucuaguggguuguuucaagguguuaggguaagguuuuuuaauuaaaugauuagacugugcagguuuuaaagucugugcuugccuaguucccacccucccaucccccaguaccuagcccaaugcauggcacguaauaggcuuucaauaaauaaugacugugaaugagauuauuucagaauccuccuuuguuaauuucccuguaaguuauuuguuucuuuuauuuuaggcaauuucaggcugcagcauucucauuuagaaacagacacaagggaagaaaaauuggcauauuaauuaaugggugaacucauucucaagaaucucccauccuuaaguauauuauaucuacauggauuauacuagaacuaacacauuaugauuauauauuuuauugcauaucuuuaagcauauuauagauuaauuauggcagaauuaucaauuuugguuacuguuaauuuuuggacacuguuuaggaucuucccaugccuuguggcaaaggcuaucauuugcuuaaacaauguucauuuucaagcacucuuuuauuuauaaagccuuuauauuuuuggagguaacaauguacccagguaaaaauacuacaccucucuauauuuccagcuuucuuuauggaaaagaacuggcaaugagcagagaggaaguuacauggugcuuugggaaaacuuuaaaaggcaagugcugagcuggcaaguguccucuugcuuuuccugucuggaauggggauaagaagucugaaccuaggucuaugagacaaccuugagaauggagucagcacuauggaugucagugcugaaacauagaaggaaccuagauacugaugauacucagagucaccaggaccauguuugucucuggacuucuuuuuuuucuacaugauauacaaacacucaucuuuuuaguauuugguauuugggucuccaauaguaacugaaucuaauucuuaaccgauuccccucuucuggggugaguuugcuagaaaauccacuuucuuuuuaacuuucucuucugcaaaguuguuuuaugaacuaaguguucugaaugacuucccccugccccacccccgcucgcuuuuguugcccaggcuggaauacaauugcgugauuucggcucacugcaaccuccaccucccagguucaagcgauucucuggcuucagccuaccgaguagcugggauuacaggcacgugccacaaugcccagcuaauuuuuuuauuuuuagcagagaugggguuucaacacauuggccagaauggucuugaacuucugaccucaggugauccacccaccucggccucucaaagcgcugggauuacaggcauaagccaccaugcucagcugacuucucuuaaauuaggauucaaugaagacuaacauucauaaauggaacuucuuguugucaaugugucaaguggaccaguccaugcaggguuuuucauuucuacauuucaucucauauaauuuuccugcaugcaaggauaggaugcaggaaaauuuuuguagaacacaaaagagauguguugccagacagauagggguccuaauuaaucccaacuccaccacuuacuggggauauggcaaguaugccucuuggguugguaacugugccucuuggguaaguuguccuuuaguguauaagaacaauaaaugguagacauuaucagaauauuauuggcaagaccuccucauuuggcacacuguuccuaccaucagaguaccuggccugguagagccaaacuuuuaggauucagggcucgcuauauuuuauuucugcugcuuucagugcuaccuauuacaauaauguuuucccuuuuguuuucuucgugucuccuacaaaugaugacugagaacaaccucuuaucaaaacagaaucuaaaauaucaccaagagaggcaugaugggcagccauauacuggucugggagccauggaccugguaaccugaucaucucugccaucuaccagauguguggcuuugagcaaaccacugccuuccugguucucggcuuccuggucuguccagccaucuagagucagucugcauggaccugauuccuggcauaggcacuugcuggcugcaagguccugggcaagauagugacccucucuaaugcucagugcccucaccuguaagauuugauuaauaaugguuucuccccauccuguuggggugaugauuaaaugagccaguugauagaaagcacuuaugccuggagcuuaugccauaaacgacuuaugcuuagaccuuaugccaacaugauguuaugguuguuauuauuauaauuaauuacaauaugagaauuuggauuguaggaucuuuaagaauuucuacagauccuuuaaaaaauaguuuucugagcugggcgcaguggcucacaccuguaaucccagcauuuugggaggcugagggaaggagaucacuugaggucaggaguuuaagaucagccuggccaacauggugacaccccaccucuacugcaaauacaaaaauuagcccggcauggugguagaugccuguaaucccagcuacuuaggaggcugacacaggagaaucacuugaacuugggagguggagguugcagugagccgagaucuugucacugcacuucagccuggguggcagagugagacuccauuuuaggaaaaaagaaaaaauaaguuuucugucuuuguucuacaaucgugugguuuaaagacugauaucauccagcacucacugcuagcccaccuauagaaaucuaacucaguggggauuccugcuacuuguggggcaauaccauuagugagauuaaugcaucauguuuaucaucaaguagcacucuaggugucccaugacaaggucucagaaugcaaucaacggcccggaacaccagaaugguugcugcuggagcacucugcauaacuggagcaguacaggaauaagagagggaguggccagaguccagauugaugcaaucuguccugaaauaguagaguuaaggacaggccagucaaaauaaaugaguauaagaccacauugaaagguuaacauucaaauauaggcuauagggaaauaaaagcuauugcugagaaacaggcuggcaaaguugaggaugucaauuuuucaauaauggugcaaaagaacaugggaauaaaagucaaacacgagagcaaugcugggaucugcagaauccacauaagcuggaccuggcagccacaaagcugauuagaaaugcagaagcucaagacuaccagucccucaguaggcuucuuguggcuucugaaauucaugcuauaaagaucacucuuuugggauaaagcaguaugcaugguccucgacuuacaaugguucaacuuagaauuuuucaacauuuugauggugagaaagcaauaugcauucaguagaaaucgauuuuugaguagccauacaaccauucuguuucucuuuucaugcgauauucaauaaauuacaugagauauuuaacauuuuguuauaaaauaggcucuguauuagauuauuuugcccacccauaggcuacuguaagugugccgaacacauuuaagguaggcuaggcuaagcuaugaugguccacagguugcauuugcacuacagaccccuugagcacaccaacagaaaugugccagaggaaaaaggcacaacaucagaaagagagguugcugacagcuccccacacacauggaugccuggguccugacugauucacaguuuucauggcaaccuucaucugcugccugcuagaaggcuugcuuuuuucagguugcuaggcagaggaagcacagggauagaagaagugaggauggggugaaagauuuauaauagcagcaaugaguauuccccaagcaaaaaauaaugccaaagaucaaaucgguauuuaucugcaauuucacauguauaauaagcauuuugcaauuaucuuuaaaaacacaacaaaacaaaaccuuuccaucagaaaauuucagaaaaucuguagaaaauuucuuuaaaagcuugucuuuucacuuucuucuuuauuuucuugguaaauaaauuuguucuuggauuuuauaagcuccugcuccuaaauacuaaaacaauacaaaguauauucuaacacuaucuaauuuauaaaaagaaaagauucuauauugacuuuucuuaaaaauauuuuaggcaaauuaguaggguccauguggguuuuuguuuguuuugguuuugguuugguuugguuuuguuugagacggaauggugcaaucucggcucaccacaaccucugccucccagguucaagcaauucuccugccucagccucccaaguagcugagacugcaggcauaugccaccacgcccagcuaauuuuguauuuuuaguagagacgggauuucucccuguuggucaggcuggucucgaacucccgacgucaggugaucugcccaccucggccucccaaagugcugggauuacaggcaugagucaccaugcccagccggguccauguguuuuuaagaaaaucaugguuucacaauucugugaguaggaauuuuauuucuuuauauuuucuaauugauuauugcuaauauguaagaucauucauugauguuuacauguaucuagacuuauugcuaaacuuuuaguucuaagaguuuucuaauugaguuuauugacaaaauggcuaauuguagaauaaaaaaauaggauauuacaaacaaggaaaacaaacaacuaaaauaaaaauaaaauucccaaaggaaacagcauuuugggagagaaaguaacaaaagauuucuauagcuuuuuuaacaaaagaucucuaaauauuaaggaaaaaaaacucauuuuaagacugcagaaaacaaaaugaguucaguguauguauuuuauaaacauuguaaaauaacagucauuugaauauauuuauuccaauguaaacagguaaauacugcgguaauggacagacggauggaaaauaacagacuuacacagaaaguuaagucuaaaaagucacaagucucaauuuggagucagaugcuacaagcuacuucagcuacccaugucuacacaaucaggcacucaacacacucagacauaaacaacuuggugcugugccuugaauauuuuuuuuaaaauugcuaacaaaacaauaauaaacucuguguuugagaguccuaucaggcugguaaaacuccauuucauuuuguguucaaaauucuauaauauaacggagaguucaagucaggccucuguuuuuccauggcuccagguaacaugauuauguuggaacccagugcacacuccaccuguuaauaucgaucuuucaggaccacuccauggcauugucugucagugauagcugccuggucuuuaaugcaagagccuuagagaaccaaagguuuuauuacauuaguauguuuuugaccaauucuaccuuaucuaccuauucaucuuagcuuuaaaacccaauuaaaaucuaauuuaucugaucucugaauucugaguacuauuuggcaaugaaucaaacagccuuguaguaacuacauuacuacacauugugcccuaaaguguucuagauaauacuuuuaaaaaaaauuggcaagugccauuuaaagccauggcuaucucuuuggagccaccuccaucucauuugaagaacaaaugcuuugucuuuaugcaaaaagugcauacucugauuuuaugccugugauuuuagucauaauuuaagugcauaaugcgaacagaucgcucgcuguucuuacaauucgguucacucucuaaaaauguuggauaauaauauuuucugacagcuacaaaucccuccaacacacauaagcacacacacacauacaggaaagugucuuaaaaucuuccaaauugugaaucuacucauauguauaaauguuacacugagaaauaucuuuaauuagacugucaauccaaauacaucuucaucacuguuucugauacuccauuuucugaaacugugaaaaaaucauauaaugaggauccaaauucuguucuacaaaucaagcucuacaauguauauguuuauucauauuauuacauaucuauaaaaacaaagggcucauuugcuuuacacaaugaaauaggcgacagugagcugguucuccccuccucccuuacuucucagcuccuccuugguugggagaugggagcagauuugagggcacugccauuuuugagggaaaaccacuguucuaggcuuuuuuccauguguuuucuaauuuaacaguuaaaauagccaugggaaguuggugucauaccaaucaaaucugaguaacauagaguuuaaaaaacaugucugccucaacacaucaugauuaaucccacccucuaaaaggucaauagaaugaaucucgaaaggcauguggaaugucuacaagaguaaaaacaaaaacuuucuucaucaguguuucucaaagacuauuuuaaauagaaccaggaugggacauuaagcaccacagaauuacuuagaaagaaauguaguccucuuuuaauugucuuuucagucuucugauuagcuuuagaauacagucuucauuucuuuuacuuuaagccucuccagccuguucuaaucuuccuuuuuaauagagggaacagggcccuuggccggcuucaguaucuucuuaauauuuaauuucauuuucaugucauuguauuuuuuucugugguuaucuucuaauuaugacaaaugauacuaauguuccuuugaaggcauaguaauauaccauuagccuuguaaauacagaugauuugaaaagugagaaaauuuagagaaauaugaaauaaugagggguaugugcagauaugucaagaaaucaugagugaagacauagccugaagauugcagacacuacaugcagaaugcuaagugaaacgauggauugucuuccacgucacguagacuggccccaucuuaugagcagguuguuuucucaaauuucauuucuaaauuuguuguuuguaacacugauaguaguuuccuuuauaaaagugcuauauguggcuguuaguucuuccagccaggccagaaaacccuaacuuagaauguaagucaacuggcuuacauuugaaacaaaaauugauguuuaaagcaaagcacuaccaaauacuauuaugauguugacaauuaaguagaaaugacaagaaauugaauaagaaaccucuauguaauuuuuaugaauauuuguuuuccauugggaagaauauuuaauaagaagggaggaagaggucauaaaaagacaucuggaggucaauggcauuauuuucuauguguaauuucaucacaaaacaauggaaacuaccuucacaucaauacuuagcaaacaggauaagaaaaguggcucuuucgcggcuuacuuaggucauguaacaugacagaaaacgaaagaaaggugaguguggggaggagauaagagaaaaaucuaagagacuucaagcuucaagacucuucaucugcacaggccuccucuaaauccugguaucuaauguuuauucaugauuuuguauuauuuuuaacuagagucucccaaguguauaaauuuuagaccucuaccccuggaaagacugugaaacuucucuaauauaaugaggcaagauggauuaaggugaggaacgauggcuuaagguaaggaaaaugguuaugccaguauccaaaagaaagaagcuuccuuagacaacuuuaauuaagccugucuacaacugagguggguugaaagaugcuaggaaaaaaaaaaaaggacgcuuggaguuuccagaaacagccacuagaugguggcacucgaagggccagaggaugccgguugcaggcaagagccaagaggaggaaaagggggucggguugucuguaacucuguucccacagggcacauucaggaaguagaggcauaaauaagggauuuucaccauuccuccuuucacagguaugacaauuaaauaauaccguaaacuguagauaaacuuuguaccuuuauaaggcauucaaaagcauucaccacugaaaauucucugggugacuacagagaaaaaaaaaaaaucccagcaugagaaaaaaaauaaaaaaaaacaaacucagaaauacugaggaaacgaguacugccucagaaagaaaaaaaaaauagaaucaaacgaauaugguuuucuucacauuuagaauacacuaaauagagcacauuguucuuuuaagccucuuugacucugaugucuuauuagaaauccuguaccaaauaagcauaagccuuucauuuuaguuauuauuaaaucucucuucauugccauucuauaacaucagcaugcagauugcucaauuacacgggaaacgguugcagcaugcaagucugcccucuucuggucauguccuuugacaguccaaagaacugugacuugcauuuaauuuugauuucaacaacuggguaaauaaaccuaaaaagggaaaaaaaugccacucaaaaaggaaaucucugcaaggaaaaauaacacaagguguauuauuuauuacugccaggccucugucaacauucuuucgaaaauaaucagcaaaccccaaaacguuuuagagggacaauuuguaaaagguagucauuucuccaccccaguuagauuuaugcauucaucucauguauagucuucguauaacuacaaugugacaccaauucuucuauuucaaagauauuugaaauguagaauuucacuagagcauugaacaaggugagccagacugggcugaucaugagaucaacuaaauccagggcacuaaaaauaaaugauagccucucuuugugaggcugcaguguaacaggagaguguggggucaaaaauagggcaaaauguuaacaggcaaaucugaguaaagcauauaucguucuuuguacuuuucugcaacuuuuuguaaauuuaaaauuauuuccaaauaaaaaguuaaaaaaaaaaaaagagagagagagaaagaagaaauacgggcucugggcagaccagucuaaauugugguuuugccuccaugugacuuuggacaaggcauuuaauuuuuuggaggcucugcccccucaucuauaaaacaaagacaauaguguucuucccuaguauggcugucagcagaaucaaaagaaguaauaagugcaaagcaccuaacaccacggcuggcagagaauagccugucaguaauguagucauuauuuucauuguuguuauuauucauuagggaggaagauggguguccgucaaggagauaaugcuaacucugcucccccucucuggcaaacaucaaaaaaauauaccaacuuuaacuguauaacuuguuaaggaucuaugcaacugcaaucucauccaaauaacuauugagcccuauuuauacauccauucuaaaauuccucuuagcaaacucauucaaacuucuacuuaucuuugaaaguaaaaccuuggugcauuuauucuaaaucuaucucuuuucaguaaugcuaccuacauuuguaacauaaaauaggauuuaagccauugggcuagguucuuucauuacaccaaagggucccaugucuuuuuuggggggaaaugaggaagagcucaccuuguuccccucuguauaucacaucugguagugucuaauccugagcugcagagcaaggacacagcuuucaucacagaagaggcaaccagucccuuaagccacauacccucccuacuugggaugcucaaagacuucugggcugggacuugccuuuggaaugauguaaggacaaugggcuuagaauacaaggaaagcugaguguaaacucaagucccaccuguaguagcucuucugaccccaaucauauugacuuauuugagccucaauuuauuuaucugugaaaugggaacaaccacucaacaauuuuguagaguugcacaguuaaagauaacacaugauuuuaaaaguaggcaaauuauuauugcuauuaguguuuggcuguugcugauauuauuagauuggugcaaaaguaauugcuguuuuuacaguuacuuuugcaccagccuaauauaguuaaguucuguaaucaggccaaauugauuuucaucuucuuaauucaaacacaaagucagagaaaauagaauuucuuuuuaaaauguauuuggaugauaggcaaaauuaaaauaguucaagaauguuuuucagaccauauaggcauauaauuuuaaagcucaaccuuagaaauuauguaucucugcuuucucauuuuauacauaaauaaaauauucaaaguuuauaguuacagcuuagugccgaccugaaccuaaaacauagaccucuucuguuuucauuuuggaaugguuucuauuaccucauggaacuuccuuaaauuuuauauuuauuacugaucuuuaaaugcuccauaugcaauguuaucuggagaugugaucaagcugucacaacuauucaaaaaauguuaaaaaacuaaaaccacacaaagcauuaaugcagguaaaugaagcacagaaacauuuuaagugugcuuaaaagcauacaggugguuagaccauguaaagaauaguaauuccagggcugggugcgauggcucaugccuguaaucccagcacuuugggaggccgaggcagguggaucaccugaggucaggaguucgagaccagccuggccaacauggugaaaccccgucucuacuaaaaauacaaaaauuagucaggugugguggcaggugccuguaauccuggcuacuagggaggcugaggcaggagaauggcaugaacccgggacgcagagguugcagugagccgagaucuugccauuguacuccagccugggcgacagaggaagacuccaucucaaaaaaaaaaaaaagagaauaccagaagcccaaagaucuagauuugaauuucagccucuuuguuucacuaggucuaguagcuuaacucugugagauucaauuuucucauuuaaaaaaugaagauacaaauccuagccgaacaguguuguuagaaagguucaauaugauagcccguaacaugguggguacacaauaaauauccaauaaauauaagcuuccucugcccgccccuuuuuuauauuaaacccaugaaucuaugaccuaagagaaaaugucuacccaauuuacacagagguugcucaauaaauaccauugugauuauggugguaguggugauguuaacacagaaaacaaaaacccuauaaagcaugaaaugauaacuauaauuguccaagauauccacaaacaaaaaucuccacuuagagcuaaucaaauauauaugcuagaaauauugacaacagagagcugaccuaaaaugacguacguacagacaaaauaaauuaaugacuggugaaacacacacuucaaagaucacagggaucaacaggaucaaugcacacuauuacaguagacacauucaaaguucuuuuucuggguaucaacaggugccugucaugaccacggcaugaaauacaaaguguggugguaaaaaugcaaggaagaagauggggugguuugucaaguuuguaacucaauguaugugaugaaaaguuugaggaucuaguuuuucaauauucaauuaaaaauaggccuuguuaaaauguacaaagucuugaguacucauaaacuagcaguuacauaaaauguaaaucauacuuuauuuacacuuaauauugggaauuauuuucauauuguaaauugaguaguucaugguguacacacagcaagcuuacuucaauaacuggcucacuuacaucauaaauucaagcugaaacaguauuuucauugaucuagcauuaagaaaacaccaaaaaaagaaaaaaaaaaaaagaaucucacacacaaguaucucagcauagguggcugagagguggccggaguuaaaagacaaaaccuuaaagguuuuaaacuaugauuucacauacucucaaaucccaaguucacugguucccucuucuccaucacacaguuagcuuucuccccugcuccucuuucccuuuuaucuguuucuucucuuuccucucaucauucuucuuuuccauccuguauaacuauaauaaagcauuguuuuuucagagaaagggagggcucuggagguagaguguggggaggaagggcagguccccauagccuuuagggcucagguucugcagucuggguguacaacaguaagaguugcuccacucagccccaggugggugaggcucguccccacagaaauccauuggaucagaauguaccucgguccugagcuuuguaagccaaccucaucaaagaaucugaaggugugagagaggcucaaugggcaguugcugaccgcaugcauuuuaaacaguaccuuccauacgcaacuguuuuugucuaaaaagcuagugcuggggauuuggggcaguaagacuggguaaggagagagagauucugagaguaggugaccucuccaggauccacaaaucccuggauucccauguuuggauuaggagccuuguauagcauuaagcugaacuugcuugccuguauugccuuugcaaacaucugcuuguauuuuugugguugucugccucucuccccuuuuaggguacuaccaacugaaaggugaaacgaggcuucccagacuaucugggaugaaaaguaguuaaaaaaacaaacuuccaguccauugagaacugaucaaccuuuguaaaauucugugccauuguugaggaaaugcaaaauuacuacaaaaguuucuaaaugcugacaauuauuguacauaucuuguugaagacuaguaacaaauagcuuacagacuagugcuaguccucacaucacacuuugaggaccauggguacaaaucaauuaagaaaugcauucuccuccaugaccucacuuauauguggaaucuaaaaaagucacagaagcauagaauagaauggugguuaauaagggcugggauaaugggguaaaggggaguggguauaggggagaaaaagaaaaacaaaagaaacccauucuucauaauuaaauuuugcauuuuaaaacauauccgauauucauagauaaauauaauuaaaaagacaagaugaauuuaaaugauauaaaacuacaacuuauuggugagucaauaacauacaaggucuuuuaaccacuaguuaacacauacacagugaacaguugcauugugcaggauauuaaugcauauugcagaguuuaauggauugaaauucugcauacugaagaguuuaauggauuaaaauuaucccaugaaauuucauaauuuaaaaauugucuaaucaaaaucaccagauauaaaaaaaaucauauauuauuuuuacaguuaacaagucaagucaaauacagguugaauaaagaggcaaauuccaaguccaauugcucugccagaaagcaagcucuaaaaucugcuucauacuguugaguaauacuugcugcagagaaaauucuuaacaagccagggauauuccaaagaccugccuaacuguaccuucaacagaaacauacuuugcauuuuaagaaguaaaauauuaauuugaugcuuaaagaaaucauacuagaguugaccucccuagaggaauggacucacauuaggaaugacuucauagaauagaauugauuuucuggcagcaacaucagaaaauauaacuuccaguuuagccuuuggagaaaacuugcccagaaucauuaucauuaauugacagucagaagaucugggcauccaggaagucuauaguggguagccagauucaaaguacauugcagaaauccaaaauggacguccaggcaucauaaugcaauccuuauuucgcaaaaguuucauucuccaccaguugcaccaaggccugguugccuuuacugucuccaggaacaaaggcaaauauaagagaaccuaagguugcucuacaaagguuaugucaaagaguccucugaagugagggaggagguggcuagaacccguguucauucuuucuuucuuucuuucuuucuuucuuucuuucuuucuuucuuucuuucuuucuuucuuucucuuucucucucucucucuuucuuucuuucuuucuuucuuucuuucuuucuuugagacagagucucgcucugucacccaggcuacagugcaauggcaugaucuuggcucacugcaaccuccaccucugccucccagguucaagugauucucaugccucagccucccaagaagcugggacuacaggugcgcaccaccacacccggcuaauuuuuguauuuuuaguagagaugggguuuugccacguuggccaggcuagucucaaacuuccaaccucaggugaucuguccaccuuagccucucaaagugcugggauuacaggcauuugccaccacggcuggccaggaacccagauuacuuuuuaugauauggaagaacuauccucaucuuugcuaaaucauagccagguucuuucuguguaaaugaccuacucagccagacacuagguaaacugcaaaauuuuuccgucaagaacugaugaauaagcaauauggaacugauuaucauuuccagccugaucaucuaaaagcccaaacuucccucucauuuuucaaaccagcuucuuguauaaaauggaccaaagaaaacuagacaaguagaauacaaggaaugaagaauuuccucgaugauggggccauccuacaaccaacagaugcaugucuagaaaauuaugaaagugauaaugucagggaaaggagaaaccuuaaaguucagccucauguuuuaauuucuaguuacagcauuccugcuaaaugcucacaacacacaauccagugagagagaacucacuagccuuugaggcagcucagagugcuucagaugauagaauuuguuggagagcucuggcuauucuaaaguuuuugcuuucuauugagccuaaauauuucccuguggucauacauacaguuucggaauacgucccuuuuuuucuuuuacaaaagaguucuuuaaauauuugaaggcaguuauucuccucucacuaucuuuuucuaaucaaaacaucucugauuccuugaaucuugcaauuuugaguaccuaccugucugguuacucucugaaaauuacuacuauaaauuucccccuggaauuaauuuacuaccuacuuuuggaugaaaugauauauucaguugcuaauccaccaaaaugccccuaaagcuacccagaaagacauuaaaaacguggaaagucuuugcuggagccccagucccugucacaucucccugucaaaggaagguuauccuuacauggcuuguauuuaguaaacacauguagggcugugguauuuacagauacuuaaucuaugaacccacaaaucaucccuuuaauaauguguuuugcaauuuugccuguuguuauuaugaaacagacaauauauaccucaaggucaguauuaacuauuaacuauuuuuaguuauauuuauaguuaauagguaacuauuaacauuuuuuuucauguauuguuucaggaaugguuggacuauaucaccugauaaaucuaucaaaggaagaaguacauuucccagugagauuucaaaccaaacuaagaggcguugacccuaucugauaaguaugaauauacaugaagcugcuggaugauccaccucuaucaucuguaucacccaugcaaaaugaaacuggcuucaggcugauuggaaauugggcagacacauugguuuuccagugguagguaauaguuuauuucuuggauaauaauguaucaaauuucaucugacucagauucaucuuaaucaacaaaauacccuauucucuaucaugucaugaacaaccugaacgaccacaauguucaaaauguaguuauuucaaaucagaaauaaugaauagaauaguauauuucuggacacuacaagguauaauuuccuugaagguacagucaguggcucacuuauucaauuuuuuccuguuccaaaguaucuacaauaguguuuuguauaaaauggauaccaaauaaauauuugaacacaguugaauaauagaaauacuacccgauguaagucaacaaagugcaugacaauuaaaaccacagcugccauaggacagagaacaaccuaaaggaaggcuccagguaacagaucacacuuagacaagauccuugagcuucuuaagggguguauccugagguauuaaugaaauuuaaugcucacaauccuucucuaacacacaauuuaaaagguacaauuaaagaauaccugugaaagcuaaaugaccccuuaagauucaacaaacccaacguaaacaugaguaucuucuauaaggccaaccuuuuucccacaaagaaauaauuuuuuuuuaacuuuuaaaauaacaaccuggaaguuauuaugcuccauauauugagccaaaaaugaccaccaaagaggcagauacuggccuguccacuaggccaugauaucagagccuucaaagagacccuggaaugugagacccaaacccaggccucagcagaacugcaacaugcuucauacuaugaguuuugauagcauaaugauuaaaucaaaagcacuaauagucuacugugugaauacaauaagcaacaggugaagacaaauauuuacagaguaacauuauaugaucaaaaccuaauauaugacagauuuuaaacacuguuaaaugcuuuucuucaaaaaauauugucaaugaauuugaucagcccuaacuuagcugacaugugaguucaaugaauaauugauaaauacaucucaugaaaagagaaaggcaauauuuugguuccuucucccaucuaucuucuuguugaaaaaaaauccaucuucagguuauuuuaguuauucuccuugaaucuguuuuucuccuuuucauucccacugucuucucuguaguucagacuccauugucuuccaucuguacuuuccuaaaaguccacuaguaggucucuauggccucuuaucucccauggacacucucaagagccacucuccaccucugcaggcaggauagcuguucccaaacacugcauauauuaccuaauaugaucaugauaacaccaagcccaaccaaaacaaaucaaaccaaaacaaauaaaaauuuaauaacugccuaccauaauaaagcaugcauuucuuaauuuagaauccuaucccucugcaacuuaaucucaacuuuccuuugcaaacauauuuuuucucuauucgauguccuuuaaucuaaucaagcaggcuucacugugcucagaauguaccauacacauuccuauaacaaauuuugcuuuaugucaucccuagccccaaaguauacucuccaucuuugauuucucuuauugcuguacaccuuucaaauauuucaagcucuacuucugucaugaauaauucaguaucucaacccagcucucucucugaaaaccuaacucauaucuaccuauuucuaucuugauaugcauuugucuuuauuauuuggaagggacuuaauaggcuuacaacauuuaagaccugcacaauaagucucucauucuauugcauauuauuuaauacuguuguaucuaguauaacucccaaaacauaacacucaauaaacucuuaauuuuuuuuccuguuuuagauguucaauucuaaauuuuauuuauaaggaaauaaaauugcccuuacccuugucagcaaguagcccccgcagcacuguuauacuauaauaacuauacacauuuaaaaccuuauccucaaguucauuaauuaucauuuccuuuuuguguuaaagaaaauaugaacagccugauuuauucagccaguggguaagcauucguucugcuaaacuguauggguauaauucaauguuucauuacaggauaagaaaaggccuccaguucaucuguagcuaucaggaaagaacaugcuucacaauaaaggaaauaaauaaaaggucuuacgggauguuuuggaauauuauaacuuauguaugcugcaaaauauuacaucuauauucuucuaaaaacuaaaaauccugacacuuucuaaagaacauggugaaaaugaugcaugccaagaguucuaguaucguacucuauaagacagcaugcuauucuucaccuggaagguauggcauagagucacuggggaauaaugaaggaaacccuguggaguagaauauuuaaccaggaacugcugagaaacuuagguuaggcgugaagagggggccagaaccauucucauuaauucgaagagauuuuauacagccaguauaacuugauagccaaacagugauaagaagcucauaauuugugaauucauuuggauauuucaggauaggucugcuaucugcaaagagcugggcuucucuauucuaucguaaucuucagauccaugaguauuaucacagauuggccgaaaaucuaaauaauucauaucucccaauuaacuucccugucaauuaucuggguauuucagaaaaaaaaaaagucuuagauguauaaacaaagaaugccauuauuuuaaaaaucugucuuaaaaacaggaucugguuuuuuuccaaauacaauuuuacauaaaaaccaaauauugaauucaauuagugucagggauucucagggaaaaacagaucugggggacagagggaacuaagagucacacucauuccucucuccuggucacuuacuaauggggacccggaagcaccuaaggcuccaugaaaugcagcaucaaaacuaauaaauuaacuaaauuaaaagcaaaacaaauuuugcuuuuucuuauccuuuaaacauauagaugugucaaacuauaugugauuugcuaguaaauaauccuuucauuaguaagaauuauuuggugaauggguguuaaauuuuuagggaaauuuuaaggaaugcuaauaaucacaauacauuaggaauauaucacaagaacuucccuaaugguuguccugaauuuaaauauuucauguauauuucucuugucacuguuucuggcaggugaguauacacuuuauauaaaaauaugaauuguuagaaauaucaaugugcauguuuauaaaucaaaucauugggucacauaccuaauaaaaguucuaaggauuaaaaagacauaaguucaagacuaauauguaaaauaauauuacagaggaaaaaacagcaaucguacaaaagauaaauguaaccuuuaguaaacaaauaaaugcaacaaauaaaugggaauaauccauuuacaaggaucuugugguucuaaauauacugggagagauacuuaaaauuauaaaaugguugagauaauaacauuggacucgauuauccuuuaacacugugcuauggaucauauugugauaucacuugugcgacuguuaucagccacuaaggggaauguagcauucaacagacucugaaacaaaguuucuaaagaauuaucaucaugugauaaaugcccgauuucuauaguuacguuacaugaacaacaaagacaagguauucacaaccacacuuucuucaaccucuaaacaggaacaaguaucuauaaugcugucauuaggaaugagauagacaaucaaauacaacagagugccuagaucaaauagauccuccaacuaagcuuuauuccaacacauuuuaucucaccucuacuuuuaucccaaaaucucaacucacuuugaauaaugcacuuugaucauuuuaucuugauucaaccccuuggucaaguuaggguacaaaacaaccaucccuaugucuaguuauagccccugaacguagcgauggaagaaaucuaaaaccuugcuuaaaaacaaaagcaagguguggcugaagauggcugauugauuuaacacacauauuuaucacugcucuuuucugaaauuccauuaaaauuaucauauaagccauuuccuuuuaaagacauuaauucuaaggacaaagacaacagaagcaaacagcaguaguauucugaaagcuggauuucagaaagagguguacuagccuguuuagcaggccagagaaagccaaauccuaagccagcaauggggaagcucagaacaacacaauuuauacugcaaaaccccaaagauguagaaauuugagacaucagcuucuccuggaauaaagaaaagagaaaggugagguuuuaaaaaagaugauuccuugaaacucuauuuaaaaagcaguuacaccuccagguucauccccauugccaaaaaugacagaauuuccuuuuuuuuaaagacugaauaguauuccauuguauguauacaucacauuuucuuuauccauucauccacucaugaacacuuggguugcuuccacaucuugacuguugugaauaaugcugcaauaaacauggcagugcagagaugccuucaacauacugauuucaauuacuuugaauauauacccacaagugggauugcuggaucauauguuaauucuauuuuuaguuuuuuguagaacuuucauucuguuuuccaaaauagcugcacuaauuuacuuuccugccaacacaaaaugacaaauacuauacaaucucaauuuuauguggaaucuacaaaagcggaucccauagaaacagagaguagagaaacaguuccaaaggcugagcagcgagggggaugaaacacggggagaugauggucaaaggguacuuuucaguuaaacaggaggaauucauuuuagugauccguuucacagcaugaaauaguuacacaguacaauaguuaauaauaauguauuuuauauuucaaaguugccaaaagagauuuuauaccugcucaucacacaaacaaaugguaaguugguaaggugauugauauguuaauuaguuugauguaaucuuucuagaauuuauacacauauccaaacaucacauaguaccccauaaauauauacaauuauuacuugucaauuuaauuaauuauuaaaagcagaccaccagaucuucucuccuacucaaaauugcaagcaacuagguguuuauuuucagaaaaaaacaaaagucagaucucuguacagaaauggcuagcugagggcagagccacugcacugaaccccuauggaauuaugaaaaaguagauauacuagugcuggcugcuaugguuguugccucuaccauugucucuuacaugaucgacagucuccaacuagauacugaagccaauucuguauucuugaaaaauauacgauuuucugcauuagcugcauuaacaccuacuccugacaaaacaggcucuucuuugccccucuguaagaaauaucccacaaggcugcugcugucugccuucuauuuggagugcuggcaggguucugcuaggaucuguagauaccuacagauuggauauuuguccagagucuaccaucuaacuaacucugagggauucaaaauauacacauuagggaaaagaugggcacuacacaauguagggcuuuaaauggagagaauagaauaccgaaaauccaauguugucucuagauucauuaauauauaacacaaaguaaugaaaagaaucacagaguggcaauaaagagacgagaagaccugaguuccaauuuuaguuguaucuaaacaugugaccuugggcggguccuuaaccauuuguuucauugaagauagcaugcuacucauuuucaucuaaauaaucugaaaucacaaaacagagguuuuaggaaaauggguggugauccuuccagaaucuugaaagaacuaaaaaaaaaaaaaaaaguaaaaaacugauaugguuuuaaagguuuuacaagugguugaaaauaaacagaugaggaaaaggggcaacagaagagauuagaagccuaaaauuagggcagcgguggaaaaaaaaaggcaaugucuguaauaagaagagaaggucagagaaucagcaucucuuuaauuuucucaugggugcagcauuuaccacauccauaagauacacggaagaagagguaucugucuauuuuucaggaauaauagugugaaauuaaucaccagaucacaggacugaucccuccuaacacccaagugugcagacaaaauaauaaaaaaggccaaugucuuuuuuuaaaacuauugaggugaaacuuacauaauaugcaaaugaugucuucuugagucacuuuagggggaaaaagaagaaaauauuggccuccaaaggucuucacuaguuccauggcaaggaguaguggaggauaauuuagacagugaagagaaauaacaauaaauaacacugugaaaaugugauuaagaaaacggaaaaaggaaauguaugauaccugucucugaauccaguguugauuacgucagauaauucucaauacuggcauaguccaaggcuggugcaggacuggaggcaggagaauccucugggauauuugcuaaaauaaaccuucccagcucuuucccuggagauuuuaucauuuaggaccaaggcaggaaccuggaauauguguuuuuaaaaaucuccucauguccugauacacagauauaagaauugcaggagcagucgggcaaaaugcuccuuccucuuagaagcuguucccuacaauagucaccaaaagaaccuagaacgaaagcucaauucaagguguaaauggcauagcucuggguugaugcucuaagucucucagcugcauucaaaccagcagaguuaauagauuacugaagucagcaauuaagcuguuaagaaagagaauuucugaauaauccaugaggcuugauauucuccuucuggcauuugagaguacaguccuuccaaggauaaaaaaugaccuuuuauaaauggaaaaguagaugaguaggaugagguguguuugagaguggugaggugaaaguuagaaguuuugaaaaacaacuacccuucaauuaguaucucgcagggcaaagugcuggugaagauuugcucaucuguuucuaaggaauucaaagaagagauuaacuauccagcuucacgagucuccucucauauugugaaugucuaggcugacuaauauauagcccaaaaaggcuucccgaaagauauuucacuugaugauuucuuacaaaguuauuuauccccacucacaaaaagaaaccccguuuuuaacccgugcuauauuaaaucaacucuugauuugauacacuuacuuauuacaucagguguucccuaacaugccugcucauaagaaucagcugggguacuugcucaauuuagagaucaaaacccccucagcaggagacuguuauucuguagguggggcugggacucugcaaacacaguaccuacuuucaaaaagcuuaacugugacccuugucuucugucgauguaucucuucagguacauaugcaaauuauuuugugucuuuuaggaagugaugaguuaagaaauuuccaaaguccccaguccagccugcagaaugcugugaacuaaaaaugguccagcuccuccaagcccucagacacauccuuaagagcucaugccgaaacaggucacucuguagcgacagaaauaagagugagcagcuugggggagcccuuugaacugaaaagcaagcaagugacaugcuuugcaucacuuuuaucucuacuaauaguuacugggaucauucuauccauuucuugaaagaauugauguggccucugacagggccuuaaauaaagcuuuaacuauagugaaaagccugggcacugcauagugagucaugaagaagccaagcauaguuaaccuuagcuaaugcacugaguguuuuaucagguaguagagcagagaaagaagaucaaucauuggguuccaagcuaugugacugaaaguucucaaaacacauagguuauguuguuucuuuauuauuagaggagaagagggggaugaaagggaauucauuuauuuguucaaaaaauauuuauuugcagccuccuaugugccaggccaaauacaccagauacuggggauuguaaacaauacaacaucccucuucacggaaaguaaauuccaacagaggagcagaugauaacacaaacaauaagaugaugugauuuuggaguguggcaaguguuauaguagaaauaaaugcacuaauguagucaagagcaacauauuugagcugaaacuuggugggaggagaagcagccaucuaugcaaaguuuaugaaagaacacuuguuuuuguuuuuguuuuuuugagauggaguuucacucucauugccuagguuggagugcagugacacaaucucagcucacugaaaccucugccuccuggguucaagcaauucuccugccucagccucccaaguagcugggauuacaggcaugcgccaccacacucagcuauuuuuuguauuuuuuguagagacgggguuucaccauguuagucaggcuggucucgaacuccugaccucagguaauccacccaccucggccuccaaaaggaaauaacauuuuaaucagagagaugguaacuguaaaguacuuggugugauugaagcauggagagguguuagagacaucaccaaccagugaaacacucaguucuuagaguguaacaauuuucgaacugaaucaagaaaaauaccucucagaguucaaggccgcauugaaccugagcaaggaggggccccagcaagggagcuuaucuuuggaacaagccauucgggaacgagagauccagcguucagaucuucuuacauacuuuguuaauucaaagggaagguuuucccagguucaucauuuugaugguggagugcagccugcugcucucccugacaauuuugugaggucuucuuugaaauaccagaagccucuuccgagaagaucaauugugcuguccagguaugugcuguccagacuggccaaaucugaugacuuggcugucagcucugucaacaaucucagcuacuaagucagagaaagcccuuuccucucucauaauauuacuugcucuuccucauccuauugaccgaaccaccuuucaagggcucaguaaggaguuuguuugauaaggagagaaacuagcuagaguucuaagugcggaacuuaauuuugcuguugaggcagauuuuuauuuccaucuccucuuucauuuggcagauuuucuuuuuccauucuguuaccaggaagaguucauuuagagaagucugccauggauaagcugaaugauacccaaccacaggguugcuaagagauuaccagaucccagucaagaguuuaccaacagcaccgcucugaacagcaaaggccagacacucucagcuaccauguuuccuucuuccuuauuuguccaggcuuguggcauagaaggcuaccaagaggaggcuuggccaagaaccgccugccccacccauucaaguaagcccauaucccucuagcaccacaacucccagcccugcuuuccaagucugcccagucagugcugacagccuccugcuccuucaucacauguccaauauucucuucaauuucuuugaaauauuuuauaaucuguaccuaauaauugcaaacuugaaacccuguagggcuaauccauaaccgguuguuauugccaacucucauucacaguggcuuguucuguuuugcuuuuagggauucuggaaggucaacuuauguucuuuguaacuuuaucuuuggaaauuuuuugagccccagguuuaaaguauguuccucuggaaggcauuaguauuugcuucuaccaaguaccuggcaacccaccacccaaaaugccuuuaaaauacauucuggauaaacuuuaggucaugcuggaaucuagcuucuggcccugauacugagugauuaugggcuugugguuagaaauuuuuagaggauaagguguuuuuguuuuauagcucuuuaaaggccaagacagcacacauucccauuuuuacucucuguauggaaguuuuacuuucuuagaucaaaccccaaugguuucauuaacugggaauccagacuuucugcugaggccccuaaucuagcuggccaucuagcugggucaucaggcuuuguucuuugaaucaauguucuuuguccuguucuuugcaccuaaugccucacuuaaaacccaagucuaggccaugaaaagucugcaggcccaucuccaguuaauuacuuucuugucauuucuuuucuucuaguaaugcccuuacauuccuaugaguucauucaugaauucaaaagaguuuuuaaggauuucaccaggcauacaguuggaaggaagaaaaagagggagggaaggaaggagauaaaauguuggguuagagggcagugagugggggaaugagauagaaguauugauuguucaauacuguuuuuucaccgcaaugaaggcaacagggagcuccuggaguugucauacuuuucagaggaccuaagucccccacuugaauaaucaucccauaccuugggcacauuaaggcccaagaagaccugccauguucccacagggccuggauguuaccuacaucuguguuccauagcucugauggguacuguauccagaacacccucaugccagucuagaucuccuccuggaacuuuucaaagccagugcacacaugcucugggcaacaccugaaccugacacaagcucucacacucucccugucaugauucuaccagagaagauguccugccagcaugacuggagauucucccaccaccugugccugggucagcaccagccaacauaucccugcacaacauccauuggcucucuaagaucgcauuacaguaaacacaguugagcaccuuuagaaagggaguaugaucauaauaauguaagaaaaaggaaguaagaaaaaaaacccucuaccaguuucccaguuucucugggaguuagagugaaaucuaccuagaaaugcagccaaacagaauuguaagugccauguugcaagggcagaaagacuuccgugccaacuauguauauuucuuuugaggaguagauucaaaggauaguuuuucaccucagagaaaggauugguaacauagcuguacucuggcaauaucugagcaagaaauaccaauuaaaaacaaauuuaaaggccaggcacgguggcucacaccuguaaucccagcacuuugggaggccaaggcaggcggaucacgagaucaagagaucaagaccauccuggccaacaugcugaaacccgucucuacuaaaaauaaaaaauuagcuggacgugguggcaggcaccuguagucccagcuacucggcaggcugaggcaggaaaaucacuugaaccugggaggcugaaguugcagugagccgagaucgcaccacuccacuacagccuggccacaaagcaagacuccgucucaaaaaaauaaauaaauaaauaaauaaauaaggcugagaauugcuugaaccugagaggcggagguuucagugagcuaagaucgcgccacugcucucuagccugggcaauagagccagacuccgucucaaaaaacaaaacaaaacaaacaaacaaacaaaaaacaaaaaaagcugggcacagcggcucaagccuguaauccuagcacuuugagaggccaaguugggcggaucacuaggucaggagaucgagaccauccucgcuaacacgggugaaaccccgucucuacuaagaauucaaaaaauuagcugggcgugguggugggugccuguagucccagcuacucgggaggcugaggcaggagaauccuguugucccagcuacuagcgaggcugaggcaggggaaucgcuugaacccaggagguggagcuugcagcuagccgagaucaugccacugcaccacuguacuccagcaugggugauacagcgagacuccuccgucaaaaaaaaaaaaaaggagaagggaggggaggggaggggaggggaggggaggggaggggaggggaggggagggggaagaauuagaaaacucuguucaaggaagcaaaaguuuugcaugggaaguguaaaugcacagaggaaucugaaguucaaaauuaauagagaugagggcauugaacauacagugaagaaagagaacaggaaagagaagaaaagauacaaguaagaaaaacgcaaggaaaaccucaccacaggcaccaauguagaauauuaggacucuuccccuugaaugaagcuaccaaucucauuaggcagcucuuaauuuugcguuagaaugcagggccauuaggcaaagguaugggcaacauucgaucucgauugcccacaaacauuuucaaacauuacuuucuauauuguguugucacaccuuuuaauagagaaaguuauuauuagccaagcugacuucagggaguugcauucccucaucuacauaauaauaggaaggagagaaaagagaagauccagauaauacucaaaacaaauuucauguuuaaucaacgaugagccuuauucuuaaguaauaagagcuacucagucuuuuucaugcuucccauaugggagaaauguggcaguauagcaauuccuauggcaaaguuaucuuucugaugacagucccuucggaagguuucgaucuuucucugggauuuuagaucaaacccaaauacugaacuugccaacuaguuguucugggccucucucggcaguaauauacagccaacuuaaauaaauucugauagauaaaaaucagauuuauauagaaaaugaauauaaauaaacauaagauuauuucaaauagaaucccagaggcacuuaaauuuuguuuauaugcaaaaauccgauugcacaagacuugucagggauccccugaaccacagaaacuguaaagcuguguccucacuucguucucauuuuguuccuagucacgcuuugggucuaaaaucagaacucuguacugccagcaggaaaaguuuucccuacuuaucuuuuccaaggcucuucccuaaaaauacacucaaaaugaauugcuucuaaaugaauuaucacauauucauauaauaaaaugcuaugcagccaguaaacauaagguuagagaauguuuauugauaugguaacauauucacaauauauugaguaaagagaauagauugcaaaacagcauuuacaauaugaguccauuuuauaaaaaauaagcaaaguguaauguguguguguguguguguguguguuuguguguguguguaaauauaccacuccuauaugcucagaaacauuggaaagacacauaccaaauuauuagcaguuauuuugggggaugagauguuuuauuuucuucuuugucuuuuuguucuuucuagugaacauauauuucuuuuccacuauacaaaaauguaaaagccacauucuuagagaucucguggcccuggauaucaucucauguauuacucaucuaguguuguggaacagcaugcuggaggcuugcuguguauaggccauaaaaccgggcuggaaauaaccuuuuuagauccuauuuuaguccucaaauccucacaagugggcuccuucaggaacccacuuuauguuaaauucuacucucuaacaaaggcuaugacaaugcuucaaacacuuguaauauguauauauguucccauaucaauaugucuucaugugcuuuuaauaccuucuauauauuaaugguuuauaaauuguuaaccccagggauccacuuagaugcuucaagaggcuugaaaaaaaguuggauccaaaauuuaaaaaaauauacaauuguaauuauuuuuaaaaauacaauuaaaaaugucucaccauauuuuacagcagagaacagcagcauuacuuuaugccaccaggaucucugccaucauuugaaaauaguuuaacugcaugauuguuuaagaaaacuguagcucuaaauuagucuuaaaaaaaauucgagcuacacagagaguuuaugcauauaaaauugaaacagguuguacagcagcacaagacacaacaaggaccaggcacaucugcucauugcauauucucaucauaggccuaaccaugaauugugcauaaagaaguaacaguuuaaugaauuuccuuauuguucuucauuuacaguuuuaguaccuagaauaaguaguaauuuuucuccuuacaguucugcauuacaguuuaauacuuagaauaaguauuaaauuuuucuagucuuuuauaagaaugugaaccauacuuagacauuuuuggugauacaacguugaaacaaaauuuuucuacuuaacuccccuuucaaaugcaaucugucuagcagaguguccaggcauugccaaguaagcuacuuucuuuuuuuuuuuuuuuuuuuuuuugagacggagucucgcucugucgcccaggcuggagugcaguggcgggaucucggcucacugcaagcuccgccucccggguucacgccauucuccugccucagccucccgaguagcugggaccacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgugcccggcccaaguaagcuacuuucaacacccaaguaaaucagaauuuccugugcaaccaaaaccaaaugaagauaucauaugagcugcaauugauacaacugcaacugucauucaaaaugcaaaucauccaaaaugcaaauauugauuuuauguucauaaaacagacacauucuucuuacuaguuaauuuauaagcaaauuuuauuuauagucaguauuugaauacuuuaugccacuucuauugcuauccccuggcccaagagaccauccucucaugaauauuacgggacgcagggccuccucaccuguccuccugcuuuuacgccuuuugccuuuguggccuguucucagcaccugaaucauggcauuuuucacucacuacugugcaauggccucucauuccauuagaaugaaagucaaauucuguauaaugguucaccacacccugcaccgacugaugccucagcaccauacagacgccaucuccugcuaccccucuacucacaauagcugcugugacucccauggugcuucaaacgggugggugcaccaggcacccauucacagcaaggcccuugaccuugucaucccuuccuccucaaggccucuuugcuuccucacuucugagaagucuuugaucuaaugucauccuuucaacgcaccuuccuaggccauucuuaacuucaguacuacccagcguccucuaacucccauguuuuagacuuccucuuugcauauaucacuaucugaagugacucuugcucauaucacuuaguauuuacugucugucuccucccacaacaguguaagcugcaugagagcaagcagagaauuuuaccuguucugguacuuucuguauccccagaagccuagagcaaugccuggcacaaauggccagcagacaauacacauuuguugaaugaauaaaauauucuaaauuugcauuccucacaauauucuuauuaauaaaacccauaaaauguuauguuuauacugccaccaaagaaagcugcauaaaauuauaaguucccaaggaagguuuauguguucacuauaauuuggaacuauuuaaaguacucagcauaauacuucaaccaccacacugacggcacucaucccaauuaacaucuauaggccgcgcauccuuuuaagucucucucuacccauuagucuucacauauguacaauaauaauaguuuacuuaaagggggauuauuuuuuaagaaucuuuucacuuuggauuauaucuucaacuugauaaagcaacuuaagucuagccaaggcuuuccuaaaagaauuccaaccauccuuucuaccaccgccaugaucugugaugauuuucaccccaugccucuguucacccagccuuuuuucaaauaucaccacuucuuuuaacugcacaauucuguugacaucuucaaguugcacacccacguucauuaaguagaauacacauuuguggaaauaucuaacaugugacugcuauccuauugagcucaauggaagcuacguggcuaagucauagcccaugcuccaugaagacccuuuuucuaucaggugugauacacagcuucucuccacaaccucugucucccucugugucauacaauuuggcauguauacaauuuuagaacagcuucagccacaagcaagcauuguguaaguggaauguucaucugggacugaugaggagauuuuuagaaaacagaaaugucaguuaugcugauuuuuaaauauuuucaguuuaacaacuuguuuauccuaaugguacugccuagcacauuaggaugaaaacuugcaaggugaucauuugauaauaccuuuauucucagagcuuaugaaauugaaagagaaagauaacagcccaggaacgauagacugauuuacuguuugcuguuaacuacaauagacuuuucagucagggcauggauguguauguguuuuuguauucauacaugcuauaucaaaauaaauacaaauugacugugcagcaggagaaaugagugcacuggacaggaauuaugaaggugaucuggcugcauccaauucuaccuugaaaucaccaaacaagugugaaguccaacuaaauguuauacaguuuacauaaaugucaaguaggagguguuuuauuucaggcuuugaucaugaugguucaaugugaauagaacuugugcauuuugaaauuuaagcacuauacccauugauguauugucuguaaccaugucaaaauagaaacuaagauuucaauaaagcacaaaacauuccugcaucacgaggcugcgaacagaaaacaaaaagugccuggagucaauaaaauacaaaaauccaucagcucugcugaucugcaugagauuacacugaaagaaaaacuucuaguuggcaggauucuagacaccaaacugaaaauuacaugucacguguugaucaacucuuauuuagucacguucugugauuucuauuuagaagaacauacuuuuuugucugauuuauuuauauugagaucuuaaccaucacugugaucucuguaguuucuacuuccuucuuuggcaguaacuauucauuaauagaaccacuagcgugccuuaauguaaaaccaaauuccacauccauguaauuagcccuuugcuauuuuguuaacaacaacaacgaacaaacaaacagcgucucagauuucauaagcauucuucguugacacaucugcuauucaaaagauucacucagcugggagacuguggggucaacauuucuagcugcacccuacguaauaccauggaucaaaauuacagaaaguguuggucauccaggguccuauagagacguccucauaagcagcugggugccacaugaugcauccacauuuuauucuuugugugcugaaaaaggccaagucuuccaaaaucaaagaaucugaagguucauggaaaggaaacaaauuuuguuuuuuuuaguuuguuagguuuucucauugacaucuuuuugcuuucucagugaguucucuggagggucagcaggaggagcacugcuacugucaacacucauuccuugcuugcaugucuguuagcuacauauuuuuacucaugaugggagugguaagaugcuggagggagagacacugaauggcugcuuuguuucagcauugccucgggguguucuaauaauaccuaacauggacuucaguagcugugagcagauuuucagugucucuguuacccaccugguagcuauacagggcauuccuucaaaauguaauaucgagaccucacuuuaucuacauuuuuccccaauuugugcuaaauuaucucaaacccgaaaguccaggaaagggggaagcacagaucauccacuguugcaagcaucgccucugcugaaugaauguagcaaaucaauacagccauaauuuagugccuuucaaggcaaagaauaugaguuucaucaccuucuugcagguuacagguacacagaaacugucacauuuuacaacuauaggagaggauggcuauuaugugccaaaauacaauuagauaccagucauacauaccuauuugaaaacuuaagagacucacucuuauaagcaauuccugacuaugaaucaauaaaacaccuccaaauuuuacuacauuuagaacuuuuccuuaaacaacccuauccacacguuuuuuaaaccuaguagauuuauuaaugccucuuaggggugaagauucgcaucuacagcuauccuuagguuuaaaagugcucuuuguaacagaggacuuacuauauccucagcuguuuccaucaaucaucuaccuuuaccaauugaaaucuuaccuacuucaaaaugcagccacuaaaaugaccgagaagaaaucagccaaguaaaaagugaaagagcuuauucuccauccaccuguuccauauuaaaacaaacaaacaaaaaauggauucagaaacaacacacacgacacgcgcucucccaaagcaguucuuugguuucaccugacucucuuugguaaacaccuggucuguucucuuuuccugcuaucuaugcuuccaaaagagcaacacgauugcagaacagaauccaccaagacaugagaauggagaucccaagacuuacauuauucauguacucgcugagcagguccuggagcgccugccgcacggcguugcacuccgccacgauccucucgcgccggucgucucgcgugcaggaggagucggccaucagcgcugcgccgcugaugaugcucuccagccucuccuccagggacggccggaaccuggccucgcugaacgucaugggguccaggauaaucuuauucugaaaguaucacacacacacacacaaaaaucagcagagaagagaggucugccuuggcacccuguuuugaaaccagaaauaucugaggcaagaacaggaguccccaaggaggagaaacugguuacucaaauucuaaaguugccuugacaaaguauuaacuuuuucuagauauuuuguccuaaauguaaucuucagcuaaaagagcacaucuuauuugaagaauauguucuuggcaaaggcuaucucaacggaagagcuuucaaauaagauuaggacacuuuuuuggcauuuuuaaaauacguagccuuuaaggaaagaacauuucaguguaaugcuuuggggaauuauauaaagauuuuagagcuaaaacaugauaaauaaucaacaucuuaauuaugcauuagcuguggcuuguauacacacacguuaauccuccucaugagaagcagauauucccauggcaggaugccuuuugaaacuugggcacauaacacccaacaggcauauucaguacagguuaauuuaugcuaguguucuagaaaaggauuccuaauguguguaugagacuugucacaaauaacugacaguauccuuauaaagguauuuaccuguuuggaaggagccuauauaagaggaaaauagugauauuuccuaaaaggaaggcgucacauagaacaugagcuuagcauuuccccagccaaguuuuaggagccuggaaacaugugggcagagaugccccgagguagauggaaauaugcguccaaaauucaggagcuauaacagucuuuauagggaucugguaaaugucagggguauuuggacauaaacuagugaauuacauacuaguaaagugaauagagccagaagagcaggccagagaagaccccuauacagaaggaccagaaucaaaaaggaagacagaaaggguagucagaaagauagaaacagaacuuggaaaacucccagcaaaugaggaggguagagcgugaugguaugugaucauuaacugugugaagucuagaagcaaaggugacauugaccaaaggcugguuuccuuuggggagccuuuucugccugaagcaaagaaguucauuccacaaugauaagguagaaugaccugcugcaggaaauggugugcuucauugggggugcacucucagagguccaagaaccagaguggcaaugauggggcaaauggucuuccaacuguagaauacuauggugcaauugccacucuguuacugcuucuuuugacguuccuuauuccuuauauauucaccaaauuuaaagaguuguaagaaaagaacaauuuaccauauuuacaaauacaauacgaaacauaaaugagaauagguaguuauucuauugcuaaucugcaccugccgaagaccuacuauaugccuacuacuguacuuaaugcuaaaaagaaggggagauaaaagaugcuuuuauggauuuuuuaugcugauguaguauauacaauaacugcuuaaguuauuacaaagugaaguccagcuguaugcucugggaaaguuuguuguaacccuccaaagcauccuaggguguuuguucagguugugugcagaauaucugggcuccaauucucugauuccuguuaaaaugcaaaucuccagagcagagagauagaaccuuugggcacaagaauguugaagucuuaaggaaugaguguagguagguugggacuuagaaaggaacagguauacaccaaacacagaccaugucugaaguccacuggaaucuuggauuuuuuagaaaaucacuaauuggucaaagccucuuuucaauuuagaaagcagugcaugaaaucuugcagauaagacagcuauucugugccagcuuuggcaagaugaucauucuuacauuuguacucucuuauaucuuagaaaacggaugaaaaagggauguuuacuuuacccaaaaugugcuauuuggguuuuguccuuugugccuugguuuuaggcacagcuguugagcgucaaaaaaucauguggaggcugcaauacaguggauggcccuauaggguucauuauuacaggugaaagucccaaaggaaagcugagaggggagcacagauauuccugcuauacguacuaguguugugucugcaaugucucuuuccaggggcauccauuggaaccaucucucuuucucucacauacucucucucgcuuucuacugccuuucuguugaugcauuuaugaugaacauauguauauauguauguguguguguguguguguauauauauaauccauauaauauacguuaagaaauaauauucuaauugaagaaauaccugguaaaaauauaauuagacuaucuuacuuauaaagauuacugauuuucaaagaccuauuuuauagaaaaccauauuaacauaaaacauaaugaaaaccauauguucugcuuuaagauuucaggagacucuucagaaucauauacuggcuuuagaacagguauuuauuguacuuuaggacuaaacgugucaagaacugcaaaugugauggaaauauggggagguaaauuugaacucuucaguaaggacaauuguaaaacaguuucucugcaguagagagaauguacuagugucauuagaauacuauuuccuaaauuauuuuccauggaacacugagcuuagagauauaauguuuugaugaaaaaauaagguucccuggccaaauauguuuuggaaauaccgcaugaccuacagcaaauuaucauaugaaaugcuuuggggagcucugcacuaaaggagucaguucacuguagcguuucccaaaucuauucgagcauggaaagugcugcuuuuaaaacgcaugaauuaucuaugagaacccaaggaacacacuuugggaaaugugacaagagagacuuuggagugucagccaauugaguuuccuaccugccauggccuggggcuguugugaaaguaaaagccugaaacauugagcuugacaaacucugcauaaaaguuacacuauccaucacauuucuaauggaauuauucauuauuuacagaucacaguggaaaagcuuuuuaaaaaaucucccuggaaaagaaacaauaauuuuacaauauucagaucuguaucugcaguacagauggggagcauugcaaugauggaugugaaaagcagcagggagaagccgcucgggagacaaaaggcacaaagaaaaaaggccagugcacgugggccuguguaagugugugcaugcacaugugcacgggaagagguacugauugcaugugggugugugucuguguguguguguguguguaucccggaugagaugggcacugguuguguguauguggagcuguguguguauguguguauggggcaagauaugugcuauuuguguguguguuuaugaaucuaugaaugggucgguacaguauguaugcauggguggaguggaugcauguauguguacguguguguauaugcacacgggcauguguauggaaggggcuguggcuuauuuguguguauguaguuguaugugucugucucugucuguuuuuagagaauuggccagguuuccaacaggcuccaacaagcgagaaaauaaggaaaaaacagaaaugaaaccagaggcucaagagcuagaggaaaaggcuguaucuauaguuccuacaaauaaaaaaccaaccccuggaaaugaauccauccugagcaagaaauauacagagaaugaaaaagugaaaagaaggaggaguauuugccauuguauaauuugaaaguaauuaaaaaacuaagaaacacccagguaagccaucuauccuaacacacuucagggacauucagaucagcaaacagccaugaacacagggcucuaacaggccucaguucuccauaccagcucugccuguccucaccucucugaguggcugcccucugcuagcaggaaggggcaccaaaucaccaccaccaccaucaucaccaucaucaucaucaucaucaacauccaggagccagauuccccucccuggucacagaagaauacuuuaagagggcagcacaccaacaccaaagagugaaaggaugaggagaagccuuccugucucucccuucgcagcaaaaguaugcuccugugaccggcucuuaugcuguuuacaacuuuacagacuuauuuuaguucauucuuuuacauuguaaauauccccaucuccugucggcauucuuaaagcucauuuagucauuuuaucuuuuugaccuuuuaguuccaucuuacauugucauuuuaguucauuuacagauagagggccugcauuucuuauuuuaucuuuuucuuauguuuuaaguuaaucuauguuuaucaugucuauuuucuuauuugcuuauuugcuuugcauacuauuuugugcuuuaugaguuuuacuuauuuuuauuaacaucucuacuuuaaaaaauuauuguuuucauucuuacaguuuauggaguggcaauuggaaugcauggacauaaagauaacagccacaauaauucacccccaagccaacaagacuagaauccuauucugccuucaagucggugcuauaacagucucucuagucucacauaauugaucucccauuugcucucauguggcgcucuauaaaaauuuuaaccuaaaauaauuuagcagacuauguaguucgaaacuacuucccagaauaauacauuuaccagcacucaccacacacacaauuguuguaacagcacuacuuuuaaauugcucuuaucauucauugucuccacaaaaagcuaugugaucuaaaauuucaguauacaaugagacaccgagcuggcuugaugcaagcucugacauaagaggagaaaacagacagaccuccaucaaagcaaguauuuggauguauuacaaaugguuugauggguucaaaaugcagugucuuugagaucccuaucuucccaucuuauugaauagggaaaugaugccagagauguugucccauggucauucagcucacaaauaaggucaccaggauuugagcacaggucuuuugauuucaagcccaguguuccuucaacuguauaagauuguccacauuuaggugaaaugagucuaauaugucauaauuacaauuauaaaguauauuacuuuaaaacgaaaauuuaauucuuuuaaauuaaauauaauacuuaaguauuaucugucaugcuguccuuuuuaugcuaucugagucaccuaacccucccaauagauaacugagaguauaaucauucauucaacaaaugagugccaguuacuguaggagucuaagagcacauauuaaauaauccuuucuucaagagguugacucucuaaucaagcacaaaaauauguacaaccaauuguaauggagaaauggcuaaugauguuauggaaugacugaaugauggcaauuugcacaguugagagguagaaaguaaaaaaauacuuccagaagaguuuaucccucagcugagacuuaaagagugaaaagcgguuggccaagcaaaguuaggagcaggaaggggcaaugcagaugggcuaggaggugagagauggcauauuauaugaaaaauauuacaagagaucaacugaagcuggucacauguacggugccauagaggggccccaagccacucuccucugaguuaaacugcuggggggcauaguuaacugaccaucuccaucugcugcaccuguaguucuacugcagucucauguguaggcugcacuugaccccaggcagcgccagucaaucacuaagcacaggcgcaugcuccugcccaacagggacuccuccaaugaccagcuucagcuccugauccgggcuccccacuggccugacugggacuugcugggaacagugcugagccucuuccuacucaauccacuuucuuuccugcucuccuuucaaagguguuuguccccauagcagucuaaaagcuccacaaaagcccagucacuccuauuuuauccuucacaggcaauuccuccuuauacauaaaaucccaucuaccuugcuuccucaagggccugaauggacauaaauaggaaugggagaugcaguuggagagagagaaagaaccagguucugaagcgacuucucugccauguuacaaaguuuucaauuugagaacaccccuuuaggcaaugaugaaucaucagagaucuuaaagcaaaggagugacauaauccuguuuggguuuagacaguuucuuauugcagcuaaggaaguuagcuuuggcaggacugcaagcagaaggcaggacagcaucaagccuucagagcccaaaagagaggugaggaaacuacaaaucaggauugugucuauauggauaaagagaagguaaugaauuuaagaaaaauguagaaugucaaucuggcaggauuugaaaauauauaggcuaugacaaugagggagaaggagacaaagauaaaaccuagaccucuaacacuaacaacaccaauaaugcagauaucagcaaacuacauccuaggagucaaacuccuacuuugcaaauaaaguuuuauuagaacacagucaggcucauucauuuacauacugucuaugccuauuuuuacacugcaauguuagaggggaaugguuaggacagaaacuguauggcacacaaaccuuggaauauuuacucuuggcccuucaagaaaacauuugcugaccgggcgcaguggcucaugcccguaaucccagcacuuugggaggcugaggcaggcagaucacaaggucaggagugcgagaccagccuggccaauauggugaaaccccgccucuacuaaaaauacaaaaauuagccgggcaugguggcacacaccuguaaucccaacaacuugggaggcugaggcaggagaauugcuugaaccugggaggcagaaguugcagugagcugagcucgcaccacugcacuccagccugggcgacagagccagacuccaucucaaaaaaaaaaaaaaagaagaggaagaaaacauuugcugauccuugaacaacugugaaagauaacagaugaagagcaggugaaguucuuaugagcccuuuaacuggagaagucugguggaagguugauuauaaguauaugaacaucggguagugguaugggcaccuguauuaauaugcaaaaucuaucgccuucauauaaacaaggaauacccaauaggaagaccuaauauccaauaacaagaaaugcaaagcaaaaaaacacaccuagaugucaaguagauguagcaagaaauguguucagagagaugaauuauugugcaggcaugaccucagggcaaagagcagggcuggaauugggaugcgugcccucuagcucuggcgucuaugcucuuagccacugcacuaauuguuuaccucauguauccuuucugcaugcacgaugcuaaucaucgugagggaaucaaugcaacagccauuuccccauuucaaaaacuaaagucacaguagcacaguagcauauuauucuuucauacuucaagaggggaucaaaaacagcaaauaaucaccaggaauaaaaccucuaaaaugcuacuuucuccuaauuuuaauccucaccucuguuucaaacuggucaguagguauuacaauauauuucuucuaccaagaagguaaauacaaauauugcucagucuuucuuuggcuaggaguuaaccgucuuaaagcugaguuuguaucuaauuguacucagcuguaauugagaaagaugggcauaccugacaagaccuggagcauaaaguaauguuuuuaauuacaguuaagucaguaggaaagcucuagcacacauagaacacuaauucaaugguuuuacccacagauuauguuucaaagacuuuuagugcacagcugacaauggucuuuacuagccaagaaacagcuuguuaaagaguaggaagaaaaucuuacucaucuuuacacuuucuggcuuucaacauugguuaaaccuuuaagugaacuacuuagucaucugaaacguacacagaauuuucaaaaugccaagaaagacaacaaagaaagcaauuugauaauauaaaguguggcugauuuucauaacuuuuuuuccaaaaucuaagcuaaucagcauggaaaaugcaaaugcuagugguaugaaaaaguccugugauucugugauuuucuuuguugauugugacaauucuguaagacaaauguguccuggauuuuuacuaccuucauaguucaaggcaacaaguaaggaaaauaguaaauugcuguucugccucauaaacaccaggcacuuaccaccugcuguccagcaugacuauuuugaaucaagcaagcagaagaaagaauaaaugucaacaugccucuaugcagucauucacuuuuaucuuuuaaaucuuaaaaaaaaaaaaaacugaaagagaaaguuaacauuagucaaagucauucuuucaaaggaauauguccuucugauauggggcaauuaaagcaaugaaaaccagaaaaccuaaaugacaaugcauguuuaaauguagguauauuucuccauuaauuauucugagcuuuucccagcaaugugcuacaauguacccaugucuucacuuucugucuuuuguaacuuaaucaucauccccauucuauguacccuuuaaaaaauuuauauuuuuaaauuuuuagucuuuaaggcuacauaguacguguaucuauuuaugggguacacaggauauuuugagacaggcauacaauguguaauaaucacaucaggguaaaugagguguccaucaccucaagcauuuaucguuucucuguguuacaaacauucccauuauacucuuuuaguuauuuuuaaauguauuaugaauuauuauuggcucuucuauuuaccuuuuaauauuuaaauuuugugguuugccuugucuugggguauaacuggguaaguuuuauauuucacggauaccacagagcuuccuuccuucuuccucccaagcauuaaauucaagauucuguuucuuuccacauaacgaagagggggcaaagccauguagucgcagguaccgaugccauaggucaggugaaauaugacagugacugagcaugacuauagaaauguuagcuuugguuuagcuuaggacuucaugcuguguugacccauuaccaagugucuaggucacagaaagcuuuagugggaucaaaauuuguuaaagcauuuuauuuuauucauuauguuauuuugaugcacugauacaaucccaaaccaaacaaaacaacauaaacaaguccagcaauaccuacugauuaacucuucacuauggaauccuucuuaaaacaaagaaaaaaguuugcuauccagcuuaaaauacuugacuaguaaccccugaggcagccucucccaguuucccauuaaaaugccuauaaacagggaaauaaaauuggaauuuuacagcacugaaaauugagaaugaaagacaccuauagacaaugaggcaugaucauaauucuggcucugaaugcuuuaaauacuuauuuuaaagacuggacucugagauaaaagcauaaaucaagaucauuuaaauaaauuaaccgaggugucuaaaucaaaagaauguuauuuguuugguuuuaaacacuuacucucccuguaguguaucaauaauuaauacagauacauuuucaucuuuuucauucugugccaagcuuucccagggugaaucuuucuaucuuuacaugaaaaguuucucuugacguaauugggguagcacuaggaaugaaagauaccaaggaccuugaguuuuaaucauguauuuuuuauuaagcuacagaaaaauucuaaccaccauuuuagauuugccuuaauuuuuaaauugcaaaguauuuuauaaauaacuuuugcuucgcaggcauauaguuaaaaauaaacuaauuaugccauuuaucuacuuaagauguuauuuguaauuaaacaguucaguuuaauuggaaauaaaugacaaagauaaugacuuaauaauuaaacagcacuuucuauccuuagauacuuaauguguuuuuuaagagaaauuuaccuaagcucacauuagcuucguuuuugagaagaagcuuauauuuagaaagacaaagugauuuaccaaagcaaaugaauaaacugggcgaggaaguucagcucugggcuguuccuacuggauugugaaaucuaguggaugccaacuucauuuucccuaaucccaucaucucuguguguugcugaguugcuauggcauuucaggagcacauucucuagcuccgacaaggauacuaguuuacaauuaaguacguaaagcagggcaaagauaauaauccuuagcuuuauauuaugaauugauuagaaagugaguauccaaaaugcacuuaaucaaaucagauuuuuagagggcuuaacaaaggaaauggauuuuauucuuuuccugaaaaaaaacagucauguuaucucuagucuccuggaacguucuacauucuugaccaucguuuuuauucaguauucauccucuuugagcucuguguguuuugaacacaauuuaccacccgcugacuaaguuaagccuccccuaugcuuuacaaaacccugcuuuacugugguucuauucauacuccuccuucccuucacuugcccaguucuucuuccuggaucuaccucaguaaguugguauaucucaaggcccugcucccuguucucaguaguccucucaacaacucuuucuuagagggcucaacuacucucuacuaucaccugcuugugaaagagaaccaaaguaccauguccaaucccgacccucuaagaagcuggcccuuacuacagcuguacacuggacaugaucuguugggaguucugccaucaccucaaauaucagauguaugagaaaguacuucucauuuuccuccaaaaccuaacacucucacuuauaaggaggaaaaauggaaguagaagggaaacaagaauccauaaucucccuucauucuccuaaugagaaauuagaauuaaugagaaaucuucacuuuauaaaugcaagaaccguuccucggucagguuaggugacuugaugaaggccacacaguggaagacuugagaagucuuucugacuccaaggcccgugcacuuguagcuguguucucuugggaaccuauguugaaagaucaagcaucaauauaaucuaagaccggccgggcacaguggcucacaucuguaaucccagcacuuugggaguccaaagcggguggaucacaaggucaggaguucgagaccagccugcucaauauggugaaaccccaucucuacuaaaaauaaaaaaaaacuuaccugggcaugguggcgggcaccuauaaucccagcuacucgggaggcugaggcaggagaaucacuugaacccgggaggcagagguugcaaugagcugagaucacaccacugcacaccagccugggugacaaagugagacuccaucucaaaaaaagaaaaaagaaagaaaagaaaccauauauauaaucuaagaccaagguauaaaauguuacagggguuaagaguuggauggugauaugguuuacaugugucaccuccaaaauucagguguugccaaggugauaauauuaagagguggcacguuuaauagcugauugggacauaaggcuccucccuuuugaacuggauuaaggcacuuauaaaagagguuucaaggagcauuuggcuagcuugcccuucugccuuccgccauaccaggauccagcauucuuccccuccauaggggaagggcaccaucuugggagcagagaacaacccucaccagacaaccaaacaugcuggcacuuugaucuuggauuucccagugcuauaacugugaggaaacaaaauuuugcucuuuguaaauuacccauucuuggguauuugguuuuagaagcacaaauggacuaagauagauggcuuggauuagaaaccuggcuccaauuccuucuaguuguaauucuuucuagcugaguagguugcuuaaaugcuaaaagcgucucagcuuccucauuugaaaaacaggaaugaaucuuagcaguaccuauacaacaguguuguugagaaaguuaaauaauauaaguaaagagauuugaacaauauaugaaauguagugaguuauagauauuaaacaucaaaucauuucaaauagcuauuuuuaauguaauacuuuauauuuccauggucaguccauauuccccccuuauucaagucaugaucaucucccauuuccuucaucgagacuuuaaauuuaucuuuuuuuuuucucgguaaagcauauuuuccuaacagccuagucuuaaaauccugcuuaaccacacuaccccacuggccucaaaccuucaacggcuccccauggccuguaauagguuauuaucuaggacccgacaaguuucagaugcuggacucuuaccuaguaauucuccaauuucauuucuauuagauuaauuuugugaguuauaucaaaauucauaagggaauaaagcaaugaguugcauuuucauccagcccuugaauugagaugucauuuucagcaagcauuguguaaaaaaaauauaaucucaccucuacucaguucaugacuaagaugccuggccuucaagauucucagcaauccggcgcaagucucugccucucaaacuucgucucuccucaugaacccccggcuccugccaaaguggucucugcauugccccaccccaguaugcuucauguguaaccguguuauuaauucuucucugcugacuguuucagccccuuccucucugaugcuucuuggcagcguauguggauccuucucuggaaacacgaucuuuaacucucuuguguacaaaacuuuccucuuuaauucccauuauuaagcuucuuuucacuuauucaaauuucccuuuuggcucuugucugauauuaccaugcacuggcagcagugcgccugugugcacacacgugugugugagagaaacagaucaccaguuaggaugcuuuccuuauaggucgguaucuucugcuccacccagcugaauguuucauacauaaguauuugauaaacauuugcugauuaguggagucaggauuccuaaaacaagaauauccuuuucccaaccuuuaccaaaaggcuucuggagcaaaauaggucacuacagugaaccuaauauuugcagaugaauauauguggauggccuuuuaguuagauauguacauuuaggucuacaguagcaauugaugugguucaguguacuugagauucagaauuauuggaauggggaugaguaaccuauugucauaugacaaacguuaguucuccuuuuuuuuuuuugagacagggucucauacucuguugcucaggcuggaguacaguggcacgauuuuggcucacugcaauuucugccugccaggcucaagugauccuucuauuccagccucccaaacagcugggacuacaggcacauggcaccacaccuggcuaauguuuguauuuuuuguagauacagcguuuugccacauugcccaggcugguuucgaccucccagacucaggcgauccaccucccucagccucccaaagugcugggauuaugggcaugaaccaccacacucagccuaauucuacuuucaaugggcaggagaccagcugagacagccaccuccugugguugguaaauucugagaaucuccucugaagauuugauuaagccagggucaacaaacaauggucuguggaccaaaauagaucugcugcccauuuuuauauggucuuaagcuuauaaagcuaauaauaauuuuuacauuuuuaagucgguggauaaaccaugggccuacuacugauauguuacauuucuguccaaaauccucucccuuacgauacccauaaauagucaaaaggcaugcagccaaaaaaaaaaaaaaaaauuaagaaauuucacaaaccacauaaucccacaauuaaauaauuaguaacuggaugaucaaugguugaauuuuuuuuaaguuuaauacuaggagaaacaaacuucuuaucccagaaauuaguuaaacucuaugucggugguuugagaugcuaaauuauccauuuaaaacggaaagucaauucauauuucucagaagcaauuguggcuuaauugcuguuaucaaccuaauaaauuaguaggugauaaccacaaacugguuauacacucaaauuucaugucugaugaaagaauaauuguaccaauauucugcaaauaugaaaaggaaauguguucacgggccgcaagggaaaugcauacaccuugagcauaaacucaucuaucuucuucugucuauuuuuaagcaggcaaauuaagaugggaaagaaacaguuuuugucucacaggaauaaugugugauauguuaauugcuucucaagaaacauugcauggccugaaaauacgcuuuuugcuuaaugagaaugucauguucucuuuugaacucugaauugugaugcacaucuguuaacgaucauuuaaauuauauauaauagauuuucuguguaacacuggaaaagagaagcccuaagagaguuaacucaagaagaugaugcgugcccauuggaacauaauagcaugaucauguagccaugggcuaucuauugugauugguauggcauauaccaacauuccagaagacugagaaguuaggauggauaaacugauagcuacuaagaucaaacaguuaauauauucauuuaagcagccauucaacaaauauuucuuuaaugucuuugugcuaaaagugcaugugaaagugugaacaauacaugaucucugucuauuuggugcucacauuuggagagacagaaacaaaaaacagaacaauauucuuaacaauaugcauaaaguacaauaguagcauagaaggaauaguggcauagaaauugggguaguuaggaaagguuucaaaaaauaaguagaucuggaaggcugaauauaaauuuauuauucagaaaagaagggaaggaaggaacagacagaggaacucccaugagggccaacacauggauuaaacagugacuauguaccugaaaaugauaaacaguucauuacggcagaauguggaauacaauguguggaaaaggaggcuaugcaaugggagauguaugcagggaccuacggaaacgauuugguacugugcuaagagcuuuaaaguugauccugaagacagaguuuuacuaguaaauaauaugugacuagcauuuuagaaaggcugggcuuaccaagaugauggaauacagagggaaggaguugguggggcggggggcagggcaaccaguuaggaaguuauugcaaugauccaggcaaaaaauaugggccugauuagccaguguucaugaagaugggagaaacaaaucaagaguucuaaagggaacugaauucauagcauaucaagguuaacuggagagaaaagugggcaggauucucaguuuucuggauucaauggcuauauuaccaaacguaguuccuuuagcuuaaaaaagaagaagaggaagaaagagaagaagaagaaggaggaggaggaggaggaagaagaagaagaagaagaagaagaagaagaagaagaagaagaagaagaagaagaagaagaagaagaagaagaaaacagccuaagcuugacagaauaaaaaugcucaauuuaguuagagaauuuuucagauacuuaaaaaucauucaaauucagauguuacauacacagcuaaacagaugucuagagcucaggagaaaguuuaguuauccucagauaaaguuagucuaaaaaacuauuauuuguauaauuauaaauguaaaaacauaaauagcauaauugacuuaaaauaucucuaaagaacaaacugcaggauuaggguuguugacauuagcaaaaguaauagaaaaucaaaguuacacugguuugagaaucaguuuguuggaagcuuuugggucaaagacugauacauaugauuuauaccuuauuuccuagcauauuauucucuaauaauaaacucaucauuuacuuuuucaaggguguggcaauuggccaccauauauuaauuuagguuggauuguaaaugucuaaaauuggggagcccaaauuaaagaguuggucaauauuaacucaauguauagcauacauuuuguuaaaguaacaaauauugaaacuuaauaucuuuaacuuuuaaccaaagagguaaccaaggcaguuccacuugaaaaccucacaagaaccagcagccuccuccucuucccaaucccauaaaaaaauaagucaaccuacuuguaguugugagugggaccucuggaaagagauucuuguguaagcagaagagaagagaggcauggaagccuaugauuuuuagaaaguuaacuuuaguggccaugugagaaaacgggcugaaggaggacaaaacgguggaaaagauaucacuuaacaggcuuuuuuucauaaugagacacaacagucuggcacaaucaacuauucucaaauauuuuuuuacuaccuaucauaugugaaaagugaucuggggagagauugcuaugagauuuucucaucaaggauuucucagccacgucauggaaauaagacaugucugugaccauaauaauaaugugguaaagucuaacaaucagggacggguauagugcuuugguaauuuacuuuggaaaugucaguguaagaagaaacucuuucuuuauuuuuaacaauuagagcuuuuaacaauuagaacaagucaucugccuccaccccaauauuuccucucaauaauguccugcaaagacaaaaguccagauguuauggauguugcagugggaacuuccaauauuaugaaagugauacuggauggccucaaauaucuuucucaauuuugaaguuuuaugggccuaugagaaaagaaaugcagcaucauaguagcuaguuaucuucagaaaugaauggauuaugcagaucucugucugucucuuugucugccugucucuuucucuuucuuuccccuacuggggauaaaauacaagugcccuaucuuuaaaaugucauguguuuuauuauuuacacugaccuaauuggaaaucacauucuauuauauuuuaaauaauguuucuuaaguaaagguucauaaaauacggaaaagaaaguuuucaguauuauuucauaauccaccaggaacaaauuuuacucuauuuugugggguuuuuuuuuaauacagguaaugagaauaggcgugcaugaauuaguauaacuuugguuagugauuauuugcagggacacaauguuucauggccaugacugucuaaagucaauauuugcagagguuuuguuauacauagccuuccauuaaauuaauacuuaaacuaggcaaaacuagcaagcuuacaggagcucugguacaacucuucuauaaauccacaaaucuuaacagaaucaaagaaauauucucugaagugucuguauguauauauauggauguaaaaauguaaaauaaaguugauuuuaucuacuuaaaaauaguuaaggaguguguguaugggagaagagcaaacauguauacaaaugacaagccaauaugauaaaauauuaacaauaguuaauaaaggacauaccaguguuccuuauacuacuuuaauauuugcaacauaucuguaaacagauuuaauuuuucgcaaauacuaugcauauuuuuuauuaaagaauauucauggaaaaaaguuuggaaaauaauaaaaauaggaaaaaauauucacagucaccacaacucaaaagaaaaaucauaagcauuuugacauauauauauauauuuucagguuguuuugcauuuucaguauaaauuuguuucuuccuacuuacuucaggaaaacuaauuucuaagguauuguaauauuuauuaagugugccuuugccuaugucauuuuaaguuuauuuugcugauccagauuuugaaagugauucugacauguagacuugagagaaucugaaaauaaaaacagcaugcauccacuggccaaagggcugccacacucuggggguugguggcagauaaccgcguuaucuucuccucccuaagagaccuaccgcuccaucagaucucuacaaaugucaucuucuucaaaucugugacagaucuuuguaaaagaaaaauguccauggaaaacuuguauuuggucagugauguuuuuuaucuuaaguacuugugccaaacacaagauuguguuguuaaaauguaggaucuuaaaaucuuugaaauauauauucaaauuaauuagagcaaaaauucuacacagcgauucaguucucaaauacaucaccugagaagauuagccauguacuugcuuuaaaauaaaacacgauucuuaacuuccaugcaaaucuggucaguuuugguaggcacagaaaauaucuuaggaaacccuguaguuaaaaccucccaacuauaaauucauuugggcccucaaguaauauguaugggcaucuccuggaagaaaugaagcuguaaaauguaaagaucugcgcuuuuuauuuugauauagaaaaauguccaaauauccuauggucugaaugucugugugcccucaaaauucauauguuggaauuuaauacccaaagugauaguauuaagaggugugggcuuuguggggugacuauaucuggagggaucuacccuuaucaaugggauuagugcccuuauaaaagaggcuugaggggcucccugccccuuccaccaugugaugacacaguaagaaggcaucaccuuugaagcacagagugagcgcucacaagaaacugagucugucaacaccuauccugaacucccuggccuccaaaaccaugagcaauaaauuaccauuguuuauaaaugacucagucuaagguauucuguuacagaagcccaaacaaacugagacaacauauuuuauaugcuguguacuugugaaagauuaucuuaaaacuuuuuaaacagaugccaaaacuaagagaagaaaggaaaagaaaauaauauccagacgaucaccaguguagaccucagugucccaaauaagcuuaagaagcaugauuaagguuguagaugauaacagcaagagauuuucaaacagauggauggagaaauaauguuuuccugguccuuucauaggaucugcuaaagugaggaaaguacuaaaccuggaaaacaagcagugucaguuucaaacuccuucacaggacacuuggggaagagacaaucugguugggagggagacaggaccugucuucaaacugcauuugcauaccaugcacauucuuagauugcaugauuauuuggcagcaucuuuuggacagaacauguuuaaaauacgauaaacugcuucaggcugugguuccuggauucaucagggaccacagucuaugucaucuuuucucccuuuaucccuacccgcuuucugccauucgcuccucuuuauuccaggugcucgcugagcaaucuucagagaccaacaaagcagaagaaaucucauauuuaaugugaaacuaaaaauggcauucacagcaucagaagcugguuaagcaauaagaauucccaaauagacacaauggagaaacuuacauucuuaguauucacacuggacuuguuaggucucacguuaagaaucacucuuacaccaagagguaauuuaaucuguuuggaauuucuccugucacauagaauggccagccucucaagacugcuuuaugcuuuggccagaccuucuuuggagucuguuaugcauuaggguuuggcuauaggcaagggagagcaaaugacauuauaauaucaauagcuacucuccaguggcauaacaacuuuucagucaggagcuuuuucccaggguuuuucuagggaauagcuucacagcugaaucuggaugaaagaugucuggccaacacgucuauuaagauggguaggagaagaagaaaacuaguauuuaugagugccuacuauagauuagacacauauaaauguucaucccacaaaacuaccaccaacuuggagucaacauuauuaucucauuuuauagaugaagaaacagaggcacagagggaagaguuauuugguaagauucaaacacaagccuguucucugcccuaugagaugcugucccaccauuguuuagcauggccaauguaaccaggucaaaccacaaccgacuauuuauguucucaguuauguugggugccugcuaaucauacgugcauaugaguaauuguuuuucuacagccuuagcucaaugaauuuauacaaucagaaaaaaagacaguaucagagaacauuuggggaaauaaagaaugggacucaauagguuauagugaaguuuccauaauauucugcuggaaaagaaguucaggaaauacguugagcaguaugguugaaaaauccaaauggaugcuucacgugcaguuguugcacguguguguguguguuugugugugguuuacuucaccacugaaucaaacuaaaucuuagaacauuuaaguaacucccuaucacguucccagcacuguaacauaggaagcacacgagaagucauaauccuggagggagaaguaaagauuagcaguacuaacauaagaaaucacacagaaagacuaaaguauuaaauguauuuaaagauuaaaaaaucaaacauuuuaaauaaaccacauguugcucuaauaaagaguucacuagauaaguggccuuauuuggguccgaaauuugaaaaaguauaacuaauagauaagugacaaucaaaauuauacuugccaucacauguuagacaauuuugaauaucauaaucaauuacaucaguauucauuauuauauuugguacuaacuugaaauaaaggugaaaucagaccuaaagaaucugucaauauucucaaaagcaaaaaucagucacacuaggaagaaaacagauucuuacauuuuucgcugccucaagaaauaacccaagauuggaaauauaauaauuuugauuaaaccugauagggggccaaaaaaucaagauauaaauugcaauuauaaaaaaaaguacuucaaauuucauucuuuuauuugcucaacaauuuuuagagaucuuuagugauugaaaugcgcaagagaaaaguaaauuguuuuggaauauuucuuaaagcaaguaaaaaaauugaaagguaaaugauucuaucagaaaauacuccuagauuuauaaaaccuuaggaaagaaaagcuguuuagaagcaauaucagagguaucgauaaccuauacaagaggugucaauaacccggaaagagauuucugggcagaaaagauggauucuggaaagugaagcgguauagcucaggaagcagugaagacuauguugucuacgaugaugccuaaccugguccccaagcacccagcagaaccagccuugacucaccacccuaccuugcacuccucuuccuauaagcucacauguauugcaucuaucuuuaucaccaucccagagguagggaugguuuuaagaauuagcuggacuugcauugcauaacauuaguguucagaagguugucauagguagacuaaacacuuuuugacggaugacuacacacuguccauauuugcaucccuuggguuugagcccguauuacauauauaaauuguaguauguuuacagggaucuaagaacccacaggaguguuucuuaaugcuuuguuuggccaccagaugucaguguaggauaaagaaugcuggaacgcuccugcuuguuuccaguuagaaagaauugaaaaggcaguuuugaugaguuuaauuugccauugaaaaagaagaaauaaauuuggaagguacuccacugggagaagauacgaugaacaggugaggauuucugguucccacuaagcaucaguuacugauacuaugcccuaaagauggaaaaguuugucuccacuuuucaaaaaaguaucaaaaaguuguuuuuuucuuuuuuaagaaguaaaaagagcaugcuaagcacauaguaggagcccaauuaagcacaaacagauuaaccuaaguuagaaaaauccuagacuuuguagaauuuuguuuaagaauauucaaaauauauaauaucugcauaaaugacuagggauuuaacaaucauacugaugggaacggaaaugaacuaagagccaaaaaaaucagugcaagaaaguuauauuauguaaaaacaucaaauuuuccaaaaaaugacugaaauuucucaagauuucauaauuagaccuagaaaauguuugguuuuuuaauuagcuaaagcuuacaugacaauacaaaacacuauuucaauauauggaaauaaaaaguacaauucucaugaccuguugauucuacuuccucaguaugguucagauucacccacuucuuccuaauucuacucuauugauauacugcagacauuccuaauuucucacgcuuaucugucucccuacucugcagcuuugcuucuucaaacucauucuccccccggcagccacugcagccacagggaucuucaaaaacacaagucugggccaggagcuguggcucacgccuguaaucccagcauuuugggaagcugaguugggcagaucacuugaguucaggaguucaagaccagccuggacaacauggcgaaaccaugugucuacuaaaaauaccaaaacuugcugggugugguggugugccugugguccuagcuacucgggaggcugaggugggaagauuacuugaggcagagguugcagugaguugagaucaugccacugcacuccagccugggugacagagggagacccugucucaaaaacaaaaacaaacaaaacaacgacaacaacaaaaaccccacaagucugaccaugccauuuccuucuuuuuuuuuuuuuuuuuuuuuuuuuugagauggagucuugcucugucacccaggcuggagugcaguggcgugaucucagcucacugcaagcucugccucccggguucaugccauucuccuaccucagccucccgaguagcugggacuacaggugcccgccaccacgccuaacuaauuuuuuguauuuuuaguagagacggguuuucaccauguuagccaggauggucuugaucuccugaccucgugauccgcccgccucggccucccaaagugcugggauuacaggcgugagccaccgcgccuggcugccauuuccuucuuuagaucaccaguaacuuccuaaggccuucagcaugaagcccagccacuugcaaggcugaauagcucuucaggauuggucuccuauuugcccacuuagacugacuuuuccccauccucuguaccccagaaauaaucacuuuaugcaggcuuuacccaccauacaacugcaugcaaugaugaucuuucuaccugagaaauacucucauucacauuucaucauguuuauucuuucuuagccuuuagaugcagcucauuuaccuccucuuccaagaauuauuccacaauuucaucuugcccaauuccacccccuuacgcacacauaauagguuaaguggauacuauauacguaagcguaugcagcagcauuuaugcauugcagcgucuauagcuguuuacuaaguauuuucuccuuuuacauaugacacucccuuauuguucuaucucaucuggcacauauacacuuugaaugaaugaucuuagcuaucugguggcuaaaccuuauccuaagagauauaaaauccaaggccuagagaugggcuuaguagcccaugcuuacacauacuuaguuauuuguagagcuuggaguaguagccaauaccugaauccaaguccuggacucuuuccaguguucuugguuacuucuauuggccauucagugggaaucacuucucagacacauagcagagauaauuauuauggagcauuaauagaagggcccugucaucucaacucuucaccuucauucuaauguaauguaagauauaggaaacuuacaaucuucauagccuaacauggaggguugcuagaugucuguagucaaaugacuuuauaaaauaucgaaguagauaaggccuggggcaaguuucccugauaaauaaguauauugguugcuacagcaaaaggaaauacuagaauugagaagggacagaacaagauccuuggugaaaauuuuauuuucccaggagacacuuauccuucccugauguugaagaaaucauaagucaauaaagcauauuaagaauccaugagccagucagaacucugggccauggccccuuaagggaccagagcuuacacagcaguaucugucugauucuaggaacaauaagaauugauuaucacaauacucaaaaaacauaaaaaaguggcauuugaaauggaggcacaacagaaaaacccucacuuauucggaagccuucaguguagaucuccuaggucuuauauuugggccucugacuuaccuauacagcguuucguucuccacugaaaaugcacuccaacccuggaucuccaaauacuaaucuuggguugugaauccccucaaagguccugcaaccucuuaaugucccuuaaaugggcugggaaccugaaaugacugcugccaugugaacuacuacggcugaacuucauucuuuggccuggagcuccuugaauaucugugugcacccagagaagccuacaacugggauaagcuuugggcagugaccacagaagcauggcccgugcucccccaguagacaauuauuuuauccucacaguuagccuacauacaauucuugccagccagggauuauuuuuccgugcaccagucugagaugcagaugucgcaucacugcucauguuaacauuccaauauuuccauccacugaauaccagaucggaaagagaauuacaauuugaccaagaacagaaaaaaaaaaaaaagcauauuuaaagagaugaugaaaaagggaagaaaauguaagaagguaaaggcagguagggaaaauuagguaaaaauaggacggggaacuuauguagaguugcuauaccaggguaacauuucagcuuaaugugguugagaauagaaugucuuauuccucaagugcagauauuuaaaucuuacaagagauauuagugguaauagaaagaaagaggaggcauggucaguauaauaaugugcucccuuccaaagcugaaguauucgaaaaguagaaaauaaaagccuaucaauuuugugagugagugacagucucuggagacacucagguagagugccugaggagcagggaggaaccgagguuagcauagaggauuguggauugucaggaaaagaaaagauaacgaaaauauggcaauaugguaauuuuagcagcccaaugcuuuauuuucuuuuuagguuguuagaauuggaauacauuuucuguagguugaggagauggaacaaguggaggagaaacugaaggagcaagaacaagagaauuacuagucaaacaaauucccagggcaaguugggagaaagaaagcaaaucacaaauagaaagcuaaauguuagaagaagucaagauaauguguacugucugacuuaaaagaaaacaacauuuuuaaaaggugaauagcuaaagauuauaauguaccuuugcaaauggugucacuuuuaauuuguuacagcaauagcuuguaauauacaucuguccugaguacuaaauguuauucucagauauuaaacaaauugauauuuuauugggugaaaaacuuacucaaacuuccuguggcuuauuuucuggcaaaauuuauuacugauucuugguguaauaccuuucuaauguaaugacaauuuaaauaauuuaacaucuuugagauguugaagcaucucaaagauauuggaaaggagcuucaugaacagugucaguugaaauuuuuugaaaguaucuucaucuacaaaacaagauuccaaaaacaagauaugguauacucucuuuucuuuaauaaaauaagaaaauucuguaggaauugcuuuuaacauuccucucucccacuauugaaaguuuguuuucuggcagucaaaaucgacauuauguuuuacuucugagcagucacuauauuuuucuuaaaucuuuugaauauuccuuuguagauaguuuuacuagauuaaaauugaccaucucaagcugccacaucuaaacagaggcugaguuuuccauugauuaucaauuauuuuacuuuuuacuguuauaucauuggaaacucucuugacaguugcaaguuguuaaaauacugcuuuuuuccucauucuuuugcuucauaaaucacuacaucaacuauucauguagaugccagaaaauaggucaccaagcauuuagccacaauuauaacuacucagauagaaaucaauccuguaauuuuagacaaauaaaugugaaaauacuauuuuuaucuuguucucaucaacuauaaaauguuaagacacuucugcauccagccucccauaaaacuggguuugacacacucgugacuauuaauaugaaguguguuucaaauucaauuuugggagggcaggaccaagauggccaacuagaaacagaggcgaucggaggcucccauugaaaagaaaccuaauaagcguaugaauccuucaccgcaaccaaaguaucagguucucucaucagaacugacuagguggcuggcgugauccacggagaggaagagcaggguggugcggcccaccucagagccacauggggcaugggagcccccacccccagccaaggaaggcagugagugagcaugcaacacagccggcaaaacugcuuuuuucauggaaaugugcaacccacggaucggaagacgccacuugcaaacccaugcuacaggcaccuagcaucccaaccccagagcuacgcagauucucagcagcaucucagcuggaaccugcuuaagccugccaagcucccagggggaguagugaccagcaccacagcuguggcugccugcugucuaagccauuuaugcuccuuggcggaggggcagcagccagcccugggagguacaacugccuaacacacuaagcuuccugggagggguaagggugacauccauuucuauagcuccaggccaugcuuuuccccugcuggagccagggaggcuggacagcuuggucccaagacuuguuccccauagcccaacacaccggcuguggcagacugcugccagagugccucuucaggccugagccugacccauccauccucauuggguggggcuucccugcagcaacucuaauaacuccagccagagacucagggacagaaaauggaucucucugggccugagccccuagggggagggguggccacagugucugugguguuagaaaacaucacuaagauacuccaugagaaaaucaaccccaagauacauaaucaucagauucuccaaggucaaaaugaaggaaaaaauguuaagggcagccagagagaaaggccaggucaccuacaaagggaaguccaucagacuaacagcagacuccucagcagaaacucuacaagccagaagagcuuggggucuaaaauuuaacauucuuaaagaaaagaauuuucaacccagaauuuaauauccagccaaacuaagcuucauaagcaaaggagaaauaaaauccuuuacagacaagcaaaugcugagagauuuuguuaccaacaggccugccuugcaaaagcuccugaaaggggcacuaaacauggaaaggaaacccaguaccagccacugcaaaaacacaccaaaauauaaaggccaacgacucuaugaagaaacuguaucaucuagugugcaaaagaaccaaauaccaucaugaugacaggaucagauucacacauaacaauacuaaguuuaaauuuaaaugggcuaaauggcccaauuaaaagacacagacuggcaaauugaaugaagagucaagacccaucagugugcuguauucaggagacccaucucgcaugcaaagacacacauaggcucaaaauaaaggaaugguggaaaacuuaccaagcaaauggaaagcaaaaaaagcagggguugcaaaccuagucuuugacaaaacagacuuuaaaccuacaagaucaaaaaugacaagggcauuacauaauggugaaggguacaauucaacaagaaaagcuaacuauucuaaauauauaugcacccaauacaagagcaccggauucauaaaacaaguucuuagagaccuacaaagaaacuaauaggucucuacacacaauaauagugagagacuuuaacaccccacugucaauauuagagagaucaacaagacagaaaauuaacaaagauauucaggacugaacucagcucuggaucaaguguaccuaauagacaucuacagaacucugcaccccaaaugaacagaauauacauucuucucagugccacauggcacuuauuauaaaauugaccacauaauuggaaguaaaacacuccuuggcaaaugcaaaagaacugaaaccauaacagucucucagaccacagugcaaucaaaugagaacuuaggaugaagaaacucacucaaaaccaugcaaucacauggaaauugaacaaccuacuccugagugacuccuggguaaauaaugaaauuaaggcagaaaucaagauguucuuugaaaccaaagagcagagauaacauaccaaaaucucugggacacaguuaaagcaguguuaagaggaaauuuauagcacuaaaugcccacaucagagagcuagaaagaucucaagucgacacacuaacaucacaauuaaaagagcuagagaggcaagagcaaacuaauccaauagcuagcagaauauaagaaauaacuaagaucagagcagaauugaaggagacagagacacaaaaaacccuccaaaaaaaucaaugaauccaggagcuaauuuuuugaaaaaaauaacauaauagauaaaccacuaacuagaccaauaaagaagaaaagagagaagaaucaaauaggcacaauaaaaaauuauaaaggagauaucaccauugaccccacagaaauacaaacuaccaucagaaaauacuauaaacaccucuaugcaaaucaacuagaaaaucuagaagaaauggauaaauuccuggacacauacagucucccaagacuaaaccaggaagaaguaaaguuauggaauagaccaauaacaaguucugaauuugaggcaguaauuaauagccuaccaaccaaaaaaagcccaggaccagauggauucacaggugaauucuaccagagguacaaagagaagaugguacccuuccuuuuguaacuauuccaaacaacugaaaaggaaggacuccucccuaacucauuuuauggagcccgcaucaucuugauacugaaacugagaagagaugcaauaaaaaaggaaaacuucaugccaauauccauaaggaacaucaaagcaaaaauccucaaucaaauacugaccaaccaaauccagcagcacauaaaaaacuuacccuccaugaccaagucagcuucaucccugggaugcaaagcugguucaacauaggcaaaucaagaaaaguaauccaucacauaaacagaaccaaagacaaaaccacaugauuaucucaauagaugcagaaaaggccuuugauaaaauucaacaucgcuucacauuaaaaacucucaauaaacuaaguauugauggaacauaccucaaaauaacaagaguuauucaugacaaacccacaaccaauaucauauugaaugggcaaaagcaagaagcauucccuuuggaaaccaauacauaacaaaacugcccucucucaccacuccuguucaauauaguauuagaaauucuggacagggcaaucagguaagauaaagaaauaaagcauauucaaauaggaagauaggaagucaaauuuucucuguuugcagacaacaugauuguauaucaagaaaaccccaucaugucagcccagaaacucccuaaacugauaagcaacuucagcaaagucucaggauacaaaaucaaugugcaaaaaucacaagcauuccuuuacaucaauaacagacaagcagagagccaaaucaugaaugaacucccauucacaauagcuacaaagauaauaaaauaccuaggaauacagcuaacaaggaugugaaggaccucuucaaggagaacuacaaaccacugcucaaggaauuaagagaggacacaaaaaaauggaaaaacauuccaaccucauggauaggaagaaucagcauugugaaaauggccauacugcccagaguaauuuauagaauaaaugcuacuuccaucaaacuaccauugacauucuucacagaauuagaaaaagaaacuacuuuaaauuucauauggaauuaaagaagaccccguauagccaagacaauccuaagcaaaaagaacaaagcuagaggcaucaugcuaccugacuucaaacuaaacuacaaggcuacaguaaccaaaacagcaugguacuggucccaaaacagacagaccaacggaacagaagagagaccucagaaauaacaccacacaucuacaaccaucugaucuuugacaaaucugacaaaaacaagcaauggggaaauaaucuccuauuaaauaaauagugcuggaaaacuggcuagucauaggcagaaaacuaaaacuggaccccuuccuuacaccuuaugcaaaaacuaacucaagauguauuaaagacuuaaauguaaaacccaaaaccauaaaaacccuagaagaaaaccuaggcaauaccauucaggaaauaggcaugggcaaagacuucaugaugaaaacaccaaaagcaauugcaacaaaagccaaaauugacaaaugguaucuaaccaaacuaaagagcuucugcacagcaaaagaaucaucagagugaacaggcaaucuacggaaugggagaaaauuuuuacaaucgacucaucugacaaaagucuaauauucagaauuuacaaggaacuuaaauuuacaaaaacaaacaaccccauccaaaaguggagaaaggauaugaacagacacuucucaaaagaagauguuuacauggccaacaaacaugaaaaaaagcucaacaucacucaucauuagacaaaugcaaaucaaaaccacaaugagauaccaucucaggccagucagaauggcaauuauuaaaaagucaagaauagauagaugcuauagaugcaauuggugcuagcaaggcuguggagaaacagguacgcuuuuacacuguuggugggaauguaaauuaguucagcuauuguggaagacaguauggcaauuccuuacagaucuagaaccagaaauaccauuagacccagcaaucccauuauuggguauauacacaaaggaauauaagucuuucuaccguaaagccacauccacauguauguuuacugcagcacuauuuacaauggcaaaguuauggaaccaacccaaaugcccaccaaugauagacuggauaaagaaaaugugcuacauauacaccauggaauacuaugcagccauaagaaggaauaauaucauguccuuugcagggacguggaugaagcuggaagccaucauccucagcaaacuaacacaggaacagaacaccaaacaccacauguucucauuccuaagugggaguugaacaaugagaacacauggacacagggaggggaacaacacacaccagggacuguugcggggugggggcaagggaagggaacuuaguggaugggucaauaggugcagcaaaucaccauggcacauguaaaccuagauaacaaaccugcacauuuugcacguguauccuggaacuuaaaguaaaauuuuuaaaaaauaaauuuuagggcaaacuagcugugcugucuaugaaaauauauuuugcauuuuuaugguuccuuuuacuucagcauuucaaagacguuaaacuuauuuaaauuuucacuauaugagaaagguauuauaccaaguaucaguaagagauuuugccagaaaaguaaaccacaggaaguuugagugaguuuuucacccaaugaaauaucaauuuguuuaauaucugagaauagcauuuaggacucaugacagauguccaugaauucaaaaucaauuucaaguuagcaugccuaagaaauuuuuaaaaaaacaguauucaucauacaacuauggaacagaaauuuauaauuuagucauaaaauaaagagaaacgguauauuauuuuaaugagaaaauuucaaguaucauuaacuacugucuagguuugcugaugucagaagugauggaaaaucuacagcaggugaaucacauuacagucuguaaauucaauacuaauuuacuagcauuacuacuuuugagaaagugcugaaauuaaauugcauuuguuaaaugacaauuguuagggaaccacaucaaauggaauuauuguuucaaaacugcaauucagacagccuccacauuuugauuuuuguugaccuccaagaaguaaaauguugaccauuagauaacgcuuuauguaauucucauagcuugagaaacaguauacauuuaauaagaauauauuaccucauuaauauacuuagcuaauauaaaauauaauuuuuucauucauauauaauauacugaguuaauauuauaaguaauauaauuaguuaauauagaaguuuaaaguuaauaaaauauaguuagugacuuauuuaccauauuauacuuuauauuuuaauuuuuccaacuguuucaaauauaucauguuuuauaaaaaacauguuugaugguuauauucauguguuaaauuuccaaagccuuauuuguccagcaugaggagauaucacuucaggaaaaacaacaacaacaaaaaaaaaaccuugaacauucaacauguugacauacuuugcuaauagauuuuccccacaugaccucaaguuugauuuuuaugaaugaaagccuuuugcacuguugcacugacgcaucgguuguuacauuaauuggggauaaaaggugcuuuuaaugaaaaucgucuggaaacaaaaggcagcauggggaagcagcaguugucacacucuuggacagaagguggcagcagcugaaguuccuggacuguucacaggccuucucucugugcuucauauuuucacucuuaaccagcuccucacuuagguuuuguuguuuauuuuugauuauaaaauaaauuauaacuagaauaauguaauugugucaaaaucugacuaaauaauccauucuuaacuaauuuuaauaaacaccaauuuauaaaauaauuuuguauuugagauugccuaugauuuuuauucuuucauggaugaguccauuuguguuucaauacacaccuuuaaaauuaauguagcauuacaauguuuuaauaucuguguguaugaccugcucauuuacuuuucccugaaauaugggcucauucauucuuuauucuagaauauaaaaaaagacaaacaaacaaaaauccuuuaucacuccucugucaaguuccaaaagaauccucuuagaauuuguauugagauugcuucaacauuaugaaaacugauaggaucaauaguucuccuacucaagaucaugauaucauuuacugacaaguaaaacuugucccucaauaaaguaauauaauuugacuuuuuagguccuucacaucuauauuagacuuauuucuagcagauauaagaaauaauaaaauaaaauuaacuuuuuaaaaauuauuuguuuugugaauaucuccucguuauucuacuuuauuuuacaugaugaaaaucuagagauuuuuguauauuuauguuauauaaaguaaacauuauuuugaacucucauuauuuucuaugaauuuucaguugcucgcugcaauuuugugaauaaaauuaccuauuauuaagucuucauuucuguagcaagugcuuuaaauauauuaucauauuuaauccucacaaaaaaaaccuuaggaaauaauauauggugugagauacauauaacuaacuguaaaaauaugggaaagaggagagaccacuaugaaaaugguaagaacuauuugaguaugaacuguuaaaauuauuccucaguuauaucauccaucuccaagccuugaacaaucauugcuuugcuccuggaccuuuuuuuccagcugcuaacuaguuauuucuugccaaaaauucacaucaacauauucaaaagcaagcucaucaucuuucuucaugaccauuaaguaaccuauuuuucuucuaugaauuccuguaacauuguguuuuaucaauuaaaugguguuuagugcauucuacuucccucaucuccccugcaggguuauuuaacccuggaaaguagaugcuaauuauuuauaaaucuuuguaggcuuucauugaucauaagauaaauaaauuccaacuucucacagguccucugacccggggggaaugggggcugucaucccggggugcugaugacaugcgugcaaccuucucacucacacugaugcuucacauauggcucagcacagugaacaauccuccuugcuucuucccucaccaggacacaccuacagaaacagccaguguagaauguaggacuuucagagaacuaacacaggcucuccccagagggucuguucuaaugaagaccaggguccugugugggaucauagggcaauguacuuuaucacugauuuaaaacaaagaaauugauggcagcuuuucacgcaggcacaacauagaggcaacguacaucuaggcugcccauaacaugugccccuuuaauaauaaagaugaucgucaaauuaugaacugucccuaaaauagccuguaaguuaucucaucuaccuggaagggauugggcacucuuaaauacaguuguuucuucuuuuuuccccgagacggaguuuugcuguuguugcccaggcuggagugcaauggcacgaucucggcucaccgcaaucuccgccucccgaguuuaagcgauucuccugccgcagccucccgaguagcugggauuacaggcaugcgccaccacgcccagcuaauguuuuacauuuuuaguagagacgggguuucuccauguucgaacucaugaccucaggugauccacccaccucggccucccaaaguucugggauuacaggggugagccaccgcagccacaguuguuucuuuaaagacaagugauaauggcuuagccaauauauuacagaaaugcauuauguaguuuaucuuacuauuaaaaccuccaaaagagaaaaaucaauguaaauuauuguaguggcccuucauccucaauacauuuuuuuuuuuugucaacaccagugcccaccccucuguguaccucaccaggaugcuuacgucaaacucauuaagagccgcagccagcucgccgaugcccguguggcccuuggcuucgucagugggcgagguagcuugagcagcauuggagaugccggcgauggccuccuggacuuguuugaacacauaaucucgguuggcucucguagcggcgacaucuggguggcggagaaaugcuugagaggccguguacagcauuguggcauucuucuucagagccccucgggcggcugccaucucaucccgacagugaggauccuucagcuccuguguguguaacacaugaaagcugucacacacaugaaauuugcauagaaauauuugcaacacaguuuggagucacagacucuuaguaacacacugaacuucagaaacccuugugcuguuucuagcugccaggccuuugcauauacucuuuuguuuguuugucuguuuuauagagacagcuaggucucuauagugaccuagguuggaguacagugguguuaucaaagcucacugcagccuccaucuccugggcccaagugauccucccucuucaaccucuuaaguggcuagaacuacaggugcaugcuuccacaccaggcuaguuaaaaaaaaaaaaguuguggaaguggggucuggcuauguugcccaggugggccuugaacuccuggccucaagggauucucccaccucugcuucccaaagugcuggaaugacagccaugagcaaccacaccuggccuacugucccuucuaugugaaaugccugagcuuuccuccucugcccuacccuuucaccugacagggcuccacugacuuggcacauccuccacccaacuuucuaagcuguguccccuuucaucuguucccacaagacacucuuccucuccuaucacuaacacuuccuacuuuacuguauuuuuugagcauauauuucucuucuauaacguaccucuaaugacagcagggagcccuaguuuucuuauucaguggcucuuuagucauuagcaaaguggcuggccuauaagaggcauucaauaaaauauugcugagauaauauaaaaaccaagccaccaagaagguaaauugauugcaugggccauacaguuaguuaugaacagacagaaaaccugaaaacgucagucuucugaggcccuacuugccuccauauucaauuacuguuacaaaugggaaaccaaacuucugauuuuugcucaacacaucagugucccuuaauuaucauuuucagaauaggguuccugcuuuguuguuguugacagccucuaauggcagcucaucauuaaguuuagagaacagaaaauaacaggccaaagaugauuuguuuuccuaguuuuggaugacaaaauaauaccacuagggagucucuuuauuuccaucuuuaaaggcuguuguuaagaaaauguucaaaugauuuucagaaauguuaaagcaguguugcucuuugagagccaugcaggauugccagcuguguuaucucugggagaauauucuuccagcuggaaaacaucaguaaagcguauuugaaccacugggcuucucuuccuauuugcucauuuggcacaugauagaugaaugaccugguaacaagaaaucacaucuucuguuuuguuggucaaaacaauucugagacaaacacauuauauuugauaucuaagauugucacgaaaauugguaauaaauaaugaacaauuuacugaaccaucuuuuucccccuuugcuuaagcauuaaaagauggaugcuagguaacacaauuucuaaauugggauuaucuaauuugagccccagagaugaaaauggauaaacagguaacaaauauuugaauguauucucuacugggcaaugauuugggcacgagagguagguuucucccaaacagucaugaaaaccuuuauuaaugucagaacaucugguccagaaauuccauuccuggguaucuauacuaaaaaaaauaauaaaaugguaaaauagaucuaaauacagaagugagaaaugcggguugugaaaaucucuccauaaaacacuugaagaaacauguuuuaaucauaagaagaaaacuggaaacaaucuaaauauugaauuaccaagaauugguugaaaaaaaacuacugaaacauucauauuggaguaugugauaauuaaaauuaguuuuccaaaaauuaauaacaugaauaauauuuauaagauaaauuaaaaagcagaacacaauacgcauauuuguaugcauaguaugauuuuaaaugcauuaauaugugaagauaaauaucugaaagaaaauauaccaaaauaucagcaccauauucuuugugggugguaggguauuauguguuuuuccccuuuccuucuguucuacuguuuuucuaaauuuucuugaaagagucugaacuaacaaucaauuaaaaacaaaguauuaaugaaguaaaaauaaauaauguaggcauuuucauaugaacaucauauauauucucguggcuuuuaaugucagcuacaugcugauggcccauguuuccaucuccaggcaacacuucucuucuauuugauguuucaauguggauaucucaaaaucggcacaucuguguugguuauuuuaggugucaacuugacuggauugagggguaucuagaaggcugaugaagcauuauuuugaaugugucacugugagaguguuuuaggaggugacuggcaugugagccagugaauuaaguggagaagcuucacccucaguguagguggguaccauccagucggcugggggcaacgacagaacaaaaagguggaggaagggugaauucauucucucucucccuuccagagcagaaugcccuucuccuccugccuuuggacaucagaacaccagauuccuaggcuucuagacucuggggccugcaccaguagccuccuggggcucucuaucucucucucacuauucagaguaacuuuguuccuguuuauauuacacauugggcuaccauacaagauucccuuucaacaaggaauucugcugauaaaaacauacuuaaaaauaaccacauaaacuaaaaucacauuuaugugccugucucacugaggacuggcucuugguuaaguuccuaaucccagccucacuuaagccuggcacagaaugaacauucaauaaauguuuguugaguggaacuuuccuguuggucagagagaaaguuagagaaacuacgaauggcccaaaauguuuuaaaaaauucuggaagcagucaaaaggaugggugaaaggauuuuaggagauccuuccacauuuggaaauauuuuuucuauggcgaaagaauaaaaacccacucgaugggaacaaaauacuaaagguauccagugagcaaacagaguuagcugaaacugagaaaucccuagacaaaaaggaggcugauaugguuuggcucuguguccccacccaaaucucaucuugaauuguaaaccccacauguggagggagggaccuauaauccccaugugucgaggaagggaggugacuggaucauaggggugguuccuccaugcuguucucgugauagugagugaguucccacgggggucugaugguuuuauaaggcaguuuucccugcucuugcucacucucuccugccaccuugugaagaaggcgccuacuuccccuuccaccaugauuguaaguuuccugaggccuccccacccauguggaacugugagucaguuaaaucuccuuucuuuagaaauuacccagucucagggcaguucuuuauaacagcaugagaacaaacuaauacugaggcugaggagaucccaggucacacagcaucaugagagugacucacgcucaccugcacucuucucaccccuuuuucccuuccuccccuuccccacuccccuccccuuuucccccuguucucucucccuuucuccguucccccaccccugcauuuccucucauuuuguucauguuuucuucuucucuuucagaaaaauuucaccccacauacuacauauccugggaguguauauguguggugguguucacaagacuaggagacaaaaagugagggcaaagggugacauccagagacugaccacagcacuaccccacaguuuaauauuuuuuauuugacaucagagcuguguuccuacaguggauagaagaucagagugugguagggcuagcaggguggguccaccagugaagcaaauaaucuguggccugcuuauaggugggggccagagagugguccagagcccaccaaggcaucacaacuggccccugcaggaagcaaccuuugucaucacagguucuuagggcauuugauagcaagcagaugcaguugauccauuguucaggccuaaaaagcuacaggguuauuuaaacucacccauuuucuccccuagcauuucuaaaaucuuucccaccuguugucuucuugcugcuacauaguuaaguuucaccaucucuuucccaaacucuuuaaaacgguuugcaaggucuugcucauuuguagcauuuuugacagcuuccagggccucuuccaccugcaguggugaaaaacaacauauuuauuaguggauaguauuuaaauauuauucaacauguuagaaauggaauuugcacccaaaaacucuaaaacacuaguauguguuaacauguaaaugaaaaaauaggagaagaguuccucuaacaaucauguguagucagauuaaauaguuauucaagacuuaaaaauauuuuguauauaaaaaagcaauugcugaacuccuggugcauauaaaauccuguguuuauuauauuuuauuaaaguaugauuuggaaagauaucgaccuuuaaguagaaacacuaaggaaaauauauuugagaaaaaauauugaaguuaagaaaaaauucuagaagccuucagaagagaaaaugguuuacaaacaaaagacuggagaaauuccugagcugcuaaaaauuuaggacagcaugaaucugcaaccaauguugacaacaucucuagcaccgggacuaaagggauuauaauuuuaggcugaguuuauaccucuccauccaauggaaagaggaaauauugauuccuugaaagcaagugaauuugaaguuuuguugcuauuugaaggugguaucaacuggaguggaauggggguggagaggaugauggcaagcacaccgcccuaccaaugugccaugcuuccaaaucgcugcaaacugucucagugaacuuuuccauaguagcauuggaccugaauugugaauuucaucaaaauuccuuuauaaauaauuuaaguuuugaaaaauauuauucuccccuccacaaugaucuuaacuucaauaugguaugaaaauuuccacaauugguaaaccuuuaaguuauaccaucuguggacaccauuaaacuaaaauuaagauauuguggugaaggaguccgcucagucccugucagucagauagugucuuuauagaaauaauuucaucaauggaaauagccaagaacacaguccugagugaauaaagcacaagacagacauguuuuuggaaaaucaacuguucuuaaacaugaagggagucugacagaggcccccgacuaguuccauuuccugagagaggaauggagcgagaaggcagcuuugaaagaaagaguaaugagaaaugcaaaaaauacuugggcagaauucagaucggcucuuguaauuuugggcaaauuaaagggcauuauauagacagugcauuguuugacaauucggaaacacaaaugacaacuacaauggcugaaaauaaccauagauuauauuaacucagaucugaacuuaauugaggcuugacgcaaucacaaagguggcuaauuucacuuccuuaucaagugcacugagcaaaggaagagaauacguaucuaaaccaguaauaaugaauaucaucaagccuuuugucccagagauauguaauaccauucaauuuaccaaauaggcuaacucauuuuaguaaggaaagaguuguagcaagcaaaggaaguuauuuggaaugauacugguggcagggguuggggggagguuaaucuagaugccacauaacguuuauguccuggauugggaaauuuaaguuuccauucucaucuucuauggaaagcaugcgucuucuuuuuuucccuaauuauaaaaauaugaaacgaugauguaaauccucaauguuagucauucccaauuccuaucuaggcucuaauagugcucaugugaaaaaggaaguacaguugaaaaaggaacugccaugugucagguuuuuuaggcacccaagucaaauuacauuuuaugguauggaaaggcacuuuuaaaacauuguuauaguuuaaagagaaucucguaccucagaucuuuaaaacaccaaaaucaaugguguuguacauucuaauagauuuauaaucaucuuaacuuggcuaucaacagcaucuuugaaaggacaguucuuggcagcuaauuuguuccugcugcuuauuugagauguaaaucucuucuugggacauaaaaacugguuccagggaagagcacaauaauuaucucagagggagcuaaauucuggauuuguuuucuaauauauauaaaacaggcuucucauaggcuguuaaucagaccaauuuggaauacuuauuuuacgguguuacacauaacuuauuuucucagugguuuucucugaagaaucuagaugccaguuuuaauuucuuauaauucaauaaaauauuuuuccaaagaaacaccaagaauggggucuuuccguguaaagguaaacuuaaguuacaugcagaguuugaauccagaaggaucuaagaagucuaaaaguucucacaaagaaucacggggcagaaucuguccaaggucccacagaaauaaaggaaauggaacuaaagucuggauuaugggcacacacuacuaguagauagaugagagauggagauggauggauggauaggauagauagacagauagauuagauagaugauugauggaugauugauagauagacagauagauagaauauugaagggacguagaaaaagaagaaaaaauaaguuuagugaacagacaauauugacaauucaaaauuaauauaaaaauuaagucuuuauuuuugaacagucaaggauuuugaacagucaaggaucuuuuguccuuucugggcagcuagagaaaggaaagugacuccuauggcccaaacaaauaccuugcucucaaacauuuacuguucauggaggaguucaggacugcgaguugaacaaagagcagaagauacagaagaaaacccugggacacuuuaaccaagauacaccugucugggccccaccaugaagaauguuaaguacaacugugugaggagggcuaugaggucagauuggucuggauuugaaccccaacgaugucauuggcaagcucugugauccagggcaagcuauuuaacuucuccaauccucacgucuucauuaauaaaaugaggauaauaaugucuacacacuaugcacagauuuugugggaauuaaaggagauaagaaaugcaaaauaucaaaucauacauauuagcaaaaucauacauuugcuuagcaaaauguauggcaagaauuaggggcucauuaaauagagacaccaacuugcugcaugggggaaaaaugccuuaauaauuuugaagauaaagguuuuuaucuuacucuuggaaagucuguggaugacaggggcucuggcagaacuagaaagaaagcugcagagagaauacaggcagugggcugccuagugauggcucuaagaaggacacuggugucaacggcugagcccuuugauaagggggagguuuggaagacacuuauguccuggauugggaaaugauuucuaaugagcugacauaaagggaucccucagaggcagcugucauacccuuucccauuaaaaaugcccucaugaucuuggacauuacagccaggcauucuucucccgcugaccaggcugggcuuauaaacaccaaagccagaacucuuugcuaaaccacguauuuuuguccuuaauauuuauaaccagugcauagauaaagcugaaaagacugacacuucuagagaagacacuaaaauuuauucccaauuuaguggguuaagaaauucuuuucagaacuugucacuuacaacucuuaaaaucuuggccuuuucgcaggccuguucaaaauagccuguaccaccauuccuaaagcaagccugucuacuccuauuauuuagucuagaacugugucauauuguuugagauagucauuaaaucagugucuaauuuuccugguugaaacuguacuuacuuacuucaacauaaaaaagcaggcuggccgcgguggcucacgccuguaaucccagcacuucgggaggccgaggcgggcggaucacgaggucaggauuucgagaccauccuggcuaacacagugaaacucagucucuacuaaaaauacaaaaaauuagccaggcgugguggugggugccuauagucccagcuacucaggaggcugaggcaccagaauggcaugaacccgggaggcggagcuugcagugagccgagaucgcgccacugcacuccagccugggcgacagugcgagacuccgucucaaaauaaauaaacaaauaaauaaauaaagcagcccuauaauucauuuauucauuaaauauuuaugcagagucuaccauaaggucggcaucuggggaugggauaguguggaauugaggagucugauacaucccugccugcacuguguguucugguucccuguagaaaauugcuggcuauaccauuacuagaaaucguugcuguuaugauuaucauuucuguuuggacagacugaccccauuccaggguuuacuauuguuaccuaaguugacuggauuuuaagugacacugacaaaacuauuuaauggaucauauguaaaucucuuguuacagucuacuuuuacagugaaauuuaaaaauaacuaucuuggaaauaggaguuggccaaaugcaugaaagaaugaaugcauguaagacccgccaucuaacuauuguacuuauuuaaucagauacucugguauggccauuggugucucagcauuaucauacuuuauauuucugccccauaaaguuaaguuggucuucuugauuaaauugugucuuuccuugucaacaagggaagaaaaaaaugauuucaucagaagcaaagaaugauuacaugcuagugucauugaugcuuaaagcgcaucaauguguguuauacaaauguguguauaaguguguuauacaaagcacaacaauuuaguuuauuauauauuuccaaaguuauuuucaguuuguacaaaaaaaaaugacaccagugucauugaguucuucugauauacaagauaguguucuaaauggcuuacgucuaucuuauuuagucccaaaaaacaguucuuugaauuugaugguuuucuuauucccuaugcuuauccgguagagacugaaaucggaggagaggaguuguauaaccugucagaagucucacagcaaguaaguguaggagccuggauuugagcccagguaguuugcuccagagcccauacucaauuucugagcuaugcugcauugauuuuucagaaagggugaguuucuaaagccuugccccauaugauuggucuccaaguucuauucacugugccucuauauccugaguaucuguaaaaucuaccucuuuuucacaauaaacacugccauugucuuagccagcuuuucauucauucauuggccuagauaauuucaacagucucuuuauguguuccucuucuaauuccuucuccacacugcuaccaaaauuauuuuucuaaaucacuaaucugaaucaaauuauuaguacuacucaguggcuccccauaaccuauauauagagugcaaacuaauuaucauguuauccaagacuguccauaaccuggaucucucuguucaacuuuguuauugccucuccccaccuugcccacuaugcaccaacaauagaaucacugguguuucaaacacuccaagacuccucucuuaaucucaugccuuuguucuuuccuugguucguaaagcucuuucuguaguuaaaaucuguugccugaccugaaucuaucaucucccuucuuaugguaauagaacccuauuuuccuucaguaacaugcucuuuuccugcauaggcuaucaaauccaaauucaccuuuucugcuaacacuaugaaaauauggaugggccgcugaaauauuacuccuuucccaguuggccugauguuaagcuuugucaguagaggguguugcauagacgcugccagaggaaaggguuugguuccugguucuggugugcuccuucaacaggcuccugcagcagaggaagcuucuccagcaccagguggccagcagcuucccucaguaugccccgcugugcaauucuguagcagaaugccuccagcaagacaccccuccaugaacagcuuuccucaacaauccaaagggcagauuucuagcaagcuccauuauauuguguggcaccuuagugacuccuuugucaucaagugacccaaggccacacccuccaacaacaucuggaucucaggccugguagggugggguccucccuagagugcccuaugccagccccagggguagcagcuucuccucauaucugccauucccauauuccuuaagaguucuugucauuucuuaugagcuaaucccuuguuauuccaaacugcuauuaguguuaagaauuauuuaaauguucccuguuuaaaugacugagugguuguguugucaucauuggacagaaugauucaucccucaacucugugauggggccaacucuuuccacuuauccccaacuuucagcccccagcuuggacuugagacuccgacuuauugaaucuaggcccagcgauagguucgaggagaggcaaaccucauuuaguucaaugagacccaaucuugagaccucccucucccaaccacaucauccuuucucuuauuguccuaaauugugcagccauacaauaugguuaaacugaucccauuuccagcuuggggugagcaaagagcaggaguccugaccauguuaacuaagaaauuagcauauucuguuauccaucuaaauaauuaacucagagauaugcacaugacugagaggccaauugugccuaauaagauuguagaacuuuuuuuuguuguuuguuuguuugagcuaccaggaaagagaauuuccucuuuugugcuaucuuuagucuaggaucaugcaaccuucaaaacgguuggcaagcacuuugagacuaugaggccuccuaucaggggcuacagagaacagaguccucaguaaggaggagaaagaaagaaaaaccugguuuugucaugcuuuugcaccuugaucaagccuugccugaagcuauuaccucuggacuuuuaauuuggugagccaaaauauucccuuuuuaaaaaacuagguagaauuagguuuucuguuauuuaugaaagaaagcaucauaauuauauuuuccaucugggugagacuacagcaauaugcacccuuuccuaacaugcauugcacucuaugcuaauguccuaaugucuccccaguagccuguaagguuuugaaggcaggagccuagucuuauucacccuuaaaauaauacaucuuggcacaguguuuugcauauggucagcaccuaauaaauaguucuuaaguguauaacugaauaaauaaauaaaucaugaacaaugcagcugcaugaagguaauacugugauagcuaugacagaaaagauaugcuaaaaaccugggccauauuuucugcaguuauaaugagaggcaaggcuauuuuaugauaccaauugacuacuguuauucaaacacaagagccacauuagaacuucaggacuaaaaaguagacuugagaaauaauacacuacugaggcugcaugaggcuguuugaugcaaaacucacaaagucacaguuaauguuaagaucaucaugucucaucaaugccccccacccccacauuagaacagcagcacuauauuuggcccuugguagccacuaaggaaacuugacuucuggagaagcugacuaaggguugcuauuuuguaucuugcuauuccauuuucuagagagaaauuaucaaauaaucaagaacauuauuaucccaggaucuagccugaggauagaaaggugauuguuuccucugacauacacaucuacaugaguuuauguguccugcuaucgcucaugcuaauaauugacaauauaaucugauuacacuaguucagagccuagggaauauaaaugucccucuucaugaucacugauugacaugcaggauuccuuuaaaauuccggaugccacauaucaacuuaacacacugacaaugugaacugauugcaggauauuccagguaucuggcuaggaaaucauuugucagcaacuucaacaauaaaauugauuauaauucaguauuuuuaaauggugucugaaauguaaaugauuacuuuagcuuuacucaggaacauuaaauucucacuugggugcuaacugggcacuagaacucuaagucacccacuguucuaucucuauccuccugaauuuaaaguaacagcagcagcaaaaaccuuuugcagucaugugaaucuuuaauauauacucaaagagaacucaauauuaaaguaccacaaauacuugcaugauagaacaaguagcauaacuugagcaacuaagauaccuauguguuaucugagaagaacuucucaguugccauauaaauuuaaguuccuaaacauaauuaucaaguagcaaaaugcaaagaccugcacacugccaaaccacacgaccucagcagggcuccuaauccuuuacucauuuuuagaggcugaacgacauuugccugugauuacucaagugacuauucuucaucaaccuggcgaacugcugaugaaaaaacaugaauauaaguugcugcggaaaaagguaauucucucuuuguuccucugaguuacucagagaugagaaaaauuaacaucuggaaagaacacaaauaaaauuuugacauauggccugaaagauaaaaaguagaauacuauguguaacacuuaaagguaaaagagauauguagcaguuaacacagcaggaggcuguagucucacuacaggguauuacucaaucugaacccaacuagaaaaccagagucacuacuuuacucuucuuagaaagcaacugucacucuuuucuuucucaucuauguuuuaucauccaggugguaaagaaacucauuguuuauuuaaaaaaauccuugagaaagguguaaauauuuucuaacuugcuucaucaaaauauguaaagcuauuugacauguucuucauccugaguuacagaaaaacaaauaaauagaagcuugcagacaauacguuacuuuauccguccugagaagauaugcuucugcgcaaaagaacugauauacucccuacuacugaguagaacuaugugcuauguuuguuugcaaugaauuauugacguauugucuuuuaggggguaggggcaauaguucaugagagaaaacaccagauggcaccagaaacuguaguuccucacuugcuccacaagauagcaacauuccaccacagcuguuugcuacagacacugcacucuaaguagaacaaauguguuauuuagucuacaaucauuuuuaauuuuacuacugacagucugacaggacuacuuaauauugccagguugaccuuuccaugauuuugugcuaaaucguuaaaaaaaaaaaaaaaaaaacuucccuuacucggcuguguggagaagagauugcaauugacuccccauuacagcaggcuucugugaucugaugagccaacagcacuggucaaaacaggugggaugagaggcaggacugcaggaggcaacugguaccacacauggcgucaucgcccuggauuuaucacacuucucgaguguggaguguaggcaguucagcaaggauauucagcccaucaucacucccugacaguugcugacagggccuuccacaacacagcaaacaaugacauaugagauguaagguuaauuuuguuagguucagucguauuauuuccuugcugggguaaaggaagauuguccuucuguggaaagacuuaucuaaaaauaucgccuucggagacuaacuaggcuguaagggaaagauaacacaaccuuucuuccaacaugcuugagaaggaaguuuuguguaacugaaaagauggauauaacagagacagacuggaggaauggcagccaguguggcagccuacaagugguuccagugaucuuacacucccuauucagcugccacugacaggacacucacuuugugccauucucugggauaagugcuccacaggaaucguccccauucaaaccuccccaccacccugagggcuccacugccauuagccccacuuuaacagaugagauaucugagauuuaucugguagguuaccagacagauggcaaguagauaccaaaccaagaugaaacccaguuacucugacuccagcagcuaaaugguuaauuauaguacuguacugcccuucaccagccucugaaacagguaaagacucuccucaaauugcucagcuuauccaauuucaagagccuuuccuggccuuucagaacccauucccugaaacauuccuaaggaggagaggaaaaaauaaaaauaaaaauaaaaaaaacuuccaagcaguuucuugguguccccugcugcucagggaccuguauagaagcccuaaacagauacacuaccuuuauguuuaugaccucggagcucaggcugcagguguuggaauuugaggccuuucauauuuuuccagaauuuauacauaauuuggaaaucuuggcuacuuuauuggggccaccuucgguaaaagauccugcccaagguuuuuugacagagaauaguuaugauuuaaguaauuucuugaugauuccuccuacugaacaaaucugagcucaauggugaggugagagcacgcucuuguuauucauuuccuaucuccccuggucccuccucauaaccugcuuucacugauaaagaaaauaagacaggaagauuggcugauaggaaacaugauaauccaggaaugcccaggacagcagggguaaccaagcgagcaauugguugguucuccaaaaaggaaaaugugguuugcaucucaucaucuaaguacccugcgaucaguccagaguuggugccaauuguucaggaaucauauuucacugaggguauggaguagggauucucuaagcagaggccauauucccaagcagcuaaguuacaucaucuuuguuaaaguguugaaccauccuuguugcaacuagauaccaaucagcaaguagaaaaauggaagaacgacccguagucaaggacuggggagguagccuuaaucacuauuccauuaaaguuugugaugagaacagggcuucaccucuauuaggaaacaaaagaauuaaaagaaaccaugaaaagcaaggcacauagaaugguguucuauggguuagugggacaaguaugugcccacccagagaaccaauccagguauguuagaugccaggcuuggugaaacaagauugacuuuagccacgggaauuguggauggggccccuuuuuauugccaauauaugauucaaaauccauauaucuacaggagagcaaggcuagaguagauagcaaaauauauucaacauguaauccacacuaaggugggcacagguggucagcugcucagcagagcugaccccaaccugaacuaucacauggaccaagauugcuccgaaucuugagauagaacaaaggcagguccacccuguccaggcucuguagacuaaaagaauguacuguuacacauuccaggaaguaaggagaaaucuaaacucucaguuuuuaggaaaaaaaauaauaauucaagugagucuuacaaaacucuuugacuauauuauugaauauaauuuuauuauuagaaaaaauuggacgugggcaccacauggguagguaaugaacugaucuggugagcaaugaaacaucuagaguagaggccagagcuguaauacacacggucaagauugccacucacauaaagaaaguuuugauaaguucuacauacguacaauuuucagaugggauaaaagucucaugacaucugccauguccgccaggaugaguaagcgugucaccgcggagagcaaagcccuugccgcccguaccauggugccgcgcuuuaccgacgagcaagggucaucugcaaacucggaggaggcgauccgcaucgucucaccuggaagacagacacggagaggcagguggguagacaagaggcuuagagacuggccauccuaaagaucugugaauggacaauuacuguuuuuauugcaaaacucugaugaccaggugguauuucugccaccucuauugcagcaaagagcccuuuaagucaaguacaucagugcacauggacaagugcuguggaccaaacaaggugcucauuucacacugaaguaugaagucaugcuuuucacaucaauaaggaguauauuuaauuccauuugucuaauaguugagauggauuugccuugagcuuaaucauccucucucugcauuugccuuggaaccaaugauaccaggcaacuuaccaugcaacucauugaaguuacugacagucgagguacaaauuguuccacauggaauugaaaguuaagaccuuggccucauuaacacuguacuccuaauugagcuaaucagacaagaacacaucauagaggcacccaagauccaaucuucuaauccucuuaguaaccaauuugccaauauagaaaacauuuagaagagaacuaaaccaauuaaacaaauguuuacuaaacacacacuugugucagauucuguacuaggcucugccauuacaaaguugacuaagaauacccaggcacaaggaguucaaagucucaugaguaaacagguaugucaacacauaaucagaauacaguaauuaagugccauaagagacaagauuaagaaaguaggcaacacagaggggagagguauuugcucauuuauugugagacuggggggaagcuguccauuuuaaugggaugcaaaaaagaaagagguguucaccaggaaaacaaagguggggaggggaucucaggcagcaugaacacuucgugggcucugaagccuggagccccaugcugaguacagagaccugcaguucucuggaagaacccaugaggaagggggcuggagagaggcaguaaugccuagaacaccauguaagagguuuggauuuuacccucagcagggugggaaguuacaauaauagauuuuuauuuuuggaagauuauuuuagucauauuacauaaaauaaacuggaggggaaaaagaccaggacagagaagucaguuaauaggguaaaugcaguuuuagucugagagagcaguggugagagccuggaccaaggagaugggagagggaguauaaaaugcaucugugugacacaaccaaccgaucuaagggcugacuagaugugaagaccagacaaaagguucaagcugacgaugagggcugacacgauacaagagucagguauauauuugcaucaagggacccaggaaugggaaacaaagagauaauuaacaaggauugagacugauaaccaaaucaguggguggauauccacuuuggggagugaaaacugugagaaaccauaaauggagcuucauauagcagaguguacacagggguauaaaagcuucaauaaacuugaagaguacaguuaauaugacagauuuuuuaacucaagaucaaacaauuuauucaauuuuuguaguaaugauuacuacucaccuacuaagcaaaaucuagcucauuuaaaugaagccaaugauagcauggaaagucugugcauccuguaauuaguccuagucauaagaaaaaauaaaaaacaccucuuaccauuuuauaggccgaucagaauauaaaguaauucucucagcuagugugguaguuauuuaaacccucacagugauacuuuuuauacucgggaauguggguguguaaggaaauauauugcacuguuggauuuuuaaaagaggcuaccaucuacaauaagcauuuuauauugcuaaccagcuuagccuuuuugccuaggcacacacaaauagcuugauauauaacaacagcaugggagaaacuuaaaaauucacuacucuaguggcacaaugaugaauuuucaagauguaugguccuagagcucaauccaaguguccuacccuugccacaggguuacauacaucuccuccucuugccucuccuccucacaaauaaaaaaagucauuggcaaauaucuguguggugggagaaagaaagccaccuuuucccuacuuuauacagugcaaguagaaagaacauuauacaccaagguaaauccaacaaacuauugacaaaagugccacaaguagagcuagacaaauuuguguaagauauuaauagguaagucagcuacuguugaaauagauccacuuauucaagggaaagggggauuuauucugcacacgaacccagguagcuacaugguugaucccaguuccugcaggugaaaucgguaugagcccuagcaugguuaaaaguaggucacucagguagggcuauuggcagaacagagauccccaggaggagagggcagucacaccccuucccugcagguggagcuugugcacuacuugaagaaccaugccuaauccaauauauuuucaaguugagauugaacauucggaaugaaccaacaucauuccagaagacaggucuugccagaacgaggggcucuggagggccuagaacgacuccuuccaucugucuuagcggcaccaucgggcaucuggcagaaguguacuggcauuucaugcagaugccaaccaucuggucagcacuacugcuucaaagccgaugggugacacgugucagugcagagaucuuagguggagcuaaucaaccuggggcccacggcaggcaccccaagaguggcucagcagauguccgugagagggagacagggaagagacagacagagagagagagaaagaaagagaaagacagagagagagagagacccacauuagaaaaugccaucugccuuucuggauggaaaacucacacuaaauucugagauuauucuaagauaaauagaagaugauuucauucaaagcaaauuaaacuaaaagcucauuuuaagcagauacaagugauuucauguugauaaggauuccaaaggaaaggcaaccucaaaucagcuauaauuuuaauaggucuuagucccugcagcuuuaagauuacugaagcaaacugauaagcaaguuuaucaggauaaaauuagcuacuuucccaggaauguagagaaaagugcuuuuucuauaagauugaaauauuucgcuaagaaauaguaugcauguguaagagggaaauggggcagugaagagaggguacaagagaucugccugcuucuuuuauauacauucuuguucaaucucauguacuugauuauagaccuaacucagagcaacauuuccacgguaaagccuuugauguccucuagccacuacaaccugcugaaaagaagaaaaauuaacauuaccaaauaagggaccaacggaaaauaacaauuuuaacauguauguagugcuucuauauaaaggcuuauuauauaaguauuguucuaaaagcuuuacauguauuaacucauggaugaaaaaggauaaacaaagucacauugaccuggguucagaucucgacuccaccccaacuauuaccaaauaugugagcuagugcuuauucaaccuuuguauuucaguccagucaacuguaaaaugacagggaaaauaaugacagcugccucacagacugccaugagaguuaaaauuagagacgaugcauucaaagcacccaacauggggccuuacccauaacgggugaucauuauucauuaauaccacuacuaucacaaccacuucaagcauccaaaaugcaguaagaagaguuggugaucuccugguuacagguuuaaaaguguauauuuugguugguuucacuucuuguguuucuuccuuagaagcaagacaacauaugcucaauaaaaguacuuauuguuugaagauagaauauauauaaaaaaaaaauggugcucugcuuuuaaaucagugcuuauucugguuccuaggcuacccugaaagcacugggaugaauacauaauugugcaucagcuugagguaagaucaauucaaauguggaaugaugcaugccaguaauaauaaacacaagaaaaggauggcaugggcugggcgcgguggcucacaccuguaaucccagcacuuuggaaggcaaaggcggguggaucaccugaggucgggaguucaagaccagccugaccaacauggagaaaucccaucucuucuaaaaaugcaaaauuagccaggcaugguggcacaugccuguaaucccagcuacucaggaggcugaggcaggagaaucacuugaacccgggaggugaauguugcggugagccaagaucacgccauugcccuccaacaugggcaacaagagugaaauuccaucucaaaaaaaaaaaaaaagaaaaauaauaaaaggaaaaaagaaaaguauggcauguggaaggcagaguuuuaggaacaaaaacaucagguaggaaucaggucaugaaccaaaauggcacaaauauccuguggcucuuuccuugaaggaggggccugcguguaaggucagcacucuaaaugcuugacaacugaacugcugaaaaacugugagaagcaaggaaaaauguguggugaaaagcaagauucaaagagugcugggugaagaaaaugaaaaccucagaauuguugaugaucuuagaggcugaagaggauuuaacucgucuuuuucauccagccuggucaaccuagugagacccuaucucuacaaaaaaaauuuaaaaaucaaauugccaggguagucccugcuacucuagaggcugaggcaggaggauggcuuaagcccaggaguuugaggcugcagugaacuaucauugcaccacuccagcuuguaugacugagugagaccugucucaaaaaaacaaaacaaggugcaguggcucacaccuguaaucccagcacuuugggaggcugagguggguggaucacuugaggucaggaguucaagacuagccuggccaacauggugaaacugugucucuacuaaaaauacaaaaaauuagccaggcgugcuggcaggugccuguagucccagcuacuagggaggcugaggcaggagaauugcuugaacccaggaagcagagguugcagugagccgagauuucaccauugcauccagcccgggaaacgaggguuaaacugcggcugugcgcgguggcucacgccuguaaucccaacacuuugggaggcugaggcgguuggaucacaaggucaagagaucgagaccauucuggccaauauggugaaauccugucucuacuaaaaauacaaaaauuagcuaggcgugguggugugcaccuguagucccagcuacuugggaggcugaggcaggagaaucacuugaacccggaaggcggagguugcagugagcagagauugugccacuguacuccagccuggugacggagugagacuucgucucaaaaaagugaagcuccgucucaaaacaaaacaaacaaaaaaacuuuucuuuucacucuuucagcaauggcaaguauuggacuuacucccuggaaucaaaugaugaaaacuggaacuagugugagaaugaaaaugaagaaaaaggcaaaccacagagcaaauguaaugaaacagccagaauaagagcagauuaagacaugaaaagccacguagggaaaggaauugcaauguauuuccuauaccuuccaugguaauuuacauugucaacauuuuugcuauaaaauaaauaugugcuccuuaagagaacuaaaaaaauacaauuaaaagaagccaaaagagcauucacaucuuaauaaccaaggacaacauccgaugagcuagcuucuagacaguucuguaugcauauguuuuuaaccagcaguuuucacacauaauagcuacaacugcauaucaucuuuugucuaaaugcguaauuauccuuuaucuaauuacauaaauuauccaacauauacugauaguucauguuuuuuauauuucucccuguauuacagaauucuuagaaaagaugagagaaggccggguguuguggcucacaccuguaaucccagcacuucgagaggcugaggcgggcagaucauuugaggucaggaguuugacaccagucuggccaacagggugaaaccccaucucuacuaaacaaaaauuagccaguugugguggugggcaccuguaaucccagcuacucaggaggcugagacaggaguaucgcuugagucugggaggcguagguugcaguaagcagagaucauaccauugcacugcagucuaggcgacagagugagauucugucucaaaaaaaaaaaaaaaaaaaaaaggaaaagaaaaaaaugaaaaagaaaaagaaaaaaaaggaugagaaaaagggcaaaaauuuccaauccucuuaaccaguuuguucccuuuucaugauaaccgacaccugccuaacaaccuuuuucacauguauuuuccaugaaguacagaucuuaaaggauucugaaaaacggaucuuguagagcaaugcagaaacuaaaacauguuuuuagagaggaaagcaacauuagugagggaaacugaccacagguucccaaagccuuagccaguucugcaacucaaacugugcaucccgauugagcucacacacuuacagagacugugaaggaaaauacauaacagaaucuuaaaacgguaauucagucaacaauguccaacuucagaacauuuuaucauuuugauuauuuuguagagucuguaaggcaauguaauacuugaaaaccacuuacaggucuggucagcucauuuucaaagcaaggugggaaaauaucuucauuugagacaaaacaaacuuaaauguuaaaugaauggccaagguggacaacaccacagaaguuacaaggucaccacagaagaucuugaugcauuacaucaugccucuuggcuccuuuucuuggaagaaauaagugagugguucuuugauaagaaucaggcagaguuggauaauguguugaaaagaugagguaagcagguguugauguggcugagggccucugcucuaacuacauuugcaaacauaggaaugucuucuucugggaugguuccagcagcaagggggugguguagcagggugguccaagauuccuuccacuuuaggaucucauuaggcuguaucuaucuggacuuaauauuuuagcauguaacucuuucaucuauaauaauaauagcucucuuuuuaagagcucacaaugugccaaguucugcucaaagagcuuaaccuguaucaacucuuuuacuacugaagagaaucugaugaaggaaguguucucauugucacccuuucuaucugaggaaacugaacacagaaaagaaagauuauuaagguuauuugcccaaggucaaacagaugguaaguggugaaguaggcauucaaaaucugucuggcucugcggucuauccucuuaaaaccagugcuuuagaaauaucuuuauuuuaacauccuguuuacucugugaaaauuauuuguuuacauaugucugucugcaccuguauuaggaguugaagacuaguaaauuauguuauucaguuuacaggguauaggaaggaaggaagcaagcaagggagaaagaaaggaaggaagggagggagggagagagggagggagagaaggagaaagggagggagggagaaacaaacagagggagggaggcagggaugaaggaagaaaggaagggagagagggagggagggagggaugaaggaagaaaggaagggaggggggagggagggaggaaggagaaaaggagggaaggagaaagggagggagagagaaacagagggagagagauacagagggagcgagggagggaugaaggaagaaaggaagggagagagggaaggauggaggaagggaggguaggagggaggaagggaaggaacaaggaccuaaacaaagacacuucuccaauuauucccagccuccaccacuccuuauugucacauguuagggaugauuugugacucccugugcaugcaugcauuugaguuuucccuccuuccuugaccuguaagcuuaaucagugaagaaaucauaauuguagcacauuaauuuauuuaaucauaccuuacaucgguugacaagguauauucccucaaggaaugcugucgagaggaggaaaggaacgccugccuggcacuuuacauuuugaaccauauugaauugauacugaagcagggagaaaagacaaaugaaaucccagaugcuauacacucuacaauaaaauaauugaaauacuuucuucuuuuucauguuugaacuuuuaguuggauuucuaaguucaggaaguagcaaggaaaccaaaacauuugcuaaaggaaaguucuagugaaaggagcaacuccuuugcuucuccucuguuuugcccacauaggccuuugcuagcaagaaggaaaaagucuuaacacuuuuuuggaaacuaucaagaauaugagagagcuauacaugcauuucaccccaggguggcuaugacugaaaucugugauuggggaaaaggucaacaaucaacaaucagaauuuuucucuaaggcucagggaugcugaaguccugucuuuucucaagcagaaucugcauuaaaauaagcuaccuccuguggacacuuuaagcaccaagcaguuacagcagugcuugguacuauucaggucuuguuaucaaaaaacaagauaauauuuggcuuaaauaagcaguauucagaagaaagccuuaucugcuuauuaaaaaaaaaaaaaacccuaucaugcaagccauaccaaaacuauguaaauauuauaaaauaagaaggcugccugucccuuugucuuucuaccaaggguagugggcuccauggucucuuuaucauucuuuagguuuuuccagaaacucucagaaaacaauaaauuaggugcaaaaugacagcagucugauggggccacugccucugaagugauguugagacuggugaauuucagauccggaugaaaacuccucaggcaucauucagcaccccuuucucaucucacacaugaagacacagaagcccaagugccguggucaggugguuggugggggucagcaucccugucuccugacaucccagucagggacucuggucucagugccauuguugcugugaggccaauaaaucccaaugugacaccagcaaaucaaacucuccucaccuaacaaaaucccacuauagccacaugguucugugacaacccuaauucaguggcaagagcagcuccaaauguguccucauuuggucaguguucuuucccaagguacauaauuaagucuuuuccaauguaauauuugcccuaucaagauauguucaguaugcaaaaguacuagaaaugucaguaacuaaugauuaaguguauugaauguuaugagcuauuaaacaucguuagagacaguaaugcgccaccuugcagaaggcacagaucauuaaccguauggauuuuaauuauuucagcuguagccuuuuccuggguugggagaagaggguguaggguaauuuuacauuguuguagccagaaagauuaugaagccgcaauauggcauacuucacaaaugagaaccuugcaaagaccuguuaaauguagcaauagccacauuccauaaaaaggugauuauuguuuuggccuugaaugcaagagaagaccauaaauuaggaaacguuaaacagugaugaucuaagcuuaagagaaaaauggcauauagaggaccaauagugaacucaauuuuguucaauauuuuuacacauaaagggaagauacacugauggaauguaaauuucauugugcaacacauauauuucugaaauaaggacacuauaucguauauauacuaaagaaaaccuauuguaaguuaucuuguaaagcauauaagcagccaauaaauuaauuuuucuauaaaccccaaauuucaauaaguaagucaagucucucuauaaaaaucaugcugcugacuuauuuauauucuuaagucaauaaauguuucuauugaucaguaccuguauucuccuacaaccaugacacaaaucaaaacgcacugaaaugucaguacccugcuacaguacuugguaguugaagugugacuucaaaaaccuucuaauguuauuaggaaaacaagaaucaaugccacaacuuccaucuagauuggacaagcagagauaacgcgagcaucaaacaugcuagcaucuaauucugaaucaaagagacggcagcauucagaaucaacaucuugacauggauauguaaaggacaucuugauuuccucaugcuccuuaagauacuguacaaggaaaugcagaguacagaggauggauuuaauguccaaauuccagacuuuaacaauaccuuggagggcaucaugcagaugaaauuuuaacagaugcaaaauccaggugugaccucuaggacaaaaaacgcuuugucuuucuaggaaaccacuccaauuuguucuagcuuuuuuuuuuuuuuuuuuuuuuuuuuuuuugagacagagucucacucugucacccaggcuggagugcaguggcaugaucucagcucauuacaaccuucaccucccagguucaagcaauucuccugccucagcccccugaguagcugggauuauaggcacaugccaccacacccagcuaauuuuuguacuuuuaguagagacaggguuucaccacauagaucaagcuggucucgaacuccugaccuugugauccacucgccucagccucccaaagugcugggauuacaggcgugagccaccacacccugccugugauagcuucaauuguuaacauuuuuuucuucuauuuggucuuugauacgcucuucugaaccacacauaaaaauauaaucuucucuucuauaggguagaucuugggaaguuuguuuaaauguccuuuaagaagggaaaugucaagaugaaugcucauuagccauugccugagaacuaaugcugagguugcauuauaaaaagaacaacugacauuaaaaaaugagcaaacaacucucuccagguuuccaaauauuaaauaucuacuaaucauucaagucaagaugauuuguuuguucccacacuacuuuuuaagccaauuaacauguacauauaaaaagauauuucuaaucugcuuuggaagaaauagaucugguuucuagcuuguuauaaaaacaauuaaaacagucacaaguuacucugagcuauuucaguaucuaaauuacuacauauauuugaaagacauuaacugugagcucauugguggaacucaaugucugaauuucagaaaauaacuaucaaaaucuuuaauggcuuucucaagcucaaauaaucaacuaagggcacaguccagaccagaagcugggucucucaacucugauauuuguauuugcugcaguuccauauacuuuggaggaaauauucuguuucugauacaguuucacaaauucacaacuuacuguccccaaguuaguccauauaguugaagccuuuguauaucaguuuggaugucuugauacuccacuuauguguauguauuuguaagucauuacggcaucuccaaauuuucauuaguaaaacugaauaauacuugaauaauacucgcaucacugauuucauaucaacuaaaauacaaucggagagaaaagcaaaugagaaguauaaaaaaggcacauuuuauaauuugcaucuuauagacuacagcuaaauaaaccaggcuugaaauugcuacacaguaaaauaagaagucaaucuagcuuuuucuaaaggagucuuuggcuaaacaaagcacaggaacaauucucagaaugagaaaaguugauuaaagauagaaaauucuaccacauauuucaaaacuagaaaaaauguuccaaguaauugguaucaugaacaugguaaaugaugcuauaaaauuacagcucaauuaaguuauauuuuaaaaugcaacguggggaaaacugauuuuccucacuggcuugugggugaaaagacuagaaugaucagguuuuaggauuuaaauggcauagccuuuaauuucugaccuaccacugauuuuccauucuucacagagaaauggucguuucuuaaaugcgauuauagccacaaggccucuuuacuaaacugugggagguccccacgucaccaccauucuauuuccuauauuaagaggauuuaaagaagacauaacauuuaaaugaauaucaguguauaaaccauaauaaaacacagcuaauaaaaauauauuugugcagcaagaagaucugacaauggguaaugaacgaaauugauuuaagguaacuaaaaacccuaaauccaauaugacaaacugccaaaaugugcuaucaaagcuuucuucacuccugugaucaauagcuugucacuagggucaugaugaaucucagaugggcuucucuccuuccaacucaaaaauacauuuuuaaaauaaguaaaauaaaguuaaaacaaacaucaaccuugaaagggaaaaaaauguuccgacagccugacaugcagccuuaagggugagggaaauuugggagauuuggauagcagugacaucuuguccuuacucucuuagugcgcaccauugaugauaugaacauagcuauaugugugcuuguguacaaaguauauaauuauauaucauuucauucauccuuuuauuuauucaauaagcauuuauuaagcacuugccauguagcagacacuuucuagguccuagauauucaacaugaagucacaauuucugcccuacuuacuuccagcuugaugguucugaaagacccacuaacaagaaucaccugcagaacaacuauagagaaaugcccccuaaguggacauuuagaaauucaaaaaaaaaaaaaaaaaaaagcagcuguguuuagggaguugggaaucaugaguauguaggggguacuuagucaguuaucauaaaagguaagggugcauauauauauauauacacauauauauauacacacacacacacaaaugcacacaaauauauauacacaauguauauacagauacacacaaauauauguguguguguguguguguguguaguuuguuuucauucuuuaucccucccauggcagcuuuuaaucaugacuuugagagauggcagagaucagucacacacagcccacuccccagcccacacuccuggcuaaguuucuaaaagacaaagaguauagaugaguuucuaaaagacagaguauagaugaaaaugucccaggaaaauacacugcugaucaucaagcaguccuucggccucauauugagcaagccugcaucaauaguucaaguucaaggcaucucuaaccuccuaacauuaagaccuaaaugaaaagcgggcuuuagggccaaaggucccucucuguugggccccauuuuacuucuaacaggauuucugaggccaagaggccccaacuuaccacaccaguugcaugaaguuggagggagauguacaguaauaaacgaaagaaugaagaucacaggaagucagugaauuuuacccuuuugucuccuacuacuggaaaugugacccacuaacucagacaaaauaauguagaguauccaaaacgucaggaaauauuggacaaaauuauuuauuucaaagcuaguuaaauuuucaaauaauaugcuccauauuuuuuccuucaaucuccagacacuauucuuaugaaguacaucaaaauauaaagcagggauccuauuguuaaacugaaaauaaguagaaucaauuuuuccuguauuuucagacuuuuuggauauucuuugguguauuaacaauucaaucuugacucauucugagauuaucuuggcagucucagggucuuccugccucuugcaggcugcuuccaagaaaagggagccccauucugugcuucuuaguguuuauuuccuuuaaaggaaaaugagaaaaucauuauaaaugacuugaaaauugcacuguuuguaccugccagugaacguagguacacagucccuaggcaaauauauuuuucacuacaaauuuaaaaacucacauugggaguacaauuuaacuucccacauaggucugccuauagagagaauaaccuagccugcugauguucgcauucuacucuguaugacauuacaauaaggauuaauaagcuaacauggauuuuuuuuuaagcaaacacucaugguuguuuaauucuuugucauuuacacauuauggaguuggaguuggaguaauuuagcaauuguguuggggcacugcuggaggguguuucaucgugguaaguacgagaacugguuuugaacaaugaagggaaaguucguuuucaacuccuacucugaacagcaaguggcuuuauucaccaaaaggaguuuaaagguauggcuggguaagaaaauacagaugccagauaagcuguagaugcagagagcuuguauuuuagagacagaaagcuuaagcauuacugagcagaaaccuagguuuaacaagcaaaauucuaagccacuuccaggcaguauuuagggccgugaaggaagaaguaggcaucgugacauacuggacggggacaauggcagcccaggcugauccaguucaugcccucacggaggccaccacucugucaugcuaauccaaggcugcuauauuaacauagaaaagaaggccagguaugaauccagcaugcauccauuaccggauguccuguagaaacaaugaguagucaacuuuaauuccugagaaggagugugguuucaguaauuuuuaauagaucuauuuguuauccacacacaauuccaaguuaaagaauccuuucagguguaaaugcaugagcauacacacaucacaucaacuuuccaccaaagugcacacuucuuaaauacuccaguuaaugcuuuggcaccaauagcuggcaaaaccagugaaugaaaccauucacagaauuuagccuuaaggcuucuuuugccccauuguuacacauuuaaauuacaauugagauuccucaaaccuaauaauuucaauaaucaacagauguaguuagagauuauaucuaaaaauggcagcauuguacaaaucuauuuugccauacucuguguggaucucuuugagauuaaacaaugucaccucuucucuuccaguuacuuuuggcacaucucccucugcucgagacacuaagaauaaauaaguaacaauuucaaugaugcuuuugaauucuaugauguaaaauacaauaacagcugucuuuuauaauguacuuaguagauaccaggcaaaauacuaagcacuuuauaaauauaaaaucucacagugagguggaugacacuagcuccauuucaaagauuuaaaaaaaaaaacacacacccaaaacuacggcuaaauuuaaauuguucauuaauuuguuuaaggucacaugagauagucagcuucaguccugagauguaagucugaaagucggugaucuuaguaaccuugaugcaaagagaagcucuaagccaaggguguacuguuagaaaaacuuauaacacaagggaguggagaugacaaugaugaugaugaugauaacaaugaugacuuagaagcggaugaugcuaguaauagcaauaauaauagcuuacccuaacauggugcuucccuuguuccagauacuguucuaagccuuauaucuacucauuuaauacucauuuaaaacuccaugggguacuguucccauuucguacaugaagagacugaggcacagaaaggcuaguuuugccagaggcuaaaaaacauuagguaauggaaugaggauuuuaaucuagaaaggcuagcuacagaauuugggcuuuuaaccauuucuaaaauaacacacaugguuauaugccaacaaaaauaguaaaaauauaccaagacauaguuaaaacaccaaugccaaauguauauguuuauaauuacuuuguggcuuuauuuuugaaaacuaaucuaaauaaaauccugauacuaaaaugauguuuucaugaaccauaauuugaaagaacugaaacacuauugaaacaaaauuaugaagggauauauaaaguaggagaugcaaaagaaaaagaccauuuucucucacagugaauucagacauauaaguauuuaugcuuguccugauuuauaaauguucaacuaaugauauuauggauaucauguuguaaucagucccaaauccuuuuuguucuguaacuagagacaacuuuacagccuuccuuagccugaagguagccaaugguacaagagcaagcacaaacaucuggcuuuuccuuugcucugcagaggguaaugaauuccauuguuaugucccaguuaauguuucuucauuaagacugaagacauauuuaaaggaucguugauugcgcauauaaagaucacacauugcuuuccuaaagaaagcacaccuuauaguagaaugagaaauuauucaucaucuauaaagauuagucugcuucgcaccuauuuugcacgugugcccacuaauuuagaccaaaaggagcaacaaaaaaggacuaauauuucaucccaugacagauuuucauuaaucauuuuaaauucccaccuucuuaaaaauuagauaucauuuacuaguccuuuucaguuagaacuugggacuccucugaaucuuaggcuuauuugccauuccauaggaaaauuaggaaaaaaauuaauaaugcuaauaguauuuaauauuccucuaggaaaauauuaaguaaacaaaaguuauuagcaggacaagcucuucaaauaauuguauuuugucucugagaauguaccaauaaaaaaguaggacucagauuucuugaguuuaagucccaguucugauacuguuuucuuguuugacucugcauguuucuuagccuuucuaaacagauguugcagugaguugauaucgcaccugcacuccagccugagcaacagagcaagacccugucuccaaacaugcuuacaugcauagauacauacauaagagagggagucucggcagggcgcgguggcucacgccuguaaucccagcacuuuggaaggccgaggcgggcggaucacgaggucaggagaucaagaccauguuggcuaacacggugaaaccccgucucuacuaaaaauacaaaaaauuagccgggugccguggcgggcgccuguagucccagcuacucgggaggcugaggcaggagaauggcgugaacccgggaggcgaagcuugcagugagccgagaucgcgccacgccacugcaguccggccugggcgaaagagcgagacucugucucaaaaaaaaaaaaaaaagagagguagucucgcuguccugccugggcugaucucagacuccuggccgcaagugcuccucccaccuuggccuccccggggacugggauugcuugugagcuacuguacccagccaagaaguggagccuuuaaaaaaaugccaucauuaaaaugaauaaaauaauaucucuuauaauaggcucauuuuaaagguaagaugagagaaugugagagauugaauagcauuuaaaaagucuccaaacaccuggaaaugcauguaaaguucagcaaacaucuuuauaccuggaaggaaaaccucugagucaaaauaaauaaacaaauacaagaaagaaaaagaaauuagcaugauugaaauaaugcaagcugauucugaaguacugguaacuuuagaguuaauaacuuauaagcuacaguugucguggccacacaaggaauaggagaaugucuugaccuucacagaaaauagaacuguacaguuguccaccuaagauaaaauuuauauucuuaaagugcuaugucgguaaaaauauuaacuaggaaaaaaaugcccuguggcaaagacaaaugguaaagaaacuuguugucucaguccagaaaagaaaugucacaggaaaaauugcaugguuucauucauaauugauaaugauaacuuauuaucacacaguauugucuucaugugucuguagagaauaauuuuauacuuucuguacagaaugggaaauauggagcagauaaauuauuuaaaaacagucucagauaagaauguuuuaguggccuuagccaaaggaaaacgaacccuuuuccaaaggaagcacaggacucucacaaauaagucuucauaaaaaaauuaguauacaguucaagaaagcacuacagaugugcuuaguggcagaauuaacaauccaagaacuucagauaauauaaguauaggauagaaaauauuaaaugaauauuuaaaaauauuuacagaacuagaauaggacuugaaaauaugaacuaaggacaugauacucugaaucaaauagauuuucuuuagaaauaauagaaauaaaaucucaaaggaagaaauaaauaacagguuagacccagcuaagaaaaaaaacuagaagauagcugaagaaauuaaccaaaagaauuuuaaaaagcacaaauaguugaagaaauaggaaauaagaaaaaauacguauguuaaggguaaagaggaauuuucuagcauaagucuaaucagaauugcaaagaaaagaauaaguacaaugaaaaagagcccuuuuuaugagauaauggcugguaauuuuccacauuugaaauauaaaauaaauucucuuauucaggaagcccaauacauacugaacaagauaaguaaaaagaaguccauauuugauagcugcauaguaaaacuggagaauucaaaggccaaagacaagguauuaguuugucuaggaagaaaagacagacacaacacaauaaaaaauuauacuguuagcauccuucugaaauggaaaauggaagccaggagacaguagcacaauauauucaacauaaugaauaaaaauaauuggcaaacuuuaauuuuauaccuugcuaaaauauuauuuaaaauuagaguaaaauagacaguuccagagaaaugagaccacuuacugccaaacgccaugauuaaagaaaguauuacaauuuacuuuuuguacagaggacugcaauucagaauagggugcgcuuaaaagauuaauaaauuaauauguauaaaaaaacuuugcccaguuuauagcuggcacauaguaagcgcccaguaauaagugguauuaaguaguaauacuaauggugguggcagcacaacugaaguaguaguaacaguuguaguaguauuuucuaauaaagaugacuaauaguguuuuuauggcuuggagucucuaucauuuaucuuauacauaauaucauguggcacuguuuucaucuacacggaauucauguaaaguacuacuaauucaaucucaucaguauuuucaauaacuacacaguccucuaccuuuccaaagccacuaucauaaucaacacuuuuaauauaacacccaagaucuuacaagagugcuuaguguaaguuccccaguuucuuguuucaucuccuacuuucuauucaucuuauguucaggaguuaaagcugucaaauuagucaaaucaugagaaucaauaccuauaauaaugucuaaucagaguauguucuuauguuagaucaaaaccucuaauaauuagucugaaauaacucuaccaauuaucacucuuuuauucagauauagccuccuauuguuuuggcauauauuccauucuagcauggaaaccccuucuguauuuuucgaaaacacaacauuccuuucuucuucuaaaccugucaucuucuuucuuuacccuccacccuccuacauucuuccuuccauggccagcauacuuuccucugaucuaaacugcuuuuguucuucuuugagguguagaaagcuagccuauacaauucuaguuauuccaaauaauacacuuuaaauccuuucauuaaacccucaacuuucauuaaauccucaaugaaagacuaaacugagcucaaugaguauaauuuuaauauuugguucacuuuauuauuuuccaaucuuuuaaaaguaguaauccauuuacugaguauaguauaauucuauuaaauggaaucaaucucauuuuuaucacuguucuggacagcaaagaaagaccaaucaguguagaggacuuggcccaggauuauuauaauaaauauucauaaucagucuuaaucagaaauauuguagaaaaucaccuugcauaauauuagucucuuuuguuuaaacuggguaauuuucuaaaaauaaaauaagccauguuuggaaauuacaaaagccugaacaaugaaauuauagaucuuuuggaguuguguuauuuucccauaggcuaaaaguauuauuuucccauaggcuaaauguugaaaaacauuuccaacuguugauuuuuuuuaaaaaaaaacacacuuucuacuuucuaacaauaaauuacaaauugagaguauguuuugaggagcuagggaguaaaaagauaacaauugguauaggagaagagaaaaaaaaguuuucgcugacaccucuccacauauguaccugaaaaaaaaaaucaacgauugcaucuucaauauacaccucugccaugcucauuugagagaucauuggcacaugguauuauucaauggguuggguucugugaugguuaauacugaguguugacuugauuggauugaaggauacaaaguauugauccuaggugugucugugagggugaugccaaaggagauuaacauuugaguuaggacugggaaaggcagacucauccuuaaucuagguccucacaaucuaaucagcugccagcacagcuagaacauaaacaggcagaaaaauguggaaagaagacacuggccuagccucccagccuucaucuuucucucgugcuagacgcuuccugcccucaaacauuagauuucaaguucuucaguuuuggaacucagacugacucuccuugguccucugccugcagauggccuauugugggaccuugugaucacaugaguuaauacuuaauaaacuccugcacauacauauauauuccauuaguucugucccucuagauaacccugacucacacagauucaaauggguuuaauuguaucucccuaaaauauaugucaaaauccuaacuuccaauacuuacgaauucguccuuacuuggaaacaggggucuuuguagauauaauugaguuaugaugaggucauguugaauuagguguucccugauccaauaugacugguguccuuacaagaagagaagacaggaggcugaggcgggaggaucauuagagcccagaagguugaggcugcaguaagccaugaucaugccacugcucuccagccugagugacagagugagauucuaacaguacauaaagaaagaaaaagaaaaaaagaagagaccagauacagaauacaaggggagaucacauaugacaacagagucagagaugaaaggacugaagcuauaagucaaggcacaccaaagaugaacagcaaaccaccaggagcuaggaagaagcaaggagggauuauucccuacauguuucaaaggaaguguggccuugccaacaucuugauuuuggacuucuagccuccagagcuguuaaaaaguaaauuucuguuguuuuaagccaugugguuugugauacuuuguuauggaagcccuagaaaacuaauacagaggaaaugcaugcaccucacuucugugaaaugauucaucuaaauaaaacauuugaaaguguacucugcgucuuauccuugguuguuagagcacugaaaaauaauucagccacugagauguuccacaagacuuugagaaaaugcuauuaaaauucacacucaaaguaaaaguuuagucaucuagggaccagcuuuccagaacaucaagcgucucuaaugacugcugaacuaaacauagucaagguuaaaaugcaaucaauuuaaggagcaaaaaaagcagccucccuguguggugaggaagagagacauauugccaagaggaucugaagcuccaaagauuaaacccaauuggcaggaguugucugugaaaagucaucccuuccauacaaggcugagaagugagacagaaguggcaggaggccaaagaaacaagaaaacuagagaucagcaauugcagcaacuagaaauggugcuagggcagugagcagugaaaacugaggugugcaagucagagaugaaagaagagagucaaaaacaaagaaagggcugggcucaguggcucacaccuguaauucugacacuuugggaugccgaggcagguggaucacgaggucaagagauugagaccauccuggccaacauggugaaacccugucucuacuaaaaauacaaaaauuagcuggguaugguggcacaugccuguagucccagcuacuugggaggcugaggcaggagaauugcuugaauccgggcacagcaacacucugucucaaaaaaaaaaaaaaaaaaaaaaaaaaaaaaaaaaaaacaaagagaggccauucugcagcacagaaaguggcaaggauccuuuaggcuucacaucuaauggccucacucucucaaggacacacagaagacaucugucagcucugcagcauaaguaggcagauauucagggagguauugccugaaagcuauuagaaucucaauugcccaaugaacaagccaagcuaggggaauaucaacauucaguagcuuacucucauaugucacucuaguagucacuucuaaaagaagacucaacgaugacuaaaauguugggucauuuuccugccuauauuagcugacugauucuacaugcacauuucauugcuauuuaaaauauaaaauuguauuagaauccugcuuuaaugagaaaacagauuuauauggacucaguauacaaaaguuuuaaauaaacaacuuaaaaaugaaauguuuaauguuauucuguucagauuuuaaggcgaauacuaaaaagcucuuuaggugaugauacucaaguuuugauugaggaaaagagggccaauaaauaauaagccaagaggauugugaagaauuuuuaaaaagggguaauaaagcauugcccugauagauaucaauauuuauuaauaagcuaugguaacuaaaucaaagugguauacauauagaaauugaccuauagaguagauagccugcaaacagcucaacuuacauauaugcaaaugugacauaugacaaauagggguggauggacuguuuaauaaacagugcuaaauauugacuaagaauaggaaaauuaauaaaacuagacuuuaauucaaagaguaaaaagucaaagauaaagacuuaaauguaaaagcaacauuuuuaaacauuuagcaaaauauuuagagauauauuuaugauauuggguuagaaaaaaauuucuuaaauaggacacauauacaauaaagaucaaugcaacuaauuguauuuuuaagaaaaauuuauacaacaauaggcauaagcaaaaugaaaauauuagucaugcacuggggguauauuugcaaaaaauaguacauaaaauacaaaguuugaauaugaaaauguaagaaucaugcuuuaagaugacaaucaacccaaugaaaaaggagacaaagaaaauagcaaacccaaaugacuaauaaagauaugaaaagcauaccaacugaagaaauaauaauuaaaguaacagcaagauauaauuuugcacccauaaaauugggaacuuucuaacucuaauaaaauucaucaagaacauugaaaacgaaaucucauauccuacugggaggaguguacaugguuacaacuacuucagagaauaucuacuacuggauaauacaauacaauauccacuacuagagaauacaacuacuaaagauaaauguuagauacucuagaacucaucaauuauacuuuuagucagccuauaagaaaaaaaaaggcaaagaucuaaaaacaaauuagugucacugucccaggaaagcaaguuucagguuaacucuuagaacuuacacuuauugauaagcuauauuauuuaacaauucuacuucuaaauaaauuccuacaagacacucucauacuucuccacaaggaaaugugcagcagaaauuguuuagugcaauuguguguuucaagcaaaacuuggaaacaucucaaaauuccaacaguaagaaaauaguuaauuuauguguccaauggaacaaggaauuuauaaagaaugaacuaguuuagaaaaaugcagcuaguuuagaaaaugaacuaguuuagaaaaagugcaaaugguaaacgauacauucaauauaauauuacuaaugaaaauauuaaagaaguuucaaauaauaauauguacuauuuaugaauggaugcauauauggcaaaaaugaaaccaaaggauucuucauggcaagacugcucuaugguagagguuaagaaagagaaagagagcucuuccaagaauaucuguuugucuuguuuuacugguuccuauuuggcaauaacaugaugauauagugauguaccaguaugaguacauuggcuuuuuguguggcaugccaugaggagcaagaaaucgaguuuuacuaaguggcaggauuuuccucaccagccuucuaggaugauuucaauccuccagguuaaugucugaagaguguguuaucuagaaaggguaaugauuacuaggacuaguuccuaacugacaauuuucacuaaauuucacuaucaaggaaaagagagaaggaugcugaaagcauuacuuuugacuaggcaagaagucugacaaaggcaggaauuccuguguagugaagggaaagaaaaaaaaggcauugaguucuuaggcuaacuccuaaagacaagcagacagaagugcaauggcccuggaaagacaaaguuuuacugcuucacuauuuugccuagggcuagccuaccuuucugauauaacuccguuuuucagccacaguaaaaauuaucuugugauccacagaauuggauuccaaacucagguuuagaaaccccaacgaauuggaauauugagcuuuugaggaaauucucaaaaucaaaugccagaagacaguccagguaaucacaugccuuacauucuuucuguuuguauuuggugagccuccuaauuuauacguauaucacuauguuuacaaauuuaccuuuccuaaagcuuuacuguuggcuaauauuuaaaucaguuucauuuucuaagaacaaaacaaguaaaaagggguaacuguaaucaguagcaauggaaaacaaauaagguuuaaaauuuacgagaauaguaaaaacacaauggucgaaggagaacugucuggauauacuguugacagagucacaucugguacuggcacucuugaauaaccacugcgaagccuugugcaaacacacaggaagccaucaacaaaugcucauccauuuaauauucauugauucaggaaugcaugcacugugacucaaggcugaaaugaaaucacaaacaggccugcuuuuguuuggaugcacaugaagacaaagggcugacacucagucucucucaaggucucuugcagcaaaacaaagcaugagacaaccaaugacugaacuauccauauaaagauaauggccagaaacugcacaccagaaaacugucaaguuauuaaaggcuaggaaagacaaaaaacaggccauaucaauguaaauggcauaauauuuaugggagaaagcauauuuguaauuuaauugccccaagaaauuagcauccucagguggaaguuaaggaaaaaguauaggcaauucuguuaauucaacaaaucugcccgaaaauccagagcacaggauuaguaaaugcuuuauaaaaucagagaggccacaauccaagucagaauauucaccauaggaaauuaaucacguauuguuucagguaauagcuauggaacacuuucaaauuccucuagguaguggaggaggguuuccuuucacaguuuguagcacauggaacauggccauaggcgacacaggccguucaguccauuucagaacugugccaagugugauagaugagauugaaguuggggguaucucacacagggaaugaguaugggacugaaaacugaaaaacuuaacaggaaaaugacugcaggcacuuuaucuuagagccaaauacuugagagaaaaaugcuuuaaagacaaagugaacuacaaugugguuucauaugccugagaagguuauuaaagaaaacuggaaauguucauguaacaaauaaaaaacccaacaaaaugcagaaauuauucaucaucugcuugaaauuuacuggauuauuuguaacgauuuagaggccaaaauaacuaagcaggaaauacaaauaaauauuggaauucaaacuuuuuuuuuuaauugaaggguagaagauugaaauuacuuugguaacgauuuaaaaaaaaaauguguacucucagugaauaaacaccgagaacaaaagaauccaucuacaaaaaugacagcgggaauuggaaaugaggcaugaggaaauagcugaauuaccaauuaccucgcaacaaucuuuauaaaagaaaagcuagagcacuacccaaaugaguuaucauauuuccugauaugauuuuggaguuaaauuguauuaaggcaaaauugugggaaggagucaaugauucuuaagcuaugugaagcaacacagacaaaagcaccuuguuuaucuaagaacauuaaaaaaaaaguauuugaaaaggaauucugggcuguuauaguuaaggggcugaaucacgcaaggcuuuagagugaaaauauuguaaauaugauuacgcuggaguuagcauaagaaaagaaaauuugaaaaacagauuuaaaauaacucuaccauacaaaccucgaggagaaaaagauuuucuuaauuuccuuauuuccaaauuuauuuuaauauuuuuuagucuauggaguaaaaccaaaauuuaacaguuaauguaaaaaaaaaucuuaaucuacugguagaaacuuguaaauuuauaaugagaaaacagaauuuuuuucuaaaauaaaaugauuaagcaaacuauaguaauuuggccgaaguuuguauugaucaaaaugacaguaauuuaugguuuucaaaauuaugcauugagaagaggaaaaaagagggguggggacaagaauggcaaugucauauuuguaauuaaauguauuuagagaagccagcuaccacuagcaccuuuuucaauuaucaugaauuaauaauuuuaauauuucauaauauacacguccuacauuacaccaagcuuaguuuucuggcaggcacugaauaauaaaauaucuuuggagacucacaggguaaaucucugagaagugucaguauaugcuaauagaaacgggcaucggauugaaccugggcagguugcauuuaauuuguagccuccauaaacaccaggcccauucuuuuuacagccuccauuugucauuuugaacggaugccgggagcuccagcuuucuccuuccugcugcuagaccagcuugucagacaccucaggcgagaagccauauugcuuucauuaucuuccugggguggaucacaaugucaagugcaggugaacauuaaauaauugcucguggaugacgagugccaggaucauaccugggcaacacugugaaguagaccaaguuucccuuagagaguccuaggauucuuguuuuguuuuugaaauuuuuuuuagcccacuccacuucuccuuuuaggcauccacuggccuaugauucccuagcaccuaccuacauucuaccgucucccacugcggagcagaugcugccaugcguggcccauccuccccagaacuucccuuugaccugccugcccacuuccaagucagugccaggacucuuugcccauggcugucucucugaaguccaaaguggaagcagaagacaaaugcacucuacauccucugccagccugucaccaaugacaggaguugauaauaaacugaauaaauacucuaucucccuuauguacucuuguaggauaacuugagacauguuucguauugcaccccagagguucccagguacauacagaagcugugcuggcucccugcccucgucucucucagucuccagguccgcaucgucuccuaaauaaacuuguccugaauuccuuuucccagggucagcuucuagcagcacugagaccuagucaaucaaaacuugauaucauuaaauggaauaaggucccuuauaccuuaacauguauuugggccauguuugaaaccccaucucuacuaaaaauagaaaaaaacuuagccgggcgugguggcaggcgccuguagucccagcuacucgggaggcugaggcaggacaacggcgugaacccgggaggcggagcuugcagugagccgagauugcgccacugcacuccagccugggcgacagagcgagacuccgucucaaaaauaaauaaauaaauaaauaaauaaauaaauaaauaaauaagaaagaaaaagaaaucucccuacgaggaauacgcacuccucuuuuuuaaaaacagacaugaguaagcaggugaauaaaagacacuuuauaggggaagguuuucuuuuuuuuaauuauuuuauuugagauggagucucgcucugucacccagccuggagugcaauggcgcgaucucagcucacugaaaccucugucucccgagaucaagcgauucuccugccucaaccucuggaguagcugggacuacaggcgcccgccaucucgcccggcuuugugucuguguguguguguguguguguguguguguguguguguguguguguguguguguguaguuuuaguugagacgggguuucaccauauuagccaggcuggucuccaacuccugaccuuaugauccgcccaccucggccucccaaagugcugggauuacaggcaugagccaaccgcgccuggccuaggggaagguuuuuacauaaggaauaagcaauuuccuucuguauuccuccuacagagcuaucucugaucaucaaaacaugagauucaacuacuugaacuaaggauaacauguuccuuuucaaguggucagaucucaacuguucucauucuucaaguagacacugaccccucuuaaauaacucauaagagugggguagguuugaaaacauuucacuuaaacacaucaauaaguccaccaaggaaagacucaacuaagauugagguuucugacaguucuucagucaaucuaaucaaugugggcaguuuaccugggcaauucaaacaacuaucccaauucagaccagugguucucaaucuuaagagugcaucagaaucaccuggagggccugugaaaacacagauuuucuguuucaaugggucuggaauggggccgagaauuugcauuucuaacagguucucaggugaugcugauguuguuaguugaagaagcaugcauugaaaaccagagcuaauauguggcagauaauucucauauucuucucucaguguuucaauucagcagacucuugcauuuccuucaguaaacacuuaguccaagagcagaaacucuauuccuaggauuuuccuccuuuuugcuuuacuggcugucugaaaggcaaugccauuacuuugcaacugaucuuuaauguaaguuuuuccaguauucuuucuuuccugcuaaacucacauucuccuuuaagacaucacucuguauaguaaaaguaaauuaucuacauucauuuuacagugaagguaauuuucugccaggcacugaguaugacagacgggguccucauuuuuaguuguauuugcguuauuuugcgcugcucuagcuuauaaauggacaaaaauaaaaugucauaauaaucauaauggauaugucucaaaaugaugcauuuuagguuuauuggcaaauaugacauuaggcaaucuguugaaaguguugccuucuauauagaaaugagaaaccaaaaauaaaggaccuucagguuauuuuaauauuaacaacuugaagggaaaaauuaucaaaugcaaagaucuuuaacaaaaagaacugaugcagguuacuacuuucucauugcuuuccuuuaaccucauauguaaguuauugcuuauacucuauuucgcaauauauuuaagauaauauaacuaaaaggcaauuauuaaggaaaagaucaacaaagaaaagaaugcauaagagacaguuucuuuaagacucaagaacaugauguuucagguggaccagacaaaaauuauaaaaacaauuugguuuucagaaaauaaaacaaugaaguaauaccaacuugcuuugacauaacuccauuguggaaacuuuguugguauuuaccaggcaauucaucccaugugacuaccugacagugugauaauaaaaaucacucauuccaaauccuuuuucuuuucauauuccuuugccucuguuaaguauuguugacacauaagacuuuuaaaaaaaaccauauauuugugcccaauggcauauaaugauacauauuccuuucaggggcaucuacagaguugcuucuauuuacaguagaagucucuauguaaaugcuggcuguaaagucaauuucuggcugcagcugucucuucagguagaugaugaagcauuccaugugucaugcuccuuggucaucacccauaugcaggcucacugcuccuugaacaagagguucuucaguuugcaucaaauaagugacucccugcucccuuaagucuugcuaauauucuggaugacgccuuguggauuuuccgucugcaagccaacuacuuuuugcucaacuuucagcuuaugcuuaucaaaauauucuaauuauuugccuuuuaaaaauuacaaucuggccgggcacaguggcucacuccuguaaucccagcacuuugggaggcugaggcggguggaucaccugaggucaggaguuugagacagccuggccaaugugguaaaacucuguuucuacuaaaaauaaaaaaauuaguugggcgugguggcgggcgccuguaauccuagcuacucgggaggcugcggcauaagaaucacuugaaccugggaggcggagguugcagcgagccgagaucaugccacugcacuccagccugggugacagagugggacuuugccucaaaaaacaaaacaaaaaaaaauuacagucuaauuguuacguagguaauugcuugaaaaauauaauuuccuugaaaaaugccauguggauuuaugccauaagccugguuguuguuaauaaaguggccagugucuccgaagccaguuuaaugacucucuuucucuuccugaguccggaugugauccgauuaucuucuuucauugaauuauaccacucuuuaagcccaaaugaaaaguugucccaauaagccacuauucucuuuccuugaugauuguguuuggaggugauuacacuugugaacucagaaagaagccuacacacagagcccuuguugaaaugaaggaaguugaagguaauggaagaaauuggcauuuaucuaauaaacuucucauagaagcauguguccagaugcaaacauacauacauuuuucuguucuuuggcauuacgacuuguaacacuguuagcuccauuccuugcuagaucccagaagacaugcagauaugaagaugauaguggcugcaguugcuccaggaggccaugcguacuugguuaauuugguugaggccaaauugcauuuaccuuagaucccuauaacugcccucuacuccaauuacuaaaauuguggaacuauagggagagcuaaguuauaagaaacaacauuuacccuccagccacauaacuugucuuugacccaguacauccuuucucuuuuugcauccugauaauuucaucugacuguuaucgaauuuuguuaugggcaugaaaugccccuuaguuuccaacacuguuucucaaaauaguacuuaugaaagaagaaauaugucauguagauggucauuuauaaaaucugaaugauucaacuaauuacuguuuuuuuucuuuuuauuuuacauugacuacuacaaauaugcagaguaaugcauaggcuagaauaucuaacaucuaauuauuuuuacuugcuaacauauacgccacuuuuuguguaggauauauuuuguaagguacuucuuuucguauuuacaaaagugagucuaugagacccaaacaaaacaaugcaaaaagaggugauggcacuugcaguucuuccaucacaacguauuauaauaucauauaagauacagcauuacuauguuguauaaugauacauugauauuuacagcaguacauuaugauagagcaauccucauuuauccaagguaauuggaaauggaguauuuguaucuucuccuaaaugcuucugauccucagggcuuggucccaagcuucuucacuuuuuucucucucuacauucucuuuccuagaucaacuuagccaucuaugacuuuaaauaucaucuauaugauauuuccuaaauuuagaucuccaguucuuaccuugccucugaauuccaaauuuguauuucccauuauuuuguauauuuccauuuuagugucauaggccuucuuaaucucaaacugaaaucugcauucccuccucuccccggcugcucaaaccuguuccacaccuugucuucccccuuuuaguaauggcaacacuauccccuuuagaugcucaaaccagauaauucgaauucaucuuucauuuuuuuuuccccucgcaaccuccauauuuuauauacaccacacuuuauuuaaucaucacugucacuauuuugaaccaucgcuuaucucaccuauuuuaaaaaucccaacuggugcaccaccauuucuacuccaaccaauuuucaacauggcagaguaaucugaaaaucgacagcaucaucacuuuaaaguccuguaauggcauucauugacugccuccuuccacugcacuauguuccauucuaucuuucucucugucucucuuaugccaucaacaacaauccuauggagccaggaucucccucugucacccuggucggagugcaguggcacaauccuagcuuccggcagccuugaacuccugggcucaagcguucuucccaucucagccuccuaaguagauaggacuacagaugcauuccaccaugcccagcuaauuuuuaauuuuuugcagauauggggucucgcuauguugccaagguuugugcugaacccuuguccucaagcaauccuccaccucagcuucccuaagugcugggauuacaggugugaacuacuaugccuggcacuaaaauauauuuaauaaaaaguauaaaaacaaaacacaagaauuaacaaauguugaggaauuugaaaacaaauuauauuugauauuaaaaccauaccaaaaaaaggggaacuuuuuugaugauuuagaagguauaucuguaucacaaagcaucucagugcaucauauugauuuuuaggcauccauggcagcuauacaauguaggaucuuuggguucgaucucacuugccccucuagaauauucuacauuuaaaaaauaucuuguguaagaucauuuagauugauuuuuacuuuuacauaaguugaaaaagcaaugucagcuguuugaccaaacuugacuaaauuuugagaaaguaagggaaauaauaauacugaguaguuuucagacucauaagcacuggggcagugcuccuggaaagacaacugggaaauacaagacgugguucuaacuguucucaaacugaugucucauccuaagauugaucgugaugcucuugaaaaacacccuaugaccccaacacagcccacggauacauucauuuauuggcuuguacaacuacuaaaaguuacuuccaauauggugacccaugcuucaggcaugauaaccacaaaauaaaaugaaaaaaagaaggaaggaagaugguguuuagccucugggugauucagagaaacuguaucuggcagcagcacguugugaaaacaacuuuuaucaccaucaaaacuggacuccaggggagaucugauauacucaccauuauuugggcucucagauguucaaaaguugaagcacgguagacugcuaaaaagauaaagucugggcugugcuuguuuucauuucucccuacaugcuuuucaagaucucaucucauuuccuuucccucuuuugagugugauuucugccuuuuauuuuuuuucccccuaaacagacagagguccuugcauuuagcacuguuuuggcuuccuggaaagucuuuauauucaguccucagcgguaaacacacuucuucaaucucuccaaguaagacuaaacauaaaaccaaguaguaagguuuuuaucuacccagagcaauuggugauauuugugaggugggguaaggaaggagauuggaaaaugacaaaaaaaaccuuuauuuuuuaacgucauuuucuauuaccaauauauauagcugcauuucaguauuacuauaauaaugaagagaugacaaauuuguagguaaaugauaaaauucuucaggguuauauuuaaguauacagaauagaguuugaccacagaaucuacgaauuuuuaaguuucuaucucuauuuuucugaagguuuaagagguaugccauacauguaguccaugugauggguugguugucuuuguccuuuucuuuuucuuucuuuuuuuugagauggggucucacucugugacccaggcugcagugcagugaugcgaucucagcucacugcaaccuccgccucccaggcucaagcgauucucccaccucagucacccaaguagcugggacuagcagcacgcaauaccaugcacgauuaugguucugucucuuaaacaguuuguaaucaugagauuuuaaaaucuaaagccuuuuuaucauucacagacuuaauagauauucacaaauauccuacaaucuuuccacuuauaaccuauaccuggguaaugaaauaauaaguaaaggcagauauggcuuaggucuucugggucuuaccaucuacuagggaagacaggcagagaagccagaaagcaaauaaaacuaaugaaaaguugcaacagagacaaaagucgucgcucuguuaugaugcuaugaugggagcaucugacccagguaaaguugauaaggaacucuucccuguggaaaggacauuuuacugacaucuaaaagaugaagagaaaaaaauuguaucuggcaaaagaccagcauacaucagaaaagagccugucaaguucaggggauggaagaccuguaugaucauugaucugaauggggauggugguaggcaagugggguaugaaaugugucugaagggagggagagcaggcagaucauauauggccuuauaggcuaugcucaggaguuuugucuuuaagcguacagagagauuccuaauguguuuuaaaucugcaggccagauauaaggugugugucuugaagagcccuuugguuacaguguagagaaaaggccacuagcggccagggaggaugagaauagccauaugaagagaccacuguaauggucaagagagcaauagggauuuggaauuggaggugcugaggguagaaaaaggcagaaugauuugagggauauuccggaggcaaaaugagccagacuuggugcagacuagaaaucagaggcaaaggagaagguguggaggaugcuuccuguauccuucacaauauuuaacauaaauuacauuugauaaaggagaugaagagaauaggauguugacacagugcuauaagauuuuuauacuaagcauaaauauucauauuuguuuacagaaauaaaguacuuucuuaggcauauuuaagugaauaaaaauuguccacuggacuaacuuggcagcacaaaauguaaugagcucauucacaguaacuuucugagaaacaaaaggcucugaaauuuuuuacauguagagaaauaguaaaauauaguauuaguuccuuaaacaucgauuuucuuuuaauuaaucacuaaccaaaaauuaaaaaaaaaaaccguuggaaucaaauaucaacacccaaguaacugacaaaagaauucucauuaguauuaguacaacuuucugaaauaaagcuaccgaaggcuaggcagauaauuuguuuugaaguguaacaucuuagcaauuauaauagcaaaaacauuguauucuuuuauguggaauaaagugaauaaaguauaacugaaaugauuagugaaaaaaguaaaauacaucauucuacuucaaggauuuuguuaaccauugcuauacuuuucuuaaguuuuauguuuauaaacuauguacaagagugaaauagagcucuaggcuucagucgaucaaacaucaauucaagcuacucucuaauguaguguaguagguacagaauaaacaccaguuaagaaacauuccaaccagguucuuguuccauauguucuauaugggauguacaccuugauuuucuaccugccaaucauaucuguuauuucaaaaacuaaauuuauaauucauuuuuucaaggaaaguuacauguauuccucucuugccaaauauuugacaugcaguaaaaauugcaucuuauacuuguuuuuauucuuuaauuuuuauauaucuagcguccaacuaauuuuaugcauucaaaauaacuuucauuuucuucucaguuuuugguagugcguuuagcaucuaaaaacaauuaggccgaugcuguagcucaugccuguaauccuaaagcuuugaaaggccaaggcaauaggacugcuugaggccagaaguucaagaccaaucugggcaacauagcuagaccaugucucuacaugaaauuaaaaaacuagccagaaauggugaugcacagcuguagucccagcuacuugggaggcugagacaagaggaucacuugauccuagaaguuuuaggcugcagugagcuaugaucacaccacuacacuccagcuugggugacagagcaaggcuucaucuaaaaaaaauaaaauaaaaacaauuaaagcacaauagauaaaugaaugaauuauugaaggaauuaucuuuaucuugcaggggaauuaaugguuuauccuaaauuuguuuuguuuuguuuucauugugacaagcuaaagaaaagauuuagauaucuacaaaauguuuaguuaccaauuuuugugccauuauuaggagauuuauuuuguuuauguuauauuaguaguaugaaaacuugaugaauguauaaacauauugauuaaaaaggaaccaagcauuccaggaaauacauaaaagacaacaaccauuaaaaauuuucuacagaauugcauuuuggaacaacccuuucucauguaguauuucaguuaacgggaaaagaaagaugagguaaauauugaaugugaaauuagggguccuauguccaaauuucagaucugcagcuaagcaucaauauuuccaagcauaagucauuucauucugaggaacaugagauuuauugaagaugaaagaccaguaaacuggcuuucagacauguuucaaaauaaacauggugaauuucaaacuuuuccuuccuuuuuccuuccuucccuuuucaauaaaauuaugugaacacuugcuauaauuuguugagugcauauaugcauacacauuaaguuagaaguaaacaugucacuuugacuccagggaagcuaggauuggaagauuccccauuucuucaaucuuuaugaguaaaucgaaagacauuccgaagauaaggauuucagccaacuuggaaaucuacagcuuccaucuguuuuaguacuugcuauugucauaguguuucuuggcaacugaacuuccacuuuugaaaguaaaccuugcuuugagugcuacuagagaauugggauaaaacuuccacaggugcuaagaaaaagaaaaacaaaaacguaugcaauaacguaugagccaaauuuuccagagaauuaauagaagaugcacuaacaagggcaauuaauacauaugcaagaaagaauacaauaaaacggccauugauuaaccauauagccuucauuacuguaaguuauagauaauccuagaaacaguguggcacuuuaaacauuuuuugauauguggcaucauauggcuuauuuuuuaaaaucacauauuacauauauuuaucugaggauuuacagucauauacagacaaauaugugagugguaaauaaaccaacuagacgaugaacuaagauuuuccuuacaguuacaugagauugcuuguuuuuguuguuuuguuuucauugucauuuuauuuuuauuuuuaauuauuaugaauauauaauaguuguauauauuuauaggguacaugugauauuuugauacaagcauagaauauguaaugaucaaaucaggguaauugugguaucauuuccuuguguuaggaacauucuaauuccacucuuucaguuauuaugaaauauacaauauguacaaucaauuauuguuaacuauaguugcccuauugugcuacaaaacacuagaucuuauuccuucuaucuaacuguauuuuuguacccauuagccauuucuucuuaaucucccccuccccacuacccuucuagccucuguugacuuuuauuuuaauuuuggaaauguuuuauccaccauuugaauuucuuauagucuuauauucuuaacacacauacaaacauucaaguaccugagagacucacacauagaacaaacucuaggcauucauucauucauucugcaagugccuaucauccccaaguauuguacaaaggacauacaaaaaugcaaguaauuuucuagauucuaaaauuguaucaaagaguagaagagacagaaguaagcccauaaguuauaagaaaguguguaugucauauaacagcaguacacacaggaaguaauggcgcacagaggaaggaguucucuacaguucugaaaauggagaaggcugggcaugguggcucgugccuguaaucccagcacuuugggaggccaaggcaggcggaucaccugaggucgggaguucaagacuagccugaccaacauggagaaaccccaucucuacuaaaaauacaaaauuagcugggcgugguggcgcaugccuguaaucccagcuacucaggaggcugaggcaggaaaaucgcuugaaccugggaggcagggguugcagugaaccgagaucauaccacuacacuccagccugggugacagagugagacuccgucucaauuaaaaaaaaaaaaaaagaaaaagaauauggaggagaaacaguagauagggauaaagcaauacuuuuguguguaugugugugugugugugugugugugugcuauuagugcuuugcuugaguuuacuuaauaugauacacauacauccauauauauauauauauauauauauauaauugcauuuuggauccugaaguauaugauacagacuuugcagcaaaacuguaaacaaaaccuaaaauaaaaacaacagaaaaaaacuuugcauaauuugccuaagagaaaccauaagcaauaaaggaucuaaaauucaagauuucaggguuuaggaguugucagugcuaccugaagaucauuaacagucuuuuaaagguaaaucacaggccgggcuugguggcucacaccuguaaucccagcacuuugggaggccgaggugaguggaucacaaggucagcaguucgagaccagacuggccaacauggugaaaccccgucucuacuaaaaauacaaaaaaaaauaagccgggcaugguggcgggcgccuguaaucccagcuacucaggaggcugagguaggagaaucacuugaaaccggaaugcagagucugcagugagccacgaucacaacacugcacugcagccuggguaaaagagcgaaacuccgucucaaaaaaacaaaaaacaaaaacaaagguaaaucacaauauccauucaagaaaaacaacaaauaugcuaauuauaauauuuaugcacuaucuuugguaauauuaaauuaugaaaaaugaauaauaugaaagugaacaaagagcaaacuuccuucuuccaaaaaaagugaacuucuuaauguaaucugcuguaguuugcuuuaauuauauaaucacagccauuacuuaaaagcuaaaaaagacucagaaaaagaaacacccaguaggaguuaaacacuguauaaauaaccuuggaaguaaugaggcuuauuaaaacgaguaaauuaaaaauugaagcccaauaugcgaaaugguaaaugugauuuuagcagaacagcauaaaauucuucaucacaugucaucauaaagcucuccuuuugggagaggggguuauuuacaucgauggugcaauauaauuggaaggaguagacuuccagccaaugguuugucucccuucuuuaaagcucaacaacaauuuguugucagcaccagccugucauuaauauucuguccuuuagucaaguuaccuguuuauuugucuccugccuuuuuuacauccucugacuuggacaaaaucaaaugcacauugaaggcacaacucucguguucucgaucuagguuuugcccuuggcgcaagaccccauugaacaucucauaagagaaggugccugugaguugggcuccgaaauauuaagagaggucuccuggugccaagaggaaaacccaacacagacagagcacagggaaagggugagauacaacacaugguucaaugugguuagagugcugccagaggaguggaagugcagcccucuaggaaugcuuugagagugagacuggaaauacgagagccugaucccaggcuacuuauucuauggcaaggcagaaccacugacagauuuuaagcaagagacugaccacauuuagucacugauuuaacucagaaaauggcaaaaaaaaaaaaaaaaaaaaaaaaaagugagagagaaauacauuauucugcacuuucugguuuguguuaucagaaaaaugaguucauuuaaugcaugaagugaaaugaagagaugaccucacaucacacaccagggacuguugugagguugugguagggggaagggauagaauuaggggauauaccuaaugcuaaaugacgaguuaaugggugcagcacaccaacauggcacauguauacauauguaacaaaccugcacguugggcacauguauccuaaaacuuaaaguauaauaauaauuaaaaaaacaggcaauaaaaaaaagaauaucuccuauaaaaaaaaagaaacaaaaugccaaugauuggcagguuuauuuaaugacugaaauggggaaucaugaggagguacacauuaggacaggggaaaaaguuaugauuugaacaucguaagguuugagaugcucuuuugccagcuagguaugccacuguaaaaaggcuauuuuaacucucuaguuuucucauuacaaaaugggaauaauaacagaguugaugugaggauuaaauaauucagcaaauuaagaguacuuagaauagugucugacaucuagaaaggccaagaauguuaacauguauugcuaguaucaucagcagcaauguguggagcuaccuguggucaaccuaacacauacauuugauuuucaggggauuauuuucagugcuuuucuuccauggccucgggguugaucuuugaacucucuuuucuuuuggcuuccuaguaaggagauauaugcuccugcucuucuuguaucuucucauucuuuuuauauuaacucuuccugcacccaucuuucaaacguuggugaguccagcauuaugucucuggaaguuggacaugaaaaauuuuugaauccuuaaaaugguauaaaaguguuauggguuuucuaugacaaacccacagccaacauaauacugaauggggaaaaguugaaagcauuuccucugagaacugaaacaaaacaaggaugcccacucucaucacuccucuucaacauagugcuggaagucuuagccagagcaaccagacaagagaaagaaauaaagagcauccaaaucaguaaagaggaagucauacugucacucauugcugacgauaugauuguuuaccuugaaaacccuaaagacuccuccagcaagcuccuagaacugauaaaaacaauucagcaaaauuucuggauacaagauuaauguacacaaaucaguagcucuucuauacaccaacagcgaccaagcagagaaucaaaucaggaacuaaaccccuuuuacaauagcuacaaaaaaaaaauacuuaggaauacaccuaaccaaggaggugaaagaccucuacaaggaaaauuacaaaacacugcugaaagaaauagaugacacaaacaaauggaaacacauaccaugcucauggaugggcacaaucaauauugugaaaaugaccauacugccaaaagcaaucuacaaauucaaugcaauucccaucaaaauaccaccaucauucuucccagaauuagaaaaaaaaaaucuaaaauucauauggaaccaaaaagagccugcauagccaaagcaagacuaagcugaaagaacaaaccuggaggcaucacaccaccugauuucaaacuauacuauaaggccauugucaccaaaacagugugauacugguauaaaaauaggcacauagaccaauggaacagaauagagaacccagaaauaaacccaauacauacagccaacugaucuuugacaaagcaaacaaaaacauaaaguggggaaaggacauucuuuucaacaaauggugcugggauaauuggcuagccacaugaaacuggauccucauuucucaccuuauacaaaaaucaacucaagauggauuaagggcuuaaaucuaagucgugaaacuauaaaaauucucaaugauaacauugaaaaaacccuccuagacauuggcuuaggcaaggauuucauuaucaggaacccaaaagcaaaugcaauaaaaacaaagauaaauaguugcgacuuaauuaaacuaaagagcuuuuguacagcaaaagaacagucagcagaguaaacagacaaaccacagagugggagaaaaucuucacaaucuauacaucugacaaagaacgaauauccaaaaucuacaacagacucaaacaacucaguaagaauaaaauaaucccaucaaaagugcccuaaggacaugaauagacaacucuccaaagaagauacaaaaauggccaaccaacaugugaaaaaaugcucaacaucaccaauaauuagggaaaugcaaaucaaaaccacaaugugauaccaccuuacucccaccagaauggccauaaucaaaaaaucaaaagacaguagauguuggcauggaugcggucaucagggaacacuucuacacugcugguaggaauguaaacuaguacagucacuauguaaaacaguguggagauuacuuaaagaacuaaaaguacuaccauuugauccagcaaucucauuacugggcaccuacccagaggaaaagaggccaguacaugaaaaagauacucgcacaugcauguuuauagcagcacaauucacaauugaaugaucguggaaccaacacaaaugcccaucaaucaaugaguggauaaagaaacugugauauauauauauauguguguguguguguguguguguguguguguauacacacauauauaauggaauacuacacagccaugaaaaggaaugaauuaauggcauuugcagugagcuggaagaaauuggagacuauuauucuaaaugaaguaacucaggaauggaaaaccaaauauuguauguucucauugaugugugggagcuaagcuaugaggaugcaaaggcauacaauggacuuuggggauuuggagggaaaggugagagguggcgagggauaaaagacuacaaauacggugcaguguauauugcuugggugauaggugcagggugcaccaaaaucucacaaaucaccacuaaagaauuuagucauguaaccaaauaccaccuguaccccaauaaccuacaaaaaaguaaaaaauauuuuugaaaaauucuuauggguucaguugugucuccaaaguuuugucggaccucacgaugaaaucauauauauaaaaguugggggagcacucauguauuaguuaagaugaagucuuaguagguuagggugguccccuagucuuaagugacugcuguccuuuuaagaagagggcagacacaaaaagagaagacugccaugugacaacaaaggcagagauuggagcgaugcagcugcaagccaagguauaggauugacagccaccacaaggagccaagaaaagucaagaaagaauccuccccugcagguuucagagggagcaugccccugcaaacaccuugacuucaaacuucuagccuccagaagcacaaaacaauauauuucuguuguuuuaaaguaucccauuuauaucauugucaugcaaacucuaggaaacuaauguagacauuuuuauaagagugugcuuuuuucuuaaaagaagguccuuagcuuucaucagauucucgaaagaacuugaaacucuugaacucucuucugaggguccuauuugcuccugugauuuaaauuauaacccgaaugucacugucucucaaaucuguaccaccaauccagaccucucuuuagcucuagaacuuuacgucuacuugaaaucuccacucacacaucccaaauugaauugaagguauagugaaucaucauuauauuccccauuucaguaaaugaugccaccauuugcucaucuguucaaccucaacucugaacaggcuuccaggauccauaauucaauucaucaauaagacuuauuagcuugaucuguaaaauggaucuugaaucuaccugucuuccaucuuugcugucacugaccuaggccuguuacuuucauaaauuucucugugggaauaaugcaauugccucccuugauggucuccuugcuucuucuuuuguccuucugaugucuauuuuugcacucaugugccagggcagagauuagaaugagugaaguuaagcaaggagugugcccaggaucagcaacugugguagaaaggagcaaagcaggauuuuagagaagagucaggcuuugaaauuuugggugacaaagucaaucugcuuuacccaggacuuuccuacuuuuagcacugaaagucucauguccugggaaaccccucaucuaugggaaaacugucacugcagucaccuaacugcaguggcuaaccagucuaacuagugguaacaagguguaaacucacccuaugggcaccugugaaguuggacuggucuccuucagaauugcaccuggaguguuacugucccucuuugggguguggaggcugagcuuucucucucugcauuagacauaggacguuccagggaaguuggcaugaccuacuuaagguggcacuuuccaucagaagguaacucuuggggagggcuuacagcugaggucuaucacccagcaggucucucagguuggggacuaggucuuuuaugcuucaggagaaaucugggugacaaaguacagcauuuacuacaaauaucacugcuagauaugaacauaauauauucagauaaauguaagcaauuccuuuuaccaaaacagccgaagaugcaugugaagaaugacaagguuagagaaauguaggcaugggugagaucauaagguuucuuauauauuagggcaaagaaaauaagcuugaccaugaaaucuuuaugggaccauuuuuuacauuuccuuuuacugugaucauugugaucauugcaauagaugcaaauaaaugccgcugaaaaauauuuaacaucauuucaggcuagugacuccucaaacaugcaauaggagauuuccuaaacccaauaaaggaaucucaguuaaaacuacagcuaacaucuuacuuaaagacaaaagacugaaugcugucucucuaauaucaggaacaagguaaggaugacugcacuuaaccacuucuauucaccaugauaauggaaguccuagccagugcaauagucaagaaaaagaaaagaauauagaaugaaaaaacagaaauaaaacugcaacuauuugaagauaacagaguugucaauguagaaaaaucucaaagaaucuacaaaaaaugacauuggaaauaauacuuaaauuuagaaggucacaggauauaaggucaauucacgcauacaugcauacaugcacacaaaacuaaacuauuguauuucuauauagaaucaguaaacaauuggaaaucgaaauuuuuuaaaaguaucauuuaaaacagcagccaaaauauuuaaguauaccuuucaggaaauacacacaagaucuguauguugaaaacuucaaagcugaugagaaauuuuaaaagaccuaaacaaauuaagagauauauuguguucauggacugggaguuuuaauaauguuaaggugucaguucuccccagauagauccauagauugacuauaaucccaggaugaaucauagcagaauucuuccuuuucuuagaaauaaaaaagcugauuuuaaaaauuauguagaaaagcaaagaaacucaaauacccaaaaccaauuuugaaaaaagaacaaaguuagaaggcauuacuugauuucaagauucuuauaaagauacaauaaucaauacagugugguauuggcaaagguauggacauauaaauugaugcaacagaacacauucuaaaaauagauccuuacauguaugaucaauugacuuuuagaaaaggugaaaaggcgaaagaaacuaccaucugaguggacaggcaaccuacagaaugggagaaaauuucugcaaucuacucaucugacaaagggcuaauauccagaaucuacaaugaacucaaauuuacaagaaaaaaacaaacaaccccaucaaaaagugggugaagcauaucaacagacacuccucaaaagaagacauuuaugcagccaaaagacacaugaaaaaaugcucaucaucacuggacaucagagaaaugcaaaucaaaaccacaaugagauaccaucucacaccaguuagaauggcgaucauuaaaaagucaggaaacaacaggugcuggagagguugugcagaaauaggaacacuuuuacacuguuggugggacuguaaacuaguucaaccauuguggaagucaguguggcgaucccucagggaucuagaacuagaaauaccauuugacccagccaucccauuacuggguauauacccaaaggauuauaaaucaugcugcuauaaagacacaugcacacguauguuuauugcggcacuauucacaauagcaaagacuuggaaccaacccaaauguccaacaaugauagacuggauuaagaaaauguggcauauauacaccauggaauacuaugcagccauaaaaaaugaugaguucauguccuuuguagggacauggauaaagcuggaaaccaucauucucagcaaacuaucugaaggacaaaaaaccaaacacugcauguucucacucauaggugggaauugaaaaaugagaacacauggacacaggaaagggaacaucacacaccagggccuguuguggaguggggggaggggggagguauagcauuaggagauauaccuaaugcuaaaugaugaguuaaugggugcagcacaccaacauggcacauguauacauauguaacuaaccuguacauugugcacauguacccuaaaacuuaaaguauaacaaaaaaaaaaaaagaaaagaaaagaaaaggugaaaaggcaauucaauggcaaaaggauagugauaugguauggcuguguccccacccaaaucucaucucauguugugggagggacccagggggagauaaaugaaucauggggcgguuucccccauacuguucuccuaguaguagucaauaagucucacgagaucuaaugguuuuaugggcguuucucuuucgcuuggcucucauucucccucgccaacugugauguaagaccuuuugccuucugccaugauugugaggccuccccacccauguggaacuaugagucccuuaaaccucuuuuucuuuuuuuaauaaauuacccagucucaguuaugucuuuaucagcagcaugaaaacggacuaacacagauagucucuaagaaaugaugaugucuuuuaauuggggcauuuagcccauuuacauuuaagguuaauauuguuacuugugaauuugauccugucauuaugaugcuagcugguuauuucgcccauuaguugaugcaguuucuuuauagugucgaugguuuuacuauuugguauguuuuugcaguggcugguacugguuuuuccuuuccguauuuagugcuuccuucaggagcucuaaaaacacaagaagaaaaccuaggccauaccauucaggacguaggcaugggcaaagaauccaugacuaaaacaccaaaaguaauggcaacaaaagccaaaauugacaaacgggaucuaauuaaacuaaagagcuucugcauagcaaaagaaacuaucaucagagugauaggcaaccuacagaaugggagaaaauuuuugcaaucuaucuaucugacaaagggcuaauauccagaaucuacaaagaacuuaaacaaauuuacaagaaaaaaaccaccccaccaaaagaugggcaaaggauaugaauagacacuucucaaaagaagacauuuaugcagcuaagaaacauaugaaaaaaagcucaccaucacuggucauuagagaaaugcaaaucaaaaccacaugagauaacaucucaugccaguuacaguggcaauuauuaaaaagucaggaaacaacagaugcuggagcggauguggagaaauaggaaugcuuuuacacuguuaguggaaguauaaauuaguucaacuauuguggaagacaauguggcgauuccucaaggaucuagaaccagaaauaucauuugaccccgcaaucccauuacuggguguauacccaaaggauuauaaaucauucuccuauaaagacacgugcacacauauguuuaucacagcaccauuuacaauagaaaagacuuggaaccaacccaaacgcccaugaaugguagacuggauaaagaaaauguggcacauauccaccauggaauaccaugcagccauauaaaaggaugaguucauguccuuugcagggacauggaugaagcuggacaccaucauucucaucaaacuaacacaggaacagaaaaccaaacaccgcauguucucacucauaagugggaguugagcaaugagaacacauggacacagggaggggaacaucacacaccagggucuguugggggaugggggaccagaggagggauagcauuaggagaaauaccuaauguagaugaugguuugaugggugcagcaaaccaccauggcacguguauaccuauguaacaaaccugcacauucugcacauguaucccagaacuuaaaguauaauaaaaaaaaaagaugaugacaaagaugaaauccauuuauaaaaacauuaaccuugaccccaaauuugccuauaaaaauuagcucaaaauaaauuaaaaaucuaaauguaaugcuuaaaacuauaaaacucguaggaaaaaaaauuguugugaccuuguguuaggcaaagauuucuuaaauguaaaaccaaaaucaugauucauaaaagaauagagaauugacaaaccggacuuuauaaacauaaaaaaguauucucuuucaaagacacuguaaagaaaauaaaaaagauaagcaagaauucggugauagcucuagcuucagaugcuuugggauugacuauggccuucaagcuaugacaggcuuuccccaagcaacuucaguuaaugaguagagcccaaccauuuuugcuuaaugaaugacuccuccaaagggcaauuuuggcaauggaacuccucauuggccucgccaacauauuuucugaacagcaacacaguguaaggcccucacuacccaguaguccuuccuccuucucccuucuccucuuucauacaugcaacccccaauauuuugcauuuugaacucugcugaacccaacuggcacaguagauaaggucucaaucauacagggcauuguaagcuagggcaagaauuugaagacaaauuaucuguagagaaaguguucugaaauacuuuaaauuacucucaucagcauuucaauuauaaauacuacguuuuacaaguuaaaugucacguaaaaaguaauuuuuguaaaggaaaauuuaauaucauagaucaugaugaguccuuaaagacagcugauuguagcaaucagcuacuugaaaaaucugaaaagugauccuauuuuggaaguuuagguuaucuacuuauaauuucuugauaucaaaguaagaaguuucauaaauguaaaucgacaggaaauccaguuaccauacuagaagacuauaauuuuccucuaacagucuuagcuuuuuuuugccccucagaacaauaucuuaguauuuacaauucacauaauagcauugugcuuuuuaaagccaaaugggacagcuguaacuucaguaaaugauuuuaaauacaucagcacuuuucuuccuuaaauguguaauguaacugcuauucauucaauguaacacuuuaauucauuuuuugaaaagaaacuuuaauaacuuucaaagagcuaauauaauguuugaacacugaauaaaauauaauaaauucacuaagucuggaagaauuaacaaugcauucagucaagugaaauuuaaaagagcauguuuucacuuacuaggaacaguuuaaacuauuuuuaaggcuaaaaaaugcuuaaaauuaagaugcagaaauauguuuuuaauaugaaaaaaugaagauuuuggaaaaaggcuaauuuagcaaaaaauccaaagaaaccauaugcuugauuuuaacccuccauaaacaucacuuuaaauguuauaaaagucaaacaauaaagaaagaggauuuauugaguugucuuuuugggaaacaagggauaagaacauuggaggauaaaaaucaugaaucuacaaagaagagaaauaggagguaacacaaaagaaaaauaauucccagucuaguagaauggaugagcaaaccaaaaauauauuuguauuuaaaaaaaguguucuuaagggaucaaagugagagcaauuuucauuaaaauaacaguaaagaaagguggccuggaaguguaagagugaaggagaccagggagagagcagagaagucaaagguaagcuacacugaguccauuugggaauaaagagaaacaggggcguuggaggaauaggacucaggaaaggaguuuuguuuuaggauaaagaaugcuugagcaugucaguugcucaggaauaagauauccauaagaaggggauuuggcauuuagcuugaucagaccuuuacugagucucuauuauaugaggcacgugggggauaauaaaugaaaauaugaucucaacucaagaagagacuuaucccagagaugcuauaacuuucaagcaggaggaaggggcagguuguacacagaagcaacccccaagagaccacuaguuuuccagcugacaacucagcucggaggaagaggcaaagccagaggcaaacgugggagacuggggcagucgcaggguucugagauccagagaacaugggaggagguagugugcacaugguacccucuguuugcucaggauggcagggaagucuaagucaccugcggacaaugaggggacagguacaggguagggcagaaguuggaagggucccagucaccuuccucucccuuucuucccaguaacuccuccaagccaacucuuuuaacauaaaacuucauucucuauuuuauucauaacacuguaggaaucaauucuuccauuauccagauguuugugcaagucgucugaacacauacaccucucucuccaccuucaaaacguccucuaaguugccucccaagucaucuaccugaaaugccaauaugcucccuucacguacucuuagaagcuuuuugguaacuauaaaaugucuauuuuuuuuuuaaauaaaacuccaaugggugcauagcccuaauggguggccuuaguccccauuuugugcccauaauaaauuagaguuaacuacugcaacauggcauuugaaucuauaguaguagugaggaauguauaacuaacuaaagaguuugagagaagcaggaaagagaauuuauacugacaccauauggaaaacuuacaugcaaaagucauguugaaaugauaauuuuuaaccuacuaaucuuugaaaauuauaggcuauucuuucuuuucuuauaaacuuaucuuuuuuuuuuuuugagacacagucuugcucugucgcccaggccgaagugcaguggugcaaucucggcucacugcaagcuccgccucccagguucacgccauucuccugccucagccucccaaguagcugggacuacaggugcccgccaccaugcccagcuaauuuuuuuguauuuuuaguagaaacgggguuucacuguguuagccaggauggucucgaucuccugaccucgugauccacccaucucagccucccaaagugcugggauuacaggcaugagccaccgugcccagccaacuuaucaucucuuaauacucuucacugcacucagcaaaacaggagucacagccaaaauuaccuucugagacaaugagcucaguaacguacugcuauuauuauucaaauauaaaagaaguugagcaugccuaauccauaaaucugaaaucugaaaugcuccaaaauccaaaacuucuugagugcuaauaaaaaugccacauguggaaaauuucacaccugaccucaugugacaggcaucagucaaaacacagucaaaacuuuguuccacgcacaaaauuauuuuaaaauauuguauaaaauaaccuucacuaggagcagaugaaacgaagacauuucauguuuagacuuugguccuauccuuaagcuaucccauuauauaaugcaaauauuucaaaaucuaaaaaugugcaaaaucugaaacauuucugguccuaagcauuucagaccaggaauauucaaccuuugcuuggugggacaggggacucauucucuaguccccuugggcuuauuacacaaucgucaaaaagaacaggccuuuuccuagcuacaacuuauccuuccagcuucuucuuaagguauaccauaaaagcauuugauguucaauuaauaaugcacuucccacaagccuuccuauauacaacccagcuccuuuggucauggugaccccgcuccccuccuucccauuuggcccagcucauucuugcucuucuucaagacucuucacaggggcaauuuccccuuaaaagauuucucugacacuugugcuacucagaacugagacuuuuaaaauguucaaaacauuuucuuaaaucgguuuuaaaacugguucucucuaugccauccauuaaagugcuauaacuugcauuuuaauuuuuggcauuaucaaagaagauauuucucaaucucuaauccauggucuaaaauuuucacagacaauaauggcuuuucaauaucuaaacuuauguauauuuucucauuuuauuacuuaaauauauaaaaaaaauaguagguuacaauccuuccuagaauaaucuaugcucacauuucaugacacagauuaagucaaacuauaaauuccauuaauuuuccccacucaggcucuuaaccucaaaauuugcuucaauuuugcaucacagaaaagaaguuggccacugcugcaagaaaaguucaacuacuccaaauaagaacuauauauuuucuuuuauuauauuucuauugcuuuaacuauuuucauuuugcucaaaaaaauaccagccagggugcaaacauaauaaagugugacugugugauuuugguuaaaagagaagaaaaucagcaguguuucccuucaucugguagauuuauuuucuagcaguuugguauauguuaaaagauauacauacuauuuuaggaauuuuuaaauauuggcaauauaugaauauaguuucuuugaggacugaauagucacuguaugauaaauacaaaaaugugcuaaaauuauugaaaaaaauagguguguuuucccauaucugggaacauuauugagauuacaauuuuaacuuauuuguuggaagaaauaagcauuucugaucuuuuuaaaaacaacuuucugaugaacuauaauggaauuaugucuugauuugagaaacugguggcccaacuaccacauggccagcugccucuuagucaagagucuagugaccuuuauccagacuuuuaaaaaacuuuuguauccaucuaacaauaaguaucuaaccaucuuccuacccuauaaaauauuccuacaaagaaugguucuuuaacuuagccuacuagaguguuuucuuuugcaucugaaguuguaauaaaacuuauacacaugcucauagccaaauugucugauaauuucucucagcagaccaaaugaauucuaaggaacuacaucaugguuuaaagugcugggagcaagcccccaaaaucuggccauaaacuggccccaaaacuggccauaaacaaaaaucucugcagcaguguaacauguucauaauggcccuaacaccagcacuggaagguuguggguuuaugggaaugagggcaaggaacaccuggcccgcccagggcggaaaacugcuuaaaggcauccuuaagccacaaacaacagcauaagcgaucugugccuuaagagcgugucccugcugcaguuaacuagcccaaccuauuccuuuaauucggcccaucccuucauuucccauaagggauacuuuuaguuagucaaauaucuauagaaacaaugcuaaugacuggcuugcuguuaauaaauauguggguaaaucucuguuugggcccucagcucugaaggcugggagaccccugauuucccacuucacaccucuauauuucuguguguguaucuuaauuccucuagcgccgcuggguuagggucucccugacugagcuggucucagcauuaaaguguuuauuaagcacacauuuuuuucaggauugcaaaagaagaguaugaaugaagaacauaaaaucaacugugugaaaaauagacaauucaaaguggauuccaucugaaaaugauguuaucaauuuacauuucagaaaugucaugaaaggcuagugcaaauaaauaccaauauaacacaauuauuaaaaagcuugcauuuuuuucauuacauuauauguaauauuacauuuauacagaacuuauuuuuauauaacuuuuaaccuuuuaaaauguuuuaaagccaauaucugauuucaucucauuuagcugguguugaaacauaauucugcuuuuucuugugcuugcacauuaagaacagaaacaagaaauaaaagauaauaaagccuaaaguaauuugaaaaccacuuucuguccccagaacugacaauucauaaacagucacacacaaaaaagcauguaacugagacauuuuaccaaaucagugaacacacagucaaucugcauuucaugcaaaaaacaaauguauaauauuaaucuuccaagucuuuuuuucccacuaauauuugagucuccuugcuucauucuguaucuacaacuacuccugaaaggcaacuucauuaccauuuucuuuagaggccuuccuaggguaggaaaaggcccguaauccagccgcauaucugggccagaggcaguucagucacuuuguaaccuuggggucacuuagccuaagaauauggaucaucagggccccaggaaggaucaccaaacaagcaguaaugaaacuuggcaugauguccucaaaucacucaaguaucugagaauguuacccauuuggcaacuucagaacuuucuuaaaauaauuaacuccuauagcucuacuuuguaaaaauggaaagaaaugcucuguaggaggauauaacugguguuacaauaauuuacauuuaggauauuaucccuuuauaccuagaagcuuucugugaucccucuauuguuucaggagugauacaagaauaaugaaugguaauacugagggagagcauagccucuacgugcuuuaggucuuugcugguggcaccaaucuaugcaauuucuccuaggaugcaguacuaguucugauuuaucuuauccugggaagaggagucagaagcucagaagcuucugccuuuucuuuuguaucggaauagcuuuuuuucuuucuuucuuuuuucauuuuuuuuuuuuuuuuuuuuugagacagaguuucacucuuguugcccaggcuagagugcaauggcaugaucuuggcucacugcaaccucugccucccggguucaagcgauucuccugccucagccucccgaguagcuuagauuacaggcaugugccaccacgccuggcuaauuuuuauauuuuuaguagagaagggguuuccccauguuggucaggcuggucucgaacuccugaccucaggugaucugccugccuuggccucccaaagugcugggauuacaggcaugagccaccaugccuggcccagaauagcuuuuacucuauggauuagagaacuaauuuaaggguucuacacacugcuaaguggauccacucuaauuuuguauucaagaaccaaggaaauuaacauagagugggucugugagcccccguaugcacugcuacugcugggaaucugcagagacaggaaaaaugcaucucaacaucaucugcccaaggcagggaagaaacagcucuuaucuauuagcccuagugccuucauuugucaaggggccucaauaaccuggaacucaagcccuuuccaguuucucuaaagagcauuuaauuagcacauaaacgauccacuauuacauuaacuauccacuaugcuugacuuagaaugucuagaugguuucccccaagaguuccaaaagcucguggcaaaagcauacccuggggcagaaagcaagagaaacuggcugcagcugagcuagcugcuguuagguuccaucugugggaagcuggucacaccacaguggcugaagacaaugagggagugcacaagaggcaagagguaucuaguccauucucucaacguuuuugaaaacaauucacccucucucauaaauuuacauuuagcaaaaccuuucucaaguccuuucuaauuucucuaaagagcuuuuaauuaguacauaaacuacuauuaccuuugcuugggugacaaaaagcacagaucuggauucagguauugcuggguuaaaauguccuuguagcucccccaauauauuaaucuagagacaacaacugaauauuuuucaaagucuucaggaccaguucuuuucaguaaaucuccauaaccacuuucuaugacaccuaaaugauccaagccuuucugaccagauucacaucacauugcaacaaaacaauaauuagcgcucaucugguaaguccccuaaauaaucauccaucagacuaaaauugucuuucagcaggcauguuaucaaaaaacguacagauuacucaacacuuccucuucugcuccugccuaaauuuuaguguacucuagcaggcucccaucacauaccucuagagcuggagccccucucuuucgccauccuccuuggcuguuguccccuucugcagguggacgugaucuguugcuggugggcuccucuaaacuccccaagacaccggucaucuuccacaagacaggagcugcugucaauauuaucugagcugacuuuuuuuuagcauuuccuguauuuuucaauuuuggacacauauuacugagguauugacaaauaaagguaauacuaauagcaaaugagaauaagacaaggaagucaauguucauucagagaaggaaucagaauugaaucuaggugggaauguacauaucucaaugcaagggagaacauuugccuggaguuuagaaaagaggugaggggcuagcguuuugcaccaaaagcagcacagccaucuuuuauaauauaacaugcgagcuucccagaaauucuuaguuuucuaacuuuccaaacuaccguaaaaucucuugauauaaaaauaaauuuucuuuucaaauuugaauuagaaucaccauacucugcaucuuaaagaguucucuuguauuuuauuugacaaaauuauagcuuuuagcaaauucugauauagugacauaaguuacagauuaauccaucugcaugugaaguuccuuaggaaaaaaaucuuaugcaaugucugaaaaacuguaucagucacuuggccuuucagaucaugugauugcuucuccuuucuacucaguuucacaucccugaacuuuuccccucuaagcaaaauggucauuauuaugccaaucuacagaguaaguaauuaccaugacuacugaccuacaucugugucuaagauguugcuauuuuuaugacauauaaaauaaaauacauuuucauaaugaucacuaccauaacccuguggaaaaauaaauuaaauauaguuuaaagaaugaaaggaauaugcuaaugugacauuaagacugugaauuugaagcuccuuucaguucagugaugcuaaacaauuuuaagaaaaaauuuaaagccuacgguaauagcucuuuuugcucucucacuuucuaagcuucauuaucuguuccaaagauguaucagccuaacugauaccuccaaaucuuuguuauguacaguaaaaucgugggggauuuaaauuucugcaguauuuuugauugucguacaagaagagauucuuccacaauacaauagggcucauuucuacaugccuuucuggacaagaaggcaaugagaguuuuugcagaaaaaacaaaaacccucaaacuauaugaaaaagguuccucuucagucugcaucuguggaggccaacucuguaucacagucuauauuacaggcggggugugguguuuggaauuaaaggaaucccuguuaaaaaaaaagaauaaggcaucucgauacauaucuagauacauaagcauacauacaauguuuauauauacaugaacauauuuaagaagagggggaaugaggcuggcagagauuaaaaaaaaaaaaacaagaucugagacugcaucgaauuauaacugugagcugacauacaaaacaucgacuuuacuuucccaaaacuauaggcaggagcugccuaggaaaguaucccuuggguccuggauugcaaaucugggcuggggcucaccagagagaacaacaaaagagaguaagauguacuauagcaggauaauuuauccucuuuucuucaacaauaaaucagaucacauguuuuuaaugccagaugcguacuuuccaugcaucaccuuggaacacugugagauucauugaggacuccagagucugcucuuuucuuacuuucuggaagugaaaacaaaugaaaccacucuccuggggagaauuuccuuuauaaaacuguguuacucuagucugauauccucagucuuauucaaaaucccugucuuucagaaauuugugccaaugcuuuuacauuugcuuucauuuuuugauauucaaauaucugucuaugcucuucaauuagugauaaagauuucuuuugagucaucuucgaaggccccuuuuggucacaucguaauuucuagaugcuuccaauuaacuugcuauucuuucaagaaugaguauuuuuguaaaaaaaaaaaaaaaaaaaaaagucuuauuauauaaauuaguuggcuuuuacuacaacugguuucacuccagugcuucaucuccuauucugcauuuuuaaaaaauaauuaagauuucaaauaaagauaaaaaucuaacugaauaaaaggaaaaaagaaauaucuuauuauacuguuagaugguucugauaaauuuuggagauccaugaggauuggaaaguccugaaacccaccaggagacucacauuguguucuuaacauggaccuuaguauagugaugaaacaaacaaacaaaaaagcacuagaguaggaguccgaugccuaggggauuaguaccaucuugcuuucaaccuguucccugauguggagacauaagaguuggacuaggccacaaauucagaauucuuggaauauccaguuaaaauacagauugcugggcccccaccccagagugucucauucagcaguucuaguauggggcagggaacaugaaucccuaacaaguucccagagaaugcugcaggucuugggacuaugcuuggagaaccagcagacugggugauuccaaagaucuaucagggaauauacauaugagaaaaaggguaaauuugugucagugucaguaagagggaugcagaaaccauucauguaaaaucugguauaaauauaaaaaaaauuaagaaauaaugaagaauaaaugauucauuuaauaaaauccaccccagagaacagugcaauccuaaagcaucuaauaauaaaccauuaacuuuuacaaauaaggaaacuggaacauauuuaauggaaacuuuuaaaauguuucacuccucaucaugaauuauuuccauaaaucaaaacaucuaaauguacaaacacaacaggggcaauuuuucuguuaagccaaucauuuuuuuuuuuuuuuuuuuaagacagagucuugcucugucacccaggcuggagugcaguggugugaucuuggcucacugcaaccucugccuccugggcucaagcaguucuccugccucagccuccugaguaagcugggacaacaggugugcaccaccacaccugacuauuuuuuuauauuuuuaguagagaugagguuucaucauauuggucaggcuggucuugaacuccugacuuugugauccacccgccuuggccucccaaaauguugggauuauaguugugagccaucacacccagccaagccacucaauuuuaagaaagcugaagucucccauuuaaacaaaggaaaugagaccaaucaugcuuauuuuagaugaccaccugggccugcaugcuugggcuuuggugaucuccauaucuuccauuacauccuaccuacccaccuuccaccugacuuuauacuggaugucuacauagguacuuucucauucuaguccuuccaauauuuuguggacaaaaacaacaacaaaaagccuauuuccuaccacucuggcauuaauagcuuauguugacaauguuuuacaauugugauacauuguuugcauuuugaaagguacuuuuaaagacauaauguaaugaccuuaaugggaauuuuggcaacagagcuggaagugaaaaaggaaaaagugccucuauggagggagggcaacucucauugaaagugaucaauuuaaccugcauaacuagacugagcuucaugagucauaucuaucucaucccugcacuguuccaucuccuggagggcuaacacaguacuccaggccacagcaggaaugcauaauaaagacgggguggauugcaucuuuuuagcauggacagggaaaaaucugcauuugcauuccuaguaacccgcuuugaucacacugugccacuucucauuaccuaacugaugcugcuacaugcauuuuucuucccaaccugauucacauauuuggcuugaaacccuggaccugcccaaaagcaaccauucuaaccaucacacaucugacagcuccaucugaugggcagagaugagcccguuggaugcugccugccuccauguguccuuaaggcaaucugguuguaugccccgcuuguggucaggagucaguucucacgaaguguauaugcuggguuccuuuucuguuuauguguuuuuguuucuauuuguuguugcuguuguaggcauauauuuauaucaccaacuugggcauaguuuaggccacuuuuuuuuuuuuuuuuuugagacggagucucgcucugucgccuaggcuggaaugcagcggcgcaaucgcggcucucggcucacugcaagcuccgccucccggguucacgccauucuccugaauuuaggccacuuuuaaagagcuguuaaagggauuacaauauuaaaaucuuucuuaaguuccagaaaagauuggauaucuaauuuucucccuguuugacaaggucugucucuguccuaacaguguuaagacgggugccuguccagggccccuuuauaguaccccaaguaucaaaaacauacaaaauauaaauguauuaaagagcagaugcaucccugucacuugggaucugguguguccagcacuggcacagugaaacuugcagcccuaaauauccauucuuaugacuaagacauuuuagggcccagagaaaccguuuccagacauacugaccaauguccucauaacaaaacggaacugaguccaaauacuaggaacucuuuuguguuguuaaagacagacauuucacccgaggacaaggagauuugaagagaagcauuuauuucacugaaaagacuaaugaaugcaguagauucuugcauggaaaugcauuuucucauaguaguguugaguaacccuuuuuaugucucuucuuucaaacugugguucugaguccuacacaaaauaucgcagcacucacaucaguacuguacucuuaaauucacuauauucuuaaauuuguacauauuguacauauauuugagucgcaauguagccuguauaaaacaugauacaguccuuuauuuuggcaauuagaaagucauuuaauaguacaauugcuaauaauuucuuuucauaaacaaauuaaaugaaauuuaauuuaauacaauugauuuaaaaauguaauauuuauuaauuacauuuuucuuauacccuuaaauuuugcaagcuaauuuaaaauauuuauaaaaaauaacuuuuaaacacauacauaaaaauauuuugaauuuuuauaguaauucauuuugauuuuuggaaaauauauuuaaaguuuguguacuuuacuauuauauuuuuaaaucuuuuaagacaauuagucucaacacaacacaaauuacguaagaaucuuuaauaacauaauauacaauuuugcugaaaugaaggcaagaaaagucaauguuauauaaaaagauaucauaguuuguauaaauugacuuuauuucuuaugcaucccaucaacagaacaccuaacuggauagucauauuuaaaguuagaugacccugagacuuugcugacuuucugucauagaaauaguauagcauugcacauauuuuucacuauugugacaguaugcuugucaagaugaggcuagaacauauuuuuauucacaguuagacugauucauaaaauauuuagacauauaguagguaggccuccaguuguacuauuguccugggcccuacaaauauuaagguugugccuauccuguuccgguauaggacaugaaaaucaaccgcacggcuccauauccucacauucucaauggucaacugaagagggagccugaaguaagaugcugaagacaauaugcauggaaagauauacuagacuuugguuucaagcaagguagauuuauccuaccuauuacaucuuggcagaauguacauacuuacucuuauucauggaguauauuacuuaaaugcucacuuuacguuucaguuauucaagauaaguaaguuauggagaucuacuguacagcauagaaccuauaauuaaugauaaaauauuguacgcuuaagacuugcuaagcggguagaucuuaugauaaguuuuguuacugcaaaauaaauaaagaaagaaagaaaaggcagggaggaaacuuuggaaggugauggguauguuuauggccuucauggugguaauaguuucucagauguuuacuuaucccagagcucagagcuguauacauuauauauguacagcuuuuuauauguaauaaaugaauaaauaaauacucacuuugagguucauauuaagcauucuaaucuucaaaaguaauugcuguuuuugccauuaaaaguaaaggcaaaagaauuaaaaauaauggcaaaaaccacaauuacuuuugcaccaaccuaacagaugucuaaagccaugaugaaauaccauaaaucccuauaucugcuuucucauuuacuuuucucugaaguccuguuuucuuucucuccuaaccuccuucucauucuuuccucuucuuuuuuuauuuuuuauuuuuuuauuuccacagguuuuuggggaacagguguuauuugguuacaugaguaaguucuuugguggcgauuugugagacuuuggugcacccaucccugaaucguacacacuuaacgcaauuuguagucuuuuaucccucacccccuucccacccuuuccucccacaguccccaaaguccauuguaucauucuuauucuuguauguuuuaucuccuucuucugugugugugugugugugugugugugugugugcaugagugugugugugugugguauuggggaaaguuggaaaaagaaaugaaaagaaaaaugaagaauagugauuuuugugcaauaauaaaaucugauuauguauuguaauuucugcacuauaauuuggguuggcccaagaccuaauggugaaggaggcuaagauuuacuuuaagaugccuccccuucaccuggauauuggguggcgauuauccauaugggucuucgaucuuuuugcacaucuugugagcauaugcacuaacugccccuuuauucgagacucucuuaucacagauguuugcauaaugaaaaccuuggaagauagagaggguacaggccagcuuuacuuauuacuuccuauaauaaaaauaacaucucccuuaaggggaauguuuacuauucaaaguaaaagauucagguuccuuuagcucagggauggguguuuccuguccaauauaaaagauaaagcuuccuguggcucagguacccucaguuggggugcagccccacugcaugcccagcucuacaugagucgcucugucucacccccaugggacucagcguaaggggauccaacaugaauuugagacucacacugcuuucugcgcugugaguaauaaaggcauuuguuuuugaugcagucuuaugucaucuaccagcuuuucugaaacuggcaaguuagcuugcuggcacugcaauacugcacaugcugcagagcucuuaacacaaggcuucucuuuuuuccuucaucaccuuccauuucaaugucuccaugcugcucaccagagauauuccacuuaggcccauauucucuggauuggcaucauacuaaacauacauaccauccaaaauucucucuauauaaugcauaaaauauugauacagcuuagcacauagauguuccagugauuucuguuaaguagaagaacaaauguaguacaagaaccaaugaauuuggauuauguaauaaaugacuuauaaaauuacaaggcauuguuuaguauagguauuauagaaauaaauauuuugcauauauacguuuuuaucauugaucagguucuuuggauuucagaaaugugucauuuuguugaguacucacaagugacaaugucaugaguauccucaucucuguuuuacugauuaggaacugagggcagaaugguaagugauuuuucuaauaucacaaaaccaugaaauguucaaucuaggacaauaauugugauccuaaagucugagaucucuucacuauuuccaaacuucacaagcuuaauuuuuuuuuucccaaaaaagguaggggcaacucauuggaaugaaucaaugccaagcaaugaggcagguaaaguaagaaagaacuuguaagaacacauccagacacaaggccuuccuucauccagcaugucacaggaucuaagacauuacacugcaagcuaaaaagucagccugccacaguuuuguggggcaacaaggcugagcagagguggaugcuuguacacacaguagucuguauuacaggaaaggaacucugagcuuagagaaacacuguuuuuuauggauagcaaacaugucuguccucugcuccagagggagacauuaucuuuauuuccaaggcuguuuacuaugcaaacauccuugaaaagcuagucagguacaaagaguacccagugccucugcucacacaaugugcagaaaugugagagauccauagagaacuguaucuaacacaagaccucagaaagcagagaacauaccagucaccuacacggcuauauuuccagagcugagaaagaauaggucugauuagaacucaaaauauauuuuuuaauggaagaauuauacuaguugguauuugcauccacaacugcauuguauaaaaaugucauauuauuuaauuuuauuuacaccugacucuuaagaaauucaauuacgaaugcaggaggccaccuguccuucuccguagagugacaaauaauacaggugucuuuacuauaccuaagguagagauucugguagaugguugagaaugaugacagcucauuguccaaauuacacaugaucccuugcugcacauggguuugaauuuuucugaaugcugagaauuugcagccccuagaaguaccuggaggaugucuccuuugugauccugcuagagcacagccaugggcuuggucuuuguggaacacccaguccuccaucuacuucccagucuuggagaauacuccuacuucuuucuacuuccucuaagcucaaaaguaauauucuccccauuuucuucucuccacuagcaugauucuuucaaggaguauauguuuucauaaaauaaaaauccuaccuaacaaaggcuaccccugaagcaacuaugcacagaggcuuaauuaccuucuuguaauggagaagagaagaugcaggcaggaugaaacaaacauuaucucaauacauuauccuaacccauuauuauuguuuacaugucucuauauguaaauccauuucuuuauuuuaaaauauuuggggcuuggaaggaugaaaggagagguaaaaaggaucgguugaggcaugucugggagagaaaugggaaaaauaaacuggauucaucuuuagggcuucaggaucucaugagauucuuauuuguuccacagcucaaaugccaaccucccacucuguuaacaucucaacauucagugacaaccauugaacagaucuugaauggccuuuuuuaugucuauuaauucauguaggggcuaaacauauuauuuaaauaguuuuugaaaucuaccaauaaguacacugggcuaauuuuauaucugugcccaaucuauucauacuuuguaagccaugaaucaaaaguugaauacaaguagguuuauacuaauucaaaauaaaugacucauucaacucuuaggaaauaaaguuacaaaagguuuaauuaaucagcucuagcuaauauauguucucuauguucuaaaugaucugcaaaaugguucauaauuucuacuucugaggaauaagccaggugaaaauaauuauauggcccuaauauuuauggcuugucaaaagugguuacuaugucuuauuaugcauaagucuaaguaacgaucaauaauaggggcauuaaaugacaucaauaacuaugauuggaucaggggacacuuacucaaaacuggaaguugaagaaaauagcaggagacugaaugauagguauaacugguagccaacugauaauucuacuuacaauuuaccuggucccaauaauuauucucuggccuuacauucugauuccuaaguaauuucauuuaaaagucacaaccccauuguauuucuaacauuacacugaaguuaguuucaaaagaucuuagaaggucauuuauuuaaucaacaaucauuacgccucaauucauuaguauauagcccucaaaucccauuuaccucuacaccuacucuuuuuggcauuuuacccucaccaccauauuccaaucacucucacaaagguuaccaauuauucucuuaacuggcaaagagcaauuuucaguauuaccuuacucacccuuucugcguccuuugacaucgucaacuccucccucucucuagugccuuuccccuucacugguuucucugacaccauuuggcuugguaauuuuccuaacagcucuuaaacaguuccuagcggaaauuccucuuuuccucuuccccagcguuucauuuguaucuuuuuacuuacugcucugcuucuacaaauucuacguaagauauugcauccacuauuacgauuucagcuacuacugauguacugcugacuacaucaucacuauuugugauucucauuugcucuagaaguacauuuccaaauguaaauauucccugaggugcucuuucuuggccuuuuucuuuauucauaugaucuguuuuucuaauuggcugacucucucccagaagauuaauauccacucucaucacagauugccaaauccuaggccaaauauauuuugagcuucaggcccauauagccaagugccuauggaggccucuccccagauagccaggaagcaugucaaaugcaacauauccaaauauuaauaugccaucuucccagaagucuugacucuccucucaccaucacagucuugaugaggggccccuggacaccauccucuacuucccaauuuuccuuccacuucccauuuccacucaccacacacucucaacucuaccguaaaaaugugccacguguuuguccuuugcacuaccacauagauacaauucucaucauuuuuaaccuagacuacugaaauaggccccugagcgcuaauuaugauuccuggcuuccucaccucuccccaguccccaagggaugcauuuuucccucugcaauaaaaacucggcucacaugcaaaucgaauuggcucacuguccugcucaaagucauuugucuucccauaagccauaucauacaaaauaaacuccuuccacucuggucacaauguccuuugugagcugaccuucccguuucuggcaagccucaucuguugccauucucccucuggcacuuuaaaaucuggcccacucaucacucccugacacauugugccuucucaaaucucucagcuuuuuccaauguuauucuucuuuugauagccuuucacauuuauagaccuguaaaaccucauccaugaagucucauuucaagggcuagcuccucuaggaacauuucccugacucacacagguuugacucgugacuagaauaaagcuguuacccuuuucucuguuguguacuuuacacgcaauguccaccuuauaugacgauuguaacauuuaauuagcuaacacauuuaaaaggcuaagcagugcugagcucauaagguuuaaacuuaguaaacauuagcuauuacuauuuuuaacagcugacaugguguaucauuauuacauauguuuaucuuaccauuagacauuaaacucuuugagagcaagaaacaacuucaugauuucgcauuguaaaggauuuauuuuuuccaauugcuuuguguuucuuuuacauuuacaggagacuaaguauggaauguaugcaaagcaaaauuauaaaaugagcuugagccugcacagacugaaauggaagcaauaucuguauucaaaagagcacugauaccuggaaguuuugaugauuuauacuauuaugcccuggucacuaaggucaguaaauugugugcauggauguaugugcauguauacauauguauguuuguagguauacauguaugcauguggacauguaugcaugcaugcaaccacucuggaguccucucacggaagcaggugucccuuaaccuuuccaguuaaguccaaaauacauauuuguaaaucugagugcaguauguuuucugcaacaugacugccaaccucugauucugaaacugacagaggcauuucucauagauauuuauaacugaauuuauucaaauucauuaauguugucauuucuuaugcugccaccuaagcuaaaaacuucaaaagguauccucuauauuccuaccucucugcaaacacuuccaaguccacacaggauccucucuggaaugucucugcaacaucugccugcacuccaauuccauugccauuauuucugaguuuaggcuuuccaccacgugagucugagcucccaucaaccucauucugugaucaguuauuuuucuaaaauauagaacugagcagguucuucaccugcuuggaaagcacugagaguucaccaaugccuaacagauaaaguuuccaaacuccuuggcacaaaagagaagcucucaaacuauuugucuguagugacaugcacuagugauaaaauccacaugucggacauacccucuaguguacucaggguaacuucuuucgcauucaucuaagugagugagauuggcacuaguagggauugugauagucaaaauaaugccccuucuaccaaauguccauguccucaucccaguaaccugagaauuuguuaccuuauauagcaaaaggcaccgugcaugugugguuaaacuauaggucuggagaggggaagauuuucaggauugucuaggugggcccagugucauuggaagggucuuuauaagacagagguaagaggaucaauagauaaaaggagaugugacagugguagcagagguaggagugaugcuauugcaaaaaaggggccacgaaacaaggaaugcaguggccucuaaaaguuggaaaaggcaaggaaauaaauucucccugacaccucccagaaggaaccagccugccaacaucuugacuuuagcaugugaaacugauuuuaaacuucugacuuucagaacuauaagauaauaaauuaacauuguuuaagccaauaagcggguaguaauauguugcaguagcaauaggaaaugaacacaaugauaauaacuauaauuuuuuuuaaauuaaccaacuugcuuacuucaucuuuuaugaacaacacaaacaacccugcuaagcucaucuuuacuacuccucccugugucuucugcauuauguauuacaaaaagucucagcuaacucacugggcuccccuaauuguauagcacuuuaauacuauaaagaucagaucauauggucucgauuuuuuaugaaguugcuaaaauagaaaguugaaaaaaguuauaaguauauaaagacaaaagcaaaugaaguaaauacagugugcaauaauauaauuuauuuuuaaaaucauggcaaugcaaagaaaggcggugauuauuuugaagcgaggaucauuuagcaccuguuucaaggaagucaucuuacugguuuuggacacaauucuuuauaauuaauuaaaaugaguuuucaguaagggugaagaacacagaggcaggaaugagugagauuauagaggagauaaugccaaggcauggauugaauaauaggggagauaaugccaaggcagggauuggaucugauggaucauucaauguccugaagacaaaaaugggcauuuaaaguaagaaaagaggaaagugaaguucccagaucgauaaacaguucagaggcaggaaugauuguauuuauuuggugacaauggauugucagguugagaaauccugggaaauuaaauuuguuagacaaugggagaugaagcaaaaaguagcagguuggggaguacuuauaagaaauuguugcugaaugacauauuagcaagcaucacaauuaaauagguaugggaugguacuccucuagaaaguucucuaguguugcaguguaaagacagguaaaucuuagcugaauuucuuaguguauucuaacguaccugaggagagucuacuaucguuauaauuaaaguguggcaacuaguuucaccucugcccacucuucuggaaagaaugccuauucccccaacacauccaaaaaagaaaaaaaaauaucuuuacuuaauucauuuauucuugagguaaaaauaagacguguguuucaacaguaaaucuuaaaguaggauguguuuaauccauuaccuuacauuuuauaguacaugcauaaaauugggggaaaaaggucauuuucuauuggaaaauuuaucagcugaaguucugcauuuugagucaaaaauuaaacuuauaucuuaauuaaauuauucuuuccaccuuuauuaauuuuaaugaauaaaauaaaaaaaaaccaugucuacuuacuauucuuuauucugcuuuucuacuuaaauaucauuucauguuaacauggucaucuguuuuccauauguauuaaaucacacugaagcacuuguuaguguuuuucaaacauuuucauauuucaacaugggaaaugggauaagaccucuuccaaucaauaacaauguguuucccuauggaauaugcaagaccacccuuaacaggagauugggaucuucucuccugcccaccuccuucuucccucaauuuagaaccauuuagcugaguuuucccuuuuguuagccuuuguauauagcaauugugaagagcauacaaacaauaacaugcaaguggcuauuucuuucauuuuuuucuuugggauauacuuacaaaguuagaaauacccuaucauaggaucuaguaaguacuguaguucuugcucauuuucucaaucacaauggaguaccuguuucccaguuguuuuuauuuauucaacaaauauucacuaaaguccagcuagcugugugucaggcacuucucuaggcacugaaaauacaaaaaggaaggcaccaaacaaacacacacuaaauaucccugcccccauggauuaaauauucuggaaaauauagaaaaauaacagauaauaacaaauuauaaauacagcuuuucauagaaucauuuuccuguggggaaaaaaagcaaaguguguuaacaugggugagaucagcagaggugcuauuucauacaggauggucaugggaggccucgcugguaagaaaaaacuacagcagagaucagaaggaccgagggagaaaauccuaaaugcauuuagggacagaguuaaguuagggucacaagacagcagaaaugucccgaggaugaaagaugguuggcaucaaugaacucuguggucaauguggcuggagcccagaaagaagggaugugaguaaggggaaguaaauccagagaacuaagcacaguacaacagaacagguggggccuguaaggccuuuggcuuccaccuugcaaaagauggagagccauuggcaacuucugaacagaaguggcacaaacccaguuacauauuagaagaucacucuggcuacacacugaggagagcaugguggcagaaagagaagcaaauaggaggccauccccaggauccgguuaagagauggcguuguuuggaucagagagguagaaagacauguccauauuauuuuaacauagguaucauauacaaaaaaguacacauaucaucaauauauagcuuaauuuugaccaaguaaacaucuggaagcucccauacaaugccucccagucacuaagcuucacgggcaaccugacuucuaauagcauaaguaaguuucgccuguuuuuuuccuuuauauagauaaaagcauagguuguauauuuguggcucacugcuuuuuuucaacauuacauuuaugagauucauccauguuuuuauauauauauauauauauuucauucucugcuacaugauaugccaucaauugaauauauuacauucuacauauaaauucugaguacauauugaagguagagccaagaguuugaagauagaagagaugaggguuauuagagagaggaguugaguaugaccccaaauacaaccugagaaauuacaacugauacacagaaaacuggggcaagagcagguuuggggagaaaaaaacagaaauuuggcuuugaacuucuuaaguuugauaugucuccuagacaucccaacagagcuaucuaguaggcaguuggauaugugagucuguaguucucaggaaagauacaggcaaagguucaaaugcaagagucaccaggguagagcugcuacauaaaaucaugaguuaaauuaccugcaggcugaguguuacaagagaaguucccguggucauaacugugcccaggggaacuacggccuuuagaguuggggaauacaucaagcuuaacuuagaggcauuugaauaugcaggucuuuaaccaacaauaagccuguggaauauuaagaaauaguagcauaaaaccagcucugguucugaauaaguaucuuguccuaagacaugaccacuggaaguagaguuugaggaacagggagagggugauggugcugucaaucaucagccuacuguuugcuaagugagauuccuguccauauaaaccgugaucuauucuagucacuuauuucaauaugagcagaagaaaaacuuaauccucauuuuaauuuaaucauaaagcuaaaauacaguuguuuaacaccagaacuucaaaauacauagguuucuucuuggcaagaagcugcugugaaaugcacaaaguaaggcucaauaaauguugaaugaauuauuccauauauaucucaagaguuuuuaguaacaacuguaggcaauuuaaugugauagaucugugaaaguuaagaaacccucuuuacaauccaguugggaaaaugaacaaauucuauuaacuguacugagauaagcauguaugugugugcauuuugagaagauacauguuggcagggaagacauggagaaacauaguagagggaggacagugaagggagggaaguccuggagaugaacaugguagggaaaagaaugaucaaauuuauguaaaaauuaagacagagugaaaauuaggggauaagaagguaagccacucuucccacugaagauuccucugcagaguuuaacaaaaggaauccacacaauuaugugugaugaguuuccaaguauaaagaauaaaagaaguccagagaaguucagagaagagagaaauaaguuuacauugggaaagcuuaagagggauuucuggaaaaggugcaguugacgaaggcccugcagucauaauccuaguagagauuccacuucugcuaacuagauauacuagcagaaggcuucuggccugggauugugugucucauuauuuauugccauugguugagucacaaaggucaugugaccaaaucuaauuaacuagaaaacucucuaagacucugauucugucccuggccaccauuggcacaguuuccagccucuggcagaccuaugauuucuauaagccacuuguucucccucagcaaguuaaagaaccuccaucagcaugcacagagggacauaaaaugucaagauuaauucuaaauauucaagagacaacucuuguugagagcugacuugaaaccaaaaauuacuaagcacaauugcugacaauuaggggaauuaacuagaaagggggaggaaaacuggcagaagacaaaaaaaaaaaagacugucaagaaagaaggaagaaaacauacuaaauuuaugaaagagaugacauggacuaaaagagaauauugguggggcagagccaauuugcaaaaacuaaaaauuccauuggcugucaauuucuucccuuuuuuuuggaaauggauuugcacucuuccccuugcgaggccccaaacugaccgguaguagggcuugugcugcucaauagcugcugcauucuacccuagaggcagcugcauuucauuguucagcaaagugauucuuauguagagaccgaacaauuaaguacuuaggcauccugcccaagcaggaagacaaccaguaucacuacacugcaucugugggggaagauaagaaaauuuaucuuccuccaaguuaaaugguacagaaaaucuugaaguugagagcacaucuaaaagaaggcaagcaggccaggugcgguggcucacgccuguaauuccagcauuuugggagguggaggcaggcagaucaccugaggucaggaguuugagaccagccuggccaacaugaugaaacccuguaucuacuaaaaauauaaaaauuaccugggcaugguggcgcgcaccuguaaucccagcuacuugggaggcuggggcaggagaaucacuugaacccaggagguggagguuacagugagccaagacugugccauugcacuccaaccugggcaaaaagagugaaacucagucuccaaaaaaauaaaauauaaaaauaaaagaaggcaagcaauagugcuuuaaguuggcuaacucuuccaaaguuugcuuauuaauuuucauuuuauauauaaaauuaaacauaauuauuguaaauauaaccuuaaaaaauuuaaagauuugauaagcaauaaaugccacuaaaccagaaaauauuauuucacuucaagcacuauaaauccauguacaaaugugaaaucucagccuuuuccauuuaaacuaaacagaguagguguaaaaggaaaaggauuuagugagcuaguucugauuauuuuuagauuauugaguaaacaauaaagaagagaaaguauuucacaguucuuauguagaguuuaaauuguuuaaauugggucuuucagcuucucuggaucucauaauuugagaaauguaugauuuuggacuaacuacuuguguguuuugcuuugaaaugaagccauuucagaauuguuauuuuacacacacacagauauaaauuaucaucaguuuuacauauaauugccccagagauuccuuaaauuugaauuucuguagaaagcugcuacauuuuauuauuuguuuacuuccaguucagauagcuuuacauaaagcagcuaucaaauacuuuuugaucuuucaaaaagugaaaaauaaaaaucaauuauauuuaaggaaccauuaauuagcaacaucucauaagagcaugucuuguacuguuuuuggcaaaugggcuauacacuaaagcuccuagugucauaggcauuugaacgagagcaacuccaucuugaauaggagcuggguaaaauaaggcugaaagcuacugggccgcauucccagaugguuaaggcauucuaagucacaggaagagauaggaggucagcacaagauacaggucuaaagaucuugcugauaaaacagguugcaguaaagaaaccagcuaaaacccaccaaacccaagauggugacgagagugaucucuggucguccucacugcuacacucccaccaacaucaugacaguuuacaaaugccauggcaacgucaggaauuuauccuguauggucuaaaaaggggaggcauggauaauucaccacuugucuagcauauaaucaagaaacaaccacaaaaaugagcaaccagcagcccucaggacuggcuccgucuauggaguagcuguucuuuuauuccuuuacuuuucuaauaaacuugcuuucacuuuacucuauggacuugaccugaauucuuucuugcaugagauccaagaacccucucuuggggucuggauuggaacccuuuuucuguaauacuaggacaucuuuauuacuuuucuuuuuuuaaacuuuguuuuuauaagucagugcuuaaaacaaagaaaauacuaccuuuaaaucuucuucucuauauugaaugcuuccuuauauuuacaaagaaaaauuugaaucaaauaugagcaaaguauaaguugcaugaauuuuaugaaguagaaagacacuucuaaacaguaagugcagaaauugaacauaauuuauaauagauggcacugucuuccuaugugaaguaagagaaaggauugcuugcuuagcuaaugccuuacccuccuuaggccauuuaggggauuagaggagaucgggcauucuuaaaguagacuaaauggugguucacagggaauucaugaaacugaaguuguauguaauguguuugaguguguguuguguuucucuauguuugugggggaaagagaauccuuccuuuuccucagaaucucagaggggucuguauuccccagacaaaagccuuaaaaacugcugagcuagaagaucucuaagauucuuugaggucuccaaaguuccucagaugucugguagucaaaugugauuguucacaaaaagagucaaacugcaaaauauuugaagagauuuauucugagccagauaugacugaucaaugguucaugacacagcccucaggagaugcugagaacauguggccaugguggcccggccacaacuugguuuuauacauuuuagggauacauaaagcaucaauuaauacacguaagauguacauugguucagucuggaaagguaggacaaguggaagccaggcuuccaaguucuagguggauucacagauuuucugauugacaauugguugaaagaguuauuaccaauagaaaggacugucuggguuaccauaagggguuguggagaccaaaguuuuaugaugcagaugaagccuccaggugcaggcuucagagauaauagauuguaagugucucuuaucagacuuagggucuguuguagcaguaauuucaaaaggcaggcggguauaaugaggcaugucuggcucccaccucccaucauggccugaacuaguuuuucagguuaacuuuggaaugcccuggaccaggaggaagagggguccauucagauggcuggggggcuuagaauguuauuuuuauuuuacaugaucaucagguaagggugaacuuucaagcucauccugcaauggcuccucucugugugacugucaucuggucauuuccuccuuuggauaauacauccagggucaucauggguaguauaaagacuuuaggaaaguccagcauauuaaaauuaucugcugcuaaaaugucuguuuacauuucaguguauggagugagaccauguuucacaaaaucugaaaauaacaauagggaaaaaaguaaaaaaguaaaaagcacagaggucagaguuaauaaggguaggacaaggaugaaaagaaagaaugacauguguccauuaguccaucugcuacuuauaugcucuaggcaggcaguagauucaccucaggccauccgcacccucccacuggaugcuugaccuauuauccaggugucuuucuucaggccugcucucacccccacugccuggcagaaacagagaagggggaugagcccuugcaaaaccucuugaagaggccagucacccuuggauacuccaggaggcuucaaucuaucguuggcugucaaaaucaccccagaaguuuucuuccugaaaggcaguuccaaccucaagacuauuuuuuccccauuaaaaagaucuuucaaauuacaagacacacaaauggaaaaaaaaaaaacaacaacagaauuucagcuguaaauguuucacaucaacaaagugagguaucugccaucauuaaugccuaauuuggcaaaugagccuucccuuggcuggaauaaauaaauauuuucuaaccaguggaauggcccuaugucuuaggacccuaggacaggaauuagcaaacuuuggcccaugggccacacucagacugccacuuguuuuaauagugccugcaaacuaagaaugauuuuuaccuuuuuaaaugguugugguuuaaauaucuaucuaauaacuuugauuuuucaaacuggcauaaaaaccuuaaauuguuucuguuacuuuauauaaaaacaacuuugccuacuucuugucuaagagauacaugucacagugagaagagagaggagagagagaaagaaagaaaggcaaggaaaauguaaucuaauuccauauauuaacauggaugcaauuaucuuaaauaucaacaaguaaaauauaucaaaguauuuaaaaaguacguauguuacguguguauauauguguguauauauguauguauauauguauauacguauauguuuuaugcauguguauauauaugacugcauauacccauauauacagucaucaugaccaaguagguuuuuuuucccaugaauucaagaaugguucaacauagaauauuuaggaauguaauugccauacuaacacauuaaaugagaaaaauuagaagccaugcagaaaaaguaccuaaugauauaauggaacacaaaagucaugaauaagccuuuuuuuauuuuuuuuuuugauggagucucacucuguagcccaagcuggagugcagugaugcgaucucggcucaccgaaaacuucaccuggcgucucaagccauucuccugccucagccucccaaguagcugggacuggaggcaugugccaccauacucgguuaauuuuuuuuuguauuuuuaguagagacaggguuucaccauguugcccuggguggucucaaacuccugagcucaggcgauccaccugccucagccucccgaaguguuggaauuacaggcaugagccaccgcacccagcugaaaaggauuuuccucuuuccauccuuccuguuaggaaggaugaggcacaacuauuucauauagacagaucaugcaaucacaugccauuuguuuuaugugaauuucacauaaaucauuuccuuuuauucuugucucuggcaagacaaguacaaaaaaaaaaaaaaaaccccaugcaaauaaaucuaugacugguggaucuuugcuaccuggacauuuccucuuuacaaauaucuauucacccuguccugguuaucuugccacuagcucauuuggagaaauaguauagguuagaaauugggacauaauauauuuuuccucuaaauggagaaauaauucugccauccuagaauugauuuaauaaaaucaggucagauucccauccuuuuguuuugguaagauggguuuuaaucccauaucuuaugcucaaacaucaagugcucugcacagagaagagaauggggcaagcucucugcuggacacaaaacauugcaguggugaaguaagugggccuugggagcacuccaccugcaucugaauuccuguucuaguaauuaucaaccuguggccuugguaagucucucggcuacucuuaagaaccaguuuucucauccauauauaaaggaagaugagaguaccuuagucauaaugugguaaggaaugcaaaugaauauacacaguacagacacacacacacacacacacacacacacacacacacacacacacacacauaacaaguguuugguaugggcuaagagcucaguaaauauuggcuguucuuauaguagagaaaucauccaguuguugacagauugcuuucacuuaaauuuuccagguaggggccccaugaggaccagcuguauaguaagcaguuccuauuuuuagauucccaugaacccuacucaagcuuaagauaaauuuccuucucuucagcugguuuguguguggcuugaaucuccacagcagcagucacagcaacaaagcucugauuggaaagucaggcuacuggucccacagacauguuuaaccgcagcuggagcccaagcaggucucacauacacgagucggccaaccugcauaaaucaaguugugaguuaauuccaagggagcauuuucauuauguguacuuacaugcucuagguuacucacagaagaugcucucagcuccucagaaagaaacauauagaaauuguaccaaugugacagagcucuuuagcaaacuccauguggguuuggcucaaauaacuaaaaggguuagagauuaagcuaauacuuuuaucuccuaggcuccauaauuaggaaauguauuuucuguggaauauaagaacagccaucuguccugaauuaaagaauauauaauaucauuacaaaaauaugaugccauuguuucauuguuuuugaaauaugauuaacaagccagugaacaauaaguuugaaguuuagaacuacuuuaugauaaguggauuuaaaugcuugaaugugcggauauauuuggcaauucuaucccaguugaguaguucauggucucugccaucuccuaauugucuaagugauugcuuuugauuuauacagugguuuuucuucccgacucauaugcaauugauuuaccuuaaaccuucaguguagcuuucuaaagaauauaagcuuagaaagcccuuaguuaucaugaagagauuuuguaucuguuaccauggauauugcuuuggugguacccagacacuaucaugccaagaagaaucacauaguaccuuucuaauuauguauccuguucauuauuuauuuaaaaaaaaauuccaaaaguuaacugguuggaauuuauuagacaccaaucuaaggcauauacaaacaacauaaacaaaagccguguucaaaguuucauuauuugaggauuccacauuuuaaaauuucaggcagaugaaaguuuacuggucuucauuaaacugugccagaauaucuuugcugucuguuugaauaaaugcuuuggacacuaauuuccaagucugcagcucauaagggaggaguauaaucagaugacucuugccuauguauaauucauaaguaacugucaggguaugaaguuagaugaauucccucucacucauacccuuaccaacuauggagaauacugugaguuaagaguucaaguacuuccuaauauuaagagucggaagaagaauuugagauuucaauaguaaauuuagaaaugcaacaagaaauaaaguucucaugaccacugaagagugcuauuuagcuggugguggaggugguggcaaugucaacugucuacuaugcaacaccuaccaaaaaacucaagaauaaagauaacacagaaaauggcauuuauuuguuucgaaaacauaaaaaaauggccuaauguucccauauuccacaugcccucuaccacagaguugaaucucacugggccucaguuuuguuuuuguuuuuaaugcuguaacuaauaguuaaugcaugcugggcuuaauaccuuggugauugguugauaggugcagcaaaccaccacggcacauguuuaccuauguaauaaaccugcaccuccugcacauguaccccugaacuuaaaauacauuuuaaaaaaugcuuuaacuuauuuaaguuccaauaugcuuugauccuuuguauuuuucuacucuuaguuguagccucuugagaaaugcuaauaucaaugaugccaaaauguacuaaauagaucauuauauaaugguagcauugcuaaagggaaaaguuaaaaauagagagaaaauuaaaaauugaaguagacauacagcuguccauuucugucuguauccucuacaaccaaaaugccacaaaacugcagaauuuuuaaaauagaauauuaaaagauccagggcuuuuguugcuucuuccagaacuguuuuccaacugucauucaugccuugucaaccauaccaaaugagagaaacccaacacuguccauuuaucagcagcugcuguuauuguuuagucuuucuuaugaauaucgcccccuucccaagcaauguuccaacuagauaagcucagcaguauuaaccauauaguccaaucauaaagggauggcuuuaaaauauucauuggugauaaaaaugaccccuaauguuacugacgcaaucugcaauauaggaacaauucauccucuaaaguuacaaaugcugaaggucagaagaaagguuucucuaugccacuaaggcuuaggaaucuauuccuuuccugguaaguggggugaaagugaaagagggaauaagaaauagaaauuuccuaauauugggccagaaagauggugcaaauucaauauugcuuuugggggcucauuucaaaaaauaaucuuaccacccuguuuuguggauauucacaaaugaaauacauaguuuguaguucaguauuacugcccuguuugcuuauaaccaugccuucuucucagagccauuuccuacagcucuguuaacuauggugccuuuaaucaguacuauguacaugcaauuacccagggagcucucauuuuccugugugacuccacuccuggcccagagugucuagaagagucuaacaguuacauauugcugcauuaaaacaauaaaaacaaacaaacaaaaccacacuccagaagugagugucuuaaaccaauaaccauuuauuaguucccaugacuggaggcauggcggguauucucugaacuuucuaauacagaggcuuucaacuacagggucagcuaggcuagaagguucaaauggccacauucccauuuagcaauuagcacugcugucagcaggggguuaagaucagcugggagagccacacuucuuuuucuauuuaguauuucaucuggggucuucaugccuucuucucucaugucagcauuacaacagggcagaaacaaacauuaaaaagucucuugaggcccgggugcaaaacucauucagugucacuucugccacaaccaguuuguuaguuaaggcaaauguuaagacagguucacagauucugagagagggaauauuugauuucuugaugagagaagccacaaagccacauugcaaaagaucaugggggaagguguagcagccaucucugaaaacaaucuaccaaaaggggacucgagucucuauaauaauacagcagccaagauuuuacacuaacccaaagaaaguagugaaucaacucuggcucucucugguuaaaacucagauuguguuggaucuaucuaguggacagaaaaaaacaaaagauaaucuucagcaugaaagcaguuuggcacauaucagaaaggaacagaguugaaagacagaaagacucacuauguuuguuuccaccuuugcaugaggccucucagugggugccuuaagacccccauucuccauaagauacugugaaagaaaaacaucuugagcccccaaaaucacuaagcuaaaaggaaaauuuaugcuggaaacugcucagggcaaaccugcuucccauucuauucaaagucauccccucugcuuacugagauagaugcauauucugacugccaccuuuggaaaggcuuaucagaaacucaaaagaauguaaccauuuuucugucaccuaccugugaccuagaagcccccucccugcuucgagcuguccccauauuucugaacgggagacauauauugauugaugucucaggucucccuaaaaugucugaaacuaagcugagcccuaaccaccuugggcacaugucaucaggaccuccugaggcagugucaugggagugcauccuuaacuuuggcaaauaaacuuccuaaaaucauugagacuuaccucgucauuuuucuugauugacaauaccauccucucuugcuuaauucagauuggguuccugccacuuguaccuaaaaaagucaucuuaacucacacuuccaguuuauguccaguuuauggguuauggcuguucacuccaaccuuucuagucuucauggcuguuuccacaugacuagaugccuuuuauaauauucuuccaauucuggaaguaaauggacauggaaggccuauaggagagaaaauccuaagcaagcaagcccuaaaccuaucuaaucccagagugagauaaaguuccuagaauaaaauguuauguuugauagaacaacugaaaaugcuacauuaaaguuuuuaaacauuuuucaaaauucauuuuaauauuacugaugaucuaauauggugcuaaucauuagguauguaaaaauggacaaacaugcuuugggaggccaaggugggaaaaucacuugagaccaggaguucaagaccagccuggacaacauagugagacccugucucuacacauuuuuuuuaaauagccagguaagguggccugugguccuagcuacucuggugacugggcaggagaaccgcuugagcucaguaguucauggcugcagugagguaugaucaugucaccacacuccagcccgggcaacagaagagaaccugucucuuaaaauaaauauuccauguucucaugaugcucaaaggcaaggcagagagucaacaaaacacccuggccuuaugcugaagccucaugcugaagaugggagagcugcucaccagaccaugcauccacuucugaacuauuaucugagauggaauuaaaccacuaucuugccaucuucucuaagguacuguauuuuugcaucuuuuuauuaaagagaccuaccauaugccuuaacuaauuuuaugugagcaaacaacaagcugugggaacacagacacuugagagauugagucuucagggauggggaguggaguguggauggacguguugaagacaauuuuuuuaauaucaaacugauuaaugucccuaucuuuuuucuuuaaaccucaaagucuuaguucagcaucugucauguuguaggcaguuaauaaauauuagugaaaggaagaaagggaaggagagaggauggacaaaagguaagaggaauagagagaaaugaauuucagaaguccauucuauagcaagucuucucuauccucucuggcaccaucaaaagaaaagaaaaaaaaagaagaggagaggaggggaggggaggaggggggguuaacuuauccaaaggcucauuuuagcacaaaacauaugaaauuguuacaucuuuaacacgggauuuuuauaaggcugugaucauagccauaaaacuauuauauagcauuagcuuuaaaauguacaaaacagucgcaaugagaauucucaguuuggaagauaauuuuguaucaacuagaacaagggugcccaacccccaggccauggacugguacuggucacagcaggagguaagcagcaggcaagugagccaagcuucaucuguauuuauuuacagccacuccucaucacuggcauuaccgccugagcuccgccuccugucagaucagugguggcauuugauucucauaggagaguggacccucuugugaacugugcaugcaagggauuuagguugccagauccuuaugagaauuuaauaauugaugaucugucacugucucccaucacccccagauggggccauccaguugcaggaaaacaagcucagggcucccacugauucuacauuauggugaguuguauaauuauuucauuguauauuacaauguaauaauaauagaaauaaggugcacaacaaauauaaugugcuugaaucauacuaaaaccauccccuuaccccucgucugaggaaaaacuaucuuccacaaaacuggucccuggugccagaaagguugggaccgcugagcuaaaagacaaugacuuucagaggacaugauacuuuucugcucugugguucgacuaucagcuuaaugaauucugauuuuuaaguauauucuaguucucauuuugaugccaucuacaaggauuaaguuuacauaaaauaucaaguuuuaaaauaaguacaaaccacaaauuucucuacugugauucaccacauaauagguaguuugauuuggaaaaucaaaacaaagcaaaacaaaagcagccuugucugucaacaacaaaaaauaggcugugauuagaaauuucacgagguuagaggccaaccagcuugaucugcauucuaauuccugauuugccacuaacuguguuaccugguaauucuuuuaaacuuucugcaauaauuucuucaucuaaaacauagaaagcuagaugcuauacaaguuaagaauugauuucacuuacuuugaagauagaacuaaguuugaaaccaaaagcugcuaauaacuggcugucauaacuugaacuuguuacuuaaguucuccaaggugcuccagucucaacaauaaaaugagaaacauauuauuuaacuuuuaacuaauggaguuuaaaaagaacauauauaucucucuugguaaucagaaauugaaugaguaauguuucauuucuuuguacucuauuuugauuuuaaaauaguuugcccauauuuugcaaauguuaaauacugacauuugccuuaauaacaugaagcuauuuugugcacaucaaacauagcuuacugugugcagacaguauuuuugugguaugccuguucaucuuuaguguuacccuuuacuuauuguaguuuacugcuuuagugagcuuacaaagauuauuacuuucauugcaugugucuccgaaguuuuguauugccuuauuuuugucuaaaaaaugaugcacuuccagugauuuugguguugacuaauuggucucuguuucaguuaauuuucugcaauuuagagaccaugaacuaaauaauauacacauagcacaauguuaggcacugagacagggaagcaauccucgucucaaaaaucucagacucaaaaccagcauuucucaaccucagcauuauugaccuuuuaggcuagauaauucuuugcugugauggcuguccugugcauugcaggauguuuagcaguaucccugacuucuacccccuagaugguagaagcacuccccaacuugugacaaccaaaaaugccuccauacauugucaaauguccccuggagggaagugguaaaaccauucacuguucuagauucaugcugccaguaagguaacaauuuaaaauuaaguaaaauuaaaugaauuuuaaaacucaguugcucagucacacuagucacauuuuaagugcucaguagccacauuuggugaauggauaccccacuagacagcacagauauaaacuauuuuuauugcagaaaguucuauuggacaugaugacuucaggguaaaggcuaugacaaaaauacaauaacaaacguaauaauaaucaggauuccauuccaguauuuccuccauuggagaacuccuaaucagaagaauauuucaaauugaauucuuucuguaaacgcuuccucaacucauccuuuaagaaagaauuuaagagacuucugcuaugaggccaguaguucaaaacguaacuaaugcuuaaggacagcuucaaaacaaggcccaguuguaauuauuggauaggcacaaugacagagcuagggauuaaucuuuacuaagggcuaaauuaggaaggauuaugaaaggaauuuuuaacagguauauauaauccagaaguuucuggagauguaaucuacgugaagaaccuguuguuaaaacaagaugaaaauaucaacugacuuuauggaggguuucacuucaacaaaaccagaaguggccugcagagucauccagcuuuaacacuucagucuccuugaacaucagagucagcuggcccaaggaaaaugcauugauuaagugacccuccauuuuucaagaucaaauaugcccucaaccugcuaacagagcaacacgagaccacaauguccaaucaagagggcauuccgaagucaacauuuuuggacauuuuuuaaggggaaaaaaagaauucuaagaaagaaacuuuaagaacagucacacaggccgagcacaguggcucaugccuguaaucccagcacuuugggaggccgagccgggcggaucacgaggucaggagaucgagaccauccuggcuaacaugaugaaaccucuucucuacuaaaaauacaaaaaaauuagccaggcgugguggcgggcaccuauagucccagcuacucaggaggcugaggcaggagaauggcgugaacccgggagguggagcuugcagugagccgagauggcgccacugcacuccagccugggcgacagagugagacucagucucaaaaaacauaagcaaaacaaaacagucacacaaacugcuuuucacaaaagguugagcuggacucuuacuggcuacacgguaugagagaguuggcguguguuagggagggagaugaagccuuuguguguaugaagcuucauauuuaauaaauccccuagaaacaguacuaaugaauauugucuccuaaacauuaauccccaaaaugaagggaaaaaacccuccuuuuauuauugacaauuuuaccuccuuuuauaauugacaagagcaugugaugcuauuguggacuaauugauucagaaaguaguuauuaaauauuuacugugucuugucucaagacaagaaagcuggggaggaggcagagcaagaugguggaauagaaagcuccaccgaucaccccugccacggauaccaauuuaacaacuaucuauauagagaaaacaucuucaaaggaaccaaaaaucaccugacaccucauaguaccugguuuuaacacgguaucacugaaagaggcacuaaaaagacagugccuccuucaaucauacaguguuaaaaccagguacuaugagacuuuucucuucaggcacagaaaacuccuggaucacugaagccaccccucccugaccccaugcaaagagcaccucuggcacugggaaagggacagcucagcaauccugaggaaaugaacucagugcuguccuguuagagaagaaaggaaaaucagaccaaacucggcugauaccuacccacagagggagcauguagaccagcccuagccagggugaaccacagaucucagaggucugaacuugaguucccacagaccucaucaccaaaugccaaagugcucugggucucuaaauaaaccgaguccuagugcucaacugggucacagacaguggacugaaggggcaugugacauacugacauacuagcuggggugacuaagggagugcuggcaucacccuuccucuaaccccaggcugcacagcucacagcuccaagagagaccccuuccuucugcuugaggagaggagaagaaagaguggggaagacuuugccuugcaucuuggauaccaucucagccacagcaggauagggcaccaaucagagucaugaggugcccguuccaggcccuagguccccaaagauguuucuagacacacacuaggccauaaggaaacuugcugccuugaagggaggagaacaagagucucugccuaauaauacagaaaauucuucugaaucuugucugagaucaucgaggcaguaccucuacaugucugugagaaucacagcauuacugggcuugggguacccccuaaagcagauacagcuuagaucacuacaacgaaguuuuuucaaauaucuggaaagccuucccaagaaggauggguacaaauaagcccagacagugaucauuaaaauaaauaacuaacucuucaaugucuagacaccuaagaauaucuaccagcaucaauaccagccagaaaaacaugaccucaccaagugaacuaaauaaggcaccagggaccaauccuggagaaacagagacaugugaccccucagacagauaauucaaaauagcuguguugaggaaaugcaaagaaauucaagacaacacagagaagacauucaaaauucuaucagauacauuuaacggagauugaaauaauuaaaaagaaucaagaaguaauuagggagccaaaaaaugcaauuggcauacugaagaaugcauuagagucuuuuaauugcauaauugaucaagcagaagaaagaauuagugaggucgaaaacaggcuauuugaaaauacacagucagggccaggcgcaguggcucacgccuguaaucccagcacuuugggaggccgaggcaggcggaucacgaggucaggaguucaagaucagccuggccaacauggugaaacccuaucucuacuaaaaauacaaagaauagcugggcaugguggcgcgugucuauaaucccagcuacuugggaggcugaggcaggagaaucacuugaacccaggagguggagguugcggugagccgagaucaugccgcugcacuccagccugggugacaaagcaagacucuguguuaaaaaaaaaagaaaaaagaaaauacacagucagagaagacaaaagaaaaaagaaugaaaaucaaugaaacauaccuauagaucuagaaaauagccucaaaagggcaaaucuaagaauuaauggccuuaaagaggagguagagaaagggauagagguagaaaguuuauucaaagggauaauaacagagaacuucucaaaccuagagaaagauaauaugcaaguacaggaagguuacagaauaccaagcagauuuaacccaaagaaaacuaccucaacgcauuuaacaaucaaaucugucaaagaccaaggauaaagaaaggauacuaaaagcagaaaaauaaaagaaacaaauaacaugcacuggagcuccaauacaucuggcagcagacuuuucaguggaaaccuuacaagccaggagagacuggcauggcauguuuaaagugcugaaggaaaaaaacuuuuaccucagaauaguauaucuggugaaaacauccuucaagcacaaaggagaaauaaagaauuuuccagacagacaaaagcucacggaccgcauuaacaccagaccuguccuacaagacauguuaaaggaagcacuucaauaagaaagaaaaggaccuuaaugagcaauaaauaaucaccugaagguacaaaacuuacugguaacaauaaguacacaaagaaacacagaauauuauaacacugacugcgguguguaaacuacucuuauccuaaguagaaagacuaaaccaugaaccaaucaaaacaagaaagcuggauuuguucccaagaaugaauucgcuuuaaaaaauaaguucccacuaaaugcaauguguauacugagcauugacaacgugcacaaauaagaacauacucagaguaauuauaaucuaggcaaugggagaagggcaaaggugagggaguacgcaaguaacauaacaccaaacaggacagaauauacacuauuagucacaguguugaggcugcauaaaaagagaaagaucacaucucauuuuaaaaauucacaagccuuucuggagguagccuuuaacuuuaucuuugaggauuaaguagaauuuuggcauauuccugugggggagaaaaugugauucucagcuaaagccaaacuucaacgcagggaagauggguguguguucugaagugcuucggcaugcugggauguggggauagaucuuucuggaagggcagucuaggaguccaguagcaacuuuaaccugcccaccucccauuaaacacaagcaucuuauucaaugugcauauagaauuuauacuuuaacaagcuccccaggcgauuuuaaugcauacagaaguuugaaaaccacuucaguaaaggaacguuugaaacuacuuggaauauuuguaaguaaaaggaauaugugaagucagggaaugcagauaauuuagauagcuuuagaaaaaaagaaaguacuagugacuugugucucuagaaauguaacaauagaggaaauacucuuuuuuguucuucugucauuauuuaaagaaaauaaaaucauuucaaccacggucaacaaauguuuacugagauaagcacuggaaaaaauacuuucacauauauuaccucauuucgucuuaaccacauugugcacaaaccaaaccaaacauugugcacauuguuuugaaaacaaaccaaaaacuuauuaaaucuucuuguugaaggaugaugcccuucucccauugccuagauaucuuguugaagcucugauccuuaaguuccauuuuuucccucugaacccuaccauaaccucuaauuacucucacuauuucuaacacauaugcauacugaauuccaagcaauccuacccgguugucagcucaaguuuugguccacaucuuuuccucacuuagugaauccuuuguaaacccuucuguugucucuuuaccuaagacagacagaguggucagcucaugcccuuacucccugggcccacauucuaguuuuagucuaucuaaagcaaaaugaagucuuuuaaaaaaaggcaauuuuaagauccuauuuuucagucuaggaaacaggugucuaagccacucacuuauuuuuccuuuuuacuggaccacucuuaucucaaagacuguucuguggcuuuuggagaaccaacaaggcuuuuccugaugagcccucaaacuuaucaaggaaugcaaauccugucuuuguuucuuacagaugaauuguuuuugauucuuaaggauguaauguuauaaacauuaauuuauguaauguuaaaauacauuuacaacaguauuuuuuggccuauaguuuucaacauuacuagacuucaauccauguauaugcacauguuguaauucuuuccacauacuuauugcuaauguaaaaacaaaauauauuuuuauuaguugaauaauaguucauuagugauagguugccuauaguuuuguauaauuggcauaacaggaaauauacagcuaaaauaaguaaaaucaaauuauugaguuaucuuuaaauuuggaagagaacauucuuuaauaugaaaauguccuuauuaaauacaaggugauucauaaauauugcuagcaaaauuuacuguauguuguucaguuaauucugcuccaauuuuuaacacugagugucucuuuccccacugaggaguaggaacuggugauacaaguuacagggucuguuuucccuccuauguggacccacugugaucaucacuuaacuguguagcugugugucuggagggacuuuguccuugaccaauuuugcuuuucccguucuucaugcagggaggggaguggauggagugggcuguugccuuaacucuaagccuaaugcaguccaaauacuacauggccaacaaaagcuuuuaaauacaacuuauauccauuugauaacuucguauuaaacagcacagaagaaagacuaucauaccugaaaaucuauguccuaguccucuuauuccuguaaugagcuguggaauccaaggggaaacuucuaggaguuacauuccucaucuuuagaauauccacaaacaaugcaaccgucaaguuccuuuucaggucaaaaauuauaugacucugugacuguggcuuuauuacaaagcagauggaugauauuaccagaucauauuguuugaugaugacuaccauagagauggaaaaaugaugcugcuauugcagagauguugaaaaacuauaagaaauaauaaguaguuuaguacuuauaauaauacucuaccuucuaccuugcaaugcccuuugaaauaaaagagaaaaauaggacauaaacagacaauaccgauugucaaggugaaaaaaacauacaaaucauaaacaccaaaacaguuauuuucuggauggagaagaaaauggagaaaaagcuacacagaaagaagcuguggaucaaagugugcaauaaauucaaaccaauugcugcugcaugaaagaaaaauaucagggucugugcaagaugaauauaaagcugaauuauucaacaaaacaaggagauacauaguaacauugaucuuggucugcaucuggaauaacugguuuaguuuauaacuucauuuuaccauauagaaaugcaaauugaagauuuaaaaaagauaaaaauauuagcgauauagacuucauuaacaaggaaagauaaaaggggagagccaaauuauuacucccauugucaaucacgaaacugucaaauaaaagaauaguuucuaaguaucugaaagauauaaaaccagaauaagaccccaaauuaaggggauaagagcacuuggguuaaaguucuaguuaacuaauagcuaauucugaaaaacaguuuguuacagagcccgacaguacagcuaaaagcuucugacacuccuagaauaggagauacucauucgaaaucaaaaucgccaccauaaaauuguguaaaugcaugagauaugaaaaacuaaaccucaugagaacuuuacagaacuaaauuuaaagucauuaucauuaagcucauacuauugcacauuuuagaauguauauucuucuugaaagaugaacaugaaagagcagaauacaaagauucuugauuuuuuaauugauuauauucauuuucaagacagaacauaaaugaaauauaaacaugaauugaaagaugcugauuuuugaccaggucuugccugaauaccagaagaaguagauaaauuaucuucaauuuuuuuucuauuacuuauuuuaucuuugcucuuuaaucucuaggacacucuaugcaaagggauucugacccagaauugaaaacaaacuaauaaaaaaucauaaaaucuacucguuguucuaggauuacaccuuuuacgcaaugucaugaucuguuucccaaggcugaaaugaaagaaccaggagggucuuuugcaaaaaccaggaggauuuucuugaagcacuccuccagggggauuucucuugaaaugcucguaucuugccuuguuuuccgugucuuucccgacucuuggccugcugucaauugagacuggaagcuccucuggggcaaaccacgccuggguugacuaaucgaaauccaacauugggcaguggauucagucuccauucuuccucuucuuuuuaaaauacaagacaaaaauauaugguuccaagaaauauuagagaacaucaaauuugaagauuuuguuuccuagcugagaaauuaagaccaaagauuaaauaggcuugcucagagaaacacagccuaauuaacgacgaagcccuucugccuugcuuuucuuaaggaaaacaaacagaauacaauggggcucucagaucacuauaccaagaagagcaagugcuuguuauucagagcucuuggcauaaaaaagagauguauuaguuauaauacucacacuuauaguuaaagaccauauuuuaaauguauuagguaauauugcagaugacugcuaccauuucaguggaagcccauagagaaacagaucaauauuuuuaaucaugacauuuaagguauuaccaaagcaguaaguucauaaggcucacaauuagaaguaaaccaauuagucucuuuccuuucugccuacaccaaaagaucauauucuaaugaauguaaauauuuaauccuuuugaccuuucaucccuuaaauacucccacaugaaucugcaucggggaacuauaauauaauuauuauaagaagcaacaaacugcuucuuccuuuaugcagcccauacaaauacgugcacauuuuaagggcuuuucaaaagccaauguuauuaaauacuuuuaugcuuuaaaaagacaaacguucuugagcucaaauuucacuccauucacgagagcacaaguacaaagagaaauggcagaaacacuaaaaauauuucaauaauaugcauugacuuacauagcauuaguuauuuauagaaauucaaaauagaaggccagauuggcuuaauagcaccacaaaacuuaaacuacccuuggguuguuaaaacuguuuuuuuaaaguaaaacuucaaauaaaucaugccaacagcucauuaaauccuuauggucacacgcacugaaauggcaaaaaaugugaaccuaaaacauagacguggccgaaaauggaaaaauuaucuauuuaccuaaaauauacagcauuucagcuuaucgucauuucauaaaggaaaaaucaugucuuuaaaagcaauuuaauuuucacauauucaauuuaaaaaauguuucuuguuuucccaaauucauucuggcauuuaucuaauucuuagaauuuuauagauuagaugagacuggcauuaauauuuggcaaauacaaauuguggcacauaaaggcugacuugcgccaugccauauauuuggcuuuuggcaaaccugagucuccauuguacccaagagggcacacguaacacccugcuugguaucuacaccccacagccuccauuugguaggacaaggguuuuccaggagaaaucuggcaccaagaggcaacuauuucuaaaagaagggucaugaacacugcauugugucauagaaauuuagaaacaauaaaugcacuuuuacauaaguacaauuauuucaaauuggcauagcauuacuuaucaauuauuaccuauugugaugguuaguuuauucugugaaguuggucaggcauuaguaaccaguaauauaaucaaacacuaagcuaaguuguugcuuucuagacauuuuguagauauaguuaacauuuaaguaaagaagauuugccuugauaaugugagugggccucauugaaccagguagaaggccuuacaagcaaaaaccgaggucugcuggaaaagaagaaauucaagacuucagcauaacuccuacuugaguuuccagccugucagacuguccuauagaugguggacuugcuagucccacaacugcaugaaccaauuccuuaaaauacacacauauauaaccuauugguucucuuucucuggaaaacucagacuaaaauaacuaaagauuauauacacacacacacacacacacacacauuuuauauguaauauacauauauaauuauuuaucaagggguuagaaaaggccuuucugagcaaaugucuuaauuagcauuuacauaaugcuuucuaucuaucagucacugauuuacaugccuugccuauaugacaaucauuauuauucccauuuuacaggugauggaacugaggccuaugagacauuaaauacuuguccaacaccacacaguuaauaaauuauugagucagguuucaaauguaggcugucuaguuccguaaacuguacucuuaacgaauaugcuauaccgccuuaaaaugaauagcuuuaagaccugcuuuggagcauggcugagggcuuuggaugugaggaaugagggggcaaaaaagaauaaaguuuaacucuagcacuauugauuuaagcaacuggauuuuuagucccauuucugaauuggaaaaaaaaaugagagaggcuguauuugggcuauauuaaauagcaauaucuauggcuugggcccagaaguagaaauuauggaaugguugguauauacaguaaaaugauugacaaagaagaaaacaaagcucaguucagagcccugggacauucuaauaaauagaauuccaagaagauauggaaccagaaaaaagugggagggaaaggagguauuguagaagccaagagaaacaagaaaggggaugaaccagggaugcagggcgggagcucaacuuuaugugaugcaacugagagguuaaguaaagauuuagggaaagaaacauccagguuuaacgaagaguugaacccaaugacucaaagcagagcaagcuuggugagccugagaaccagagaaaaaguaugggagaaaaagugaccauucauaagcaucaauuuuauuuuauuuauuauuauuauuaucuuugagauggagucacucuugucacccaggcuggagugcaguggcacgaucuugguucacugcaaccuccgccucccagguucaagcaauccuccugccccagccucucuaguagcugggauuacagacgcgcaucaucgugccuggcuaauuuuuuguauuuuuaguagaaacgggguuucuccacguuggccaggcuggucucguggcuuuucauucauuuuuaacuguggcaacaaaagaguaggcauacagugucaagcauuaugauuuuuaguuuaagaugagguaauucagccucugcauuucuuucuguuuaccacuuucuaaugauuaaugugucugcuuagcuccacaaugcuggguugacaucuccauaauuuauuguaagaucugauuuuuccagauugccuauauaucacuucaaagagcuggucaucugagaccuuuuauuaacaugcaccuaacaagauucagcaugguuuaaccuugaccuguuuguuuucuuuucaaaagcagacucauggaaucaaccuggguacugaucaacaguggauuggauauagaaaaugugguaccuaaacaauagcaaauacuacaaagccauaaaaaagaaugaaauuauguccuuugcagcaacaugaaugcagcuggagaccauuauccuaagugaauuaaugcaggaacaggaaaccaaauuucacauguucucacuuguaagugggagcuaaacauugcauacugauggacauaaagauggugacaauagacacuggagauuacuagaagaggaaaggaaggagggggcaagagcugaaaaacuaacuuggguacuaggcucaguuaccugggugacgggguuaauuguaucccaaaucucagcaccacacaauauaaccagguaacaaaccugugaaggcacuccccaaaucugaaauaaaucuugaaauuauuauuauuuuuguuuuaaaaaaagaagagucacaucuagaagcacgcuugcccagccuugguuucugagagguccagaguuaaugaagacugccugguuugcaucaagucacugacaucagaauuagaacacaucagugaaucagcuucgucuucaacaaucuuaucugguuuuuauucaagauguuuauaucgaaugcauuuuugauugaauuacagaccuagcuuuuagagagaaaaugcuugauaaccagguuucuuuaucuuuauguguuaacguagaguauuuuaugcacaaaucaaacauuuuguuuaaggaauuuuccuuaaaacaaagugaauuacaugaaauggagauaguuucaugaucuaucggaaagaucauuuuaugauuaaaaauacaauuuugucauuaacuuuacaacugaugugucagaaagcuuaagagcccaaucuguuguccaguuguagcaagaauaacaaugacguuagcaauaaagacaacguccaccagguuuuucaagucugaggugugcuaggucuguugcuaaguacuuuacaugcauccuaucaucugcucugcauagcaaugcuggaaugaauguaagaugagccccaaugaacucaugaacacacuggcacagagugaguaaauaauuuucccaggucgcacagcgcaggcaccauaaaaacuacaguuggaauuugaaccuggacucuacugcaaagcaagccccacccauugagccaccuguggcuguguucucggguggacagguuugcacaggaugcauaggcccuaauguauaugugcauuagucacuucccugacucuucuugagucuucgaccauauuugucuuuucucuuuuccauggauuucuuauucucuuucuguauuuuguauauccuugcaugccucuuuaaauguuuucugugaaacacaagaaugguuuuacuuagacugguaaguuuagacuucaaaaaaggguauuaaaagaaacaguccugaauuggcaaucuucuaaacuagauuucugauucuuauucauacagauguauaauuuaccauucuuugcaagucagcuuaaaaauaagaauaguucggcacucacacuguguuuguucuugccauuuuugcuaagcauaucaacagaaagguuugugauuaugguuuuuuuauuauuaugcucugcucaguuaauaaucuauaaauauugguuuauuaauugugacaaauaaguguagaguauauguaauuuucuguacuaucuuugcgaauuuuccauaagucuaaaauuauucuaaguuuauuuuagaaaauggaacaagauuaggugaugccauauaaauagauguuuucaaaucagcagaguaaauauguaggguugugauuacugaguuauaaggcaauuaaaucuguuuaguuuuauuuuagaaacugccaaacuguccuucaaaguggcuauaucauauugcaucugaaugaaugagaucuccuguugcuccacauaucaccaacaguuuguauugucaguuuuggagauuuuagugauucuaguaaggauauuaaaaucucauuguuguuuaauuugcauuuccccaaucacaaaugauggugaacauugcuucuuaugcuuauuugccaucugcaugucuuccuuggugagguaucuguucagggcuuucacccauuuuuauguugaguuacugguuaucuugugcaauuuuaagaguucuuuguauauuauggauauaagucuuucaucaaauauguaauuuaccaguuuuuucuugcaguuuauggcuuguuuauauucucuuaguauuauguuucucagugccaaaguuucuaguuuuaauaugaaauucaaauuaucaauuuuuuucaugaaucaugcuuuugguuguuucauuuuuaaauugcacuuccauagccuauaaucaucacccuguuuaauauuuuacuuauuugucucaucucaaaauguaauauucuuauuagcagauaauguauguuuucuuuauuucauauucucagcacccaaaauagugccugugcauagaacucaaaaaauauuuguagaaguaaucaaugcacauggauaucaguaucagugucauauuauacaaguauggauaauacuucaaaugacaaacaggaugacuuugagagacuauauacaaaguuucuuacaaauggaguggcaaacaauaaaccauugcuauuguugcuguuauuuuugcugaaagaauauagcauuuucaaaagccaaggguuccagaaagagaggucaggugaaagaauaauaugccauuaucuuccaaugucuugcaauaaaagccacacaaagggcucugugcugaccugaaguacuccugggcccucagcuaaugcaaacuuuggcauacaaauauauuuuauuuaacaaaauaugcaacagaugaaccuauugcaaauguuaaaauuugcauuaagaugaauccuaaggguauaugacauuuucacguguaugcauuuuucaucauauuuucacauggaacuucuuuuugucuuuuugucauuguaugcaucucuagguuuuuugguauuuuuuaaacuucugauguuaaaccuucugagaauugauuucauuccuagauagcauacuuuuccauggcaaagagaccuaacuaauuaaaaugauguugauaacgauguauuaaacuuaggcuauuagugauucucaaacuuuagaagcauaagauuuacuuggggugcuaucuaguaauaaaauuuacagggucaccccagacauacugaaucuggaguuauggcuagacuuaucaagaugaauuuucauggacuccucccauacccacgcagggaauucugaaccagauggucugugaacuucacucugagaaacacuuguaaaaugaaguuucuauaaggaaggggaggagaagccacuggaaggacagugaguggcaguguauggccauaguggagcaccaucagaucucuagcucagcugcacucauagacucaagaacgacauccuccauuccaacuucaaggucugcccuugcuggaucuagcacacaugcacuuuauuacauuacucaaacuguaucauuugcucuugcuuugucacuuaggcugaaaugcaguggcucuaucauagcucaauguagccucaaacuccuaggcucaagcuauccuccugccucagucucuagaguagcugagaccacaggugugcaccaccaugcccagcucauuauuuuauuuuauuuuuuguagagaugggggucuugcuaucuugcccaggcugguuugaacuacuaaccucaagcaauccucccaccuuagcaucccaaagcacugggauuacagguaugagccacuguacccggcugugaauaguaucauuuuaaaaaguaauggaucuacacucagcagaguccaggcucaaugaagugagauccguagagggaagauacaugaguuaucuucccuucucuuaccuaggauuugccucuuguauccccauuuucuguccuagaauacucuucuuuccccaaagguauccuccuucaguggaaacauccccuccgcuccccauacaggagugaaaucuuacccuaagaccagcaagaacccauacuagaacaugguaacuaagguaccauccauacagaggcagucaggcagcagugaagagucagcgcacagcacagaaaggaagcccaauauccuaggagacucaaguauucaggguauaaggaguagaggcauaaagccagggauacuugagaaaaggacacacagaggaguaacagaauccugcccaccucccgcaacucuuguuuuuagagaggcugaccccugcggaaagugcugcaggagcgagaagaacaugcccaccauccccacacugugcugcuuuauguauuuauagggcaaaugaaggaggagggacagagcugugugacagagggagcuuccuggucagggaaguagucucugaccagcucucagccuaggaguucacacagcuggcaucaacugaaguuucuguuggguccucucauuccacuaacaccucaccaccaaagagggugagaagcagggaggcaccaggucauuaggaggcaagggcuuaugaccucucagauaugugaaggagaacuuucugucaugcucugucauguuuucucagucuugcucucugucuuagcccauuggucaucauuuacuuaauaaaugucgauugaauaaaaaugaaauagugaggccaggcacaguggcugaggccuguaaucacagcucuuugggaggccuaggugggcagaucacaagaucaggaguucgagaccagcuuggccaacauggugaaacccugucucuacuagaaauacaaaaauuagccaggcaugguagcacacuccuguaaucccagcuacuugggaggcugaggcaggagaauagcuugaacucaggagguggagguugcagugagccaagaugacgccgcugcacuccaaccugggugacagagcaagacuccaucucaaaaaaaaaaaaaaaaaaagagagaaaaagaaaagaaaauaguggaacuuguugauaucaccauaucacuucacauuugagguuaugucauaacaaagaaaauacugcaugagcagugaauggcuuggccaucacuuucauuuaggaaauggucccaugaagaagcuucuucuuucaucugcaccuccuugucacucugcuccauaagauuccccuuaguuuugaguuaggaccauguacaucucaucuacacgcuggccaaauacaccuugguggcauggucauaucuuagcuguuuggauuugucauugcucagacagacagugggcaaugugaaaaugcuguugucgaacgaaggcaggaaacauaagcaacugcuccauggcuuaagagaauguggagauauaauaacggggugacagaggagguguuuuaaggauucucuauaaguccuauggcauacaaccaaugcuguguuacaccauuaaauggauuugccuauugagaaaauuugagaaaggaugccuaucauucaaagcacagcuuucaaaucuauuucaaauugaauaagauuacugacuaccguaugugaacaccccauuuuuaacagaugcaguuacauaccauauaaaugaauuaaauaaaaaauucuuaggcaaauuaugccucauaaaaauuggccuuuucagcagcauccaugaaaggaguaaucgucagcuguauucaguaaauuaaaucccuuaaaaauguacgggagauccacacagauggcaguaacagacaaaaaauagaaaaacaucuccaauaguggucaaguaucagcuauccaugguccauuaaaaacaccucugucuuuguucaaaauaaucgagaucauuucaucuaaucugcuuuugcucuuacuuuuuccacaaaacauuuuugggauuaucucuccucccuaccugcuuucuagauaaagaaauuuccucucugcaucacuucaugcaacccugaacugucuuucuuuguauuauaauuauggcuccuucucuucauauauacccugauacuucuuuuuugggcuggaaacaauaagcaagcaggcaaacaguuguaauuuugugcuugccuuuaaugucuccccauugcuccucuccauuucucuccuuccauucugugacgaucuucuaaugcaugccugaagugcucacuaugugcagacauugugucaggcuccagagauacacaaaauaauaacaaaggggcccuuaguugaguaccagacuaugagaggcaaaaagaaauaccuucaauauguauugcaaugauaaccaaaagagagucuaguuagcauuccuaccuacaucaauuauuucaacaucuuuucuguuccuucaggauggauucuuucuuuucauuuagcuauugcccuuguggcuuccugaaaaugcacuuuugaauauaauuaaugacaccugucuagcuaaauccaaagcauuuucucauuauucauucuccacaaucucugaacacucugauaugacuacaacaacauucuagagucuagagugaucacuaucuccuuuaagaaacauccuauucccuuggauuuuaggauucuuuguucgcuggauauuuuucaggggauugcuuucccuaauuuaguucuacuucauuuucuaauacuaguuuguucuuucuuccaaaacuauaccuucaucccucuguucuccucucucuauuggcaaguacuuccaaauuucucuauuucaccauggcauuguccuucugccaggugguccuccccauucaucuauguuuaaaaucaaacccguacacucuccccugccccugucacuccuaaagacuucccaauuaauuagccuagggccaaaaauguagaacaaauuuuggcucuuaucuccccuucaguaaguugaaaaagauuuuauucuuuuuuuguaaugccugcaacuuuuagcuucuuucuguucccauuaccaccuccucaauccuggacccucaaaguaguacuauauuuuguuucauuucccuugauauuaugaucacaccuaaccaaucugucuggguccaguuuuucucuaauuuagucagguuuucaugaaguugccauauuaaucuuucuaaaauaucauuuaagugaguagaagccagccagguagauagcuucuguccuccuucccucucucccuuccuuucaucauguugucuauacuuuucccuaucuggaucuguucuaucaucuuaucauauuuccuucuuucuuucuuuuuuuuuuuuuuuuuuuuuugagauggagucucuccaucacccaggcuggaguacaguggcacaaucuugccucacugcaaccuccgccucccagguucaagugauucuacugccucagccucccgccuaucuggagcuacaggcaugagccaccacacccugcuaauuauuuugaauuuuuaguagagacgggguuucacuauguuggucaggcuagucucaaacuccagaccucaaaugaucugccugccucggccucccaaagugcugggauuacaggcaugugccacccugcccagccaucuuauauuucuaacuguaccugaauaugaaacauuucaucaaaucagggcuucuuuauccaaccuccaauuauuagugccauucuuuuuuaugccuuugaaaauuagauacagccugaaauucuuaucccaccaaucuuaaaccugcaauucuugucccacuggucuucgaaaauuuuuaaucaaugaucacauuaaauauuaccuccuucuuguuaauuucagcuauguaucuuuuuuuccacaacuccugaaauauuuaacugcccuauacauuugacugcccaguauauacuuaacacauauuccuguguaccugcagaaugucaggcuggguaacacaucauuuagcauaggauauaucuauccauaauauuuuaauauagaauaucaaguuguuucuccuagguaagucuuaucuaccucuuuuuuuuuuuuugagacagagucucacucugucauccaggcuggagugcaguggcaagaucuugguucacugcaaccuccaccuccuggguucaagugauucuccugccucagccuccccaaguagcugggacuacaggugccugccacaaccccugguugugguucuucugcccagccugcugccaccagacuucucuuucacuguguuagccaggauggucuuaaucuccuaaccucgugaucugcccgccuuggccucccaaagugcugggauuauaggcgcaagucgccacgcccggcccuuaccuaccuacuucuaaguaaacaauaagcucauaaaccuuguauaaugacugccuguuaucagcugccaaaugugaaacacuaaauaacuaccauggauugauaaguaaucuaagcagggcugauaagcaagaaagggauuaguccacuucuucucaaauuggcuguaaaaugaaaucaccugaggagcuauaaacaucuugaagccuggguccaacugcagagauucugauuuaauugaagaggggugaggccuggacauaaagauuucaagaucuucccaggugauucuaguauucacuaaaguuugagaaccccucaauuagugcauagucaaaaaaaaguuuucagucuagaaaaaucuucgugguaaacacugaaaacguucuggaauuccccgauuuaagcuuuccuugguccagagcuucaauaugaagaaaugauuggaauaacuccuuugcauuccuuguuuucaagaagcuuuucugugaaugguucaccagcugcacaucuauccacucauaguuugcggacaccacgugcaacuaccaccaacuguaagccauaccgagcuacucaaucuucuucaugaagacuauuagaugcugauucagcucucuagcauccugcuuggaaaggccgggacuugcucacuaaucaaaagguaguacacauugcuauagguaguacacauugauuuaauaaauuauaauuaauaaaucuacucugacaucuauagaacauuuagcguuuuuuuaauccccugugacuucauuuaguaaaacaauucauuuagguagacacaauaauuguauuuguaaaauggagaaacugaagcuaaaagugguuaagugacuuagcuuuucagcuaguuauuuguaaaaguuagauuagaaguuggauaucuuagccaaacugccaaugcuuuccugauuucacaagacuccuuccugaauaucaccuaccaugugcuuagaggaccaugccgagugccucaggagaagaaagaaauacauaaaucucauuguuccuauucugauacgguuuaaacuuacauuaggaagauaauaugcauauaucacaugacuuuagucauaagugaacagauaggaagggagaaacacacacaccaaacuagauauccuaucuuucccaaagucuaaaacaucagaguucuaaguuuugaauacaauaucucuuuuaggcaauuuauuuuuguuacuucuuuuaaauauaaaugcuaucauaagccuacuguauauaaacacaccugagagcaaaaacuuacgcauacuccgagaaugaccccauacggcagaugcaucugaaugugucugcugagcuagggaaucugggaguggcccaccuagagauucauuccuugucuaugaguaacaucugagcccccagcccagcccauggaacaugggguguagaggggauggaggcaccguuuuggguugaaugaagguugccaggugaaaguuguuagguaaauggugauacgugaaaguacuauaugaacugcaugccuuucacaaaugguuaugguucuucugccagccugcugccacuagacuucucccccguagguaagccccccaguaaaacuccaugucucauuugcuggcucugggucucuucuuuggccccgugauccuggcgucauccccaucagaguccauagggguucagcacaacaccuacuccaguauuuuuuuacagauauagggaaaucuucuacuggaauauucuagaguaaaaauauagucaccacucauacugaaaacuuuuagagaucuggcaugcagccagguuuaaaagauauauauauauauauuuaaugauaaagaaauucaaauaacacuguuuagccauaugaaauacaauaacauaguuaaauagauaauucuauaaucuugacagaugggguaauuauaaugaauguugugaaacuucaaaagaaaaacaaaacaguucuauauuaaaaaucugaaaauggacauguacaauaugaaaacuggcauuuacuuaugcugaaaacaaaaagugacaauacuuuuuaauaaaaacaaaaacaaugcaauaguaaaacuaacagauuucauucccacaacauaucauuuaauaaauaagucauguauggaugcuggagguaguuuaaaagagguuauuguuuucuaaaugucaguguguccauaauuucugaauaucaucuugcauauuggaaaacagauuucuaugauagaaggaaagauacuguguuuuaaaguuuccauuaacuaaauaucuugccccauuccauauuccuuccccacaagcucuuuucucucuaccucucucucugaaaaucaaugcaggcucucauugguaaauaaaauuuggguaaugggcaaacaggaaaaucagcuaaagccagauaagcuaaggggauuacauaaugacgagcugugcuagagaauggaaagaauggagauaagagcuucugggcaucaaauucaaacaagagacugaggaccuugcugucagugaggaggugcaccacucacaccugagaggcaugugcaguguauggaaaagauugcagaaugaaaaauaacaaagcaaauuuuaaaugcuuuuacccauuuuuuggguuauuuugcauacuauaguaaugcuucuuugaauuugacacuguucaagagaaggagcacguggcauuugaguuuuauacagguuacacguagacaacauuucugauauagaauuguuuuguaagaagaaaucgauaauauaaaaagaaaacuugaaauauccccuagaaguucaaccauuguuagcuguguuaaauuagcaucuguagaaauuuguuacuccaauacuccuaggauagucuggccaagaacuguguuguuuauuguauuauauccacgagaacacaauuucauguaagcuucaagaaaaugaaaacguuaguuucuacagaaugugugaaaacuaacuuguaaugacaaaagaauucuuaagagguuuuggagaaacuaaagggaaaaauuuauuaucauagaagacaaauguuuuaaaaggaggcccggggccaaucaaaccacucucuacuaugaauaccuuugcuaucuucagugcaaagaugguuucauggauguauacauuugucaaaauuuaucauauuguaaauuuuaagugcauacaguuuauuauauggcagucaaccuaaaaaacccacaacaaaagaaaaaaauaaaacaacuauccaggcuauagaugcaugaaaacaaacaagcguccaucugcaauucagaaggaauaucaguuuucgaaugcaccugaaaacuuagauuuggcacugccaaaacacauacacaaauauacucuucacaauagauaaaauguggcacauuuaacguugcaaauuaaaguaauaauuuaaguuaguauaauagagaugaaauuaauuuuuaggaggaaggagaggaugaggaagaacagggcagaaggggaacaguauuuguuaguguggaaggaggguugguguuuccagguacuaaauauccagcugugaauugauacagugguagguuugcaagaagaauuggaagagaccauucauucaccucuuaauucaauaauucaacaaauauuuaaugaguacuaagcauugaaaaucaaugauuagcaaaagagacauggucuggucucugccuuuauuaauuuauaguauggcaugaaagacagucaccucacaaauacuuaauuauccugugaaaaguaacaaggaaagaacccauuaaaaaguaugacaggaguuucagauaaaguuucccugagaagguauuccuugagcugggaaguguagaaaugugugaaagaggcagcauauauaaaggcccuggggcaugaaaacauagugcuuuuaaauaacuaagacaggaagugguccauuaaacagauauauaggagguaagaucuaggaaacuuuacaauagacuauauuuggaaggaaagggaaguaacaagaauggcacuaagauuuaugcaacgugcaacucaauagacaugcauugcauucuucaaggcagaaaaugcaggagagagaccaagcuugggaguaggugucuguucugauuucaugguccuuagaacuuucaacuacaaugcugcauaggacuacaccaaaauuuaaaaauucucugugucaaaggucacaauagagugaaaaggcaaccuacagaaugggagaaaauauuugccaaucacugucugauaagaugcuaauauccagacuauauaaagaacuccuauaacuuaacaacagcaacaaaaccaaacaacuugauucagaaaugggcaaaagacuggaaauauuucuccgaaaaaaauagucaaaugccuaggaagcauauaaaaaguucuucgacauaaguaaucauuaggaaaauauaaaucaaaucuacaaugagauaucaccucacaacaauuaugaugauacaauucacaaaauaaaacaaguguuggugaggauuuggagaaacuggaaccgcugugcaccauuaguaggagugcacuacuauggaaauggugcagccacuauggaaaacagcaugcaggcucugaaaaauuaaaaauauaauuaucauaugauccaguaauaccaccucugagucuauauccaaaagaacugaaagcagggcauuaaagagauaucuuuaccucuauguucauagcagcauuauucccaggagccaaaaaguggaagcaacccaaacauccgugaauggaugaauguauaaacaaaaugugguauauacauacgauggaauucugaaacaugccacaacauguaugaaccuugaagacauuaugcuaagugaaauaagccagucaaaaaaagacuaauauguaugauuccacuuauaugagguauuuagagcagucaaauucauagaaaaagaaaguagaauggugauugccagaggcuucagggaggaggauaugggaaauaguuuaauggguauagaguuucaguuugcaagaugaaacaguuauggagauugcuugcucaacgauaugaauaucguuaacaguauugaacuguacacuuacaaguaguuaagacuuuuuucuuuuuauuuuauuuuuuuuuuuuaagagauggagucucacucugucacccaggcuggagugcagcggcgcgaucuuggcucacugcaaccuccgccucccggguucuagcaauucuccugucucagcccccugaguggcugggacuacaggcgcacgcugccaugcccggcuaauuuuuuguauuuuaguagagacaggguuucaccguguugcccaggcuggucuugaacuccugagcucaggcaauccacccgccuuggccucucaaagugcuaggaauacaggugugagccaccgcacccggccguaguuagaacuuuauguuguauauuuuauacagaucaaaauuuuaaaaugcuaaaucaacaguauuauagcuagcuagcuagagagguagcugauuuauuaaugaguggcuagcuugcuacauuugugaggaaaucuaugaacugaaaacaugaauuugagacuugcagaaaaauaagaauaauucucuuauaauacuuuacauucuucucccccuucauccauagaaaccugauuuuacauugacucuauaaacguuaggucuucccaucccauucucccuaaagccugaguuugacacaaagucuguuuacauugaccaagaagaaacaucuugaagauuugacguaacagcagacauggaguguuuguagcuguaccauacugcaacaaugaaaauaucucuauguaccacauccagcaaacauuaaaaaugacaaguguagauagaaaggaaaaaaacguaagacuucuucuuugaguaaauauccauugauucuaaagaaaaagccauuguuugcacaucaguauagauccgccuugaacaauaauaucauucugccuaccuuguuugcgcacauccucuacagcagccaccaacucuucuuugagaucuugacucuccuuagcgaucuguucacccuuuuccaggaaauucugaguggcuugcucuacagaggcagcuaguacaugggcuuucuuugaccucccuuucuuuuuaccagaugggccuuuguugcuuguguugacaaguguagucaccuuaaauauaaaagagaaacuguaaaacuucuuugcaaaacugucuagaaaugucauguuaucucauaauuucuaaaucuccguguuuauuaaaucaugggauuucaauacuaaaucaugaaugcacaucacuuagccuccucacauaaccuuaucaaggaaagugugaaauuauguggauuaucauacaaauaaaugguuaucauuuauuuccuguggaaaaacaaaagcacaugaauaaccagaaauagcauacuugccagugggucaaagcuucaaguucacucacuuuuacagacugacagguacagugcuccuuggaguacccagccucaggguggcaaggaagcaaagcaaauauggaaguaccucugaguauugagcuaggagaaccaacauccagugcugagcccuguaagucagggcagagaugaaugagcaauuaauaaauaaugaguagccaacacccgguacuuauguguuauuuuccaaggacuuucgaagaccuuugcuauuuagaauuuuaucuuauacaaauaaaaugguaaauuucugccaggcgugguggcucacaccuguaaucccaacacuuugggaggcugaggcaggcagaucgccugaggucaggaguucgagaccagccuggccaacauggugaaaccucaucuauacuaaaaauacaaaaauuagcugggccugguggcaggugccuacaaucgcagcuacuugggaggcugaggcaggagaaucgcuugaacucgggaggcagagguugcaguuaaucuagaucgugccauuguacucuagccugggugacaagagcaagacuucgucucaaaaaaaaaaaaaauaaauaaaauaaauaaaauggaaaauuuuaugugagggaaauaaaugauucagacucaauguuuaguuaaccagcuaaaguuucuagaaucauaauaagauuugaaucuauuauuacucuuuuucuaaguaucauaauuuggacaccuaucucaacugccaaacuucuuuuaacacuauaucuagagguauuuaauuugcuaaaaaggcuauuaauaucuuuugagcaacauguuaucuccuauaaacuucugaaccuuuauuuucuaccagugagaaguuuggaggggaaaugaaugcaacuguuccauauucuguucaacaaaaguugccagucauguuuacugcuguauuuuuuuuuuaucggcuucacaagaauguagguucugugguuuauuuucguugauauuuauccugguuagcagacuaaagauguuauuggagguuauuaagaaagccagucuacaaaaaaguuccaaaugcaguuagcuucugagguuuacuccaaaucccagagcaaucaaagcgaugacucaaagucacaauuaauauccggucaguuuauagagaaagagauaacacugaaagaaaaaaaggauugaauaaauguaaacuaagaugauguguauagauagaaccaauacuuaagaggugauuagugcaggguugggagcuguuuuauucggcucucuuuugauugcuaaauaauuagguagagugaauuuaagaaagauucuauaaggccauuuaaguacaaacacuagccaaaaaaauggcaaaaucauuaacuauaagaauaucagauaauagugguuuagcuguaaaauguguaugcgaugaggaacacguuguaaucuuuucagugccacccaugugaggcaaccauuaaaaaaagaaagacagcuugucacaaagauugcuuuucugaggugcagaagcauucuccuuaaugaggauuuacucuaacacaugaacauguuacucuuccaagaaccucaacuccccagaacagccaauaccuggaaacaagcacauaaguccccuaagcaaacacagcaaccaucucuaccaucugcauuuaggccaggcuccuuuuaucagaggaaaauacucccuauucucacugagaugugauuuauuuucacuuuaugcauaauucuaagauguuucauaaucuauuuuuuuuuagacuucacaaauuaaaaaaaaauaggguggagaggagcuauuaauuuuagauaaauugacauuucaaaggaguagaagcugguagugacuaccaaaauugcuacacgacuauaauguggguucauuuucuggaggggccgacacauuucuagccuucuguaugucauggugcauuacugcauuaggcacaguuuuggugaugcaaauaauagcaagccaguagaaaaugucaguuuugugggggggaagaaaaacauggaacauuaccaggaaguuccuaagaaaaaugugauuacuuucagaagaagcaaaucaauccucauuuaguaaaagcucucauguacucauggguggaagagcacaaagggaagaaagggaaaagagacaaauggaaagaaagggaugggcuuccauaaaggcucaugucauaaucagcucggaauaaacaauugucaaugcuuuucacugcuauucaguguuuuauuggaggacaaacuauuaaauuagauaagaaaaauaaagaagauauauaaguauuagaaaaguaaacauuaaauuacaucuuauagagaauaugauucuuaagaaaauaaaaaagaauugaaagacaaacaaguccaacuacuacaagagugaagagcaagguggcuaaauacaacauaaacaauaaaaaccuaaaggaagagcaguaacaaaggagaaaugugguuuuaaauaugccauucacaaucagcauacauuuauaugaucagaaauaaccauaacauaccauguagaauguuucaugggggaaaaugauaacauuuuagugaagaacauaaaagaagaccuacauaauagagagacaucccgcauucuuggaugggaagacucaagauugaaaagaugucauuucugcccaguuuauucuacaauuagcauucgagauauuuacacaguaaauaagcaagaaagucucucacucggaucaguucucuuuuuacuguaaacuuaaaauauccucucauucaguucgguucucuuuuuaccauaaacuuaauaaacuuuucaguaaauuagagacagauuauuuaagauuagcauaugcaggacucuugcugcccacuucuggccaauauaucaaauguuuaaauggaagcagcaaaaguaguuuagcuccauuaguaggugaaaaaguugggucuaucuuuuuaaacuaaccacucuugggaauucucagccuagcccuugcuaugcaaauucacugauuuauucccacuccuuccccugaguugccgugcccguucucuugccacccuaugacaaugcaugccacuccacacuacugcacauuuuccuuuucucccaccugaagugucauuuuuucccaucauguuacaggcuuuuauucuucuugagcuaugccuauauuuacaccuaaaauucugaaaguucauauucaucuacuucaguucuaucuuguuauuucacggguagggaaacccagcuuagagaaguuaccauacguuaaaaaaaaaaacuucuucaaauucacaugacucgagagagacaaaaggcugaauuguuguugugcucuaugcuguaucuuuggaaccugagaacucaccagucuccucuugcuuuucuuucuaacaaugagaggcugcuaaacgacaaaauaaucuuaaaauguauuuauucucuacauuugucucacuacauuuuuuguguccuauugguugucuuuucauucaaaggcauuauuuauauauaugaauauauguuuauaaauguuagugaaauguuaaccaacuauuuuauccuaucuuccugcaaugcccuguaauaucugauguauucaagagucucagucuagaaaaugcauauuagggcuuuuugugucagcugaaagcaaaagaaggacaaaaguauuucaaaaaucuuauaacuaaccaaauaggagaucuuaggguuccuauguaacaaugcucuucuauggguaaagaauaauaagaaaauuuguugcuuaaaaaagaacaagaucauguccuuugcaggaucauggauggagcuagaggacauuauccuuagcaaacaaaaucgaauacugcauguucucacuuacaagugggagcuaaaugauucagacacauggacacaaagaugggaacaacacacacuggggccuaucagaggguagagguugggaggagggagagaaucaggaaaaauaauuaauaagcauuagguuaaauaccugggugacaaaauaaucuguaccacaaacccccuucacgcaaguuuaccuauauaacaaaccugcacauguaccucugaacuuaaaauaaaaguuaaauuaaaaaaagaaauuuauugcucagucaugaagaaccaagauauacuaaagaucaguaaucaaagauuuuuagugaagaaaaugacuaccuugucccauggauccaccuacuaccucucaagucaguuagugaguaucagaauuaugaauucuaaugaauagugcagucaccuuuugcauaacuggaugccuuagagaagucagagcagcaggaacacauuuugaucuaaaggugggagccacaagguggcccaauugcuggaauugcagguaucugugcguaaguuugauauccagacugacacuaggucuugguagaugguacuuauagacuuuuuaagugucugaugcagcuuguuggcagucuuguaagaaauggcuuauucuggacuucaccacuacacaauauauccauguaacaaaacugcacuuguacccccuaaaucuguauuuuaaaaaaggcaaauaucagcaugcuuucuuaaacauucaucauaagcuguuuucuuucagugaaugaaagagcuugacagagaaaaacuuuuguaaacagacauugagaauauguuacuagaacaugggcccuaugaggacaaguagagaaauccagaaauaaaaggcaaauguaagcauacuuucuuuaagauacaucauaagcuguuuucuuucagugaauggaagaguuugacagagaaaccccuuuguaagcaaacacugagaauauguuauuaaaacauguuucugucucaaaacaaauguuucauucuauggaaauccuugguugaauguuaggccucccucugccccaaccagggauucucucuaauucccacucucaacuuccacucaaggcaaggaucacucaagauccacacauucuucuuuccuauccauuuguaaagcaguaggggaaaaaauggaaaaaaaagaaaaaaaaaaaaaacagcaaagucccugcaacaaaaacugguaguaauagcaugaauauugacauauguaaagauggagcugauguuuuccaaggcaguaaggaaaucagucuuaauugagaauaaagcuaaccuauaaauuauuuggaaaguaagguuagauagauguaauggaacaaaacuuugcaaggcuuugaaagccaaguuaagaaauucagauuucauuagucacugccaauuuuuuaaaaaagaaaagcauagguucaaaauguccguuucucuuuccauucauuucucagcccagugaaauuugcuuuaauccucucaccuccuguagcagaguccucuuguuaguuaacagguugcuaaaaucaaaucauuuuuaucuuauaauaccauucuaccacauuuagugccguugacucaauuccacuuccuccuggaaauaucuccugguuaauuuucuuagcaauaaucauuuccuucucuaaacucauacagcuuuaaaaggaacauacauuaccguccaccaaacucacuuauuucuguacccaucuuuaucucuaucccuccuccaacaggaaaagccugcuacuaccaucaccccuuuaacuaauuuccuaaucacauccuccagaacuguuguauuagcugugccagcuuccugcuaaaucuucaacguccuccucucugcagacuuccuaaccacaaccuacaagaauacucaacuuugcucuagccccaccccaaauauuuccucaaucucucugccucuccuuaaagagaagaaauuccgcaggucacagguaagaguguaaguguucuaggguccuucgaccuuaaucuaauaauggucccaggaacacuggccaguggaaaacucagaaauagccagauaauaggcaccacuguuuucagauauguuaauggugugaugugaguauaaaacugagacccaggcuuguauagacugcucaugaccuaaaguccuaaaaguugaccuaccacuccugcacaauggcgguagugcaguggccaagaccauuucauucauuucucuuucuugcgauauguuguauuuuaagacaauuugucaacuugacugugucucuucuacuugaucaguacuccacuuuuaggcugcaaaagcucaacaggcaugaaauacuucuuucuccaaaauaauaggcaauagggcaucaaggcacuuugucuuggaaacuccauuacacugauuuugaaaugugagaaggaccugagacuugugacagagcaacucuguugcuuccugaaaccagcaacacuauaguuugucuaagccuuaccuauggggcagccagcugaaaaacuuuagcacacugauacuccaagugagcuauggagagcaucaguguuauauaggcuuguuagaaauguagaauuucaggacccaucccagaccuacuaauaguugauucauaugcacauuaaaauauaagaaacgcuaaaauuuggcacaauuauuuuccaacuauaucaucccuaacauuccccuagauuccuguaagaaggcaaauuucuggacccuacccacagagcuucugaucagguaagucugggcuuaggcauuuugcauucguugcauacaauuaagauuuguauggauaauaaacuucacuugcagaaacauuuaucuaggagucuagcugaagcgaaaaaaagugaaagacaaagcagugaccuuuuuuuuuuuuuuuugagacggagucucacuccguugcccaggcuggagagugguggcacaaucuuggcgcaccgcaaccucuaucuccugaguucaagcuauucuccugccucagccucccgaguagcugggauuacaggcacccgccaccaagcccagcuaauuuuuuguauuuuuaguagagacgggguuucgccauguuggccaggcuggucucaaacuccugaccucaggugauccgccugccucugccucccaaagagcugggauuacuggcaugagccaccgcacccggcagcagugacuuuuaacagguaaacccuuccucucauuuuaggugccaugauacaucaugauuccuuacaaacagcuuggugaaucaauucaccgucuuuuggugggaaagcaucuccucuauuauggaggcacgaggaacuugggaaagugagaguauacauauauaaacauggugaaauuguugagcucuccagaaaaacaccaguaaaggagaaccaagauaauuugggcauuguuuugcuagaugccuaaagacuugugcacuuugcagauacgaguacuaagcuuuugggaauucuacuguguugcucuaagguaguucaaucuucacgauuacucagcuaacacaagagaaggcuucaauugcugccacaaccuaaaagaauuaaaauuuaaaacaaguaaaaauuaaaauagaaauuccaaagcaagacauuuuuggggugaauguuugaagacaaaauuacaaaaaacacucuauuuauuccagcagcaacugaagauaaaugaaaauuuccugaaagaggaaaacuaguguaacuaacuugaaauaugaagaagcuaagucuucaacuaguaauauauuugauaauaccaagcuucuaaggagaaaucuucagucagguuuuaaugaccaguuaaaaauuaacugccaaguaauacaucaaaauguuguuuuucuuaaauuauucuuccuugaaccaccugauuuauuccuuuagcaaugauagaguaagugcaaauauggcuugugccuuuuccucauaaaauauauaaaaagauauacgcuuaccuucugguauacucuauuagaaguuauuuccuaaagcagaauacuugugagauuuaaagauauauguauguuguauguuguacacaucagagagaaaggcagaccaacaaaguuauacaaauucugacgcaaagggaggugacaauacagacuuauuucagcuucauuaaaaacuaagauaaaacuuucacagaaacuacuacaauagaaacuacuacaauaggaucucuuguugaaaggaucauuucucucaagcacaacuucacaccuuauuuuagauuaaaaaagaaguaaauaauaagaaccaaaguuacugaugcuuccacaguuucaaaagucagaaacaaugaucuuuuaaugaugcauuaaaaauuuauagaggaaaaaaccccagagaauuagucugucucuuugucuuugaaauuuccuccccguuaucugacaguaacugcauagaauucagaugcaugcccacugauacugagaccuggaagaccagcuuucugaaaccuugaagauaugguuuuaugauuuaauuaucuaagauaggacugaacuggcacuaauuaauuacugcuacaaagaaagccuauaauuaacguauuauacuuauuaauuauuguagacguacccucaacuuuuaaguaaggccaugaggcaagccuuguaacucaguugcuguggucuacauuuccugaagaauauaauagcaaguagaauucagaaauaacuccccaaauaaauaucuaugauugggugagauauuuuuauggccaauaugaauggccagucauacguauauuaaaauuuuucuaggcuaaaguuucuguggcuucaaguuauggaguagagcauuugggaacuggaucauccuuucauguugucggugagaugugauuugaacucauuuccuaggaaguguuucaguagugucuacgagccaagacaaaguacagcagccuuuucuucaugcaccuguucuucagaagaaacucaauuuucccuagagaauaucaacuaauauuuuuuccagucucuauuagggcacgauguuucauauuuaaauagcagcacagauaagcuccauuuuugguaaccuccagagaguaugguguagauuacugccauccaaaagcuuacaugagagaaacauuuaguuugcuuaaggauguucaguccaucucucucucaccaccuaguacaaaccaccaaccacucuacauuaaagcagauaagccaggagagaagaaguauuauaauggacacugguaaaaguguuucuacugacuuauugugauaccacuuaccucaaugggaggacacuacugcacaaagucauaggaugcucauuguguauucucuaagguuauugaugagauauuauuguugcucacauuacauaaauuuuuguucauuaccaaggaaauugauacuuccucuuagaaacugguuugauuuuacuuuaugauuuuaagcugcauaauaaauuaagauuuccuuuuccuuuuuguacugacuucaaaacaguuucacccaaauuuaugcucccuucaggaaggcauaugacguaaugaugauuauuaccaaauuagucucaauccuggcucuuauuugugcuacauucaucuugcuuucuuaaaagcauuuucccuuaagauguuuuaaucuuucugcacuuuauauauccuuaaaguuuccugaaaccuuugcuggaagacaguagaauacuuuguauuucauuaauucuaagguauacauuuuuaccacaguuuaacauauacaaaauaagaaugagucuuacaauuuaugucauuuuaaagauauauuugauagaacuuaauuuuucucuuagaguaucuaaaauauauaucuuacaguugauggcaucuuugauuugauaaaacacaauaaaccaagcaaugaaaagaaacaaacugguuuaaaggaucuauugccaaccuagguuauccuaaaaucuauacaacuuucaaugucuacacuuacagccauugaaaagugacacuaaaaauuaagacacuaaaauaaugccagauauucacugaagaaacaauugcuuagaaccagggauuuuaaauggguaagaaggcauuccucuuuuucaaauuccaaaauauuuuaaggaucagugcccaucucaggaaagcuguuuggaaugucccuagaaauuaaaaauucaauuccauugaugaaucacuauuuugcauuuacuaagguuaaaacaaaaugaaacaaaguaaagcuagacuguuccaagaaagaguagaaacaaaucugaaagcacaauagacacaaaauauuuuccaaucaauaguauguuaggcaaaggauucuguuuacccaaauucccauuaucccaacauucaucaucuuuuuauugcacucuuugauugacaugaacacgagguuugacauuuucuuucuuuaagguuaguggacuccagcacagggugcacauacucuauagggaguagucgauggugagaugcaggaaaaauaugaggacucuauauugauuuuugucuaaaaauauaaaacaauguauccugacuacuguuucauguaaggacuuacacuuguaccaccacccaucccuauguuagauggucacaugucacaugugauaaaugggguaucuugagggaaggguaaguucccacaaauucaggaauugcagggaugaacuuauacuuuaaugcgugccugguaaguggguuuaagucuuaaauuuucuaguuuucacacacacuugcacacacacacacaccuaugcacagaauggaacaggcuuuaaaagacuauaaacuggagauugaagauaguacuaaaaauacaagcauaaguaaacuauaagaaaacacauagcugacacugccuuuauucauaauacaagcucuuugucaacuaguuaugaggcugaaaaaacauauagucucaucagagcugagaaguuaaaauauguauuuacaucuauuauugcugacagugaaucucaucccaguguccuuaagauauuagcucaugaugguauaagcaauuaugacuugcaaaucuuuaaaaagaaaaaacaccagcaaauguagcuauuugagauauauuuguugauuuucauucuuagcaaaaagcaaacuuauuauauuuguaauuguuaguggagaagacugcugggugccaccagcgaacccgcuucuuuuuccuguggacacaaugugagacuauauuuuucacucucguuugaaguugaugcggucaauugacaaauucuagccaaugaaaugugagcaucagugagugcuguguguucuucucaaucuggcucauuaaaaucaaccuccauuuuguuuuuuguuuuuuguuuuuuguuuucucccaacuggcaaacauggaagccagguguuaaagacgaagaagccacagguagaaaggagccuaacuuccugaaguuucccuuggaggagagugaccuauggaucagaaagacccauuuagauauuauguaguaagaagaaaacuucuguuaagucucugagauuuuaaagauacucuauuacagcagcuaauauuaacuguaucaucguauacaguuaacaaauagaauguuguuuuuaaaaguguaugccauucuuuuaaaugucuacuuuuauguauauuguauaauguauguaauacauuauuaguucaggaauguaugcucauuuagaaaaauaaauaacacauacauucucuauuuguaugcauacagagacauauacaaacuuuuuguuguuuuacuguuuuauguuauuaugaaaauauuucuauuauaacauuuggcagauaaagcuuugcaugccagucucgugcuuuuuagguggcuuucacacacuuuuuucuaugaauugcuaggaacaaauucccauuuuuuauaugaaaaaauuuuaaaucgucaaguccuuguucuuauacaguucuagaaauccauucucuucacuuuucaaugaccugggaauaacucaauugccacuuguuggcaucucucagagcagaaaacaaacaacauggagacaaacaucacaaaucugaaguuuuucacgucagauuucaaacuuuuucuuaugguaaaaacccaacuacugacucuaaaaagaauuauugagaaugaaauuucaaacagucaguuaauggcuuuaguaaauuaugacacuaguauagacauuuuaaauaagcuuacaaaaacagguagauauagucgguauguauauaguccaauguauuuauaaauuuuuuuuaauguuacuugaggacuuuacaagcuuuuacucuuuuuaaugucauuuuaggagaaaaugagugauuucugcuaacugagaaacucugucugaauauuuauuuuugcucuuaaagagacaaacugcauuugaugguaaaaaaaaaaaacaaaaauaaaguuguagaauaaauauuuuccugccacuuucucaacuugagagcacauuaagggcuauugccaaaugcuuuaaagauaucucaaaugucugaucaucucccucaauacuuccagcccaaaugaaccucacggacaaccagccagauuuuccacucacuaaaauccuuaccaagccuccacuagcaaugaauuuucuauuucuauccacucacacgcaucucaauguauccuuuucuuuuggaugaaaaugauaagcaaaacccaacauguaagcgaacucacaucucucuagcacaaauaguucugguggguagccacaagcuaucacaucuccuugucuuuuauaccuguauggguuuugcagagggauuaucaaucaguuuuaauucaggauacagaaaaacacauuagucaguuucagaagucagaaaaaguuuuucagaaaacagauaucaaccacauuugguaaaacuguagaugacucgagaguacagggcucccugagaccacacuucaauaaacaagucuaaaucaucaaugaaaaaucaucaaaaucaucguugaaacacaggagauucaaguacuuuaucacuaugcccugucuauucuuacuucauuggcugaagcuaguauuuguuccuacuaaguauagcggguaaaggcaacaaucaaaaguaacacauuuugaaacaaagaaaauuucuaguaauguaaacaaacaaacaaacccauauuuugauaugggaaauuauagcuuaagugacacugaccuuaaaaaguaacaguguuugauauuaauuucuuuauucuucuuugauauuaguuuccuugauauuaauuucuuuuaaauuucuugaaagaaacauccaagcaggaaaguauggauauaaaccucauugcaucaaauaaaaaugauuuauucauuuuucucauuuuuuuuguaguaaccacuaaauuuguuuuuuauuuauuuauuuuuuggucucccuuugucucucucucuguagcaugaaaggaauucuagccuauauuuguguccuguguauguacguaugugaguacacucuaccuugaguuucaugguuuugucauaugacacauauuuuuaaaaauacuuuaucaaaucaugguaacuaugauaugcugaaaaugugaauuucaagcuacuuuuagaaauaaugaaaaggagcuuuagauucuuaauaagcucaaaaauuaauagcuggaauuaauacuaaaaugaaaaauauaaauaauccauuagcauuucuuggaauaaaaccaacaauacuagucuccuaugaagaaaauuauacuugaaagccacagggagauaaguuuaacacaagccuacuaaguucuaagaaaaaaaaaucucuccauuagcauauauaaaaacaguuuuuuccaaaaauuagaagcagaaaaaucucaacaaaaucucauccuucuauuguucauuaguuucuacucuagaauuaaaauaaaccaugauuaauaaugccaccuugcucuuugcuuaauagaauguuaaauacuaaguguucuccagguaugcucagcucauuacacauauagcacauguuugugagaacaaggaaauaaaaguauuaucccuauuacucagauaagaaaaucaaagcuuugagcaauuugccugccagaagucauaaagccuaucaaagaauaauaauucagguuuuaauuuguccgacacuugugguuuauuacccuaagauaaugaucagcacauauuugucucauuuuacauauaauacaaauuuuuaaaacuaaaaucaauugguuuuauggcaagacaacugauguggcugcauaauuuuauuacaguaugcaggacauacuccauuuuaaaaacauucccuuguuuuucaaagaaacaauuacaucauacacugacauuuucugauuuugauguguaaguguacauuauuauucuuccauuaaauuacaaacugcugguaaaaugccagugacaugaaaaaaggccacacugguauuuuacuguagggucaucuucauggauagaauagccagccuuccacuugaaugcacugccauauugucaagcugcauuccuuaagcaucacuucuuagaggccucaagcuucucgggaauguuugaugacuuaaaggggaaaugaacagguugcaauuaugcuugucaagguucuucuugugaaccuuuauuuggacaauucacacaaaaaaagaaagcagcucauuuucuaauucaggauauuauuucuuuuuaaaacugguauuagcauuucugaaauugcagaaugggcccuggauaauuaguauggaagcauucaauacugcagagugaaaugucagugagaggaagcagcacgggucaggggacagaaacaauacagaauuuggaacuucccauuucuuacuuaggugccaaaugauugaaucugagacucagcuucccauucugaaaagugaagacaauaauauacaccuuaaagggaugcugugaggcuuaaguaagacaguuuauuuaaggaacuuagcucuguagccaaaggaaugcuucaacaaauaauauugaacauacaaccacaaggggaaagggugccggacaugaggucagaauaauugaacuugagccccagaccagccacuuauucgcuguauaaaauugaguucaauuaaucucuuugggcuucauuuuugucagcuauaaauuaaaaauuauccuuaaguuacuucaaauuucuacauucuaugugcuaauaaaauaaaauucuugacuccugguucaugaugguaaguuuuauauagcaucacgcuaccugacuucaaacuauacuacaaggcuacaguaaccaaaacagcaugguacugguaccaaaacagagauauagaucaauggaacagaacagagcccucagaaaauaacgccgcauaucuacaacuaucugaucuuugacaaaccugagagaaacaagcaauggggaaaggauucccuauuuaauauauggugcugggaaaacuggcuagccauauggagaaagcugaaacuggaucccuuccuuacaccuuauacaaaaauuaauucaagauggauuaaagacuuaagcauuagaccuaaaaccacaaaaacccuauaagaaaaccuaggcauuaccauucaggacauaggcauggacaaggacuucaugucugaaacaccaaaagcaauggcaacaaaagccaaaauugacaaaugggaucuaauuaaacuaaagagcuucugcacagcaaaagaaacuaccaccagagugaacaggcaaccuacaaaaugggagacaauuuucgcaaucuacucaucugacaaagggcuauuauccagaaucuacaaugaacucaaauuuacaagaaaaaaacaaacaaccucaucaaaaagugggugaaggauaucaacagacacuucucaaaacaagacauuuaugcagccaaaagauacagugaaaaaaugcucaucaucacuggccaucagagaaaugcaaaucaaaaccacaaugagauaccaucucacaccaguuagaauggcgaucauuaaaaagucaggaaacaacaggugcuggagaggauguggagaaauaggaacacuuuuacacuguuggugggacuguaaacuaguucaaccauuguggaagucaguguggugauuccucagggaucuagaacuagaaauaccauuugacccagcaaucccauuacuggguauauacccaaaggauuacaaaucaugcugcuauaaagacacaugcacaaguauguuuacuguggcacuauucacaauagcaaagacuuggaaccaacccaaauguccaacaaugauagacuggauuaagaaaauguggcacauaaacaccauggaauacuaugcagccauaaaaaaugaugaguucauguccuuuguagggacauggaugaaacuggaaaucaucauucacaguaaacuaucgcaagaacaaaaaaccaaacacugcauauucucacucauaugugggaauugaacaaugagaacacauggacacaggaaggggaacaucacacucuggggaccguugugggguggggggaggggggagggauagcuuuaggagauauaccuaaugcuaaaugacgaguuaaugggugcaggacaccagcauggcacauguauacauauguaacuaaccugcacauugugcacagguacccuaaaacuuaaaguauaauaauaauaaaauaaaauaaaauaaaaaaagaaauaucugaaaucuguucucuguauccacugagauagacuaaaauaaaugggauaguauugauuuucaaugaauuuuuacgucaaaauuaagagggauucacaaaagaauaucagagaucuccuuuucugguaucuuuccaagucauuuagguggcuaagcugaagccauucugggguuuacagggaguccugcugaucugaggaccacugcugucuuucauccaaguauuugauggaauuccucaacacaugccaugcuuuucuucauauguacacuuucuuugguuuucauguguuuuuaacaagcuuucaaucugaauauauuuguauaguaccacuaaauuagcuuaauuacaaagucuaaucuuuuguuuuaagcaaugcauaauucccauguauuuucuuuacauuuuucauacagaaugugcaaaacaauuuuucaaauuaaagucauauuuuuagcaaugugcuagugauuuugagaagucuuggguuugcuaagcaaggaagucuaaggcagguguuuaauuggacuaauuaagcaacauguagucacuuccgguuuucauuugcuguuugugaaugcagauaagcaacacagugauugccuaauuagacuauuuaaaaccgacucacuuuuuauagccaaggaauuuuuuuaaccaacaauaacaaauccaaaaccuaauauguagucugaagucugauauauuuccucauguucuaaccaucauuuuauaaguaaaucaaucaaccuaacuaugccaauaggcagauagaaucucucuaccccauuuuaaaauauugccuuguuuuccaaagaaauaguuacaucauauacugaaauauuauuauuuugaucuguaaaguguacauuauuauucucccauuacaccagcggucccuaaccuuucuggcaccagggaccaguuucaugggcaacaauuuuuccaccgggggaaugugucggagggaggagggaugguuucaggaugaaacugcuccaccucagaucaucaggcauuuguuauuauaaggagcaugcaaccuagauccuucacaugugcaaaucacaauaggguucgugcugguaugagaaucuaaugcccccacugcucugacaggaggcggagcucaggugguaacgcucacuugcccaccacucaccuccugcugugggcuccuaacaggccacggacagguacugguccaugaccccgggguuggggacuucugcauuaaaccacaaacuacuuaaaacacaaacuauaauaguacaaaugaaauauaacauauauauuauauauacacauacauucauaucucuaucuaucuauugacugauggaccaaaagaaagcuguguagaugugaacaugaaauucaacagaaguccauuucaguguuuucuaauaacuaggauuacaccaaucuagugucaaagguuaaaauuugucuucuagaaaugaaaacagauuuagaaaaaggcuaugccuggugaauugcaaacugcuggcuaaauuuuauauggccgaugugccuaaauccaaauuagcucaaucucacacccuguauuuggacaucugcagaccuaaggucaccuggcagagggacaaaugcccagacagccggauucacaugcauuuccuuaguaagaucaguggacucucaucauucacucacuguguuucaauuacuuccuccuggacucauagaacagaugcuggaggcaggcagcaggagaaagagggauuauaaaugaucuauggaaaaaaucuaugggugguaaaguuuuuguagaaaggaacuggggagcaucuucaagguuuuaaggugcaugcacugacaauuuagaaagaaauaaaaaugugaagaaggauggaaaaagaggacaggaaaugacaagagacagucuuuuauaguaaggacaugauuagauuuuauugauccuugaaugaguauaguuaugagauccaaaaaaacucucagaacuuacccaaagccaagcuuuauguuaucccuuuaucauuaagauuugaauguuagaaagauguaagugaauauucaacagugucccuucuccaguaagcaaagaacacucuuggagcaugugcuuugugauggauuuuuugauaggcacuuacuaugcuuucucucaauuugcacaacugucuugaacaaugguauuaaccuaugucaaagaggggaaguaacauucaaugaauucuugcuuaaagucacauagaagucaguagcgcagccaggguuuguagccagauaugaguuucucuaccauaccaucugggccugaucaucuuuuauuuuauguuuaaauaucaaauagauuuuaacaauuuagacagagauguucuguuucaugauauaaacucagguagaaugaguauuuugguaagcuuaaucugaaagacauauaucaucauggaauugaaaucacaaacuuaauuacaaugaaagcuuauguagcucccucuauggaccuaaauucuacaaaauauaaaacauaugcaaugagagugcuggaccaaggcuuuucuacagcuccuacuugcugugacaugcuacaaguaguaugcuacuugcaggagaaaggcagaaagucaagagcaggguaaagaccagggaguaccgcagaguagacgugcugaugugcugcagacaagccucuaagucauaacucacucauuauuucuuuuuucuuuuccuuuuuuuuuuuuuuuuuuuuuugagguggagucuuggucugucgccccggcuggaaugcaguggcaugaucuuggcucacugcaagcuccgccucccagguucacgccauucuccugccucagccuccaaaguagcugggacuacaggcgcccacgaccacacccagcuaauuuuuuguauuuuuaguagagacaggguuucaccguguuagccaggauggucuugaucuccugaccuccugaugcgaccgccucagccucccaaaguacugggguuacaggcgugagccaccgcgccagcccauuauuucuuuaaaguggcgcuagcauugaacaugaacaucuugaguggcuaauacugaguccacucaaucccuuuauuaucugagaacagcagaccauccuccuguuguucaugaagguuccuagagaaaccaccaacuaaagcaaaaauuaaaugaacacaucuccuggaaugcacagagcaucaaacccuaacacgcauuuuggggucuucuuguagggaacuucuugcaguuucuuuguuuuguuuuguauuguuuuuuucccaaaggugucacuugucacaauaugaacaagcauacuagaccaaacccagagccaaaagaagaaaauggaaaaaaaccugaaggaaaccaacuggagaaggaaguuaaggccaccagaagcuauuaggcacuaugaugcuccacauuuggcuggugaaaccagcuucucaagugucaacaucaguaacauccaacgaggcaguccagaacugagauggugguugaggaauuccagacugcugauacuguagacaaaacaguuggugcugaagucaugaugagucagagcaauaugugcaucagacgcaagaccaaggcaguagcugagggaucuagaggcaggauucaaguuuucucauccaggcaggaaaagacacaggcaggaaugcaacuggccuucaggccucauucccuuaggaauuaguauagagacaaacuucagcacuaauagaaaagaugcagggaaaaugaaucaaaagaucaguucuaaaaaucgaaccauuagagcgggggguggggagaaaugcuagaacucacauauauucauuuccuggacagaaaguaccauauguaugaucagcaagacucaguucccuaaucuauaagguagagcucauguuucagaaugcuuacugauucgauuaugcuuaagauucuauuaugacugaucugaaagcuacauggggauucugccuuuaauccauccaagaucuuccuguuauaaacaggccuagacuucugcauagaaccagaguauaugcagauguagcucaugaagagguagucgguugaugaguggcauagcugucuucugaguucaaagaaagaguaagauauuaacauccuaacauguaucaagcauguuuuaacucccaauagcuacacugauaccaguagggaaaagcaauuuacauuuggaaaugccucuucauaaacaaugcaacugaaaaguuccucuucacaaaugagaaaguauugccaaagaaaauaguagauuuuuuagagaucccuggucuaaaccuuuuaauuuuucucuaaagccauccauuuucuccaggaccaauaggacuugugcaggaguagugagaugaacuacgcaggucuauaggggguaggaaagacacucaccuaacugcuuguuucuuaggcagaaaacuuuucuuauggaaauacuaaagcaaaacuuaaaaaaauaaaguauuuuuauaaaucuugcaauauuuucucuuacucuuucgcuuucuuauuucaccauauuuacuuaccuucauuuugcuuuauaugaaauauaaucuccuucaaaauaaaaauaaaaaggugguucacuuuuguagaaaugcuaaagauccuaaaguaaaacacagcauagcaauccaaaauaacacaacucucaacuacauaaucaugaucugucacaaccuggauguuuacauuuagaaacugauuuugcagucauuaauaaauauuuauugaucaccuacuuugccuguggaccaauuaggacacaggcaaugacucuacucaggugaacaaaacagacauaguucauguccuuguagcaauuccgucuaguggugggggcaaaaacauuaaagaaguaaacuguaauaaauaaguuacacaaaucugaaccagugagauaaaggaaaaaguguacugugagacagaauagaagagaggagggcucuuuuaaacagguggucaggaaagacuucaggaguuggguuagauaaucuccgauaucagagauccugugagaucugucagaagcauuauauauuacuaaaguaauugcuaaccacucuagaccccagguuaacacuuccucuaaucaccuguucauguuaacugaacguacauuucugugagcaaguucaucccuuccuuagauucuuuuccuccaacaaaacaaauccaaccaaggcugccacaucagacaauacaauuaagcccauuucacccccucacacuuuuggcuggcccauuuucauauuuggcuuaauaaaacaaauaugaaauacguuaaauauguucugccugcuuauugaugaugagcccaugccuauguugcucaucauuauauguccccagccuuacaaagagcgugaaccacaguggguguucaaaaaauguaagcugaaugaaugaaucaguggugacacaugcuccuuccaaauauuuauguaauucaguuuuuagaaaauugaaucaaauucaaguguaauucugcugcagaaaguucauuugaaaaguaaaauauugagaaauauuauaaacacgcuucauuuuuuuucuuauuucuuuguucuuauuuaaauucaagcccaucugcacgguauuuauucuauuauuguaaaaacagaaaacauuuuccacuguauuacauaauacauuuucaaaaacauugcuauuguuucagauuuucauucaaauuuauuaaauugaaaaccauaaugcacaaugguggcaguacacuuuucuaauaaugaggacuuccucugauuugagaaccaaauucgaacauauucaguagaagagcugcuauauuaaaagguuuugauagcaguccaaauuauuuaguaccaauuacaaagaaagugauuuuauuagaugauauucagggauaaguauguguguguuugugcauagauaauaccauuucuaucugcaagcaauuuauaaacaguaaggcaaaguaggucuggcaaugauaugaagcguacaggcugcuaggauuugaauaugucccccacauuucauguguuggaaacauaaucuccaaauucauauguugauuggaaaugggagguaauuaggauuagauaagguaaucuggauggagcccccauuuuaggacugguggccuuguaagaagagaaagagagacuugaucugagaagcauacuuuugcucucucaacaugugaugccuucugccauuuuaugacacagcaagaaggcccucaccagaugccagaucuucuaucuuggacuucccagaagaaguguaagaaauacauuuacuuucuuuauaaauuacccagucugugauacucuguuauagcaacaaaaaacagacuaagacauaugcagagcagaagucucuagacacaaaauacaaaaaauaccaaacugcaaacuacaugaacugagcuuaaugguugagauuuccgccugaacaagaagcaugaugugauuuaaaaaaaaaaaaaaucauacuuuucugggccaaugauaauuuaaaguauaaauuuuggcucuuaaaccccauauuaauuuauacaugauguucuuuuuauaaaacacauauaaguacacuauuccauuuggccuuuccuucccuaagcuuuuguaugguguuaaaacaaagugggaaauaaguccuagacagagcaauagggaagagaaagaaaagcauccaaauaggaaaagaaauaaaacuaucuucccugaagauaugauucuauaucuagaaaacccuaaagacucugugaaaaagcuauuagaacugauaaacagguuuagcaagguuccuggauauguacaaaaaaaguagcauuucuauauaccaaugguguccaugcugaaagucaaaucaagaacacacugcuauuuacaaagucacaaagaaaaugaaauaccugaaaauacaacuaaccaagaaggugaagguucccuacaaaaagaacuacaaaacugcugacagaauucagagaaaacacgaauaaaugaaaagcguuccauguuuauagauuggaagaauuaauuuuguuaaaaugaccauagugccuaaagcaauuagagguucaaugauauuucuagcaaaguacuaauaucauacuucacagaauuagaaaaaaaaauuuuuaaguaauauggaaccaaaaaagagucugaauugccuaagcaauccuaagcaaaaagaacaaagccagaggcauuacacuaccugacuucaaacuauacuauaaggcuauaguaaccaaaccagcacgguacugguacaaaaacagacacauugaccaauggaacagaauagaaaacuccaaaauaaaauggcacacuuacaaucaucugaucuuccucaaggucaacaaaagcaagcaauggggaaaggaccccuuauucaauaaauggugcugggauaacuggcuagccauaugcaaaagaaugaaauuggacucucaccuuucaccacauacaaaaauuaacuuaagauggacuaaagauugaaauguaagaucacaaacuauaaaaauucuagaagaaaaucuaggaaauacccuucucaacauuggccuuggcaaagaauuuuuggcuaaguccccaaaagugauugcaacaaaaacaaaaauugacaaguggggccuaauuaaacuaaagagcuucugcacagcaaaagaaacaguagauagaguaaacaggcagcuaauagaaugggagaaaauaucugcaaacuaugcaucugacaaaggucuaguauccagaauacauaaggaaguuaaaccaacaagcaaagcacaaauaaccgcauuaaaacgggcaaaggacaugaacagauacuucucaaaagaagacauacaagcagccaacaaacauauuaaaaaauugucaucaucauuaaucaucguagaaaugcaaaucaacaccauaaugagauaacaucucauaccagucagaauggcuauuauuaaaaagucaaaaaacaacagaaacuggugaggcugcggauaaaagagaaugcuuaugcacuguuggugggaauaucaauuaguucagccacuguagaaagcaguuuggagauuucccaaauaauguaaaauagagcaaccccauuacugguuauauacugaaaggaaaauaaaucauuguaccaaaaagacacgcacaugcauauguucaucacugcacuguucacaacagcaacaucauggaaucaaccuagguguccauuaaugguggauuggauaaagaaaaugugguacauacacaccaugaauauuauauagucauaaaaacaaugaaauccuguccuucaagcaacauguauagagcuggaggccauaauccuaagggaauuaacacagggacagugaauuaacauaaucuuaagugaauuaaccaaauacugcauguucucacuuauaagggggagcuaaacacuaagcacauauaaacauaaacauggcagcaauagaugcuguaaacgacuagagcgaggaggaagggcgggaggaaggaugaguugaaaaacuacuuauugcauaccaugcucacuaccuggaagcaauauacccauguaacaaaccuguacauguacccccuguaucagaaauaaaaauugaaugaaaaaaaucaaacaacuauuuaaucacagguauuuaacuguccuuauuaaaacaggucaaacaacaaucaccaccaccaccacaaaaaaaaaaaaacaagugggaaaaaggugccuuaaauauuugcuguacauuuaccaacucuccuauugaaagcaucaggcauuguagauaaaaaucuuugcuauacaucagcauauuuacuugcaauaaaauaaauaugauggcuacucuuucgauguguauauacggucuuaaucuauuuuuuauaaaccaacaaagaagacaacaaggguaauccaaagggaaagagauaugucuucuguucaagugaggucuaauuuuuagauaaaauucauuucuggaggcuucaucuuuaaggcacagccggaauuacaugaccucucaaacuaaugaauaaauguggcaagaauucuaaaguggaauaaaguggggagcagaucauuuuuauuucuguuuauuaccugagucagaggaaauaaaauuuuuagaacuaaugaaccaauuucaucaauaauuaauuuauuaauagugucaaauuuuaugcuaagcauauuauaagucucucauaugcucacaauauacugaauaugaucauuccaaucucuguuaguuuuuauuuuuaagaaaagagaaaauucuuuuaugaagcuaggccagauaucucauaaacguacuuguuaacuucauuugagaaguaauaaaagucguaucaaagaggaaaucagaguauguaguugccugcaagggaaacacuauuacuauaggaaguuaucacaucugcugacuuuuuucuuuucccuuuuauguaaacaaaagcauuccccaaagaucaaaccugacccaagaguuuauccagaaguucuaaagccauauggucuucaagagguugcaggaaaucucaguccugggagagcuauccaccuaacagggauacaccuaacuaucugggacuucaaggcucuacaaaaaugauaacgacucugcugacuuaggucccccaguggcacauauuacagagugaaagguagguuccacuuuuaaguccaugaagcagcauucacucucuccaugcuuugacacaacuaugucccauacagucucugacguuggcccuacccccuggccugcuaucccuagauacccaccuuaucacuaauucugacacuucaacuguuuuucugccccucacuuucuguuauauuuugaccacauuuacaccuaauuuuuuccuaccaugugaccagugguggucaguucaguucuggaaucagagucauuauagaauagcagacacugcuguuuagauggcucaggacaauggaaucuuaggaaugaucgggucaagcuccagccaccuaggaaucccuccaguggcuucucuuggccgcugcuguggcugccuccucccuggccuagcauacccagacugcuuucaugcagccugaaccacacuuccuuuagcaaucccacagugccucagguugacuggagaagacaguaccaaaagucaugccuuucgcuauuucuucacagugauuaaaagucgaaggacaccuaacaaaacugagaaaaagugauggaaggaaacuucugcaugaaucuuucuaaaucaggaagcugacuuauuuccaagguagccuguggaguuucuuuccauccaaugaauguuuacuuuuaucaaaauaagauacuuacauaguuaaaaauuuaaaaauuuaaauagugccaaaagucuuacaccaaaaacagcagucucuuguauaauucucuuuccuucuccagggcucauacacaaauagaaauggcuuucauuuauuaaaauuguuucuucugguauucauauuuauauuugcuauguccuauguauauacuauaucccuuaauuauucaaucuuagauguccccuaugacuucuuauuacaaugaugaaaauuucagcaccuuuuuuccuuccaacauuaaagcacaauuauuuuuccaaccacuuucagugucuucaugccuuugucaauguuuuuuguuuguuucugauacaaguaacaugacuacauuuuuucuuguacaucuuauuuuuuucccugcagucaauugguaccuccuguuaaaauuugauuuucuugcaacuauuggcuaagucuuccuacacucuucaacggcuguguaaaauucucauaaaauaccagaauauccuauguuuguguauucccaggacaccccuccuggagcucccugaccaccagaguucacugugaacugccguucccuagggcugccauaucccuucagccuuaagacuaccauuaaccucagcaaacuaaugcaggaacagaaaaccaaacaucacauguugucacuuaucagugggagcugaacgaugagaacacauggacaacaaacaauggggcuuguuggaggggagugugggggaagggagaccaucaggaagaauagcuaauggaugcugggcuuacauagcuuacauagcuaauggaugccaggcauggaugcaacacugaggugcuggaaugaucugugcagcaaaccaccguggcacauguuuaccuauguaacaaaccggcacaucuggauguguaccccugaacuuaaaaguugaaggaaaauaaauaaauaauaaaucaaugacauaaaauaaaauuaaaauaaauuguugguguauuggcaaaaaaauuuuuaaaagucuuccuuuugcugucaucugaguguucccauccugcccucucccacaacuccacccuggcccuguacacccaauuuuguucuuaauuaguucacuacgucaucuagguggagcauaucccuguggcuuccuaacagggggaagauauugucugaaaaugccuuuuuuuuuucaauccuuauagucgauuaacuggcuguauauaaaauucaaugaugaaauuuauuuuugguccaaauuuugaaaucgugauugcacuuugucagcauugauacguuggauguaauucuuacucuagagcuuuuuuagguaaccuggucucuaucucaggaucuucuacuuaugcuugauauuagacguaucuauccuaguauauauugaugugggucacucacuuuucugggcauucaguggguuagcaauggguccugacgguccaauggcuccauauuuauacauauauuucuuuuuaccaaguuucauauuuaguccccucccuccaagcauuuccucuaauugaugaauuuaauuccuaagccuuucucagguuuugugggagagauguagcuucucaucaguguucccacacugugaagucauuugcuguuucugcauccauugcuuacccuuauauguauacugugguuugagacuauagauguccccugauuucaucauaguuggaguuugguuuccuuuuuguugcuuuugucaucuuaaaucugaaaguacuguuucauuuuuugaauagcuuuauucauuggaagauucuuuacuguacugcccccaaaucuaccugucuguauuucuguucguugguccuagaucuaccauauaaagaaaggcagaacaauucuacagugcuuuuccaugacaguccuucaaauaucugcagauguuagcaaggcguuccuucauccucuuucuucaagcuaaauaccccuagauccuuaacucuuccucuguggguuuuuuuuuuuuuuuuuuuuuuuugacggaauuuugcucuuguugcccaggcuggagugcaauggcaugaucuucgcucacugcaaccucugccucccguguucaagcgauucuccugccucagccucccaaguaccugggauuacaggcauccaccaccacgccugguuaauuuuuuuuuuuuuuuuuuuugguauuuuuaguagagacgggguuucaccauguuggccaggcugguuucaaacuccugaccucaggugaccugcccgccuuggccucccaaagugcugggauuauaggcgugagcuaccgcgcucguccuucucugugguuuuuaggaucuuucccuaaacacuugcccuucuaagaaugcaugccaugcuaguugauuaacauccuuuauaauuuauacaaaaaacagagcuguaauuaauguuucaaaaguggacagauuaauaaagaauucaaggaguuucuuaucuaucacaauucagaugucauccugucaugacuggauaaaugaaagcuuucucuccaccuuacccccagugcccuacacagauauccuugaagaugauugauagucaaaaucuaagaauguaauuaggccccuaacagugaugguuugaaguucagcugggugaaagauugggcauugagacacacauggaaugcacauuugccuguacauugauaggaaagcgguaguuagaaaguuauugcucuuucuucuuagguugagccagcauaaucuaugauagccauauuuuaucacugagaagucaguacaugucuaauagaauugagaucaggaagacaaacugagaaaauaaauagcaugacugcaauucuccagugggaagcaaccuccuugacuccacacuugcccuauacagcuuuuuuuuuuuaaaguugugguuaaacaacacauaauguuaaauauaucaucucaauaauuguuaaguguucaguacuguaguauuaauuaugugcccgucauuguggagcagaucucuagaacugcccggacaguugcauggacugucuugaaggaacucuggagcucuaguccaguguguauaacucauguuuggaaaugagcccuguuggaggaaaggcaaggcuguaugcuagaguagagcagguugugccauacacaaaggcaccagguggagggacaagcaggguggaauucaguucuugcucuacuucguaaagcccaugucaaggaucacccagaggaagggagagcuuuuuguguucguacauaaagacauaugaguaaauucaggcaagggagcagggcagauaagcaaagaaaucaaugaggggcuccuagguagaauuuaaauucuugggugcuuuucauuucaccuugggcguaaguaauaauuaauguacuuuucuaaaguuuuuauccuaucccacacacuaauuuucuucaacugagccagcccuucugucaagccuuacaagccucucuacaguaaugguaaaaauuuaaaugaacagggaauucaguggaaauuuaucuaccucccugcuuaccuuucuauuggugcccaagugcaguguccuaucaagaccacugugucacaggaagugacuagcaacaaaggcugugggaaccccugguagagcugggaagcagcagaaccaguacuggagugauguaauucccaugagggcagggauuugggugaguuuuguuuaccaacauacugcaugcaauuuuagcaauucccagcacagaacagguucuuaaugcucuuuuaaaauuuuauuuauuuuuuacucuugcugucacccaggcuggagugcaguggcaugaucacagcucacugcaaccucaaacuccuggccucaagcgaccuucccaccucagccucccgaguagaugggauuacaggcauaagccacaguucccggcugcuaaauauuuuuagaacgaccaaaugauucaagggaaugugauaaauuguggaacuguauuagaauugcuaucucagauuguuaaagagaaaugaaccaagaaucugacccaacauuuuauucaaugauuuuugccaugauauucaauaagcauagcaugauucaauguuuuaaaaguccacuuuauaaagagaaaucaauuuuaacuaaauuuauuuauuuccuuuucuuuucauuguaaagaaagcccagguuggauaccagugaguuuuuccccugaggacucacauacaugcuguuuaaaaaucuguugaugaauauugcuaggcaucuuaauuaggcauaccaaucccaguuucuagaauuaacguauucuuauuuugugaaaauuauggcaaaucuagagcuuugggucuauacuuaauuuauccauuagaucuuaaauauuauccuuaagacugcauccacaaauucuuucaaauuucaaaaacaaguaugguaugacucaauuauacaugccaauaguagaaauuugcaaucagaaauauuuuugauucuuuaauauacauuauuaauauaccuaugccauggccagcucaucuuauucuuuaaaagcugcuuuaccugacuauaauuuuuuuucugauuucugccauucuucacucucccuuagugucucuccuuaccaauugcauaaugaauuuacacucuuucauuuguugacauauugccucauccuacugccucaucccaaggauuuggggaaugauuuuuccuucgcaauuagauaauaauauuaauugauguaggauguuacagcuagaggaaaaaacaacuuaauacauacauuacucugauagucuuaauaauaauuuucuaaagcugcacagcuguuuagagcuuugagaauuacauaagccucagcccaacugcauggcaaugaaaguaagaaugguacauccauuuuacagaugaagagacgaaaauccaaggaagcaaaggguuuuuucuagaguugcauugcuugguaggagcugaacauaaaucuuuugacucuccaaacagugugauauuuggaaaguuuuucaacuucucugagcuucaauuaguucacuaaagaucgagcuaauaaugucuaauacagaauugcuuuacagguugauuaagaugacauauaaaguagucagcacaaugccucagauauaguaagugcucaauaaaugcaguuauugucaguuuuaucaaugccucaugaacaguauaauguucuuucuuuuuauccuguaguuggcaaacuauagcucugagugaaaaguagcccaccccuuguuucuaacuuggcuuaugaguaaagaaugcuaucuaucuuuuuaaauggcuaaaaaauucaaagaauaaugauccaugacaccagaaacuaguaugaaauucaaauuuaauuguccauaaauaaguuauaugggaacacagucacaccuauucguuuacauauugucuguagcugcuccccacaacagccgaguugagcagccacaacagaaacuauacagccaacaaagcauaaaauauucacuaucugacccuuuacagaaaaaaaaguucuccaaucccuguucuuaauuaauaaucuacaguguucugaugagcuaugcaaaagucagggucuuuucugcuuucuaccuuauuuguauauacccauuccaauucuuauuugcaacaaaaugagaaaaaaauaugacauaggaaagacuaaacaauugccauuauuagggaaaguuaugaagaccugcgauauacucgguugucuuuuguauuuagcuauuuuaucucaguuccucccuucugccuucugggauugggcagaggagaaagagagaaaucaggccaguucaaguucaaaagcuauuaaucagaugagagcauagaaaccaaguacuuuuuccuccuccagcauaucuggaauccaagcaaaguaauagcagaagagaugaggcaacaccauugagcaaaaugcagugucaacaauagucuugaaaccacuuuaucuucaucccauucucauucccaccagacaaaaauaaggaauaaaucaaauaauaucaguugagagacugccauagguuuucucauuucaaacaaaguuaaaacuaagcuggagauaucauuccacuuuacagcuacacaaagccaaaguaaguacauggagugccuacuuuuguauaccacuacuuuagaaacaauaucuagccuuuaaaacaaaaaggagaaaaugagcgcauuuuaugaauaauccaacauuucuuuuccucuuguucagcuagcagcacuguauaugguuguguuucaugcaaaaaggcauuccuuugcuaaaaauacauucagcucauaaagccuguggauaaacaauagcucaaauugaaaaggaaaacaaaaaauaauggaaauauucaugugggguauuaagucuaccuagacuuuucucugaaaguagaggauguuuauaucacuaagcaggaauauguacauucacagacagcucauaugcacacacaacacacagacacacaucacacacacaaacauacacacaucuacuuucuccucuuacaccagguuugaaagcugauuggcuuguggccaaaacuaauuuacaggcccugcaaacaccucuguggcauccuuauuaaaaagaauugagguaauaaaaauaaaauguuuaaccucaauguucucaccagguauaacgugucucccaccacucgaaacacucuccacuggguggaaauggaaacacuucuauucacaaucccucugucaugacuaacaaauauaacauuucuuccuacaaacagaaagaucuguccuucaugcauauuccuagacaguucaaaauagguguaagcacuuucuuauaaagguuugagccacuaauucaguguaagcauauuagaaauauaguauuuuuaaauaugaaauaugugagauugaaucauuaguuguaacguggauaaaagcaauagcaacauuacggaaggauguacuuuucaucuucauaugauaaggcaacugugaagucucauccauuuuuuuuuuuaauaaugguuuagaagaaauguaacuacucagaauuaaucaggcagaagcugacaggcucaaagauacagugccuaacgucuucccaccaauucugcaggaugauucagaaaacaucauuucggguuucagaauucaagagggacaaguaucgggauuuuuccucaccaagcucuacucuggggaaaaaugaccaguccaguguuagcagccaaucagugccauucuugaccuuacuauguccaaaucagagcucauuccacuuucuccucuccccugaaugcccacuccugaccaguguuuucuguucuuguuaaugucucuguuauugucccaauuccccaucuggccucacaaaaggggcugcaauaccuuugauuuugugacuuugauauuucucuuacucuuccuuguuuuggucucgcucuguaccccacccuaccccauccuauuucuccauuaccacuuccugcugagaauauugcaauugucuucuaaauuguuucugcccucuguaaaacaugcccacaguuucugaggucuggcauacugcaguagucacuccugcucaaaaaccuucaauagacccccacugcugacaagaaaaaugcaaucuccuuagucuauauuuauuauuauugaguaauaacagccaaaauuggcuuuguuuuggauugccaaguacuuuaucauaucaccccucaucccuacaguaacccuguccgacaugccucucauccccauauuacugacagaaauauugaggcucagaagagugcaaugacuuucccauugaccugagucccugguauaucuuucauguacucaguguuccuuauauuuuuauuaaauaaguaauuguuuuuucuucuuccccucucugucucuuuucauaguaauuuuaaagcagaugauauuaggacuuguuucuuuguuaaauucuucauccucagagaaaaugaucuuugaguaacuguuagaacucugcuggugcuagguuuaaauguaagagcugucaccuucccuagggucaaaaccuucucgauucaagacauagauggcacuucauuagcugauaugguaauuaaaggccccagcuguaauguguaaggaccaguauaggauauacauuuaucuuacuuuucaauuuuauuccacucuggacuccuaacugaaauagaaauccucagauuaaacagguaaaaccauaauaggucaagaguaucaaggacucuccucaaauuguuguucaauucgagaaaggaaaagacgauuuuguacaagguuaaguaguacguuauuaucucuggccaggaaggcugccaugauuuccaaaccuguucugccaccucucauagaaaaggagaacagaucuaaagccauaguccuuguaugucaauauauuuugaucaagaugaacuauaucaauauuaauuugcaaaaauugucauuaaaaagacagguauaugguaacucuuuacaaaaaugauacaauuuucugaagauuuauuuucuuauugaguucuccuaaauuauccuuauaaaaauuacaguauaugaauugcaaguuaaauaauauaauuuuaauuuaauauaguauguaaagguauguacaauuuuaugaaaguuuacugauuaaagcauuucguaguuuuuuaaauuuuugaaccauuuugaauguuuauuuaugaaagcauagacaaaagauuuaagacauuuaaaguggcugaacagggugugaaaacugagaaaccagaacacagaucucaugaaacacugagagaucaaguaaaguaaaaacaaaaauaaagcucuacucaccaucacagaaagagaagaaggaauauaaauagggugaaaaggaaaacaaucacauacaaguucccgccuacuuacuggggguguuaacuaacaugcuguaaucaaagagauaaaagccaacauaggaauauuuauuacagcuuucagaagggcaacuugaacuacuggggcaagagugaaacacugaaauaagcauaguacacuguauaagcacgccgugagaaaucaaauggcauaauguaacuuccucuacaaucacuugaucuaacuaaaaaucagugggcauuaccacaauacuugggcauuuuuagaauguuuuauuacugcaaaauuauagaagugaaaggucuauaauuuaauaauuuacugguuaaugacuuggcacacaguaagcucucaaauccuuguugaauauuaauugacaugguaaaccuccaaauggcuugaggaaagacauguguuuagagaagauacacaggaucaggguaucuagaguucagugucauugaaacaauguaaggagcuauccccagagcccacucaagcuggaaagucucucgaauugucaaaaggaagaguuggcugcaagauaucuauuuccacgaccucacuggaugauguuaucaggaugggugugguggggaggaagacagugcacuggaacugugcagacaaguaauguguagacaaagcaugggcuucuuaacgagagugcugaaggaguaaaacagauauaaguacuauggcuaaacuuagaaaugguauugauaaagacacuguacaaaggaugccacugcagaaaaagucacaggaacuccucuguguaguaauaaagggcuuaguuaaaguaaaaaguaugccaaugcaggaaauacacagacuaggacugaagaaguuaccaaagcuacaucuguuggguuguugcccacuuuccuagcgaggugggugagagguuaauaguugacauaguucuguacacacagggacucacacagacaugcccucagaaaaacacacaccuggucucucucuacauguaauuacacuguguauauuacccauauacaauauggauuauggccucucaauucauccuugucagggucccuuuguaccauguuaguuuauggugugcacaaaggcauuuaguaggaggggguaccagugggucugaaauccuaccaucuucuuuucaccaagccaguaacuggagccagcacauguguccucgcacagauguugcugagccaggugaaagcagugccuuucucaauggucauccagagggguccuuuccaugauucauaaaaaugccccaaaugugcaaauggcaguucugauccuguguuuuauaacauacaaaguaggaauuccuucauggucauauguuaaauauauauuugcaccaaauuuccuuugacugacaagcucuguguagucaggauucuguggcagagggaccagaucagguaagcagcauaccuuaccauauuggauaaagaugcuuauuccucucugggcaaugaacuucaaagaaauaaaguaagaaagaaaguacacagcuccaaaaauauaaaauaucacaagaaugcccacucaaugucuguaaaaguaggaauuaggcaucuaugaccugggugccugcccaccacccaagauuuucuuauacuuucaagucccugcuuguacucauuuuuaccuccucagccaucugggacucuuacuaccaugugagucacuuucauuuucauaaauauauuuuguucccugaaggucuuucagagacauaaaguaucuggacauaccuuuucuccuuaaagaugauggcaaggaaagggaaauuuuuaaaccaaaugggaagaauuuccgagagugaaacgucaagcacuaugguacauaagugggaaucuuuguuggugaaagguuuuuucccccaaacccacauuuacccucaaguaaccuguuguaggcaaaucgggaauccacacaugcuaauuuuuuuuuuuuuuuuuuuuuuuuuugagacggagucucgcucugucgcccagggcggagugcaguggcgugaucucggcucacugcaagcuccgccucccggguucacgccauugucccgccucagccucccgagaagcugggacuacaggcgcccgccaccacgcccgcauauuuuuuguauuuuuaguagagacgggguuucaccguguuagccaggauggucucgaucuccugaccucgugauccgccugccucggccucccagagugcugggauuacagguauaagccaccgcaccuggcccacacaugcuaauuuuuaguaagaccacacgaaggccuucggcucuuccaugccucuggcauacaguuaucuuuaccaagaaugcccacucccucuucuuucccaccugacuaacuucaguuuacuguucaggucccuucuuacauaugaccucuucucuguagcuuguucucuaacuacuuauugauucauaauuauuuaucucuuaaucuccccagcuggauagcucuuugcaaagaagcauacucuuuuuaaucucuguuacaggcagugugcuagauaguagagaaauauuuauugcaaugaagcccaugcaaugcaguaccaaguauuauuuuuuaauauuuacauuuuggugauuuuauuuuucuauccaaauugccauuucacauagguccucaaguaaaggacaaacagcauaaaguaaggaaaaucaagacuuggacuccagcauaaaauaaacuguguauuugaacacaucucuccaccucauugucuaguuucccuaucagcgaaaucaguacagucguuuuggaaaaacuccugaguuuauacauacauauguuccagaaccccaguggacaccugaaaccauggauaauacugaacccuauguauacuguuuuuuuuccuauacauacauaccuaugauaaaguuuaauuucuaaauuaugcacagucacagauuaacaauaacuaauaacaaaauagaucaauuauaacaauaaacuguaauaaaaauuauguaaauguggugucucucuuucucgcucucucuuucucaaaauacuguaauauucuuggaccacaguuaacuccaaguaaccaaagccacuacaagugaaaccagggauaaggggguaacuacuguacuuggucuacaacaggauuucucagccucagcacuacugacauugugggucagauaacucuguuuguggggagcagggaguggaaccguccagcgcaugauaggauguuuaguagcauccuuggauucgacccacuagaugccuguagcacccacccagauguagcgucaaaaauauuacuagacauugacaaauguccccagugguggcgaggagauucuuaaaauugccccagguugagaagcacugguguagaucagaaguuucccauacuuucgagcaucagaauacuuuuuccuaaagaaauaugaaauagcacucauuguagaaauguagacaaagugcagggcucugcuugaaagggguagagagggcacugcugaaaacucucugcuuuuuaugauucuucgauuuuaaagaagcacaagugaacacuuugggaggccgaggcggguggaugacgaggucaggagauggagaccauccuggcuaacacggugaaaccccgucucuacuaaaaauacaaaaaaauuagccaggcgugguggcgggugccuguagucccagcuacuugggaggcugaggcaggagaauggcgugaacccgggaggcggagcuugcagugagccgagauugugccacugcacuccagccuggggaacagagcgagacuccgucucaaaaaaaaaaaaaaaaaaaagaagcacaagugaauaugcucagaacauaugccagacggugcuuugcaguuucucuaggauauuuaccguuaaacauugagauuugaaaagaucacguugaaaauaugcacaaaaaaguuuaacaucgaucacacaauaaaagacuguaaagucaaaauauauuuucuuucacccacagaagggaauccucugcuauaguaacaauaaaggaagaaaagaagucacaugucucuggcauuuaaaaaauguuauuaauuuauacacaagauucacuaggcaauaaaccucuuaaaaggcugaccuaagugaagguuucacauccccaaauuuauuuugcaaaauuuauguuuaugaaauuauaugucaguuguuugaggcuaaaaauacaaugaugaauauauauuuauaugugugaauguauauaucuccauguauguaccuguaugugcauaaacaugucauauauuuaauguaauuuauuuuacuacuaaauauauaugccaacuuucuaguaauaauaacuuuaauuuagauaaaagagauauaaacuuaucacauaaauuuaaagugauuuauauuugcaguuuauucaaauauaaauuuauaugaaaauauaaaaggaaauuauuacuaggcaaacauauauauucuuucauucacuaugauacaaaauacuguaauauuucuggacugcauguuaaaaguuuuaaucauugacuucuguuaccagaauaagagauuuuaauguagaaguccuuaaaauuuuuugcuaauauuuaaaaauuugcucuaaauuaaaagcuuagccaacauucaaauaaauacaaauaauucaguucaaaauuacuccauuuuuaauaacugagaagaacaaaaauuaaaauuaacacagcaggauugacagauguaccuaacuggaaggcaguagauaaaaauucagaauggaaaguuuaauuuaacauucuaacuguaaaaaugcaggggaaauaugaacauuggcacccacauuaacuuucucucuaucuauggagacccagagcaaauaaguacuaggagaaaggauuucacuuaccauauagguaagcgauaagaaaauguucagaaaugcuaacacuuaagagaaauugaaugauccaucaguucaacuuauuacaaucaccuuauuccaaguuuggggaaaaaaaacaacuaagaaccaaguuacaaucuuuuaagcuacuaaugucaaguaauagauuuuugaaccuaucugcuuuucaaccagauguuuaauccuuggguaagcaacauuucaaaauaaacaugcagauuagaacucacccacuugucaaauguagcagaaaaaagccucucugcuaaguuggagaaagacuaauuguccccuagggagcuaugacaagcucuccagauuucucuucuguguuucagauuuuagaugucuggacacaacuguucucuauuucccuguguuuauuucaucagugcuuccucugcauggaguguuuucucuaaggguaacaacaaauauucuugaccaguaauacccacuggccucuccuguguuugaagggcugcagagagggcgaggacacacacaucuuuaggacccagaaguuaacaucacaaucaagcccacaguuuagacuuucguagcaguaacauaaggugacagucuaaaauggauaauagugaauccuagucccacuuucaacaggaaacuagucaauuuagguaaguucuacauuauaaaaggggcaaccuauaaaugcuaugacugcugacuuagaaaacuccagaaacagucucagagucaacaaaaucauuguagguaaaagcgguucccaggaaccuaguacaagaaaauaugaaaggaggcaaauuaacuaacagccaaccuaagaaauaugaaggcacuuaaaacccuuuaguuacuccccauugccuuucagaaucaaaauaaaaaucucucaaugugaacuauaggguccuucaugaucuaacucuauagcaaccucucauccucuacagcaggagucagcacacuuuuuuuucuguaaaaggccagacagcaaaucuuucagguuuuguagacccuauggucucuguugcaacuacuuagcucugcuauuguagcaugagaguagccauauacaacaugaaaauaaaguggguauggcuauguucuaauaaaacuuuaugaacacugaaauuugaaucucauauuuuucacacaucaugguauacaguucaauuucuuauuuuuaaaaaaucauguaaaaauguaaaaaggcaggccauacaaaagcagacagcagucaggacuugggccacagaucacaguuugcacugcaacccccgacucacucagucaucaucuccgauuccacagaaugaaagacuuugaguaccccauucaugccaugcuuauuuuggguaucaggggccuguucuuguuaccucucuugcaauacucuuuccacaucagucuuuuuuuuuuuuuuuuuuuuuuuuugagacagagucucgcucucccaggcuggaguacaaugguauaaucuuggcucacuguaacccccaucucccggauucaagaaaugcucgugccuuagccucauaaguagcugggauuacagguaugcaccaucaugccuggccaauuuuuguauuuuuaguagagacaggguuucaccauguugaccaggcuggucuugaacucuugaccucaagugauccaccugccucagccuuccaaagugcugggauuacaggcaugagccaucauguccggccuacauccucuuuaacaaacuaauuucaguucaucuuucaggagucauuaacuucccugagaugccuuccggucucccucaugacugggcuugaggccccuucaauaugccagauaacuagguuuuuaguaucauaggaccagugagauugugucuaguccuagacccaguauggguugaaucagaauugcuguccaguagaucuccugugucuagacaguaaguuggugcucaguaaauauuguugaaugcaugacuaaaggugggaucugaagaacauuacagugacaaggggacccagguacauugguaagaaaguuagacuagccuuuggggugcuggggugcuuucugcaaggucccguuuagcugcaugaucacagcuguucagaugcagcaguauggcauaagacccugacaucaaauugucugaucccuggacccacuacucacuaguuaugugauucugggcagguaguauaaguguucuauaccccaauuuccacaucugugggauacaaguggcacuguuucauaagaacuaaauguguucauacuaguggaacauagugguugacacacaauaagcuaucaacaaaucauagcuauuauuaguacugaugucagccaaaaaggacucuauucucauggauucuaaaaacuaaaagugggaaccuauauuuuguuuuucaucaauacauuuauugacuaacuccacaaacaacuuguccaagcagaaccaauccaauuaggaaaaauggaacaaaaaauagagaacagauuucuccuccaugcuagucugcagcuacauaaacacauuuacgauucucuagauaugaauauguaguguaugcuguuagauuucucauauggcacugaaauacucgaaguggcugacugaggguacagagcugaugauucaguagaacagccuaagcaaagagagauaagaaggaaugcugccuucccuauaucacauccuaaauuuccuuuucccaccucuauucccucaauucccugggugguguuaauaaacaagagccgugacaaacauggggugcuuugcauugaauauguccuuaauauagccuugcugccauuugcucauuuuauggcaucccaaucgcuacucuuuuuuuguuguuguuguugccauucuaaggagggcaggcaggaaacaaggcugucuuuaggccccuugaucccagcgggggucaaguccccauggcugauauuggggaagaagggacuggagauggccauuucuguaugguaacuaacuacugaagccugacucucuuggcaccuccauuauuucuacgugucccaucugucucucucucuugagcuguaguuauggcuaaacagaagagcaucagcaucagaaaugcuaugauagcaaaccuuacuauucccuuaggccauaggaaugaaaaaugcaagucauaguguuaaaauuucaaaauaaauuuuaugaugagcauaauacuaccuauaauacuuugaugauuauugcauagauauguuauauucauaaccagcuacacugaaauucucacuagcaagauuaguuaauugcuaucauugcaaauggauacaaguuggguguugauuacauuugaauaauguaaugugucccugucuucagcaaaaccauucuccuuacuauguaacaagaaaaccaaauaccuccugaauuccuggcagcaucuugcccuuccucaccugucacgaggauaaaauauauaugcauuauauuauauauaaaaaauaugugauauguaaauauauuauauauacauauauacacacauagguauauaaauauauguauuauauauacauauauacacacauauguauauaaauacauauauauauacacacacguguguguguguguguguguguguguguguguguguguguguguauuuuuuucuuuuuggacuaaauuuucauuggaaaauauuucccggcuuuuagcaucaaaauuuuuuaguugauuuaagaagaaaaaaaauacaaaaaagauccccccaaaaagguccaagguacuguugggaugucuaacauggagggucuuuuugaaaggucucuuaacauaaaauauuuugauuaaaaaaaagaacuuugcaaaguuggauccauaugggaauaccccacuuccuuauuccauuauucuauaaauauggaucuuugcauaauuuuuauauagagacuuuuggccuugaauuuaagauaaauuucaccauaauauuguuuauaauaaguagcuaauauuaagcccuuacacuguacuaagaaccaacauauccacuuaucuaucaucuauguguaaaauuuauuccuuaaaacaaaaaacaaugagguacauguuuuuaugauccucaucuuauuaaugaaucaggaauggaaaauugaaguaaauucuccaaggucacagggcaaguaaauggcagagccuugcuguugcucauuuacgcucaucagucuauauuucccuacuuugauuuauaauuuuauucauuaugauuuuaauuuggaaaguuuaugaaaacuagcuugucaguauguccuacaggcauaugggaaagguggcuuuuuaguuuuuuaguuaguacuacauuuuauaguacaaaauuuauucaaguuacugagccaaaucacaaucuaacaaauaaaugccaaaaauguaucaguucaccaaaaauccuggucaccacucaauuucaucacauaggaggaucaaauagaauuaggugcuuucuacucacuuuugauaaacuucagcaaacgugacaggcuaguagaagacugcccuuuacugcuguauugcugagauaaauauucucagaaaagucuuguuagccaaucugaucuuaauuuucuguuuccaaaauggggauuauguuuaucagggccaaaguguggaauaggcuacauuuaucucaagaucacauaaacaccaugcacccauaugcaacauguacacacauacacacauucccuuuugguaucuugcucucugcuucuuguguguuaccucauuccuaaagaacuaugugcugagugaacuagcaaacaauuuucacuaauauuuugggaaagaauuacccccaaauauuauucuccugaagaggggcaaacuuaguuuaaccauuguaauaggcaccccucuggacuaaacaauuauauugcacguauaaucauuuuuaaauguucucuuaccaaaugaaauauuauuuguugcaacucacacacugugucacuauuucaaauuugaaacacaaaauucaaguggucacauacagugaaaguauugaaacgauucaaguucuguuuuuucuccuuuaaaaucccuguacuaucauuuuuccacuuccaauuuacugucuaaauauaggaauauauaguaccauuaguuguggagacaugaacugcauccaaacagaacuugaacaauuccaaaauauuaagaacuuaaacguacucuugaaauaaacacauaguuuacaaaucaacaguauaacucagaauuauccaaacuaacucccauguaaaaaaaguagugcuuaaaauauaaaauauacucauccgaagcuuacauauauguuaucacagcacaacagcaagcgcagccaccaaaaauaaauaaauaaauaaagguuucuuggacaggaauauuuuaucacgaauacuguuuagaauugcuauaacauaacaaaaauaaaaagcaaguuaauguugaaugguuuugucauuguuuuuaaagucauuguuuuuaaauuuucuagaguauaccuucuuauugguuguuccuggggcagacuguuucaaccacauccucuuguauaauaagugguaugccacuuauuaugaagaaaaucuauuuggugaguuucaacugaaaaaaauaugugaaagugauguauaauuuguaaaucuguauaacaaugcaaaauacuaauuuuuuuuaacaacagacucuggaagaacgaaagggcuuauuuuaggaaccaaaggaaugauucuacauugacaaaguuucaaaugcuuuggaggagaaagagauguguuugagaaugaggcuauaccuggccucacaguuuggcuuaaugccacaaaaguuaccauccagaaagccaggcaaggaggucugcaaugcaaucaaacacuuaaaucacaaaccugaagacugacuauucuuugcaacacauuugaaaaggcaacucaaauauguaauuucuacuuacaugugcuugauauccaggaaacuauaaggagcuaaacuugauggcuuguguugacagacugucagaacugcaggcagaguuuccagaagaacauguggguguauaauacacaagaaauggagaugcaucucugauucuguuuuuaaugcacggaaguuuaaaguagcagugacugacuucagacggcagcucuacaaaguuugucaggagugacauugcauaacuauggaggaacuauuuucacacucuaauuaaacuuaacauuuuggugauuuuggauuuuuaaaauuaggauucagaugaaauuugguaaauucuauuuaaauuguuaagacucauauugauaugcccucuguucuaaauaugacuaugaguuuacuaacuggccaugugacccugagaaaaccaguuaucuuuggucccagauuagaaaucuguaaaaugaggguauugacuugaccauuucugacccuccaacuuuauaauuuuuagaucugugaucuuauuuaccaaauggauuagaagagauagcaauuaaagucucuugaaugucugucuuaugacaaaggaaucugaacucuguugaaaccugcuuuucuuaguucaaagacccauacugauuugccaaaauuaagcuauagaagacaagucuuccaacaacaagugauucucaagguacucuaaagauuagagaugauucaaauaaggcugcaaaucucccacauuuggaaucccacugggucugaucucauuuucauugccaauucccuaucgcuaaaaccaaagaagcauccucccucuaggcccagggaguacugcggaagaaggagaugggcaugugagauuguaagugcuggcuuugagggauuaaaauuaguucagacccuccaaaucaaggaugggcacacacaugccuaaacaacugaaagauugagaaacugccucuugggccauuauguggccccuuuucauccaugccaaccguaaacauuuuccugcuucucauagacuuaaaagacaauuaccaagaggauaucaagaaaccuguugacagagucuucuggcuguugcaguucccaguuauggguuuuauacaaauagagauauaaauuuuuaagcuaccuuaggacaaaucaguggagacugcaaaaagcauuguggcacaacaaaggucucugaauuccuugccuuaaaagguuuuaacagaaugcuuauguuuuauacagcaaauggcuacaagccuuuaacuaauuccaagauugcaguagcucaaugcacagaauuuacaaagcgacuuuguaaccuugcuuuuuggcuucgguuuuuggcuuuuauauuguuuguugaugaaugccuacccacuuccauucccaucugaccuagaguguuuaauuggcuguaagucuuuuggcucuaagucccuugucuauagggcuuccaccaagggacaggauagaccuggggcagguagccacaccauccuggcaaugauaugggaaaaaauaaaaguuuagccaucaaugcugccucuggcaaauauuggccaaaagagagaaaaugagaaaucaaaauaaaauccuaagcccccaaaccaacugagcagaccuccucuugguaggggaccccauaguaaucuugaaaacugaguucucagccaagacaagauagcaggucagacaucccucguuauacacacugacccucucuaaccuccauuaaccuuucuucucuaagggcuaaaacgaaaccagcaugcugccccuccuuuuuugccugauaagagaccauggaguggaccuggccagucuauggagaacacacaguaagaauguucauguccucugcuucauguuuugaagacagagggcugaaaacuccacucucaguucaucuuaaggcugccauuuuuuguacaugggacccauggagaggcuuaaagcugaauugcucaugugcauuuucuccuuucauaaauacucaugacugcuccuauaguuuauugaauauguauauucagccacccugcucaacauaaauuccuguuccuuuugcccaucccuagaaguauuugugucuggcuuaccagccugucaggauagccagccugcaggcuguaacccuucauaagaaauaaaaucuccucuucuacuuuaaaugaaacuaaaaaaugugauucuaaugauuuaaauuugguucuaggauuauuuuaaucaguaguugcauacacuaaaguguguccaagaugacaacucugcccuaaccccaagugcuuguaagugaaugcaaauaaauccaugaccuuccaaacauaauggaauggagcuuagcaguuuuuuaaaauucuaaaucuucuuaguacuucuucaaauguaacauuaaaaaaaaaaaaguaaugugaaagagaagauuucuuuucacauaauaccccaaaaaaaaaaaaauguaaggcuugguuucauacggccuugagaccucacuaaaugaugccgcuuuaggcugauauaaagcagguaauuuuccuguaacaacagaugccuguguuuuuuucuugaguuugccaugaaucaccgaagaauucacaacugagcaaaggaggaucuguucuuuucuagacucccagacauuguuaacucagaaguucuuaaagacaaaagaagauuuaaggaagccacuuguucucuacuuucuauuaaaauuacuuuuaguucuuuauguggggacaugaaagaauuuagaacaguaacuaacugacacagcagaaaaacagagagucuuuccaaaaaguccucacuaacaucuaacacucaagcagccuauuacgaugucaacagaaucacuagauaugauuugaggcuuauaaucuguuauuucccugacauccucuauucaaaugugaaauuauuuuccaauguuaaaaaaaaaacacagaaaugaaacuuaaauacuaaguuuuauaaaauauacagaguuaagcucaaauaguugacaaagaagugcauagcauuccuugcucugaaucaaaaauaaauucuaaaaccucuugcaucuuguuuauuauuucuggagaauaaaagagcuggagauauuauugcaaucacgaugaugcccaaacaaugucagaaaaucaaaugguugaguguuuucuuucauaauacauuuuuuauuuacuggauagucuaaacacuuuuuucuuucugaacuuuacucagcauaaaaagauguuaugaauaguuuuccuaacucacagccauuaaaugucucccuuaacauuaaaguuuuauguguaacauuucuaaauuaggcgacgcaauuugacagcacuauaaaaaaacauuaaguuugugguugcugugagguugucuaagugagaagaagaugcuccuguccaugucuuugaauaauguuacugaaacauuauuagucuauucauauaaguaugugcaaacacuauaugaauaauacaauauuuguaaaaacaccauugcucucaauucuuccuaagucaucuacauugguaccauaagaaaauauucauaaccguguaccucaaguaggcuuuagggaugcucuaaaauccuaauuuuauuuauccccaugauuacuucacagcuuuuccucaauccugaauccaauucugucuuugccaacuuuauucccugcugcugauuuccuacaucauguuuaauauuucuggagaagguagaaugggugagaacauccacauacccuauuaucaccucugcccaccacuugccccugaccuuuauacucugacuuucccccauggaacuuccaucuugaucaagugccugagguccuccugacagcuuuuaccuucucacacgauuccuacccacccuaaguuuucaaggacauuguuccagugauuuucccacucuuucuuagaaucaucaaaagauuuucucucuucugaauuauucccauuaguacaaaaacauacuguauucacugaugcuuguaacucacuuugaaauuugaaaaaauagaugaaagaaugaacagaaaaaugaauagguaugucaugaagcaaaugcagcaaaauguguagacucuagguauuagggacauaaacaucaauucucaaaugcuuucaaguuuuccauaguuuugaaaaauuuucauaauaaaauguuauaaaaaaucuuaaugaaauuuuugccaacuuaaaagaaugccucauccacuucuaacaccauccauuucuaguuuccuauuauugccacaaagcauugacuuuaauuguacuucuucccacacauuuuaacuuuaauuguucuucuucaguguaaaaauuuauaucagggauggcauggaaugucuuuccaacucuuuaugucuaaauuuucugcaucuuuauaauuauggcaugucuaauaaguagcauauaguauauagcuuuauuuuuuuaauuuuuauuuuuuauuuauacuuaaaguucugagauacaugugcagaacuugcagauuuguuacauagguauacacgugucauggugguuugcugcacccaucaacccaucaucuacauuagguauuucugcuaaugcuaucccuccccuagcccccccaccccccgacagacccaguaggugauguuccccucccuguguccauguguucucauuguuaaacuccuacuuaugagugagaacaugugguguuugguuuucuguuccugugauaguuugcugagaaugaugguuuccagcuucauccauguccgugcaaaggacaugaacucacccuuuuuauggcuguauaguauuccaugguauauaugugucacauuuucuuuauccagucuaucaaugaugggcauuuggguugguuccaagucuuugcuauuaugaacagugcugcaauaaacauaugugugcaugugucuuuaugguagcaugauuuauaauccuuuguaauuuaccaaucccaguaaugggauugcugggucaaaugguaugucugguucuagauccuugaggauaugccacacugucuuccacaauaguuaaacuaauuuauacuucuaccaaccguguaaaagcauuccuauuucuccacauccucuccagcaucuguuguuuccugacuuuuuaaugaucaccauucuaacuggcaugagaugguaucucacugugguuuugauuugcauuucucuaaugaccagugaugaugaguuuuguuucauauguuuguuggcugcauaaaugucuuccuuugagaaggaucuguucauauccuucacccacuuuuugaugugguucuuuuucucuuguacguuuguuuaaguucuuuguagauucuggauauuagcccuuugucagauggauagaucgcaaaaauuuucucccauucuguagguugccuguucacucuggugauaguuucuuuugcugugaagaagcuccuuaguuuaauuagaucccauuugucaauuuugccuuuuguugccauugcuuuuggugcuuuagucaugaagucuuugcccaugccuauguccuaaaugguauugccuaaguuuucuucuaggguuuuuaugguuuuaggucuuacauuuaagucuuuaauccaucuugaguuaauuuuuguauaagguguaaggaagggguccaguuucaguuuucugcauauggcuagccaguuuucccaacaccauuuauuaaauagggaauccauuucucauugcuuguuuuuuucagguuugucaaaaucagauaguuguggauguguggcuuauuucugaggccucuguucuguuccauuggucuauauaucuguuuggguaccaguaccaugcuguuuugguuacuguagccuuguaguauaguuugaagucagguagcaugaugcuuucagcuuugugcuuuuugcuuaggauuguccuggcuauacagacucuuuuuugguuccguaugaauuuuaaaguaguuuuuuuuuucuaauuguuuuucaauauagucugaaagucugucuuuuaauuggaguauuuugccucuuugagucacuauuguuaugccauuacuaauauauaucuuacuauucauucuuugcagaaacugcagaugauaaucucuaugguauccacuaaaugaguacugaaauaauguauaacucccaaggaaauguaggaggucacugacuaaaaauaauuaaaugauuuggaaaauaauaagaaaaaggaauauagaacaaauuacuacuuuuaucacauucuagauaaugcagauuuaggcuaguuuacuucuacuuacuguaugaccacacuuuuuuaugcucugucauauauuucaguucuuucuauauuucaccuuaaaguaguuauuauaguuuuacagagucaacagucauuuggagcuacccucauauuuccuguuuguucugcauucuguaucucuucugcaugaagaacacucuuaaguguuaccuuucuuuuguugugugugcuucaaaauugcauuuauuguauuuuuucuuauuacauaugauaucauguucauaauggguacauaaauuggaugcacauaaaugcaaauaaaaacaaaauaaccauauucucaccaccuaaugcaaccuguuaaccccauguauaaauacgugaauguuuucaguauaugaacacacaaccuacuguauaaauucaagaaacaagugugaugaugauauaaaaugcagguucaucucuucugcccccacuuccucugcagccuggguguaaauccucgcuccaccaccuguucucugugugaacuugggcaaauccuuuacucucucugggcuuuccuuucucaucugcaaaauggggcgaauaauacauaccuagcugaucuacuauaaagacacaugcacacguaugcuuauugcagcacuacuuccaauagcaaagacuuggaaccaacccaaaagcccaucaacgauagacuggauaaagaaaauguggcacauauauacuacggaauacuauguggccauaaaaaagaaugaguucauguccuuugcagggacauggaugaagcuggaaguauuuccuuucguauggaaauacuggugacacauucuaagguuuucuuuauaugaaagugucuuuauuucaacuuuauuuuugaguaacauuuugcuaguauaaaaauaauagaauaucaguuauuuucaguguuccaauaauucuuccacugaauuugguuuucauguuucuaaugaaaagucagacaucucuaucacuuuaaucccagaaugcuaacaucuuuuuuuaaaucucuaauugcacuuaacuuugucucuuuaccugugguuuuagauauuuuaauaugaaauaaguacuaauacaugcaguuuucuugcagugccuagaauuucuuaaaucuguggcuuaauggcuuucaucagauuuagaaaauccuuaccaguuaucuauugacuuugucccuuuauuucucuuuucuucuauggguauuuuagguauguauaugcaagauauuuuuaacuaugcuuuaugucuuauauuuuuucuggauuuucaucauuuugucuguuuuauucuacaaauuaauguuaauucaucuuccaguuaacacauucuuucuuuagcuuugucuaaucuacuguuaaaacuaugauucaaaucauugaauuauuauaacuuucaauucuaggauuuccauuuuauucuuugcuacagcucucuucuucugcuauaauucuccaucuugucauuuaauuucuauaguauuacauuaaugcauaauuacaucgaucuauuauauuuaaauaccccuguagauauaauucuaauaucuacaucuuuugugguuugcuuuuuugcuaccuuuuucuuuguuuuggccauuauauauuuuugcauaucucauuuuuuauuuaaugucauacacuguguauuaacugcagagcauacagaaaguuauggaugauaauauuuucuuccagagagaaauuuucuuugcugugagaagaauauuguagaaggaacauggcaucuuaaugcauuaugagacucagcugauuugaaacugggcuucaguccuugugaugucugauuuccauguuucagccauuucagaauccaaaauaaaagcccagagucuugugacagauucuauuuuccaacgauaaucugccuuuaaccaugucuauuucccuugauccugaguguaugcucaggaucugugacaacucugucgauggagaaugacagaaauccagacaugugauuuuugagguuagaucacaaaaaugccuuguacuucugcuuuuuuaaagugauauucucagccuuaaagcccaugcugugaggaaucccaaauaagacaauuuggagauacuagaugaacaggccauaucuuguauuugggaugaugucuucaguuguguuugggaagacggaucccagcugacagccagcaucaagucucacacauuugaaugaauaccccuccagaugauuccagucuucuuacccccagccauugaaucuuucuaguugaggccucaaacaccacggcacagagacaagccaccaugcuaugugcugugacuuccuuaaauuuauaaaccauagaaaauaguuucagaacacuacauuugggauaauuuguaugcagcaagcgugaugggaauaggugccuucuggaccuuguucuucaauuucugucccuccagaucagugaaacugcccgaagcucuucucagcuucucauugcucagucauugcuuuaauuggaaaauguucacauuucugaauuuauucucuuuccagaagagaaucuuguucacuuaguacuuuucuagugcuauaaaaauguuuauuauauuuuaagauuugguuauucuugguugagauaauucaucuggaacaaauuaauucucuuuuuuuggagcagauauaucucauucucauugaauuuuuaauuuaaaucacuacauacauauauacauauagugauuuacauauacacauauagauauauauauuuuuaauuuccaaaaguucuauuugauuuguuuuuaauuauguuguuuuuaauaucucuuuauuuguugccauuuuaaagccuuaauucucaaaacagaguacacaaaauuauuuuuuauauuuaugucucauaauuccaauauauguagcuuuuauagauguaauucuccuguguuuugcuguuuguucuacuggcacucguuuaugagcuuuacugauauuuuuuggcuuaagcccacauuucuugaaauacaccuguggaaauuauuuaagaccuuauaagaaacuucauauuucuagaaaauuuguuucugccaacuguuuauuucacuaccauccugggaccaccuuaaauuaaauucucuauuuggaguuuguucacacagguagcaugaauuuuggcugaaauuuuguuuagggccaacucaaauuuucagaggaaacuuuuuuucccuccucucaaaucgaaguugacacagacaagaugcucucacuuuauaguuuguuguccuuuuguauucccacucuauacggagauucuccuguucaacuucccaucugaagcacaaucuagacuucauaucuuaucuauuccgggacauucauccuucaaauaaaaacugaaucagggcuugccagaaacccuaagugugaaauccauuuuuggcgccuguauuucaagccgaacaucuucaguuaauuuucagcauuuugggauaucuuauuuuuuccaaaagucacaauacauucaaaagaugcuuuuauauuucauccaguuuuuuaaguuauuuucaugaaaagaguuacccaauucaacagguauccuuuuucaagaugacagucagcaauacagauuuaugugauuuucauuugaaauauccgguggaaaaaaaaaugcacugcaaggcaaacaaaacaauguguauucaguucugguggauuccagugugugcccucuggguaaugcaaauaaaaaugaaagcuaaucaaaauuaucugaagguacaaaaaaaaaaaagcagauccaaaugaccuuuuauggauuuuugcugcuccucaguacuauaauaguaucuaaaauauuuuuguucuuaacucaaauuuucuuuuguauauuuauaagcauuggaggcuacugugcuccuuagaacuuggaaaagacaauacuauuuugaguaucacuuuuucagaauuaagcuaaaauuuaauaaagaaaacugccaccaaaaucuaaagugagccagggucaccauauucucucaccaaggggucuuuacauuuuauucaaccaacacucuugauucccugcucaccaagcaaccuccccauucccacauaagccugucuaugagcacagaauguguccaucaugcugucacaauuauuucuagucugaauuacagugauuucucccaggaaauugaugaagugaugucugacuaugauuuggcuucccauaaagcuugacuaaagagcgacauaagacauaagcugauuaugcuaacagaagcauuuccacugggugcaaccauucuauuccucacuuuaaauuaauggaguggcauuugggguguuucccuaguucauucauaaguucuaauuaucucucaggccucucucacucuagacauugagcauauuaguauuuuuuucaaauugggacacccacaucaucaggaacacacuguacaguagcagggugugugaaaugccuuaaaaauaauacaggguaucuuccuguauccaauauuuagauguuaccauaauauacacuuccagauuaaugucuuccaucauuuguuuguuuaauggcuacuguacuuucuuccuuauuuauuacuucuuccucucauucuguugauaaauauauuuauaaggcucuauuuuaugucacuguagaaugauuuuuuguuuguuucucaggguaugcacauuauguaguucaaucaaugaguacgaaauagaguagaaauucaauuaucauuaacuaaaugaaguauuuugcagcuaaguaguuuguaugaaaaccacauuaagguguauuguaagcauuuauauuagcuuuauucuagaggguugagcaggaaguuuucauauuuugugccuuccuccuucggccacaggaauuaguguggcagcuauaacucagacuggguuuguauaauaaauagcauccauccuucuccugaguugaacccuugaacaaauccuucuugccuuuagaauaaaguccaaucuccuuagcuuucaguaaagcaugaucuuccucuagcuaaccucucagagccucauuucuugucaugacuuucccugcaaugggucuaccagccaaacuaauuuuuuuacguuucuuaaucacucuaugcucagccuuaugucagggccuucaaauuucaugcuucuuuguccuccaacaauuauugggugauugacuucacucuucagacuucagccuagauaggaaagcuccucucaucuugccuuccaagcuuggguuaggugccccucacaugugccccucaguggucaguacgcugcacauaccuuuucauuguauuuccaacacugcauuacaaaacugcccauuugcuucucaguauccucuuuggaacugcaagguggauagaacagucuuucuuacucccuauacccuuccccugauuaguuccuauuuacucuuuuagauauugggcagcgaaugcuaauugcucuccuuuauccagucuuccuuucuucuuugugguacccucaguuucaccaauuacccggcugcccaauacagaguauauuugccagccucccuugcaacuaaguguggauauaggaugugagcagaagacuuguguacaacuuucaggcuaucuccguaaggacacuuguccuagacuccguguacauauucuugauggcuggccuggaaaggcagaggaauggagcuaaccuugggggucgcauguugagguuggugugacuaccccacuaggccuauaugcuucacuucagacugccguguaggaguaaaagaaacuucuaucucucauuugagucaguuaagauaaucagaucucuguguuacagugccccauucuaauuaacacagaggucaguuuggaugucacuucuucaaggauacuuauauguaucuauuacuggacuauaaauuccauaaagccaggcacgauucauauuuguucaaugauacauaaauuaguaagugaaugaaugaauccaggaaucagaaauuauaugcuaaucuaguuuaugaauauaauuucaaaaauuccaaaugauaugcuggcauaagaaauuaagucauauuuuaaauaaauaaauaaauuagcaauuuuaauuacagaguaaaggaauauuuaauaucaggaaaucuauuaauaauauuccauaggucaaaguauaugaaaaauauaaacacucuaagguugaaaacuuggagcaaaagaaagaaauuaauccucucuuaugaaguaggugcauuguuuccucugucagcauugauguaagaauuucccagcucaugaugaacugggaaagagggcggagcucacagaggccagaagggauaggaaagaggucagcucgguagugagaaagaaaguuaaacauuuaaaggaaauuuggacaaaucuucaaucucuccuacagacauaaauaaagaaaaggaaauguguauagucauuucauggcaaauaaagaagcacauacuaaucaaugaacaaugguccaaacuccccuaugccgucuccaaaacaauuauucuacauguuacagguguugcuauuaccauuuuuuuggguuugguuuucaaauaacacaguaaaguauuggaauccuucaugaaaauaacugucuugauuuauauauugaacauaacagccaauaacaaaugacuucauagggugugccagaguauuugcuaagcacuuuacauacauuaugucugaaaauaguuuaaacacaauccaguagaugccuaucaucaguuuugauucacguuauucauauuuagcuaaauauguuaagaauaaacuacaguuuuucacacuauaggucaugaucuauuaguggguugcauaaggaauuuaaugauuugaggucagauguuauuuuaauagcuauguagaauaaauuauacaagaaaagaacagggcagaagauagaauagaaaauaucauaaaguauugcauggaauauguauaaaugauauuucaugaacuuuuauuuugguuacauauauugaaguguagacugguccaaaaauuuuggaaaugcaucauucuaagguaccccuacucaguugcgcacagccacaggugcaauaagugugcucuuaauuguucauuauccuggcuccauuuuuucacuacauccuguccagcuuugagccucaucuggauggcuacacccuggguucagacugcccccucuccuucagugguauggaguaggaaagauuagcaauagggcacagugcuacgaacaagucucuccuucagugacagcagauccuaugucucuguggccaccugcuguuuuccaccuauaaaaguaggucuucaaguugugugacagggaacacaaagacuccaagugcuuuuaaaaucuugagccugguucucccaccacuccauagacuugguugccuuugccuguaugcaucuguguugucaaugccuuucccccagcaccugcagcuccugcaacuugugggaacucucucacaauugugugaaguuccacuucaaaaaauugacaaugacagaggugaacaaagggaacuaaccuggcaaaguagagccucuggugagugcagacacuuaacaauguaaaagagugcuucuuuguggcuaauaugugcuaaugaucuucuaagcauuauaaauauagaaaacacaucacauacucuucccugaaugauggcuggagaacagucauacucaacagaaacaacacuucuaaacaaaagaggccaguagguguuuuggugcuuacaucaagcugguaucucaaauuauuuuaucuuugacuuccaaagacggacuucuucagggaaauugaggcagaaaaaaaguacuguguauuguuauuauuucuguauguuuaaguccuaaaacuguaaugaaaauaaacacauucuaggagauggaaaaccauggagcauucuagaaaggcccuaaggagaugaguggaucuaaucucugaagcuguuucucaaagcagggcccauuaaccucuuguaccaguuaccuggcauguagggguaggggaugggcccaguauuaagcaggcagagagguagacucugaaagucuaacucccacagaggguucuuaguuucaggaacacagauuucccaccaaaauaaggaaguacuaacacaaucaccaaauuguaaagaaccaaucaagucauuucaaaaaccaccaaccugcauguauagacuuuagucuaauacucguguuuuaauaaaugccauuuauacuauuccuacaacuucuucugaaaauaaaauauuuuguauuuuuguuuguauuuuugcaaguaggaaaaguaauauuccucuugcuagugaacccacaacuugguuuuuuauuuaauauaaggcuuaggcacaaauccacaggcauuuaugacaauuuacagagagguaaaugaaaaaucaaaaaucacaaagcacauauauguaucuauuuuacuuacacuaaaaauaaaaaauaccaaagcacaaacgugauaagcuccauuuaaaauuuuuuaacucaacucugaguaaguucaggaagguucaaggcugaauuuguauauaaauuuucccccuuauauuucaugacucauuuauaauucuagauuguuagaacauucuaaaauguuuuauuuaugcuaugggguuuuaugagcauauuugaaacugugaaagcuacagagccuuuuguucaggcuauauaucuuaagucuugccaaaagaauggaaccacauuacuucaaaccaauauagauucagauuuuucuuucuucuuuuuuuuuuuuuuuuuuuuuugagauggaguuucgcucugucacccaggcuggagugcaguggcgcgaucucggcucacugcaagcucggccucccugguucccgccauucuccugccucagccucccgaguagcugggauuacaggcgcccgccaccacaccuggcuaaguuuuuuuuguauuuuuaguagagacgggguuucaccuuguuagccaggauggucucgaucuccugaccucgugauccgccugccucggccucccaaagugcugggauuacaggcgugagccaccgcgccuggccagauucagauuuuucaagcaaauucuuagguauaaauauucagccuaaaaaguuuuaaagauuguuucauacaagaaacagaaaguagauauuaauccagagaaauccaguccucccucaaacauuucugcucauuugaauuuauuaaucugaaugguaacuccacuucguaggaagaagaauaaaauuuaaaguguaauuucucacuaacaaagauuuucuaauaaaccucaaagauacuuuguuuaauccacugagggagauuuaaagaauuuucucacaguauugcuaaagcccgugccuuuuccccucugaagcgguaaguuuuucccaaauauauuccauguuacuuguacauaauaagucugcucauuugcaugcaaaccauaucuauauuaaugaaguuaaguagaaaaugaagguacagaaccaugcaauuaugucuuaagagaugguuucauuugaaauaacaagaaauuugggcaaaggauuuugaugcaugugugaagcugacuuguuccauauuucauucugcuaagaaugcacuaauaacacuuguggacauugaucaaauagccauguucuuugugcuugucucauucaccucuuguaaaacccaauaguguguauacuauuacuaccaccauucccauauuacaggaaagagaaaagagaaagauuacaucacuggugcaaaagucuagggcauggagguagauggaaaacaggucagugugaggccaaaagcugucuacucaacagcuguucugauguggucucacuggaaggcggucuaguaacagaaaagaagguuauucaaaaguaggaaaaucuuucaaaagaaaugccuccaaagagugucuauuggaucaggggacaggagaaaaauagugcccucuaaaaaaauuaguagaaaaguguuaaaggugauggaugauaggaaagugaaacuugcuuuuuguguguguaugugagacaggaucucacucugucacccaggcuggagugcaguggcuugaucuuaacucacuacagccucaaucuccgaggcucaacuaagccuuccaccucagccuccugaguagcuaggaccacaggugugcaccagccacccaaguaauuuugcuuuuucuuuuuuuaaacaaaacaaaacaaaaacuucuaugguuccuucagucuccuguugcuguccugaaguuccacgguggcuaaggucccaguuccacacugcagcagucauucaggacagaggacguuugugauacacaagcaaagcuuugcucugaugaaaaagccaguuuaccucuuuucagaguuuuacaaugauucccuggcacuagcaggagcagcaguaauacuucacauuuagguugacuuuucacauuacugaaagcaguuuuagagaaagcauuuagaucaagaaugcccuaagaguaagauucccuggaacucuuuugaaucaauaguaccucacugaugaaauucugaaacaauggccuccaugaggccuaguaguguuucugguacuacaaaaauucaagaggcuccagugagaagguccugacucccagcagcuuagggucuaucucagugugguacauucaaggaaaagccuucauuuuacauauacacucaauguuuucuugucuaucacacauuuuuuugacaccucugugaacucuuuucaaugugagaaaagagauaagaaaugcagguacaucagugggacuguccccuccccuccugagaggccccuagcagaacaggagcaucuacaguagaaaauguccuuuguugacuggacucaaacuaaaaauaacauucaaguaaccuaccuuuucaguuugaaagaauuagcuggaucuauauuauaaauauucaugaaggagggauauccuaagggaagauaaaucucuaaaucccgagauuuucuguuuuguuuauuugcugccucauuuaaaacaacaccaaaaccaaaaacauucaugguaaaaguggccaccgagaggcaauaagggucaguccaaaaauaagaauaaaauaaaaauuuccaaaucaggaauauuuuaccauugcuuucucuuccucucuugcugcucaucccccuuucccgauuuguugcaaaacauuuccaguuccugaggugauaccuggaggaauccccaaguuguaacauuuaguguagaaacagccuaaucuggugcaaaaacugccuagugggccuagggaugagaugccauggagacugucucuguguuccaauaggggaucggggagaagacgcaggaggacuucucuucacacuguaucacagagaccuuacccagaauaagaagagaguuaaacacucacuggucccuccugucuuccuccaaacagagguuuugcaagccuacagugacguaggaagcagaggcugcaggacauugaaagaguuaaaauacuaggaacaucagaagacaguaaugcgacaaacguucacccuaacuccccugggcggugucagcugccauggaacagaaacagaaggccaggaccacagagaugggaaaggggcuccagcauggggcgguuuacagcugcaugcugcggggcaggauggcugcaaugggaacagggcagagacuccagagcaggaagucuuucaugaccgccauggugaaaggugugagccaccugggaucugccaggggauaaaaaagggcucggggacauggugaggcuaagaggcaguggaguggggaacaaggugggaugccaacccgcccaccaaugaggcuuuuauaauuaacacaccucuaguuauaucucccaguugguuguggccuagggaauaugugcacaucugaaaaacaaauuccuuauauucauccgauacauuauuuucuagguguaaaacaaauaauuuaaagaaaguuaaacuauauuuuagauacaccaggaaaacccacuguuaaaacuaaauuacagugaaugcucuaggaggcgaaacacaguuuuauaauguuaguaauucucccuaaauuauuuauuuuauauguaugcauuuccuuaucuuaauuuucuguaaaguagaucauacggguauacauuguuauauagagauaaauacaacugagcuaaaaaaaccccacaaaucugaacaguggagggagagccagugaaagcagugguggcagaaacauuccauuauagaugcagaaaguguugcagaagaugcuguagauuuuaaggagcuguaaauugcauuuacaguggagaagagaagcaagugaguauuuucaagaaugcccaaaggccuaagagaaauauaaacuuuucucugagccuaauuuggagaaugcuauucaacgagacuccaagaucacugaggccacaauucugucuugaaagaugcaaaagacccaggagguagaggucaaugaccccuuaauauaggcccagucagacagggagggaucugcagcuggggcaaaaugaaaaugggagacuagcuuccuggaacucagacagggacacagccuaccacuggggucaaaggaagaaacuauggggauagagacuuuuucuuuuuuuuuuuuuuuguuuguuugagacaggguguggcucugucacccaggcuggagugcaguggugugaucuuggcuaacugcaaccuccaccuucuaggcucaagugauccucccaccucagccucccgaguaucuggaacuacaucaccacacccaacuaacuuuuggauuuuuuuguagagacaggguuucaccauguugccuaggcuguacucgaacuccugagcucaagugaucugccuaccuugggcucccaaagugcuaggauuacaggagugagcuaccgcgcccagcauggggauagagaccuuuuaccuuaaaaugugaugauacuugaaacuggagcauuaaaauuaggagucgaucagcugggaacuguugccucauaaucaggcaauuuacgggaaagcacgaaguagucgaaucuggaaguaacuaucugccuucuguauauaauuugcuuucuguagacaguguccuuuccagaccuuaaagaaucaccaccaccgucaugaccauagcaacaaauaaaaacaaauuguuauuuacugugaacuuacuaugaaccaaguacuaggucaaauuuuugcuuuguuuuguuuaauuucaucuauuccucagugaguugcaaaacaucuuaaaugucuuuccggaggacaggaugcccauguuacacauguccacacagugucuccugaauucuuuuccauccaacacaccuuuuaaauuuauuuuuuacaaauuauuguuauucuuaacuccucuucuuacuuuauucuuuaacauuuccuuucaguggcuggauaaucacauggcaaagauauuuggaaagaaggccuauaggggguggaagguugagcuaauucaucuccaaaguuccuuuaaacucuaagcuugaugauuuuauuaugagaguucagugaaaucuuacaauucugguacuuuucagauuacagcacagaugcuuaaaauaagugauuuucccaaaggccauauggauacuaagugggcugucauguaaccauguuuaaaauauuaacguguguguguguuuccuauuacgacuccacauuuuaccuauuguuucucccccauuugauccgccuaugccauucuagauuugucauuuaagauuaggacggcuuuagcagaaaauagagggaagaaagaguccaaagaagggacucaguggacaggcaauaggcuuggcagauuccuugaggaggaaaaacuagucucuccauccccaacccuccuccucacaggacuccguagccugaaggaaggcagggacuuuaaaggggaaacagugugucgcagucacaagacucugagaaaagggucccaggaacuugucccugucucucagauaaucuuugaguauaauaaucauaucauuuauugucaaaagagacaguaugaauaacuguaacuuauuugaaaacaagugcaaaaaaauccaaaaguuaguuggguguggugauguaguuccagguacucaggaggcugaggugggaggaucacuugagccuagaagguggagguugcaguuagccaagugcaaacucagaccugggcaggucugauggagagucacccuaagccuuugaggaugacaggggaauagcacuucccacaaaagguggagggaaccuguaucucuuuucuaagcaaagcucuagggaaaaagaaagacuccugagaagaaauuuaucuagauagcugauguauuuauaaagcuuuucacaauuucucacaucucagaaugaauccuuuccauuucaggguggcugugaguuuauuuuccuuuacaguguacacuuuccucaaauguuuguggagucuugauggugugcuccuauuuauaguugaaauccccuuuuggacugucugcuguuucugcuugugccauccacuagucaggcagaggccauagggggcaucuggacagaguauucaaggacagugguaggguguugcuguugacggucacuuccagagccgaucaccuaggcaugggaaugggcagacuguauuccuccaggcuauggauauacaugugcuccaugaaucucaccguggguaccacccuagaccccugaaaccaagcuccuacacuugcugcucucaacuggauacagaaaaccacaguaaguguccgaguccagggaggggugugacagcugguaugugaccuggcugcugcucccagaagucagccccucauugcccuggcuuaggucuaaugcuguuggcacucacagaaggccuucuucaauccaguccuauccuuugaggauuacuuacaguucuugauccacuaaaaguuuccaauauuugaacucagcuauauagauauuuauuuauuuaaaauaucuucucuaucauucccagccuuccaggagagggaggcuauagcaugugcucagucagccauuguaauaugaaagcccaaggaccaacucagcacagaccugcaugcaccaagagcugggaccagcugggucaacaggcaucucucaggaugcccucaccuacggaugacccugagggugagacagcugauccaauaccuugacacuccacaaacuccugaguacuuggcuguaacuccagugggacauaggauguaccugacauugauuaggaacauguuuuaucuugcccaaaggaauaagggcuuaaaauagaaguuaaauuuaagaaagaagaacuuacauuuuuuauauccuuguaaagguaacagggucagaaacauauucgugcauuaauucuggaaauucuuauucaguaacuacuacaugccgagcacuguucuaggcccuaaagaucacacaaugaaacagacagacauccaagucuccugacuuccauucgguguuuuuauccauggauccccaaaagcaccucguuuuacauaaugcaacugaguauuuugauaaagaaauaccaaaugcuuaaaaauaauuagaaaauaaaauuuuauguaguuaaaacugcguucugugcaaauguuucagcaaucagguaaagagguauguuugguuuucuguaaguuacagagcagccauauaauucccaagcccccgaaaguguuucugagucauguccagcauacaucuuucuuagaagacuaagugccuuauuucaauuuaccuaaaugccuucucuacccucuuuaccagaauccuaagucuauuaauauuuuaagaagaaauaggcauuguccaccgccauaaaauuagguaauauggguuuuguacaauuugaaucaauaccaauuauauaccuccaauucucuccauuauuacaauggcuucuauucaagcauuaggcaacuaauucucccauuguucuucaguugaaaguaaauuguaaagaaaucaauucaguuuggauaauuaaugacauuuaugguauucccacauuuuauaucauggaauaggugaucauuauuucagcugaucaaaaagauauauaacuaaaaagcauucacugauaauaucucagccucugauuuuuuaaacauaacaacuacuguuccauacaagauauuuaaaaaugagaaagccaaugucaacauguccuguuaacaacuagaaauuauugaaaagagcauaagcaaaaugcaauugauaaauauauccugugcucauuuuagaugagaauaaacucaacugacaauaaaauauagaaaccuuggaaaauaacucucagaacaaagcacuuuuggaaaaugggauuguuucuugaauuucgguuuugguugccaauaacaaaaaguaucaagugaaaauagcuuaguguacauaacagguauuuuuugguggcauuaacuaccuuuaaguugucucuccuuagccauuucccuuuuauaucuuucaucuguucgcuuacauaggcggucuacauacuagagaacuagauauuucuauuuacuagagaucuuaucacuagauaacuuuuuuaaguucccuauuuaacuaaguucccuauuaucuaauaggguauucucauuuuuaugaugauuuagugauggggucaugccauuuagaaauuucuuauauauuuuuucuauccugugaauuauuugaaaaguguuacauuccuggauuagacaauagaaaacaaagucaguuaauggaauacaaacaaacugaaguuacagagguggcuccaaucagcaaagauggaagaugacaggggucuguaacacagucuguuuauccuuaaaauuaacugugaccuucucucaaaagaauaaaauucuacccucaaggcccagcucaauaucuucuugcuuuaagaagcuuucucuaaaauagggccacugacauucacaaccucauggaagucuagggcucauauuuauuugaacauaccauuugacagugugauucagggaccacaugucucagaucgugcagagcaauuuuuuaaaacacagauugccaaguuucaccccagaccuacugaaucagaaauucaguaaacagugaccuggaaccugcauuuaaaugagcucccagugauucuucuacauauuaaaguuuaagaaccagugccucacaacuuccaacacagaucuaugcauguuugaaguucaauaaauaguuugaaguucaauaauuagugucuggggucacaggaaagaauauauucagaaggagaaaacaugagcacaaagauugacuguggcuuauuaggaaauaaaacacggagcagagacagagggagacuaaggaaagcagacauuaaagaaggaaagucauugcaauuacacacaaaaaggaucauagaaguaaucaaacacucaaaagaaaugcuagaaccacacauacacacacacucucuuucucuaauaggaaaaaaauauuaagauaaaacaagaguguuuuuugaaaaaggcaaauggucauucauuuauuuacaaaaucauaaaacugccaaaaaaugcugaaagagguaauugaagaaaauguuuccuuauuuuguauucacagaggaagacaaaacaguucuuucuagccaaggucaauuuuuuaaggaacgaaaugauuagauguucuugccugcugccuuuuacauuuagcauaguaaauuuaaccugaucuccuacaaagcuauaauuuauuauuguacuuuaaucccaauauauggaaauucaaguuuauauuuuuaaaaagauaaagguaaccguucacuuuaaaauguauuuauaauauaucaguguuuucacccccgccccccagaaaaaccuaaaaguuuuuaaggaauccacugaaagaauaaugagguauaacuuugcucuauaaagucaaccaaucacggcacacacaaaaauauguuaauuguacaaaauuuuguaauagagcaaaacuaaauauucaaucaauaaaaacccaguuuaaaaaaucuuagaaacuaacacaauauaauaacauucaaacugaacauucacacagaagaauauuuaaugucauugguaaauauugacaauauaaacuauuuuuuuuaaccucaaucauguugaaaauguugcacagaggccgugcccuguggcucacaccuguaaucccagcacuuugggaggccgaggcaggcagaucaccugaggucagaaguucgagaucagccuggccuacauggaaaccuugucucuacuaaaaauacaaaaauuagcugggcaugguggcaggcgccuguaaucucagcuacucaggaggcugaggcaggcaaaucacuugaaccugggaggcagagguugcagugagcugaggauugugccacugcauuccagccugggcaguaagagcaaaacuccgucucaaaaaaaaaaaaaaaaagaaaaaagaaaauguugcaucggaaaauauuaggaaaaaaucuauguuucagguaguuauccuauuuuuuauuuucuaaguuuuuuugauuuucaacuuuuaaaaaacauacauuaacuuaggugauuaaaaauauaugauuaaaauauuaaaaggccacaggauaauugcaauguugacuuguugacuuuuuuuaaaguucacuuuccauuacgaaauuuuucuuuucuuuuuucauggcauuucaugaaaguggcaauuuucuuagaaccgauuacaaaaaaagggaauaauuggacauuucuauucauguucuauucuauuuaacuugauuaaauuugcuuuaauguucgugauuauuguuaacgaucagagugaguaauuuauaaaauucuaguuugguuuguuucuagagaaauauauuuuugguuaccuuuucaugaugccagggcuaacagauguauuaaauaacggcugaaaauaacuacgaacuucaagaacccaacgcaggggccagggauuuuguuaaccaucaaguaaugucaucuugacuucaaggcuuuugaugccuaucaaguugaaaaacauauuuuuaaaagaacuuuuuuuuauagaaaauaggcauuuuugaccaagaugaagcacagccuaaaaauaaaaauaaaauaaaauaagaaaauagguauuuguucagguuauaaaguguguauguaaagaaaauugaauuugcucauuugagcuguaaauuaacuuuccagccuuaugcuuauuuauguuccgcuauacauguagauauuguuaaucugccuacagaaaagaaaaccuuuuaccuuuagcugauagaaucaccuaugacacagguaauccacaugcaaugugaaguuccaucucuuagcggcuaaacaguaauccagaacaagaucucaaaaacuuggugacucucauauugccuucagauaucauuuauccuaaauuuauacuacaaaucaugugucccuucuucaccuaacagcagcaaaaaugcauuaagcauuuacuauuugccgagcaguaagagguucccaggcauuaugucauuuguuucucauuguuucuucuggcacuuaaaaaggaauccauugagaaauccauuccuuuucaaaagauacauguucaagccuuagucuugauucccugcuuucuucugaauuuugccuuaucuuuuuuuuccuucucauaugaaaguaucuaggucaaaacuaugugcuuuauugauaagagcuucuugccaucuuuuuacacauuuuucaaaacagacaagugcauaggcaggcuugagaggcagaggguauuggggaaaaaguacucaggaacuugaaggugguacuagcaugaaagcauccauucuaugcucuaaugcgaucacuuaucugagcuaugcggagcuggagcuagucaaaaugccccacagugugauccagccuuggcuuacuguagcauuucuuucuccuuguaacauuuuaacacauuagauauaguguaagaagaggucaucagccaggcaacaacauccuuuccccaaggauccagugcacaggccugcuucucucgaagugccaaucucauucacgugcucaugacagcgccgugcauucacuguuccugucugugcuguaggcaguuaacagucgcauucuugcuucuuagaggugugaggaagaaagauuucaccuuacacauauuccaauuuucagccuuuuauuuauugcgaugauuuuuaaaauaucgguccaugacuugugagaaaacuucuuuacagucuugauuuugagugaagaaaaggaaacaugaacuacaaagcaaggcgguaaaccaaaaugaaauaucuugaaaucgaaauaaaccuccaaaauguaagcaaacagaacaugauagaguuaaacacgugauccagagcaaaagcguuaaucacaaaacucagcuucaaugaaccaaacucaaauuauccagaaccacugugaugauauauugguuuuugccaaaaacuaaguauuagguuuuuaaaaaauuaaaauuauggagauauagaagaaaauccacuaaagaacucacaaguaggagaaauaaggcacccaaacugguaaaccacaauuauuauuauauuuauuucuucauuuauuucagccuguuaauaauggcaguggcugcugccaucaugcuggcugcagcacggaagcgcccugggucugcacacuccauggagucagucuucugaguccggacgggagcucccccugccgcugcagccacccaaaucgcaacugcagacccaggucuuuuguuccacggagcagucaggagcccuacccaggagggcggggcuacagcucccuaaacuguagcuauggaucgagccucccugugcucuuguagggagugaggaaugggcaggaucugcccuuccaugugcagccgcagcugcuggacacccggcugcagaccugggcuucccacuccaggaagcaacuaggagccgggacaagugugggcccugccucuuccaaguuggcagggcgugagcucccgggugcagcuguggcugcccucccaggcacaggacuggggcaucucugcagccugcacccucgggggccccaggaaguaucccccaacccuguuccugcaggcucagaguugucugcucccacagccuggccucucuccucccagcgucugcucugaucuuggagugggguugggguccccaguaaggccccacccacaggccacggaauggcugggggcugggcugccagucccacugacaggaguggagacuucuggugccucuugcuggccgcccauggaccaaugggcaugcacuuccuccccucugcggucaauaaaagcccugggcucagccagaacagggcagagcauggccagaggacaaagaggacagagagaugacaggaccauccuugaccagcugcagagaggagcacccucuucacugagagcugcagagacgaccugccagcagagaggagcuaccuucucugcugagaacuucagagaccugcagagacauccaaaugacuugccugcagucagcagccacccucuccagggccuucucucugcuaagagcugaacacucgacuggacaaucugccuauagagcggagcugcccacuccucugagcucgucuaacacuaaauaaaccucuucuucacccuucaauugucugcgcaccucauucuuccuguaugcaggacaagaacucgggcaaagguguuuuggccacagagguuuccagccagaaaaaucgacaccccagaggucucguaacuuuaagagaccugacuagcccgcaugaucaaauuuuauuuucuuucaacaagcuauauuagaguggaaaguagcagugggaagaaacuuaaaacauuugcaucuggugguuucaacuagcagauauuugacugauccuauuaccaacauuucuccugcuuuucuucauuuaaaaaucuuaagaauuacuaucauaccgguuucauggcccuuaaagauaguccccaaguggggcauaucuaagaaaaguuaaaauuauuaaauauuucaaaauguacuaaugcuuccaacuggaaucaguauuugucaguagaucuuaagguuuacccugcaagaucuccacgugagauaccaucuacacaccucacccagccugcugggauuagcacacagugguugaaggugagacuugcaaaaacuacauccaccuuucucccaaacugcaugugauuauuuauuccuuaugauuagaauaaggaauguguuccucuguuugauuggaaacuuuugguuuaaaugaucacacaauauagaguauuuacaaauugagaacagcauagcaaccaagcugcuaugucuuauguucuaaaaauaaacccacaauuuacagauuguggcugcaucugcauucugaaacagcagguauuuuuugcucacuuaacuuggugacacuguguuauuuuuaacaucaaaaguuuaaguuuuuuuuacuagaaagugaaauuguggaaagaguuauauaaauagugacucacuguguccaagaggugcauuucuuuaugagaaaaguaaguagaauacuaucuugagaaaagaaaggaauauucaaggaggugguucuuauuccuuacaaccuggauuuaaagccaugcugaacauuaaugagaaacuuaauacuaucauucacugauguagauguauaaaugcaaaagguaguaaguguuaaaaaaaacuaacagaguuuuaaaagaugugagggaaaugaauuagcucauacauucauuuaaauaucuuaaaucacaaaaaauccaccuggcuagaaauaaaugaggaaagaaauuccaugauuuuccaaaaugacagagaagagaaaguuguucaaguuuuuuuuuuuuuuuuuuuuuuuuuuuugagacggagucucgcucugucgcccaggucggacugcggacugcaguggcgcaaucucggcucacugcaagcuccacuuccuggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccucaaguuuuuacuaguaugaauuucaguugguauaggacuucagaauaauguaugauuaauuaaaauacuacaaaccaugcauuaaaguuuaaucaccccuuucuauaguuuucauagauguacuuaauuugcugugcaaaccugaauacauuaauaaaugucuucuggaaauaacucaauaucuaguaaccacucaguaugcuaggauugauuaugcuucuacaugaauagcuaguaauaaaagaaccugcuauuagcauacaaagauauaauucauuuucauguuacagaauaauaugacuucaauggugaacuauaauucuauuuugaggauuuaccuuuuguaugccuucccaucauaaaguuuuuggacuuaacccauuccuaccagauuguguuagguauaaaaauacagauuuuucauuuacuuaaaaacaauucaauaaacucccaaugaguuuaaacuggaggaccauuuauucaaaagaacuccaaauacaugcuaaagagcaaaaaagaacccuccagguaaaagcaaccuauuggauauuccuuugaaauacaagucuauauaucucucugaauaugaauacaaagacacaccagaaaaccaaacaaccaaccaaaaacaaaagaaaacacugauugcucuugcuuuaaugaucuccugcaagcacacaaaaaguuaaccuucaugacggcccaagagggacuacucucaaacaugaaggcugccaccaguuacuacauuuugcgcugcucuauuguaaaucagauauagaagagauggcuaguuuaucuuuaaaagaaauuucagauauuaaauuuuaccaaaguuaguucuggucauccaagcgaugacuuugaagaacccagcuuuaggguuugcauggcaaagaaguggaagagugaccuuguugaucuuuaaguauuuuugcuucuucuuucagacuccuucuugagguuccuuccugaucuuaaaaaaaaggagacuuagaagccaaggucuuggcccuuucuuccaucucuggagguuucuguaagaggacaccaugcuugagagguggccauucugucuccaggagaagacaggugaacuggagauguacucugcucagaugcucaaccgaccuaagcuaaagugagcaaaacaaaccccucuuauguaagccacuaaguuucuuauucuauuaucaaguauuucuuacuccugaaguuaucaacuuuccagccagaucuuagcauauacauuccuuagccacuuugcaaccuagcucagucucaaugcaaaaagaauuugaaguaacgucugaaaaucuccugugucagcacuuaucaagcaccauccguauuugugugguuaaacaucuaugagauucugaauaaugaugacaauuccagaaagcacacacgaacuacaaugaacagaugaacgugguauauggauaucuaaaagaacaguaaaaaucuaauaaugaauagaacaaagacaaaaaugcacaugaaaauacuaaaaagagucccaugacaucaaagucaaucacaaauucugcuauuaauaaacugauuaucuauuaaugcaaagaaguucacaaaagaaaauaaauuuggcaacuuuaauauuaaucuaccaaaguggucugauaggagccacacuaagaaaucauuuucuacaauuaaaacauugauuuucuauaauguuuaaugauuuuacauuuuugaaacuuuauuaaauuacagagccuguuuuuuucugggaaagaagcccauaugaagaaaaaaguuuggaaaccauuuuuaaaaaaugcaaaagucacuaaaauauccugaaauuuuuaauaguuaaaggaaaaucauuuuuacugugcuugaaaaagucugcaaaagagauuuuugugucaucucuauaaaauuccccucggggauaaaaacaagcuugagaaguuucagucaacaguguaaacugggaguucguguuaaauaagccauugaaaacuacaguuuagaaugaaauuaccauuucagccauuaccacagggcuccauaguacauuuacaauaacagcuacauuugguaauaacaucauauucaaguaguugauacuucuuuacauuuuuaaauuuaacuaacauguuccaggagauucuaaaaauaaaaaauaaaguguguuuccuacucuuuccuuuuucuaagcccagauaauaauauggcaacauuauucaagauaaucaauacucuuaaaauuauaaagcacaaaauuacuaauaaaaagacugaacaguuaaaaugacauucugcuaagcccauuaauguuuaaaaauauuuuuaaaagauaguauaauuuucuauugcuccagaacuguaucuuagcucuacuuaacuuggugucuugccuuagugaagacagagagacugggaaacaagagacagucccauuucucagaggagggcacuuucaugugucagcaaagaaaucauucuucuagucauucaacagaaauuuacuaaaucacuauuauaugccauuccgaggcagaaauauucagaaaauuuauggucuuauggguaauaaauguaacacauacaaguaugcaugcauacuaaaacaugcacauacaugcacauuucaaaucaggaaucaaaacacugugagauaacagggaaggugcacaaggucugagagcagagcagagaccacgcccaguugugugggugucaaaaaaucagaaggcagcaucuaacauaagaacaaaaggaugcaugggugcuggccaauacaaaggaaaugaaauaggagaaaauuuucauacacuugugaaaugagagacccaggguuuuagagauugaaagaacuucuuucuggauugagaguggaaaucaagguaggagugacaagaaaggaaacaaaaagaaagacaaaugaggaaaaaucuuaaagaagaaugugggccgggaacgguggcucacgccuguaauccuagcacuuugggaggccgagacgggcggaucacgaggucaggagaucgagaccaucuuggcuaacauggugaaaccccguuucuacuaaaaauacaaaaaauuagccgggcguguuggcgggcgccuguagucccagcuacuugggaggcugaggcaggagaauggcaugaaccugggaggcggaguuugcagugagccgagaucgcgccacugcacuccaaccggggagacagcgagacuccgucucaaaaaaaaaaaaaaaaaaaaaaaaaagaagaaugugaauucuccagaauuuacaaauuagcaauauaugguuucagagaugaaacuacaauaacaauuuauuuuaguauaaguauguuucaaauauugcauagaauguaauuauacaacacauuggcuuauuauuuaucugacauucaaauuuaccugcgggucuugaauuuguauuuguuaaaucuggaaaccauggucaagagguagucaagggaagauuuauuuaacuaaugaacuaaguggcacaaaagugauaaugaauauauauugucccuguauuccagugccaguuggaauaacagaaaguucauaaugguugagaaacuuuaaugaugauaauuuugucuaacaucauauuuaagguucauaaauuccuuugaacaguaauaauuaaaaaugaagguuucauucaacaagaggucaagcaaaacuaauuuuuaaagaaaauauagagauuauuuauagacaaugugaaaagacucauuaauuuugucuauguggacacaugcauaugcaauauauaagaaauguauuuauacuaugccuuuuauuaugaagauaaaauauuacacauuucaacauacaaaaacacauuucauugcuuagugaggucgcugaguauuaaaacauucauacacacuuuuuaaaagcuaauaaauauauuuaucuuuuaaaaugcacaauaaacaauuguugauugucaacaucuucguaaaacaaauacugcaacauacaauuacauuuuacuacuagcuaacuuuagaagaaaacgaggcagacuaaaagagaauacacaaguugcauuuuuugaaagagaaugguuuauuuaaucguucaacaaauauuuaucaaacacuuccugugucaaagguacuggagauaaauguaugaauuagacuagcaucauuucuaucuacaugagacuuccugcuuauuggaggagucagagaaaauucacacacacaaauacacauuaauacaauuacaaauaguaacaaguguucugaaagaaacacagagaacauauaaaagguggggcaggaggcauguacuuuaaaaaaaaagaguggucagaaaaggucucugugaggucgggagaaugauacaugguagccgaaagauguaagggagccagucacagcaguagaagggcagcauccgcccaugcagagagagcagcaugcacaaaaauccugaggccagagagaacucaguauguccaagaaacugaaagaagggcucugagccuugagcauugugauugaagggccaccagcauuaggugauuacagcaagguacaaaucaggacaugguuaggaguguuaauuucauccucaaaugcaaugaaaaucauuugcagauucuuaagagaaugacaugaucaaauuaugcauuguuuucaaugaucacucugguugccgaauagagaauguauagguagugaguaagaaugggauugguggauaauuuggugacuguacugaucaugaugagagaggacuuguguuuggaaccaggacuuuagcagcagaguuggaaaguggcagaucugagcaaagaagagcuaaggagaacucuugggugugugacuagggcucugugaaaaacugugggcugaagauacaaauuugagugcugucagcauaucgaugauaauaaaagccauagggauggguagaaucaccuggggagaaaaugcagaagaaagaaaggaggaguaccaaccaagucggaggccugaacagcgugaacauuuaaaggcuaggccaggaaacaguaaagcaaagagaaggcagagcuaaugggggaggaaauaaaucccaugagauggugacaccaaagucaagauauccauguuacaagaaagacuuagaguuuuguuuucagaaugaaagaaaaaucacugguuaguuuuuuuauugcuugugcuggccuucccucuuuaguuaugugaaaauagggcuuaccuuuccuacuuucaaucggaugacaagaaacauauaagccaguguguugacaugccccaauccuuuaucucagaucucugacaagcuuuaauuaguuugcuaguugagagcuuccugcguaaauucaauucugucacuucguaggcauuuuccugcuugguguaauggauuuuuuggucuccaguucagauaauauuucuacauuguccaaaauaguuaaaagcaauuuuguuagcuaaccgcccccaaucuuucccuugaaauuuuugaauuagcaugcauaagauuucacuaauugucccauuucaagcacauaaagauaucauuauuuuucucugacauuacuugcauuuuaaauguaguuuuaaauuccauuuuuuucccauugacaguauuugcuaaguauucacugaaauggaaaauacuuuuaagguuugauuuuaucgcaaaacagaauaaaaggaagagugcauauucauaugcauuaaccauuuaauaggaaaaaauggguuuuaguuuaauauauucauuugaaugucaagggauuuguuuaggaauugugugcaugucagcaaacagcagauuuggacaaagauuaggcgauacaaacaagaaaagguacuaaauccuuacucuaaacaucuguuccaucuucugcuuguuuccuuuccuuugucuguuuaauguugguagcucuucccuucucaccuauuuauuuccuuacucucuucccuuuuacccuucacauucuccaugguuaauguacucccaacuuaccauuucaguauuuucaguccacauuuuccuuaggagcuucagaucuacucagucuaacucaccuuagaccuuuaauuaugugaucuaucuuuuuuuuaaucuguaagaaaauaaaacuauacugaccuuaccaaguugacacaagaaguaauggaaaugccuaggucagcaccaggcauuuaguaccuacucaagaaacauuagcaccuuuccccuuuuucucuucaaggauuaucuguggucaguugcauacucauugagaggagcuccuccuaagaccacagcaguaaugagugugcaaagcaaagauucuaaucaaaguaguuuugaaaaucuaguccagcaucuuagaucaccccuaugggugagccccaaccuauaacuuguaagaggaauaagagaaaccaggauuggugaacugggccuuaguaucuugugggggaaaccccaagaaugucuuuuuaaauuaaaaauaagauuuaaucaauugaguaguacauuaaacacagucauuucauagacuccucuuuuaucuucuacuaaauggcauuucucuuauuagcauucauaaaauaaucacuguguuuauacuagaaauuauuuaaaguaaauauuuugauggaagaauagguaguuuuaucaauguuaauauaguuagcuuguauucuaaaacuaucacaaguuuugcuacuuaacuuucaucucccuaggcuaauaagaagggaaaaagggcagaugucacauguuaacugugaaaauauuuaugcuaaacagagugcaaugauaccauggugcacuaaauagcugugauuugcaguaggugguucugaaggugaggaaagaagugacuuaucacauggcacagggugguguguguucaccaaacacaaaagacagggagcuagagcagucaccaccaacauuuacaucauacacagugauuuaauuucagcaaaacaguaucauccaucaaguugauguugauuuuaauugcuuuguuuuuguauuuuuuguacuuauuuuauaaauuucuuuauggauaaacauacaugcauuacauaauuccauguuuauacuaguuuaagcccacuuuggaauuuggggcuuuuuucccuuuuuuccuuauuuuaaaaggguucuguacauuacucaaguuucaaaacauggccaacacagcuggccauauaacagaaagaguaucacucccaucugguggcagacauuaaaauauugagcauaaucccaaaacagaaauuaaucuaauuccagacuacacacugguuaauuaaacuccuauuucagaaguggaaacacacuaacuacugaacaaacuaccagaggaccucaauucaaagaaguguuuccaauauauuaacuacuuuggguauacauaccuacuguaaaaacauagcaacuuaagaaauguuuauauuaaaauacaaaaccauauuuauaaaacaauaaaaauauuuuauagucuuucaauuaaauauuaauauauguaauacagguaaauuuauaaaucacaacuuaguuacuuauauucaaauucuguucacauauguauguguauacuauauauguguauguauuuaguauacauacacauauguauaguauacauacacauacauauguauauacacauacauauguauauacauauggauacacauacauauguguauauacauacauauguauauacacauauauaguauacauacauauauacaaauauauacuauauauacauaguauuuguauuuguaaacaugcuauuugcauacauacauacuacuuguguguguauauugcacaugcuauuuguauguaauauguauguauauauacauauguauuuauuugacaaggaaagaugcagagauuuagcaguuuucaauaaacuuaugauacuuaagguacuucauucacccccaaguuuuauuauuauucuuuuuagagaugggaucucaugcuguugcucaggcuggagugcacuggcaccaucauagcuuacuauaaccuggaacuccugggcugaagcaauucucuugucucagccuccagagcagcuggcaugugccaccacaccuggauaacuuuuauuuaaaaacuuuuaguagagacuggucucucuguuuuucccagguuggucucgaacuccuggccucaagugaugcucuugccuuggccucccaaaauguugggauuacaggcaugagccacugcuccuggccccaaaacuuucuuuaaagacacauaaucugaaauacuuuucaaggcaagaaaaauaucauucaaaaaugaaaauggaaccuaguaugaaaacaaagguaaauaaauaaaaaugggaaaauauacuuggaaauggguuaaucacacuauacaugaauuagaucaaacaucaaacagucuuaauggaguucacaucauucacuuuuagcacauccuuuaccuuucaugcaauuucaauucuuugacaaaaaugcaugcacaacuuaugguaacacuguagugccaccauagaaaccacccaaauguauucauuuaucaauaucaugaauaaaccaugaauuaaggugacucucaauaaugauauucucuggauagauggaaaaaugacuauaaugaugccucacuuuauauuuugauuauuucaguaaauucuugcauaaaaugcuauauuuuguaaauucuauaagaaaguguaugguguagcaaaaaaaaaaaaaaaaagaggcacuggaucaacucucagaaguuacuuugcuucuaaguguucauuuauuucuggaaucacuuucagcucuaaaucuucuaauuuuaaaucugaaccuccuguuucccugauuuuaauugcaccaaaguaaugaacuauuguugugacucacagaaaauuuacuccuguuauaauaaauuaaauauaaagagggagaaaauugauuacuuuuuaaaaauauaaaauugaaauuuuaacuuuuaaaauguuuuuaaaauauauaaagugcuaauuagcuugagauaauuauuaaauuuuggaguaaaauuuaaaaugguucaacuauaaaauucaccagagccuaauuucacagggccccacgaacauugcucaaaauaauacuggaaaugauuaaagagagcuccucuucuuaggagguuccuucccuauuuggcuacuuuagaacagcucauuaaacaucaaugauauucuuuuaucagauguuuaguguuauuuauuaaguuucagguucaucuucuauuaaaaaaaaagaacaaaauuucagcaaauucuauucugauggccaacucauuuugauggccagugcuucauuagcuuccugaaaagguaaagguugaacucucaauaacuucacagguuuccguuuuaauuaucuuuuguuaaugcaauaagcaaauccauguuuuuauaaaucuccauuaaaauauuuuuucuaaaaaguauccaaaugaaucccuguauuagauaugacaccuauguuuuauuaagcgaaagccauuaccauuaaaugguaaagaaaaugguacugaaagcaagccuguauuacuguaagcauaccauuaggcauuucuagucccuuuaaaccaucucacuuguccuuucaauacuguuaugauguagaaauuauuauuaucuauauuuuacauuuaaggagcgguuaaguaaacuacugaagcuaucaccaugaauacaggauuuacaauugagccucucugacucuaaagccuaugcauccacaaucucugcuccaaugauauaauaaauuacaaaacugcaaaugaaauuaaaacaucaauaugcacuucauacagaaaaaaauaauugaccuuauaauuuuucaauuauaaagaaauaucuuuguuuugaauucuuucccuuugaauagauacaaaauuauuuuuuguauauuuaucuuauaucuagcaaccuaaccucauuuucauauuacuuguaaugauauaaaaauuauaucccaaagagggcuuuauuaguccuuuuccaaaauuuacgugguacauuauuuuaaaagauugauccuagucuuagaauuuuuauuagaaauaacugcaaaauucuauuaaauaucuuuuuaguaucuaaugauauaaucuauugauauacuaaaguauuuuuauuuguuuucuaaauauaggccaccauuauauucuuuaaaaauccuauuuuuuuucacacuuaugcugaucuuuucauauacugcugggugcuauuuacuaauagcuuagguagguuucuuuuuugcauuuaaauuuucaaaugacauagaaucaucacugucuuuuucuuuaaaaaguuuuagaaugugacuuaaacuuuuaauguuaaaauuaugauucucuaaaaaaugauuaauguucucuauauuuuucuaugguuggaaucauuuaaagaacacuggaauaucagcgcuacaagcgucugguaauauucaacuaaacauccaucuguucuggugcuuuuuugauaacugaucuuuaaacagcucuaguauuuaaauggaauacuacaguuuucuacuuucucuugaaaauauuuuaguaauuuauuuuuuucuaggaacugauucccuuccuuuagauguucaugcuucaucacugcagagccacaccuaauauucuacuauacuucuuuuaaccuuucuuguuucgggauuuacuucugcuuucucauuuacaauuuuauauauucuuucuuuauauauuuuccauaauuugugccucaagggguuuauguuggccauuucaaagaaucaccaaauuuugaguuuauuuagccauuuuuacauuugcauucuauucuagugauuccaguuuuccuuguuauuaaauucuguuuuccuaguuucuuuugauuuuuuuuaauuccuuaagauucauaguuuauuuuuuauaucuuuucuuucuucaaagcuaucuaaagcuaaaauucuauacugaugauagcuuuuacuggaugugccuauuuuguuaggaagggaucuucuuuuucauuaacucauauauaguuguaauuucccuuugguucuaagaguuaucuaagaguguuucuuaauuuccuaauaauuuuuuuuuaguuuuguaauaaaguugccuaauaaauuguguuaguuuucuaauaaggcuucuuaauacagaaugugaccuauugaaacuccuuccuuuuuugaauuuauaaaaaguucagacacuuucaaggacuaaacuuccuaagaugaauaucucuucucauuagcaguuucaucauuuuaauaauguacaauuucuccaaaaggaaucuugccauuucaacauuauacaauaaauguauaggccucauauauaucauuauugauauaagguaagguuuugugggauauuuuaaauauuaaucaacaguaaauuccuaaugucauuuuucucaugacagugaaagaauucuacucagaaccccauaacuucuguuuuucauuucaucccuuauccauccuuauuagaaacugugggauagcuaugagcaaacuguaucauugcauauugcuaugaauuuuguucaauucauaaaguuguguguauguguuugauacaacuggggccuugguuugguucccucucacaguuccaguuugcuuuaaauguugaguaagaaguuuauagcuaauauucccuuaucucuucuuccuuauucauaagucuuuuaagggucaacagucacaucaguccuaucaugaagguuuaauuccaagggaagaauuaguuaguauugauaacacagucauguauuguagggaaguaauaucauaaggaaaaucccaucuuaaaauucacauauuuaauuuuuuuaaaucaguauggaauacuaggaggaaauauaaggcauauagauaggggacuggaaggauguuaagacuacuuacagugccaaaucucuguaugaaauucaagaaaaguuuuaagcauucuacuguauuaugugaacaaauaugaauuagccacuucacuguccuuaauuugagaaaauauuuuaaugcauugcuuuugucugcaacagaaggacuuuagauaacuggacuaaaagguauaugaaaaagacauuuuuuuuuuuuuuuugagauggagucucgcucugucgcccagguuagagugcaguggcaugaucuuggcucacuguaaccucugccuccuguguucaagugauucuccugccucagccuccugaguagcuggguuuacaggcauguaccaccaugccugucuaaguuuuguauuuuuaguagagaugggguuuugccauguucgccaggcuaaucucgaacuccugacuucaagugaucuucuugccuuggccucccaaagugcugggauuacaggcaugagccaccacgcccagccaaaaagaauuuuuaauuauaaucuuagaugugcuaugauuuagauaagcuaaauucaaggguaaaauauaaguacauaaauuuuaacacauaaggcucuauaaguguaauauugugcuagcccaugccuaauucacuuacauccuucucauaaauuacacaguauugguuuaugacuagcaugagccugaauauauagccaucaaacaggaaaaacagaagcuacauuuacucaauguuuguuuuauaccagguacuguauucuaauauuuucuuucauuuaaucuguaugauaaggauuaaauauacuuauagguacucuuaaguguaaacuccaaggcuaggaaaaggucacucacuuuuuaacugaucuggcagaaguaccuuuuagaccagauuguucugacuccaacauaucuccuaagccagucuuucucaagcuaucugugaugaaaggcuacauuuuuauuauuccaauaucucacagaccaauauuuuauaaaacacaacaucaugaauaauuuuaaaaauuaaacauauacaauuauaaguccauauuuuauauuuagguucagcagacaaaaaauuacugucaaauuccuauaaaaauuucaaguguuuauccucaauuuuguucuuacugcagaccauaaaaaauucaugaaucaacccuaggccacaggguacaaucugaguagguggccaacauacuuccuaucaguauuagguaagcauaucaguauuaggugcuucuugcagaaauuuuuauagaacuaacaagagucaugacugaaugaaaaauaugcaugaaucucauaaaauguucuccaauuacauacaaagauguccacauucuaaucccuggaauuugcgaaugugcuaccuuaaauggcagaagggaauuugcagaugugcuuagguuaaggaugucaagauggagagauuauccuggaauauaugagugagcccauuguaaucacaaggaucuucuucauaagagagaaggaguagaguuaagauucaucgaaggaaauauaacaguuuaagcugaaaucggagggaucuggagcauugugcuacuggcucuaaaauggaagaaggugacacaaacaagggaugcagguggacugcagacacugaaacaggcaaggaacuagaugccucccuagagccacacuggucuuagaacuuuucacccccaggacuauacaauaaauguguuuuauauuaagcuaauacauuugugaaaacuuguuauagcagcaauuggaaacuaacacagauuuugguacuuggaaguggggcgcugcuaguaacaaauaccuaaaaauguagacaguggcuuuggaauugguaaugagaaaaggcuggaagaauuuugagaagcauaauacaaaaauuauagaucuccuugaacagacuguuauuaaaaauaaagauuugguuaaaggcucugcuggugcagacucagaaggaagugaggagcaugguagagaaaaccauuaacuucuuggggaguaucuaaguugccauaaauagacguugguagaaauguggacauuaaaggagaugcuggugaggccucagaaggaaaugagaaacauguuauuggaaaccggagaaaagagaaucuuuguuucauaguggcagaaagcucagcuggacggauuccuacaauuacguggaagucagaauuacaagugaugaacuuacauauuuagcugaggagauuucuaagcaaaguguugaaagaguggccugguuucuucuugcuguuuauagugaaaugugagaggaaaaagaugaauaaagggaauaacuauuaagccaaaagaaaccaggacuugaugauugggaaaauucucaacguaugaagacuucaaaaggcuaaaauuaggagacgugcuuucaagaaagcauacuugaagagaaagccaauuuuaugucuggauaacauuuuccuagugccauauaaggauuaaaagguccaagugaaaggagggcucuuugaagugauuaggcauguaauucauggauccccucagccacuucaacagaggccaaaaauggagaugaaauuauccaagaaagaucuguagaggagccuguuuuucuaauggagugaauccuggagaugugcauaguaaaaucacaauguucuugagaauccuacaacggugguaacaccaucagcuuggacugauacaggcagaaaagggaugaaaugcacgaaggcugaauggacacucaaaauucuacagguaggagauggaugacaagaauaccugguugaaaauaugugcaacccuucaugaaaaugaagaaauaauucugaacuaggcccagagagcagacucaagccacagaggauuauucacaggccuugaaaucuaauggaauuuucccauguagauuucuacauuucuugagacuggcaacuccuuuuuccuuccacuuuaucccuuuuuauguaggaaugucuguaacuguuauccuaugccugucccuccauugcauuuugggaacauauaauuuguuuuguaguuucacagcuacacagauggagaggaacucugcucaaggacagauuauaaagagauccucagccauaucuaauuuaaauaauuuggacaaugagauuugggacuuuuaagcugaugaaauuuagaugauauuuugaacuugaguugaugcuaugauugguugagacuuuuggagaccugagaaugugguguaauguguuuugcauaaaggaaggaucugaaucuuuggggagccagagggcaaacuauggcagacugaauaaugguccucaaagcaacuccauccaaaucccuggaaacuguaaauauguuaccuuaaauggcaauagaagccuuuuuggaugugauuggguuaaggaucuugagaugggaggauuuuucuggaguauuuggguggaccgaacauaaucacaaggguccuuauuggaaggaaguaggaaagacaauuucagagaugggaugcaaggacaaaagcaaaggucagagugcaagagaaauuugaagaugcuacauugcuggauuugaauauagagaaaggggucaaagaagugaugugguuucuagaagaugggaaaagcaagaaaauggauuuucuucuagagcuuccagaaggaaugcaagccaaccaauaccuugacuaggauauuugaccucuagaauaauaaauuugugcugcuucaagccacuaaguagauaggaauuuguuauagcagccacaggacaauacaaaugccucuauuauaauuugguaaaaaaaaaaaaaaaaucacaucccaggaaucucagaguuaaaauagcaaagagcaugcuuaacaagacacuaaaaaauaacuuauaacacuuaaaaauccugaugauauuuuucuguugaccguuaucuuguggaaaugugacaacugugacaacacaaaaauggaacaucucaucacuccaacaggaugaauucugcuuuguaaacugaaagaaaaguaauucaauaaauauacauugcuguuguauagucaacacaguuuuuccuaauggugcauuagcaucugaaagugcaggaggaauaguuuauuuagacuuugaacccauuaccguaaaugagggcccccuucaccaaggaccccucuucaauuaucucaucaacuuaauuucaaaaaucauacaaauaguuuuuaaaagccacuucaaauguuauagggcaaugagauugcccauaguucaggcaguaauauauauucaguaaucggaaucauggcaugauuuauucucuuuuaaggaugucuaaguuuuuccaagagucaggauauaaucacaauagaaacacauauauaacaaagugguuucaaagcaucccuuaccuguguaacaaguggcuccaacagccuuuccacuguuagcguccggauuuccaaacuuuuggggucccauuucagaaugauaggugaaguugccgaagucaugcucccuaugggaacacauguaaucaguuagaaauaaucaucuuugaaauaaauuguaacuuuggugauucaaaauggguaaaucacugaaacuuagaacauacuggaagauagccucucugguccaaccuggucaaauuagagauggaaaaaccagaccaguacacugugagguggcaauguuggaaucagauuaaaaacugaggccuccucagcauacugguguaccuuaggccugcuuuugggacccaauagccacugaaauauuucauuuacucaacaaugaguaugcauaccuaucugcuauaugcugcgaaagguuucagucuugcuuucaaguagcuuaauguuuaaaguuagagauagccaaauaugggaacaauuaggucucagugugacacauguugugauuaagaaacacagagaguucuagaucccugaggaaucgccacacugacuuccacaaugguugaacuaguuuacagucccaccaacaguguaaaaguguuccuauuucuccacauccucuccagcaccuguuguuuccugacuuuuuaacauggaauacuaugcagccauaaaaaaugaugaguucauguccuguguagggacauggaugaaauuggaaaucaucauucucaguaaacuauugcaagaacaaaaaaccacacaccgcauauucucacucauaggugggaauugaacaaugagaucauauggacacaggaaggggaacaucacacucuggggacuguugugggguggggggaggggggagggauagcauugggagauacaccuaaugcuagaugacgaguuagugggugcagcacaccagcguggcacauguauauguauguaacuaaccugcacaaugugcacauguacccuaaaacuugaaguauaauaaaaauaaauacauuuaaaaaaaaaaaaagaaacacagagaggacuaugggagaggugaggaaggggcaucaaugucagucuggagagaacaacaaagaauagcaggaagcaaaguaaauccaccaaugauuacuagauguaggaaccccuuuauaacaaaaggcuacuuuuuucuucacaucauaacugaccccugagaauaucauacuccuugggacaagaguuucagucucuuaaauaugaaagacaucuucaaacuaagugccaauguucugaaaaauuaucugcuacuauuuacaugcucucugauuacucacuacauuuacauucuugucccauaaaaucagugacugauaagguuauuuauuucacucuaaagcaauccucucuuaccuaagaaccacugacaugcagguagcagucuccacacaacaagcaaaaaauuacaguucuagccccuccccccccccccccgaaaaaguauacauucuaucagggguuuguuucuuucaucaagaaauugcuaaauacauucugacaucuaaccacuggacaagcaaccuuagauuguacaaaccgaaucugaaugauuugccuuaauaccaacauaaaucaaaauguccauggcuguucuuuuauuuugaaucaauguccccauucaauuccaaccuuauaaaucaauguagaugauuauuucuacuagaauuaacacgacaaagaaggccuaucacaauaggcacuaguagaaaugugccucuuuacuggcucucuuacagcuaaagcuuuugcaaauagacccaaccaauuugcuucagaaaaaaaguagaggcaaagacacagugugcugguauuuuaacucucuccaaaugccauguuuuaaauaaacuaagcauagcaauccaaccauacagaccgauuuagauuuggguuucuucaucacaacaauaguuggcaccgacaugcugccuguccuccaaaaaccuaaaaacacuuuacacauuuuccauucacacuaccaacugccauagagcagcucugucauauacagaauucugccgcugggcaacacaccuucucaugccauagaaggauaaagaugccagaugcuuccugcagacacugggauaccuucaucccuacugaagccagaccuaccuaagugaucuuaguccaguacuuaugauacagcuguugcaaguuucuggagaaguucccugagaaccuuuuucaaacucuaauggaaucacaaguggcauaauaaugaugaugaacacggaaguucuguaggaaagcuggauacucagucauggucauuguaacaugauagugacagguacuggguaagacugcauagagaauuuccauuauaacaugggcaugcuuguagacauacgcugauagaucaaggaaggcacauaaaauuauagcuguuccauuauguaacuuuuaaaacaugacacaaaaaugcuggggaagucacaacagagacaugaaucuagcaugcaucaagcagaagugaaagauacuccuuaaacaaagaucucaagccaacuaugagccaagaagcaaguguuaguuagggccuucaguccugaaggucacagagcccuucuaacucuaaaaauaaaagaacaauaguucccagacaaaucacucaaauuaauuuauuccuuugaggaucaaucuuuuuagucauuucuugugacaaagguaaaauucaguagcaaagaaaagguuacacgguacuaauuuguugaaguggaaaaauaagucauagaaaugugaaaugcuguuuuccagccaugcuguuucugauacaguugagacuaaaaccaggaauucugucucuaccccauaaucuuuucaccauuuaguuuacuaaccacauuagcaaugaacaaaaggaguggugguggggaccgcaaaauccccaccucuaaacccaugauguugauauguaagauucccuuugaguugccucuaaggggcauuuuagcuucauaucagccauugagcacaagguagaagaagguaagaagcuccccugccugugauaccucagcugguaucaucuuuacaguuugcuguuucuagaaaaaguauucccauccugcauguccugcuacuuguaaaacauuggauugcuuucugcugucuguauuagaccuuguaguaggaacauuuuccuuaaaaaaucccuuggccaauuggaauugcaugaaaacagaaaaaaaagauucuguuccaggauaguaaucauaaccauagucuucuagaaucacucauuaaugaucuuugccuccagaguucuaguaugaacaaauuagggcagagaaggcaaaaugagucaaacauccucuagagcaaaaagggaggcaaugguagucagaaaauaugaauugaugauuugguauguggccccucugacaagcacacacaauaaggugacuccuaacugagaaugucaucccgccuguacauucaauauuuaugaauuaggaaggacagagaaaaugcacaggcauuugagguagauuggaggauuuuucaguaaauagucauuuccuucccauccucaccuccaugagaagagaauauuuuccuauuccauugcuauugagcuuuggcuagaggaauguuaagaaauaugacgugaguagacauuuggaaugugcuuacuuaauugggcuucuccucugugcuacugccuucugccauaagagucacauauaaccuacugguccaaaacgaaagaaggacacauggagcacaccugaauccgagcuggagcuggagccaagcacagcuaaguuaagccuagucagccaacucccaaccaaaccaucaacacaugaucaagaaguaaaugccugcuguuguauguugcaugccacugagauuuugccauuaacuauuaaucagcaauagcuaacacaaugguaucaaauagacuuuuguuuaaauugaagcccugccauucaaguauuuaucauauacucugggccaggcauuguucuagguagcagggcuacaucaguggacaaaaccagcaaaaauaucugcugucucggcagagaucacacucuggagggaaagacugaaaauaaacaaauaaggaacguauacugaaaaaaaaaacuugaagccuugcaauuuauuagcucugugauacuguucaauugccugcccuuucugagucccaguuuccucaaaugaaaaaucaggauaauaaggauuuuauaggcuuauugugaggauuaaauaacuuaauggauagaaagcaugcuaacauuccuggaaauauuuguuauuauuguuauguugucauuauuuucccaaauuuaaauuuccuuuuuuggcaauucuuuaucucugaaguaacagguaaacacucauuaaaauagagauccagauuuacacuccucuauguggaacaaccaaauugacacaaacgagaaaacaagagaacagaucaagugugcagucucacgagcccuucaucuuucugaggauaaaaugauauauagucucaaucccaucugugcaauuaauaccgucuguuugcccacaaaagaaaauuuacauaaagcaaauaaauuucuucucacugauuugaauucaaaguaaaaauuuauauuuuacuuaccuuugguagagagacuuagaauacagacuggauacagucaaagagugaaaaacaagauuguaaauaacaaaagacaacaaguuugucuucuuccauacagcacaauguuacaagccuaugagaaagcuccuagaauuugaauuucugaggagaguuucuucgugaaaaguuuuagcugggcacaguggcucaugccuguaaucucagcacuuugggaggccacagugaguggacugcuugagcccagaaguuugagaccagccuggacaacauagugagaccaauaucuacaaaaaauacaaaaauuaggugagcaugguggcacaauauuguagucccagcuacugaggaggcugaggugggaggaucacuugagcccagggaugucgaggcuucagugagucaugauugugccacugcacuccagccugagcaacagaaugagauccuuucucaaaaaaaaaaaaaaaaaaaaaagacagaaagaaaaguuuuaaauuguguuuccauguaagguaauaauacagcccaccugguaauacuucagauaauuucauauucuuucuguggugguaagaaagaggcacaggccaggaugcuaucagcuauuugucacucaugauagaaaauacaaaaccugacagaaaagaaaagucagaguaaaaugggcuccucugugaagcagccaaggguuaaggggcuuguuuccuuggacagcguccugauaaggagaaacugacucgaguucccauaccccaaggaaugccuucaaaugccagauauguuaauacaaugcaucguucacugcagaaauucuccuuuucaaaccuuccuggaaaaugucuuuggaauucucugccucaccuuucuaaauuaucuccauucuuucuacuguucuauagcagcacaauagcccaggaugcuuuccaguugccaaggggaccacccaaaccuguuuucucuccauggaacuccagcuucagauucuccucaugaauuuuuuucuucaccaauacugggcacuacugccaucaaacuccacgaagcuuuauuauaugauaggcuagcuuuaguugauacaaauucagaagaagcuaaugacugauaaugccugucauuaucauagagcuguggagauaauucaccuaccucugcacguaugauguugagucaguuauauuaccuaagcuucgguuucauuguuuguaaaacaaggauggugauaacauuauauuauuaaaagauuuguucugaaaaucgguagaauaauugcacaugcaaaagugaugguuuuucuucuuugcaauguugucuacaugaguaucauccuaaacuucaagacaccaauugggguagggaugccacuggaaaucucacaagacaagaugccucaaaaacagaucuauugagaaagggagagagaugagauaaggugaauuuucuaaauuucuucagcauuucaagaaucaagucugaaaacccugaauugcuuuuuucucugccuuuuuugcauuuauuuucuuuaaauuucuccccuauuuaggguaguuggcagguauuauuaguacugagucuccuguacauuaaauugcuuuuuccaugaauaaaauaauacuggcuuaaugaccuuuuacuauuaccucccguuuauaaaugagggaacugcaguauaaaacaguagagaaaguugcucauggucaucaaaguugaaccucagcugggugcgauugcucucgucuauaaucccaguacuuugggaggcugagaugggaagauugcuugaguccagaaguuugagacuagucugggcaaaaaugaugaaaccccaucucuacaacaaaaaauacaaaaauuagccaggcaugguggcacgcaccuguaguccuaccuacuccggaggcugaggugggaagauggccugagcccaggaggcagaggcugcagugagccgagaucaugccauugcacuccagucuggauguuagaguaaaaccucaucucaaaaaaaaaacaaaaaacaaaaaacaaaacuugaaccuaaauugucuugacuucaaaguuuaugcucaaaaccacucuggcguacggcuuuuagagaagaaucccaaggcuuaguuacacccuggagcuucugaaucaugggaggcaauagagguaaggacacaaaugaaaaaaagaggagccagccauuucuggagaaugagagaggaacaggcaagagagagauauaaaggaauguuagacuagaugagggagacaccaacagcagguguucuaaugcaugcguggggcucaugugcaauguggcugcuuuccuggugagacagagcaggucuugaggucaguuuccccaaguugccauuggucuuauauggugagaguaggaugcuggcuguaaagcugggccagcuagugagcaacacaggggccuggcaaagucaagagaaggaaccugugagauguaaugcaaaguagacaaaauuuuggcccagugaccucagcccccuuguguuaugcuuguaaauaucuuacauuacaugaucaaggggauuuuacagaugugauuaagguuaccaaucgguggccuuuaaaaaagggaaauuaucccgaauuaucuggguagaaccaauguaaucacaugaccccuuaaaaagcagaucuuuuggccaggcacgguggcuuacgccuguaaucccagcacuuugggagaccgagcugggaggaucacaaggucaggaguucgagaccagccuggccaacauguugaaaccccaucucuacuaaagauacaaaaaaauuagcuagguguggugguggccaccugugaucccagcuacucgggaggcugaggcaggagaauuguuugaacccgguaggcagagguugcagugagccgagauuaugccacugcgcuccagccugggugacagggagagacuccaucucaaaacaaaacaaaacaaaacaaaaaucagaucuuucuccuggcuaucgguggaagagaacaugauagagauacagcagaagaggauguaagacggguagggcuaagggaaaaggcagagggauuugaauugagaaaaacuuaaccuaguugcuagaggggccacauaaaaagcauggaaaagaauguggguggccucugggagcugaaugaguucuagcugaaagucagcaaagaaauggaggucucaguuccacaaccaccuggaacugaauucagucaccagccuaaaugaggugagaaguggauucuuccccagagccuccaguaagacacagcccuaucaauaccuugauuucagccuugagagagccaaagaaggagacccagccaugucugccugaacuucugaccuucaaaaacuaagugguaauacaaugguaaguuaccacauacuaaguuugugguaacuuuuuuacugcagcaauagaaaacaaauacaaauaguucucagauuuguguguccaugacaaucaccuagaggccaugcuaacacacaaauuccgggacccaccccaagaguuucugauugauuaggucuaggguggguuggauaauuuucauuugugacaaauuuccagaggcugcugcugcugcugguucaggaacgacacuuuaagaaccacuguuguaaucaggaaccaucaccacacaugccagugggggaguaguuauaugggauaucucugcucagaccagaugaccaguaagaacaauaccucuuuauuuggggaccauaaaacuaagucuuccaaauauguuaucugaacuaugauagugguucuaauuuucuguuaauuuuuuuuuugagacggagccuugcucuguugccaggcuggagugaagcggcacgaucuaggcucacugcaacccccgccuccccaguucaagcgauucuccugccucagccucccgaguagcuuggacuacaggcgugugccaccaugcccagcuaauuuuuguauuuuuaguagaggcaggguuucacuguguuggccaggauggucucaaucucuugaccuugugaucugccugccuuggccuccccaagugcugggauuacaggcauagccaccgugcccggccuguuaauuuuuuuuuuaaaguaccucuaggauguggauacccuauuguaagaggggcuauuuucuggcgcugaagagaguaucuguguguauguaucacagauaggagcagaaguugagggaaaaaaaaaaaacaggagaaaucuuuuguauuauuaucuacauagcccuagagaguaaaaggcauccuggcucccaccagaauacacucugccaugacaacaccauguccaaauggaggugggaggaagauggcauuugucacucuuccuggugcuaccauguguaugaaaauugccuggucuggugcccaaacuaugggaaagcccugcuucuuaucuuccuccauuaacucugcucaaucuaagcccauuuccccuaacuuugacuauaacgagguaguguaucacccaucacuauucuuuacacaauaaccauucaaagcccuggcucagugaacugagaggggauccaagauguaagcugcugcuguaauuacaggaucugucaccccuuuuauucaaaauugcagugauaugcaaugucuaaguaguuuuugcuauuugcagugaaggcaggguggggugcggguaucuccgcuauugcuaaaguguaguuaaguacuuuccucaaauauuacaauauuugcaagacuucuauuuuugguaaagccacaccuuuuaacaaaacacucaaagaagugcugcugaacaaaaauaucauuguaauaauuugaaaauauuacuguaauaauacucaaugucaaagcauaaaugcauauuaaagaaugcuuuaauaaacuuaucaaacuaguauacccuuuucagaaucuccuuuuucuucuacccaaauaaacaaaauguuaccacaaauauauauacaaagaaagcuccaaagccucaagucuuucaaggugauaaguuaagacuaauaauacauggccuagaguuugcugaguaaaaagaaauaaccauguccauaucucacugaaauggguuuuuauacuuacaauagcacacucauaaaauuuaauacuccgugccaauuuuauagaaauucaccacuccuggaguaugcuaauagaaagccaguaauuugaaauugaaaauaaaauuuaguaucugucaaauucauuuccuugcuuuucacugcauucacagucuuaucauuuuaauucauuuuggaaacauauacagacucagucuacuccuaaauuauggguuguuuuccacuugaguaucaaccuaugugauauucagguaaguagugcuuacucuauaugccaugugagguguccagugucccaccagggacccaaauugucuaaaugaaauuucuugaccaaagguuaacauuguucaacuugcuuauuauccuucagcaacaccgcaauucagauuuggacaguagauuccaacaacugaaaaucagaacuguuaguaugccagguaacauaucuugaggaauuaucuuuacaguccaaaaguaacuuuaaauuauuuaauaggaacauagcuucuuuggcaauuaauuuauucuuuguucuucugccuauaaauuagaauuucuugugcaauaacuauauaucucaauucuucaccagaaucucaacauuucauauuuagauuauagcaaacuagccaccaaacugccuuccuuuagucucacuguaaaauuuagcccaaacuaauuauccuaaacauugcuuuucuagaaaaccaaaacaacugcuuaauucucuuuuccaacaagccccaacuucucuuuguaaccaggcagauauuccacuuucugacccugcucuauuggaucuuauuucuuuaacaaaagucuucuacuccgaucaggguauaacauuacaacacaugguucaugccucuuccuaaaguuucuaccugggacacauuccuucucauccuccaauauccaaauacugacauccuuaaccugcaccuucauaaucccugaaucaagacuguauuuacagucaguaacagaagaucuuaacauuuuucuuaacuggcucauuaagaaauugacauuaguuugacauaacccaccagguuauaaacucauuaagacauaaauucaguuuuucauuuauuuucugucaucugcagcauauaguagagaguuaggcccuuccuaaauguuguugauuaaaugugaacauaugaaauauccaaauauuuauuuguacuuuucaaguaucaauucuuuaucuuuucaauugugggucuauuuccuagagaauaauagcuuuuaaaauaucuuucagaaauauuuuuagacauauucuuagacauauucuuuguucaguacuuccccagacccugaaaacacaugacaucuugguauuauuuagagaacguaauuuauacuucagguuuacuuuuauuuauguauuucagaaaaauguauaguacauauuagaacaggauacuagcuuauuuaacauguguuaaauuguaccccauuuuuguucaggaaaaaguaacuuuaagacuagugauauuugauucaguucugauuuccacaugaguaacuuugugcaaaguauaguucaagcugugcagguuagcccacaaugccuccuaggaagucuuccuucucacugacucaaauuccauuuugucuucaagacccucucaggucccaaccucuuuaggaagucucccuguuuacacaagcccuagugacuuuucuuuucucugaauuccacugguauuuagaacgacuuuaagucaauucuaauucaaauacaugauuugaauacaaguugccuguguuguuaucuauuugauuuaccuaaguuuugugccuucuaaugcauucaggaacagagaucuucacuuucacaaugauuagcaguguugggcguuacucaaaaugcuaugaguacucaugggcuugauucuuugccacguucaaguuucucucucucucucuucacacacacacacacacacacacacacacaauuauaguuaaaauaaaauacaaauguucugaugcaggaaggagauuuuuuacugaaugcaccacuuuagcugcuacagaccuggaaaaauaaguguucuucagaaugccuucgauauucucucuuuaaaauguagcuuuuauuuuguuacuagagucauuugaguuauacuaaaacuaauccuuuugaacccaacccaaauuuccuacaauaguuaccacaauauaauuugaaucccauucaacaaggcauugaaaacccucaaauuauaaccaagucauaaaaguuaauuuuuaaaguaauuuucauauuaagauaucuuuacuuaaaaguuagacaaccaauuuuaaacgaaaaaaaaacuuuuaaugaggacuuauguccagaaugcauuagaaacucaaauuuaauuacaguguuuucaaauaauuuauauaaauaaauuuuacuguuaaugcaagaaucuaaugcuucucaauuauuuccuugaaagccuuugauauucuagccaaaaagugcaaucccauaaugcauuguuaaauaaaaguuuucugucucuuccuucauucaguuauccauccaucauucauucaaugccuauauacuaacuacccauugugugcaagcuccaguuaggugaugugguaaacauuaaagugaauuagacaugcuuaauauugauuagagagaugagcuuuguucugacucaucagauuguaaaagcaggaaccauucaccaagagggcagcccucacagagugagcucugcuggagaugggcaucucugggaccauuaaaucauuucauuucaacuuggcauuuagaucaggcaguacccagguaaccaauggcagcuccgaauuuugaaugccuugauggagccauauuaaguaguuugugcaacagaguaaugggaaaauaaucaaugaucuuuugaauugcugccagaaaaaaugcaggaaacaaauuaaccgaggcuaugaaaaggcauccaaguaacucuaggauggagagucaaggagacaaaguaaucaugauauaaagaaagaaaugcagauauuuaagagcuauuuucaacaguuaagugguuauaaaaauacuuaauuaguaccuaaggacuuguauuuuuaaagcaagcaagcucuagugaauuauuauauuuuauuuuaaaagucgaaguuaaaucuacacaugugcuggugaguuaaaaaggaauuaaguagcagaaacucauagggaaauuauuuaagccuaauagaccugccucaugcaguuuccugugucauagacuggcugauucacuggaucuaaaguaaacagguacugcuuugcauccaguggcagcuacaguaagugggaaaugauucuccugcauuuaauuagccuugccccuuucaauugaauuaugagucuugaaaggucguaacacauuacagcaauuauauuugccuagaagucuuucacagugaggacugacauuucagcacgaguuguguucagcauauauacuccuuaguaaaucaucuuauuaagcuuuugauacagaaaaucauauguaaaaaagagaaacaaugaccuagcuuuccuucuggucaucugugggauuuaauuuuguauuuaugagccaaaaaauaccucagguaauaugcuucuguaaauauaaaaaaaugaaucuacauggcuuuaggaaaugcaaaugaggccuguuaauuuuguacaucucaagauaguauaauccuuuccauuaauuucaugauauuuacauuucaaaacaacaaugauuccacugaacacuacaggucauuggccgaaguuuauuauaauuagcaauaguuucauguugcuaucaucaaguccugguaugcuggagugaaugggaguccuuggucaaucacugagaguaacaacauguguaucagacagucauggaggaaggcacuaacacaugcugagcacgcugucucagcaguuacuguucaggcacuugaccuauguuaccuuaugcuacauucacacugcugucaggucaauagugaugguaucccaauuuuacccauaagagaacuaaagcuugcuuuuccaagguuaauggaauucaaccaaaguuuguuccaaaucuguuuuuuuccaagauaaaauucaacuuccugaaauguguucaauauguuauuucacgggugguaagucugguggggcagaacaggcuaagaaaauacacaacuuuaagaaacuucacagaaauauguggauaauaaauccuuaagguauuguuuaagauaacugaguguuuaggggccauuuuugaccuuucaguuugucagagaagacuagaccuuucuagcaugcaucucucgauaccacucugaagauaaaagugaacagauaauggaucuaauccaauauggaaggucuuuguuuccugaaaguucaaaaaaccaucaaauagcucaauacaugugggcaucagccauaaucauucuaaggugaccagaaucaccucaggugacacaucuacaaauguaugaaacuaucuguuucuacccuuaacuccuucccaauugccuuauuagaagauggggcuugguucuucuuuccugcaucccaucccuuccugccuccugacugaggccucacuccaucaacuguacucucucuucuguauccucaauuucaccccuuuucuggcucuuuccaggcaguggaaaguauuguccaauuaaaaaaguaaaauacaaaauaaaaaauauauauauccuucaccauccuacuccucacuugacauucuauacuucccuucuccuucacagccuagcuucuugaaaagguagucuauaaugccuguuccacuuccucacuaccuacucauuccccaucccacaacaaucuggcuucugcccucaccauuccacugaaauuagccuugcaaaauuacaaaugaucuucuaguuacuuaauucaauggacaucaugugauuucccagcuuauauacuaaaauuagaaagauguggagaagauuaucauggucucggggaagaaugacaagcaaauuuaugcagcauccaauauuuuuauaguaugaacucauuuuguuauauauagacauauaucuggauauagagaauauauuugcauauagaaaaagucuggaaagauaugcaucaaaauuuuaacaguaguuaugcuggguggugggauuuagggugauucuuaaauuauucaaaauuauucaaaauuauauauauuuuucaccuuauacauuuauauauauucuaguuacauaaugaucacacauuccuuaucuaaauaaaaaucaauaaguaaaucauuucaacauacccaggguccucuuuaaaaaucuuauuucaucacacagaaauauuuggcaauguuguuguuucuuuuguuucaagaauagaauacuauacucuccuggucuucuuguacccucucaacaucuuauucuuagucgucuuuguacccucuucuucuagacccaugcccuucaugguucugcuuuggacuccaucacugugucucaucucugucugcucuagugcccguguggucucauucaugucagugucuuacuuuaugcugaaaacucccacaucuauuucuuuucuuuuucuuccuuuuuuuuuuuuuuuuuuuuuuuuuuuuuugagacagagucucacucuguugcccaggcuggagugcaguggcgcgaucucggcucacugcaagcuccaucucccggguccacgccauucuccugccucagccuccugaguagcugggacuacaggugcccgccaccacgcccggcuaauuuuuuuuuuuuuuuguauuuuuaguagagaugggguuucaccguguuagccaggauggucuagaucuccugaccucgugauccgccugccucagccucccaaagugcugggaugacaggcgugagccaccgcacccggccccccacaucuauuucuuuaguucagcgcuccuuccugguuuccagccuccuauauacaacgaguuacuagguuuccaagcacuucaaaaugaacaggcuuaaaagugaacucaucuuuccacaacauugguccaacuccuauggucauaugucaaugaauagaacuauuauguauuggccgggcacgguggcucaugccuguaaucccagcacuuagggaggccgaggcaggcagaucaccugaggucaguaguuagagaccaguuuggccaacauguugaaaccccgucucuacuaaaaauacaaaaauuacccgggagugguggcgggcgccuguaaucccagcuacuugggagggugaggcaggaaaauugcuugagccugggaggcagagguugcaaugagccgagaucacaccacuacacuccagucugggcgacaagagugaaacuccaucucaaaaaaaaaagaagaagaagaacuaucauguaucaagcccugucagaaaugcaguagucacuuuuuuuuuucuuuuuucugugacggaguccagcucugcuagcucugccacccaggcuggagugcaguggcacgaucucggcucacugcaagcuccaccucccggguucacgccauucuccugccucagccucccgaguagcugggacuacaggcgcccaccaccgcgcccggcuaauuuuuuguauuuuuuaguagagacgggguuucaccguguuagccgggauggucucgaauuccuuuccuuucucuuaccuccuacaauaaaaaguucaagucuaauaaauucuaucagcaccugauugacaaccaucucuucuuucucucuccaccaccgcugccuuaaucaaggcucuuggcauuucuuuauuagauuauugaaagacccucuuggcuggucauguugccuucaaucuuacccccucugaucccuucuuuaucccacagccauaaugguuuucgcaaauaugaaugacaucaugucacugucccaucgaauagccucugaugacucccacugccuaagaauaaaguucuaaauauauuaacucucccccagcacagucccauuacucaguauuugccaauugugcaucuuaagucuuugugaacucuagaccuagugaacugcuagcuguucuccagacaucccauauucucccauuccucuaagacuuuucuugugucauuccuucuaagccuuuucuugugucauuccuuccauaggccagcuucaucccuguuuuccuuacuugacuuacuuugguuauguuuugagacucaacucaggcaucacuucuugaccuguucagugucacccucgaucuuaagaggacauaaugcuucccucgacugugccauaaaucucacucuacuuuaauuguucggcucauucucuuucacacuagaauacuuagaaccuugaggauggaacagugaauucgauauguuugaauagacacauaaguaaaugauuggcguuaaaggagcagccccuucgaaauugaaccaauuacaugagggagaugcaaaacaaggucuccugaacaaaccuauccacaaaauaguacaggaucauucuccaaaagucacuacaauaaauagaguugcaucuaaagguauuuguucaaccccaguacugacagcuuaaagagcucaacauucaggaauagcuccaggaaaaaaaaucagaacuugagucagagccaucccuacugauaagcauaaggucucuugcagccauuuugcugcaggaauaccaugauguaauucagggaacacagcacaacaaagugggaaaaccagcuucuaguuauaucuguaccucucagccaccaaaauuauucucuugauaaaucaccugcuucaucugaaauuguagggcagcaacuuuaugagcuuaaaagaauccauuggucuucuguauucccuuuagcacuaaaaugauuacaucauuucagugaaaaugcuuuucagcaaauuauuuucaacucuuauaaaucaaauucuauacuaacuauuuaugauuagcuagggcuuauuugagagguuccuuaaggacugcugagugauguuuguuaagcaaguccaaacacucuuccauauacugguuuuacugaccucgcagaaggugagcauaggcucugcaaugguucuucaauaauagagacagaugaccugucgucaguggguagaaugcuggucuacacuccucccucuccucugaccaaagauagguggaaugaaacgcuuccuuugacuagcugggaaacagagggaaacaaauggacucaaauaccgucuaagacagaauuacauuugaguguaauuuaguuaacauggaaaacaaugcaucucacagacaucuuucuucacucaccucucaaaggccccugcucuuucuuacccguguaaucacagcucauucaaauauuggucaucuacagguauggguuaaggcugaaucugucucuccaggcuaaggaggagaaucauaauuauccuauguaaaauaugugggauauuuuccuuuuucuauuuuuuaacucaaguuuggagaugcagccaaacaagaugugauagcaacucagcuggggacuucugggaaagguuuuccuggacuauauggacauguccuucuccccugugcacuguuguaacuaggcaugacacuguugcaucuaucugugacuaugaggggagauaauaacaacugagaauaacagaguagaaggauggaaagcgcuuaugucucuuaugauaaucauacauuaaauuaaucaagacugaaacaacccuaucuuuagaaacaggaaauaugauuucauauuauuugcagccccaaacccuccuaacuaacauaauacgacugauuguuuuucaaauagcauucuuuguguucagacugauggacuugugguacuuuugaaggggcuggcaaacuacagccccccagugaaaaucugcccagcacuugcuuuuguaaauauagucuguauuggaacacagcuacucuuuuucaugccaucuauacucuaguugcucuuucaccacaauagccgaguugaguaauugagacagagacuguauggcccacacauaugaaauauuuauuauccaccucuacagaaaaauugugcugguuccuauucuguaucaguggauuucagguaggggcuguauuacucacauaauauuuuccaggggccauuuuggaugccccaaucauugugaaguaauuaaaaggccagcauuguuuaauggagugcaauguuaaagucccacauaacaacggauauucucacucaaaauaccaacagugauccuacugagaaauacuacucaccaucaauauaauaacccauaacauaacuugggccuugggccacgugaauuguuuuuuacauuauaccuacuaccauggaaacuguaggucugguagauuuauuagcauagguaaauggcaaucuagaagcaucgcacuauaaaaacauuauugauccucauuagcuauuugucgauaaacagaagaaauauauuuauuguuacuuuagaggauuuuuuuucauuaaaauuuucugguuaggaguuuauuuagacaaacugaauauuccaaguucuguucuaaaauacaaguugucuaugcacacaauuuuuaucgaggaauauuuuauuuuauacucaugaauuuuaagugcuuuuuacuuucaauuuuacaaagugguuauaauuucuuuggaguucuuuuuauguuaagcaguauuuauaaauaaugauaauuauuuuaauuucugcuuuaauaaaaagaccuuaaaauauuuuauuggaaugaacuaaauuagccucacuacggaauuuggauuugaaagaaagacaaaagauacacaucuaaaaccacugcgacuguuucacaaucaagaaauauauacccuuaaacacacagucugcuaaaauauaugaaaauuacagggauuuuaaaauaugugaauugccuuuauagaacaauuuaaggaauauaaaacaaauauauccucagaggaauaaaccauaaguccaaaaagucauaauucaccuagaacuguuauuuuuauccagagcuuacaauacuaauaaccacaaaagcuagggugaggcaugcuucaguaaggcaguggggugaaggagcaagugguuugguccuuuagaaaauaaucaaauggcacuucagcuuuucagauuuuaacuacguacuuuuuuucugcuuuagaaaguacacauggugauaagaggaaggcacugggugcucuaaacuucguguugcaaauauuauuccaguuuauucaauccuuuuuuguauacugagaguuagcauuucuuguacauguguagaacaaaaccaccuaaaauucuccuaaacauucaagaaagacaugcccccagcuccuccgucuaaaauguguauguuacauauacauaugacaaugaguauguaacaacccccuggcuauucagcaaacaauaaauacuaagguacugcuaucugggagacgcguagugguuuguugacacugggcagugucaaaguucuuucagcgugggccccaaguaugaaugauccucacauacgaaaugaguguaaaauauuccucaguuggguauacagagagcacugauucuacagagcaaaucucuggcagagagauuacauacaggacuacacacccaaguagacaacuauuugauucaacagacagauaaaaggaaaaucaagaguuaccacauaaggcguucaacauuaugagcacagcacacagaggaaaggaaagccucuacaaugacugugcuuagaggaaaugcugagcaaauauacuugagaaacucuaggaccugauaaaauaaaugcaacagaaaaaaaaaaaucugccagggggcacauaaaacaggauccugugaucaaugagaaaagaacucaggaagauagacuucacaacgaaggguuucaaccagcuuucagugaagaaguggaaauuguuaucuaaauauacuauagacuuuucauaccuuaucuauguaugcauacaauaaaauguacauuauucucaguuuagagcacaaacucagccauuuccaaaaaacgucuguguugguuguagaaauaauuuguaggcccacccauauagcauuguuuaaugugugugucuggaauugauggcuccuacgucaccaucgcaaucaagguucuaauguccaaaggagcaaaagauacauaaaugacaccacguuacagcaagacuuggaauuacacaaaauaauucacaauacuuggaagauaauuuuuaaauacaaauaaacaaaguuaucccaaauucuucuuuuagcacuuuggguauuuuaugcuggacuauuuguuucugugucuuacauuauguauacugaaaguuuuucuuuauaauugggaccaguguacauacuguuuuaaauaacccauuuuuuuggucucuuuuacguaaaucagauuucaaugucaauguguguuucuguguauaaauauagcuacaucauagacuauuaauauuuaauuuuccugcccaauucucugauggucucccacuguuuuaaauguucuuggaauuuaauucauagaggugacugaguaacaacacaaagacgucagugccauuaaaagaaguucuguuacucauaguuaggaaaucugugacucacaguccccaacaggagggggcaugcuaugccaugccuuacagugccacuuggggaagcaccugggugagugaaggagguggcaaggggagagcaggucccagggucuauauugugguacggcaggaaggaaugaauaaagcaggguacguuaagugugagcaagguuaagacuggacaaucugaauacuuucagcaugcucugagcuguagaggugauccuugguugucugauaccuagcccuaggaugauacagggcaggggaaauauuggcuuaggguguaagagaguuaaagaaaggagcuggcugcuuugacuaggauaugggcuuuggauuuguugguuugcaagugaaaagugugcucccaggcaaguuguuugauacauuugggaaucugcuagcucuggagggacagccucuccagguucagcaaggcacaaagaugccaagauaucacaaaauucagaaaauuaaaaaaagucauuaauauacccauacagacagcugcucacugagcuucccuucagcauccuuuccucccucucccaucuaucgagacacugagaucauaaugccuguggcaccuggcucccacucuuccuuaccccaccuacuucugguguuauuccugaugaucucagcauccuugugucugaacaucugaccccccaaccugucugaccuuuccuuugcuccaucucagccacacauucccauaaccacauccuaggccuacuaaucaccagaaccagcaccaccucuagagagcaguguuugggaccacgauggcaaagguuuaacugcucagaauuuuuaaaauaauuaauccacucaaagcuagguccuacuuauguuaaaaaaagauggccaauauguggccaagaucaaaaagccugaaagagcuucauuacagguuugggaaacagauacucuuuauucuucuuuauauucuuuauaaacaggugcuuugaagauaggucaguaccuuucaaaggcaauuuuauauuaaccauuaaaacauuuauuuucauaucuuuuaacuuagaaauucaacucccagcaauuuaucuugcugauaaaaacuucgagaaaaaugauucucacaauauuugggaaaccacacgagggccaauauggcuggcauaggggaagcaauaaggggaagggacggaaguggagaguggggaaggagacaggaggucucaaaaguccuaggaaagacauagauuuuauucuugguacaacaggaaacaaauguggaauuuucagcaguagagcuaaaucauuaaucagcuuacaucaauuuauauuuuguccuccacaguguacagugccacuccaaaggcagaguugcuaagguuucugaaaaauuaacuaaagggucagggcugcaaagaguggugaagaaaaaggaaagaggacaaagcuucugcccaugagacaagagucacagaucgugaaaaaugucuaaaaugccaggaauaaugugaccuuaagaaaauaaaauuaauaaagaaauugcaagucagaggcugucuuaaagcuauaggagaaaaauuccauuaaggaaaaauacuuuaacaacaaauuaagugauauuuaugguugaaauuagaaaucagcaggaaucaucugaacugcuucuauggagcaaaaaauaauucaguuaggacugcacauuuaaauguuauuaauucuuuaaaagcacaaauacuuaccuauccuguaagauuuuuauaaugaaaaaauuucguuguucuacaguugacaaccggauauugaagcaaauucaacaauuuuuuuuuuuuuuugacagucucauucuguugcccaggcuggagugcaguggcucuaccucgguucacugcaaccuccaccucccagguucaggcgauucuccugccuaagccuccugagcagcuaggauuacaggugcccgccaccacaccuggcuaauuuuucguauuuuuaguagagauggaguuucaucauauuggccaggauggucugaaacuacugaccucaagugaucugcccaccucggucucccaaagugcugagauuacaggcgugagccaccaugccuggccaaccucaccaauuuuuuaaugugaguguuuaaaaaacacguuucuggaauaggaaaaaccuaggucaaaauaccaacuaauuuccacaacacuuucucaagaaugacuuaaaaucaugaacaugcuuuuuaaaauaaauggacuaucuauacuuauguguacacuauaaaaauauauauucaaagaauauauaugcaaagaauucaucauuccacauuacaacacuuaugagcuggcacagugucaaggcuauucaaagaacaguauauuucccuucuuaaauaaaaugucuguuuugaaaaguauacuuuuaaggcaucaaauaucaaaaaccuugaacaaauaauguuaacccuuucauaaaguguagucauacacuaaauaaauuaaaaauaggcuccaagaauaaaucaucaauugaauauuuuggaaccaggauuuacuuaugcaaaagauuucuaaaucauuugaagcacaaaagaucaacuguaaaaguacacuauaguagaauuccauuuuaauaucaacaacagaaagcaagauuuaauagagauguaccaugauauuacacgggagauagaccauauguuuauaaagacagaauugaauuuguguuguauuuucaguuaugguauaauggggccugaaauagugaaguugcacuuuaugcguucuaccggaucugucacgcaggacaggaaaucugcuaugagggggaggcagcaggcagcacucugcuggguauuuacaggaugacaaucaacccacaaacuucccuuaaaguagcucugagaacauggaugccaaccccuccauggcacauuucaaacagcucugggagcuucuucacucccuggauucguacuguaacuuguuuuaugguuuauagcaaaauagaaauaacugaagaagcauaggcuuuuagaguuggaagaaaccugguucuuugacacaacacauucucuauuugauggcaaaaccaucuacaucuuuagaggcaagucuguggcacuugccuucauguuuggguggugaucucacaagaugauaacgcuaaaacgcauucccagagcugucgcccauaaagcuuuuggcuucagaagcugucuugaagagaagcagucauuuaggaaaugagaccuagggacaggcaaucuuagaaaccugaaucuaauuauacuucuuuaucagagucacaaucgaugcucaggaccucagcaaaaauuauuaaauauuuuaaauuuuauugcuauaauauuuccauaagcauuacgggaaaauuguuuauuuuauuaguuucuauguuccaaucucccugcccucaucucagaccccuccaagauaacccaccacaccagcuccacagcaaccauucuaaaauauaacgcauguugucucgcuaccuaaaacccuucagcaauuccuccucucacacaaggcuguuuagccagcccuguuuagcuuuccagauucauauucauuucccacaccuuucccaugucuucuggacucgacacacacacacacacacacacacacacacacacacauacacacacacacgcacauacacauacaugcacacacacacacucuaaccaucuugccauuccuaguguguuuuugagaaaaagaacuacauaugcacaggauugguuaaauuugcacagagcaaguucaagaaguuuggaaaggcuuuacuaucagaguuuggugaacggaacggugaaauuucaggcuaaugguacaaacuugguuauuuuucucaaaaacauaccccucucacuuccccacccagugguccuguuuccuggcuaaccuguaauuaggguucaacaucaaaaucacacaucccuuauccugaaaagccuugccugaagccucuguucugggaccacugcucccugguugugccuucugcaucuaagaacagagcacauuguaucacaguugauaucaggaccaccucagaaggccacuugcuguguucuauuaaaaugcugcuugaggaacugauuccuaggauucaacuucugguuagcagacauaaaagaugauguagcucccacaggagauuuguuuucccaccauuuaaucaaaauagaugaaguagaaaauggucaaacgucccuccuaacacacaccuacaaccacccauucccucauucccccaggcuggaccagaaaaaaauacagaccugcuccaagaagcccagaaaucuccaaacccugccagagggccaaagagaaguuucuguagcuggacauuuaacucaucaacuauuuacaaagggcaaauaccuaccuugagcuaaacauuauucucaauuuaucuauaucacaacaccaaggagguaacuggcagguuuaugauuguugucaccuugggaccaaaggcaaaguaucaguguuuucacucuuuuugucacugggcccugaugcagaugauucuuucuuuaggcucaggagcaagagccuggagucugucuaguuccuggucuuuuugcugcuucuccaggccccucuccucagcauguaaacacaccugagaaacuggaugcuuccaccacagcgacuuucaggcuucuuuaacuccaacccacaguaagaaauacaauuuccauguuuuaucugcaugcgaggcauacaaacauguagcuauaaaacugaaacaaaaguuucauaguaucuauuuuuucagaugcccuuuucuauuauauucuaccauuguucacuggacuucagaauauugauuucccagcccccuaauaugacucuacacucucaaacauuuauacuuuuuguagagacauguaaguacuucauuuuaaacuauuaagagccauaaucuuccaguucucaauuauagcaauuaucauaucaccauuaauucaucaaaaauugagucucuaucacauuauaaaauguguuccuuuuggucagucccucuuuuuuccuguguaucucauuuuauaauaucccuucaccaauauuaggauccaguaacacugaaguacuuaaaguucuuuccuaucuuuugagauuuuauucaaaaaauuauggaaaaaucuccccaaauacaucaauuugcacacucaugccaauccuucuggacuugguuucuaugucuuuugugugccuuccaugacacaucuauaauaaaauggagacuccuacuaugcucucaacgcaguaucacaaauugccacuaagagcaaaaaguaugcucugccauaauuauuugcauaccuggcuccggagacaagaacaagggauacauugcugagcccaugcccagacuggggcagaaaucccuuccccuacaucacacauacccacacaguucugcucacaguacucuacacuucucaccagaacugaucuuaauuauguuuuauuucuaucucccuuucuaggguguaagcuuuaugauuacagaaaugguauuccccucaauuauucucacagaaucuggugcagaagucaaagcacaauauauuuucaaucaauauugauugaauuaacuaauuaauucacucccaccaccaaaaagaugcuggugacugagcuucuacaggccagucuugaaccagcaacaucuauuugauugcaguccuccccggcauuaccuuuccuaaaauaucuuccaaauugcagagugcuuccugaauugcccuucuuuucauauuuuccaaaccuuucuccaggcuucugucaucaacuucccucaccugguaaacauucuucaauuuuaauuacaugcuuauugugggugaaucacaacugaaguaaauuuagaaggugagcuauuugcuaacuguagacaaaaaaaaaagccuaaugaaauucaaauaucuuuccuugcuuauuauccaaauuuacagcuguuugcauugcucuucuuaaugaauauagcuauuuucauauccagcugaauccccaaucucuuucuugauucucuuuaaaacugucuauccucccucagaaaucagggauaaucuuuucuuuuuuuaaacuggauuugcccagaguuucucucauauuugcuaugaaaaagaaaauggggaaguuccccugcaaaguaguagaaggaaaguauagaaaacagggagggaaagagaagugggcaaggggaaagagagcaugggggaaagagagagacuguacgggggagagagagagagagaugucuuccauaugacucaagaauucuuucgcaaaugauuuaagucaaguuacagagcuacuacucaguaugagucugagacagauugguucaguggcaaagcucugauaauuuuacuauaauauuugaaacaaaguaaaaauauggugaaauuaauauccaagccauuuuauguauuuugaccuaaacugauuuucuuuuucuuccauuuacaaucaugaaaaauucaacuucucaccuaaaaauaauauuuauagacuguacacaugcaucugaauuuuguugcaugcuuucuuaaaauaggggacaucaauuacuugagauuacaggucuauauucuaacaauuugaauaauuuucccaaucuccauuuggaauccggaaagcacauauauaaaauugaacuaugauccaugugaugaugauaagauuuucuacaucaaauucaugcaaauugcaggcucaugucauuucagaaugaauucucauuaccauuuacuuagaagggaagaaauagauggagugaggugggagagacucuuacaagagucuagaucacaaauagcugauuaguguggcuguuuccucuccaaagugacugguuaaaauuguacaugggcuacuugccuuuguaaguauauaugcucaagucuuuaugaauaacucuggcaaaccucccagaaaaaugcaguagucacaacugcaccaaaaggaugagcacaaauuucuuccuaccaucagaaaauggcaaauaacauauacaagguucaaaacauccucuuuauagaggacagcuaacauaccauuauuaucucuaaaacaaccaaaggcuuuucacuguaacaacaacaaaaaaugcugauagacuaugauucaugaacaucuaucuccuacaaucaccuccuaaaaggcuuauuuauuucaaaacaauaaaaaccuauuaagauaauuuuguguuguuuauugaacuccagugucaguccuagcucuuagucaucuguuggugaguuauagaacuuguaagcaguuaaaaacagaugcuauucuaagaaaggauaaugcuuccuuaaaaauuaguuuccuucuauuauucaaaguacuauauuucaguuuuauauauacaugggaguaggagugaaauauccccuacagacucggccauuaaaaaucuccauuacaguccucucaacuuuacuccauccugccgcucccugcauccagaaggcugggaaagaagaaguccgaggccagagggaauggcuaagccaugagagagagaaugucuaggucucugagucacccucaugaaccacuauccacauccaaauagaaaggccuguguugaacucugccuguguugaaauaaacugaaguggugugaagugggguuaucaagcauuuaauuuucccuaaccuaauauaccaauugaaaaauaauguuuucuuaucauugucauuuggaugguuuuuuugcuaagaggaauguuaaaaacaucauuuaucaaacaaccauauuuucaucacaauuuaaaggaucauuacauaaauucuuccucuuucuuuaaagcacugcuacuuuauuccaagaaguuaaguuccuuaucuguucacuguuucagaguuuaacgcauccagcuuaaaaggauugaaaauuuucagcaccauguaaaaggaagaaauauagagggggauuuuauaaacaaaacaaaucaggaaauuuaggaaaauggaaggaauucuggacacugguucacucaucauuucuuaaagacugagguacagccagucuucaaauucaaauugaacuuuggugaagaucggaaugauugaaaaagacuuugccauucuuaaggagccauuuuuguuuguuguuuuaacuaaaguauguacuuuuauucagauuuccucaguuuuugucuaauguccuuuuuuaguucaggaucuuguccaagacacacauuacauuuagucuucaugucuccucaggcuuccgaaggcugcuacaguuucucagacuuuauuuuugaugaccuggacaguuuugagaaauacucaucagguauuuuguaaaaugcuacucaugugagaguuuucucaugguuauacugggguuauggguuucugagaagaagaccauggauguaaagugccauucucaucaucacauaaacuguccacaugguucaucacuacugguguugaauuugaucaccuggcugagguaguguuaggcaggcuucuccacuauaagcuuacuccccaauuccauacuguacuuuuuagagguacucgcaaugugcuuaaggaauggagaguuaugcuacauaaauaauuugaaauuacucugcaugggaaauuugucuacuuucccucauuuauuuauuuauucaaucacauauuuuuauuaguauggacuuacgauguuuauuucauacuuggggcuauaauccaauacuacuguaucguauugcucaaauugucccagcuuugccacugggagauuucgcaauugacacuuuuuaauugugucccuuugacauguguccccaucauuguguuugauuauauccuuacuuuauggcaguacaagauguucuagguugaugauguguauugcuagcucaaacccauggacaauaacggagaauaagccauuucuccgaggagccugguuccuuuuauuggagaaugguauuagaaaucacguucuggaugcuagaggugcucauugcuucuagguccucucagcuaagggagcacagaaaaacauguguguagacuaacuugcauauauacacgucuaaagcauaacaguuuuacgaaaauggggugaaacuacucuuccugaaaugcauucaucaucccacagggagacaccacaguagccacuuuuacccacacauguaaaagcuuaaugcagucaaugagggucaccacugugauggguacuguguucaucaguuuaacaaaaggagguuauggggagggggcuuuccagauauacuccuguaaagccugcagaccagugauuugucauccacugcugaucaacugaccugcuugcugcugcacaaugucauuugcacaaagguuaauuuuuaacgcucuagucagcuuuuuauaaccgggauuuuuauacuguccaagucuggcucccacaugaugcccucagcuugcccccauaggagugucugccucuauuauacauaucuauggcugccuaugcacaccaaaacuguaggcucuaaccuucagaucacaucaaacugauuugggcacugguuuacccuaguuuucuugagggucaacagaaccucccuuagccagccuuuugcuacagcaugaguccugacucaggguccuuagaaaucagucuauuucuguccuauuuacuauuuaguggguaugucugucuacucagguacccuguuagggagacaucaggcacuaaugugaacaaggccuagguccuuagcccuaaauaaguuaugugccacugaaggugaaagacacauauguguaugaguggagaggguggagugugaaggauuucacauauaaggugacauuucacuauccugaaaggaauguaggaauuucccagacuaaaagugagcaggacaaggagguuccagagagcaaagaacacuaaaaaaauauagaagcagcaaugagcccaguguguuugagcaugugaaggacuucagaagugggacccacaggcgaauguacagggaagggcaguuggagagcuggugggggcuaguugaaugggcuuccuaaacugugaucagaaguuuagaaauuauucuugggugaugggcagcaacuaaagaauguuaagccacacacugacauaaauagauuuuaugcaacucuuggccacaaauauuuuucugcuguggcuauagccucagaccaugauaaagaccuuagaaucuaucgcacucauuuuuuuuguuugcuuaauaagaaaaagucacauaguuuagcaucucaugcacauuguugauuguagauuguuguaauuuaaacagaaaaaaagcuacgaaaaucugaaaaucaagugagucagcaagaaaaaaagaaaauacaaggaagaaaaucugaguuauuuuucuuuguaagaagaccgcauaucugcaguggggaaaaugugaaugucuggauuuaaguguaauauugcugugcaaauuuucggcucucauaugagaugcaucuacuuuuaagucagugagauuaugagaugcaaaaucugucugagccauuuaauaugaguggaguggugauggcagcagagguauuuuucaugacacacguauugaaauaugaggcuauauucaaacacuuucuuaaugacaaccauucacccacaauauuacggagcuucaaaaaaggcguuuuaaaaucuugagacucaaagcuugugucaaaacaacucaagguauaaaguaaaaaaucaccguuucaaaaauagcaaaguaauaaaauuagaaauauaaaauaaauaaugucagcagggcccacugcagccaagguuaaacaauugguucuucaggaauuauuaaagcaguguaacuggaugucaugcuaauguugcuauugcaggugccagcuuggacagcuggagcuaauacucaauuaucacucuugguggaggaccuggccacugcagugcccuucuucuuucuuagucuuuucccaccaccacauaaggauagaauaugcucauucuucucaaaacugauaauguaugguggccacugcuuuuguuuguuugagacggagucucacucugucacccaggcuggagugcaguggugcaaucucggcucacugcaaccuccgccucccaggcugaagugauucucuugccucagccucccaacuagcugggauuauaggcgcccgccaccacgcccagcuaauuuucguauuuuuuggagagacuggguuucaccauauuggccaugguagucuagaacuacugaccucaaaugauccaccugccucggccucccaaagugcugggauuacaggcgugagccaccacacccaaccugggcaccacuuuuaauugggugcucauacccauauauuuaugugcauaucccuucucuccaauagccuggcccaugacugaggcaacuggaaacuucuacagugucuaauauggagauggggccuuacauguacuccuacuccauuuucucucaacaacuuaauuuucugauuagaguuuuuggauuucagaauuacgaagugaauauagauagauguucuggcacuuggagaagaaaacaagaaugggaguuggggaauccacugagggacuuaaguuacagaaugggacuuggagaagaaaaacaagaaugggaguuggggaauccacugagggacuuaaguuacagaauguaaauucaaaaucucuuaagaggugacccuguuuccagagcuucagaggcuuaucuugggcauuuuauauuuuuuucucaucagugaacuaaaccucccauuaaaaaaaauaaauucuaauaccucaaaaguaaccucaaacuagcaaccuaagagcugcuucggaacauggggccagaaggagccaauccaauaacuaucauagaaagagaagugcuuguaagagaaagaaacaggaugaaaaaggaaaagaagagaaacauaaaauugcaaacaaaacaauucaaaguacacugggaaaauucaccuccaaggaaauucaaaugaaagacaaucuucugaaaaacauuuaaaaauaaggacauggcagacuuuguugguugcugcccaaagggcaucaccccuuccuccaugcuccacugggcacugggugcccagccuuggcacauggcuuaacgcuggauuaccuaaccuauuccugcuugccaaucauugguccaggaguguguguguuggugguggggauggggguguccaugacucagcucucugaucaaagagauaugagggaggauuuacuggagccuaauuggagguuuucgucucugguugcagagacaaaauccuuuuugacaauaaccuuacuacuuugaacccgacucucauaugaggacaggggaagaacugagacagacauuuugugaugcauaagaggaaaaaucaccaacacccugaaguagcgagggaaagaacaagaggaggcugggcaccugauggccucagggaaucuuaaaucuggucugcuuuccuccaggcuucucauuaacgaauaggaaaagccucaugauuuuaccacuauuggucagguucucuuauuuguaaacaaaacugagcuuauaaaguauauguuugaaaucuucuaaaauauucagaaauaugaaaaaaauucauaaagcaaaacuaaugaauuauguaacaaaauggugaauaugaaucagacauagcuguauauuaaacagaaucacauagacaucugaaaaugaaaauguaaucacuaacaaaguagacuggauaaauaacaaaccagagagaaagugaacugaaaagaagauauggugaaacugaucuaagaaauaacauagaaagaucaauccaugggaaauaagagaauuuaaaagacaguaaauuaaguagcuaacaagaauuccaaaaaugaaagcagaaagaaauauugauaagguauuuccugaagaggaaauggcugacaaauuuacugaauuaacagaaaauuuaagaacugaaaauauuuucacuccuaggcagaggauggggaaaaugcaaaauaucauagauaaaagaaaauauuagggcugaacgcgauggcucacaccuguaaucccagcacuuugggaggccaaggugggcggaucacgaggucaggaguucgagacuagccuggccaacauggugaaaccccgucucuacuaaaaauacaaaaaaauuagccggguaugguggcgcacaccuguaaucccaguuacuuugguggcugaggcaggagaaucgcuugaacccgggagguggagguugcagugagccgagauugcaccauucuaccccagccugggugacggagcaagacugugucucgaaaaaaaaagaaagaaagaaaauauuaaauauuauuggggagaaagaagaggggaaaaugacaaacgccaaaagacaaggauuaaugguugcaaauuguauaggggaaauaaccacuaaccuaaaauucuauuaguaaguuaaauucucacccaacaguaagggcaaacggaaagucuuuucagaaacauauaaacauaaagucuuuucacugaaauaucuacuaaacaagaagaaaaguauaccaagaggaaagguugagaugcaagaagcaaugagaugaaggcaggcaugaguaggugaauuagaaggugauggguggauggaugaaagacgaggguggcugugguuuuuacaaugguaaguuguagcuucuuuacaguaccuguucuuguuuuuauuuauuuaacaguuaguuuuacauuuuaauaguaauauaugcuugcugugauaagcucaaacuaaaaagugaauaaacaagacuaacauucuuuaaauuucucuaccguaaauagugacuguuagcauucuguuuuacauccuuccuaaagucucuauagauuuuagucucuauagaccuuccuuaggucucuauagauuacaauaugcauaaugauuuuaggauuggaaggugucccuaaauguucuuacuaugcauauugaauugcuacuuuaaaaaaaaucuagcaauaugccaaagauacacuuacaagccaauaauuuagaccuauccuauuacuuuuaacucaugcuuuuaaucaugcauagagcagauaccacccaacuuguucugcaaauggccagauaguaaguauguuuggcuuugagagagauaagaucucuccugcaacuucuuaaugcugguguugcaugaaagaagccacagaaaacaugucuccuuccauucagcucuguucuucucucugucacagugcuccucauaacacaggcauggcaaggcacgcagcuauggggaagcugacuugaggaaacacuuaguuugggcgccacagaauauuuuuacgugauuuacaagucaccugcauguaucacugaguuacuguuauacaacuccccaacacgcacauacaaacacacacuucauauugcggaaaugguucccaggaauucuccucacacccacuuggugaacucaucagugcugugacaggaaggcacauggccagaggucuuauaguaauaugaauaugccuuacagaagcauguguauagugggaaaaacaaaguuugagagccagaaccuagccugaagaaaauuccuucaaauaccaaacgagcaaaacugcaaagauguaguuuucauugacccucucgucaaaacaguucccuccuaucaggaauauacucuuucacacaaccauguauaauuuaaaagguacuguauuuuuauuaucuuauugacagaaaugaaauaauaaagcucaaauauuccacuguaaaugaaauuuuagaauauuccaguuaaagcaagacagcuauuauaaacucuuaauuuguuuguguagaaaggcuaacuuuuuuagucauauuuaaaugcauuuuuucagaaaacugaaauuucaggaaaaaauuuaacagauauuaaaugucauaaauaugaguaaugaaaucaagucaaaagaaauuauucuaacauuuagaaauaaauuauaccaaauuuguuuucagaucacacuaaaagcugaauuuauuaagagaaaaauauucuuuaaauaaaaauaauuaaaaggcacuuugguuauuugguaauccaauuaaagaagagggcuauauauagacaugcugaaaagaaccuuaaauuucugcugauuuuacacaacauguuaguaucaacaaauauaaugaaaaauauuaaauaugcucucucgucaaccacacacugguuaaugagucucauaaguucagaguauuuagggcuagucacugcucaggaaaccuugaaauucccugaaaucuaacagccuaugcaugagagaaacuuuaugauagagguuugcccaaauuugaaaacaaucucauaaauucauauacauuaucaauuaucaguuguaaagcuaaaagauauuuuucuaaacugguaauaaucaaaugcacacacauacauuucaaucaaccaugcuacaggaaagacugaauugucauucuauuuuuucuacagaaaauauaaaaacauuuugcauaugaagagauaaucaaagacuauccaaaaauauugggaaaaagcauaacuguguuguuagguaguuaauaagaauaucauuuuauuuucugaaucaugugacauuuugacacuguaguacuuagagcauuuuaaaauuuauauuuuggugugacuuguucucauucucaauaaauagucacauuucugccuauuucauuuucauaauucuuaucauuuuucuuaaagauggccccaaauugaguauuuuuccaggucccacaaaaccuggaucuuucccugguuauaacuauuuccuaggaaaaauuauugcagguauugaaacaagauuuuuauaucaggacuuuugauaauaugucagaaaaacgauuauguguaacauaauccaaagugauuuccagucaggagaauucacaaacacaaaaauaccucugagauuccuaguuauuuucuuauuuuuuaacaucagguuauccuuauauuuugacuaaccaaaaauaacugauauaacauauuaaagaggaguagagaaaacugcuuuuaauguugaguucauuuuuuauugugcuauauccaccauauuuauauuuaaauauugcucaguauauuuaaaaaagaauaucucaauuugauaaauucuagagcuacgucacaccaaauugcugauuagcagcagcagagccuacuauaaggagcacaggcuguggagucagacugucuguucuugaaugaauccaggccuagcacaugcuggcucacugaccuacggcaaguuauuuaaccugacuguauuucauugcucaacuauaaaacagucaaacaacaguauuggcaccaugagauugguguggagacuaauuuagauaauccacgcacgcauauugcuuaaaaaagaauauguagcuggauacgguggcucaugcauguaauccagcacuuugggaggccaaggcaggaggaucacuugagaucaggaguuggagacuuucugggcaacacaacaagacccugucucuaaaaauauuuuuaaaaauuacaaauuguugaaaaaagaauaugauacuuaguacauccuuaauaaauguuaguuauguuauuauuuuuguuauuguugauagucuauccuucucuaucauuucgucuucaauuaucuaaaguaguugaagaaaaaaggcaagcacagaauucauuaucugaaagagaagcaaacacaggaagucuguuuuaaacacaguagaucugauucaauguuuucuauuuuauuauuauuauuauuuuacuuuaggauuacagguucuugaugacaaguaguagaagucucuuuaaaacuuguaguugucucuuccuauuucaagaaaaaaaaaaaaaccaaagaauacauccacauuaagaaaacucggaaauuaucuaacugaaacagcaugguaacaaacguaucccagaaaaucugugagucugauaugacuuccugagguugaagcuucacuacacauuuuaauuucacaaggagagaugacucagcauguauguaaacaaacaucguuuuuuuuuuuugcucugaacguuaaacacuguaaacauacuaauggugauguuuucaucuccgcaaaauuggguggccaagucaagcauuaccaaaauugcuuacugaaaguauuugugaagaaaucuacugaagucaacucguaagagaggagaauacuaugaaaauaauacugcacaaagcauauaaauagaaauaugucauuuucaaaauccuuaacaagaauaucacaauuaacuucucuaaacaagaaguuuaaauuuuucuuuugaaaaaucuaaugucaggcuuccuuuuaaauacuucacagaaaauguaauuuuaaaaaaauuaaacuaugauuuucuuugguaacaguuaaaacagguaagcaaugccagguuuucuuaguauuuuccaacuuugauucauucuuuacauuacuagguaauuuuucuauuguuauuagggauaaauuauguuguaaaaaucaagucauacaaaugcuuucuuucuaugcuuucauccccacuaagucuuaagucauuagaaacagagcucauucuacaaucaucugaauuuuuuuccccaaaacaaauauaaauuaaaauucaauguaaaauccucacucaggccaaagaaacaacguuuuaaaaguguacggcauuguauucuaauagugaaucauuggggcuagaaaauguagauugccucuauaauaaugagggaggauucuauaaagcaggugcucauauguugguuuguuaugaaaacagucuaccuaacaaugaaacauucaaaccuccaacaaaaacaaagccauggauuuugauuuagaaacuguuguucaaaaauauuugaggucagcauuuauuaaaauucaaacggcuuccccuuaguugacaguaaagcaaauaugaaacauuugcuaccuuauacaucugucugauauggauuauucuaaaagaauacuggagcacagcaaccauuuggccagcuucugacauacagaauauugcacucaggauucauuuguucuaccaggacuggcuacuaacccauaaacuuguuuuugaaauaaucaaacaguugcuaagcucacaacauuggcauaguggaaaacgugcugagcauaaagcauucuagaauaacauuuagugcacaguaggugaaaacuuagcagauucugcaggguucuagcaaccucguuaaacuuuggugucuaugggagaucugcuagaugggagaaagguaacagagaagugacauuuaaaacagcccuucugugucaacguacuggugguugauccacucauuuaacucauaaugacaucuguauuaagcaagucaaagcgugguuauuuauaucgcugacuuuguauaauucaagcaaaaaaguaaaauucauuuuuuaaucauaucaagguuuaugcuucucauacugcaguaaaucagaugacuaaaaaagagacuagcugcaggaaagcuaggcaaacagaacacgcauugcaauuuccucuucaaacaucccugccucagaacuacccugcccaauaaacuccuccgcaguggcucaccuuaaacauuccucugcacagaagcccuuccugauccucagacuuaaaagcagcaauauguuuucaggauacguucacuguagaagcacuuuucaugaauuuaacugaagaguuauuuguuuaauucuguauuuaaugccuuccucgugccuagucgagagaccccuugaaggcgggaacugugucucucuuuuucauuguacgaaagcucugaacagagaaccuuccuugcacagguagguuggcuuccuuguagagcuggaugacuacuaaaagugaaaugugugaaacagaaaaguauggaaguuaacauaauaggagcccagcuacauuccugcccucaagauuaaaaagauauuaagcgugccaaauucauuuuaaacauuuuaaagaaaaauauuucagaaauaacucaaguuuuaucccaucuuuucuuccuccuuccaaagaguaacugcuguguucacuugguggguaucaacccuguguuuuagaguaaaugauuuccagcauuuaaucaacgcuuauauauucauuagguauacauacuauuguuuuguuuaucugaaacuuucauauaaacuuuuguacagaugguuuacuacauauauccauuugcaguaaugauuacgguuuugagauuuaucaguguuggauaccuacagauccauuccauuguuuugugugcuaguguuacugguucuucaagaucauauuguacucaccaauuugcauguuacuuuauuuuuaacaacuuuauucuaguacaaaagaacacauuuaagguguacaauuugauaauuugcggaacaugagaaaucagaaaaaaccgcaaacaagauaaugcacacuacccucaaagguuuccuugugcuccuucaucauuuccucccucccuccucucuccaucccaucccuucuucacaggaaaucacugaugcauuuucugucaaaaguuacuuuacauuuuccagaguuuuauaugaauggaauccuauaguauacaugugcauucuuuucaucugccuucuuucacucugcauaaucaucuugagagucauccagguccuuaauguguaucaguaauucauucuuuucauugcugaguagcauuugugacaugcauuauauauucauuuguugaugaacauuagaauuauuuccacuuauuggcuauuauaaauaaagcagcuauaaacauucaucugcaagucuuuguacagacauaugguagauguauauuuaacuuuuuaugaaaguggaaaacugcuuuucaaaguauuuuuaccacuauauuuucccaccacugugggaaaggggaguagaagagaaacaauucuccacauucucacaaaaacuugcaguugaaucgguuuaauuuuaauugugugaauaguguguaucacauuaagguucuaauuuacauauccuuagugaccaaugaugcugaaauuauuuucacgugcuuauuugccauauuuauaucuucuuugauagaugcuauuuaaauuauuucuccaaauguuacacuguuuuguuuucuuauugauuuuaagaguuccuuauacauucuggacauaaguucuuuaucagauauauacuuugcaaagauguucuuccagucuauggcugaucuuuuccuucuuauaacaauguccuucaaaaaaacgaaagauuuuacuuuugaugaagcucaauuuauugauuuguuucauggauuaugcuuuugcaguguaucuaaagucacaaacauuuucuccuaugucuccuucuagaaguuuuagaguuuucgauuguaucgucagaauccauuccauuuguauuuaauuuuguuauaugauguaaguuauggauugaagaucauuuuuuuggcauauggauauacaacuguuccggcaccauuuguggaaaagacuauguaugcauccugcaaagaacugccuuugcaccuuucucaaagaucaguuauccauaugcaugcuggucuauuccuggacuuucuauuuucuuauggucuauuugucuagcuugaugucaacaccacauuggcaaaauuacuguaccuuuauaguaagucuugagucacauacuguuaguccuccaacauacuuauaccuuuccgaaguuauuuuugcauucccggauccuuggaauuuccauguaaauuaucaaaugagcuugucaauuuuugccaaaaaucuuacuggaauuuugauugagauugcauauaaucaauuugaaguagggugaacagauacagcacauaaaaccauaagaugaauauacuuaugcuaaaaauuaguuuuuuacagaaaauuuaaaaauaacuggcugucguauauguuaucugacagccuuaauucuaggagaauuaacagcuuaauaauauuggguuuuuauaucuauaaacagaguuuauuuguuuacuuagaucuuugcuuuuguucagcaauauuguauaauuuuugguguacagauuaugcacuucuuuugucagauuuaccucuaaguaacucauauguuuugaugcuauuauaaauauuaauuuuuaaauaucaauuuuugauuucuucuguauaccacaacuucgcaaaagucacuuauuauucuaguagauuuuuccuugaucucaccagauuuuuuucacagacaaccccauuuucuccaaauuaguaugcuuuccaaucuacauauuuuguuccucccuaauuauacuggcuaaguccuccagaacaauacugaauaaaaucaaggagaguggacaucuacauuuugucccugauccaaaggaaaauauaagacucaucugucuuuuaacauuaaguuuauauuugcugaaggauuuauguagauguucuuuauugguugaagaaguucccucuguuucuaauuggcugagaauuuuauaaugaaugaauauaaguuuucaaaugcuuuuugcuguuccacuaaggugaucauguaguuucacuuuaaucauuuuuaauauaaugauuacacuaauugguuuccaaauagcaaacuaccuuugcauuccugaaauaaaucucacuuagucaugauauagucacauuuuucuauauuguuggauucaaucugguacacuugguuuagcauuuugcauguuauguucaugaagaauacuuccauguuuuguauuuucuuuugguauuuucacccuaaaauuuggcaucagguaaugcuggccauauagaaugagauaaaaaugacuaccuuaucuucaauucuguaagauaauuguauagaacuggcaucauuucuucuuuacauguuugggcaaagucaaugauaaagccacaucacauaaaguuuucuuuguaggaagauuucuaacuacaaauuccuuuuuuaagagauagagagcuauucaguuaucuauucuucuugagugagcuuugguagucugugaccuugaaagaauuuucccauuccaccuaaguuguccaacuuauaggcauauaguuuuucaaaauauucuauuauccuugucauaccugaagaccuguucaugaugaaaccacucucaugccuccugcugcuaauuugaaucuuucuacuuuucgccccccucuaagucuggcuagagacuuacuaaauuuaucagauuuaauuaaaaaaaaacaaccugccuuuguuuucacugauuuucucugcuguuuuucuuuucuaccuaacugauuuccacuuugauuauuuuugcccugcuuuuguuuacauuuaguuuaauuugcccuucuuuuucuagauuauuaaggugaaacugaaucaauuaauuugagauauuucuuuuuucuuauauguguugggugcugaguugcccuucuaagugcaauuucagaagcaucccagaaaugugcauaucuuguguuuuaauuuucauucaacuuaaaacauuuuauaauuuccuuuuagaguuguucuuuggcacacggauauuuacaaauauauuauuugccacccaaauauuugggggauuuuccagauuuguuauugauuucuaauuuacuuccauuguugucugagaauauacuuaucaguaaucaacuuaccaguuuaugccuuaaauuauuuuuauuuuauugaaauuuguuuuauuuacuacaauauggucuaucuuggaaaauuaccuguuuguauuuggaaaaauguauguauucugcaguuauugaguggaguguucuauaaacaucgauuagguccaguuagcugauggcauuguucaagucuucuauguccccgcugauuuucugucuacuugcuccauucaauuaagcacuaagauuucugauuauaauguaaauuuuucuguuucuccuugcaguuccaucaguuuaugugccacauauucuaaugcuuuuuuaugaggugcauauguaaaauguucuucugaucucuauaucacuaugaaaugaacuucuuuaucccuaguaauaauacuggcucugaaaucuacuuuuucuaauauucguguagucauuccaauuuuccuuugguguuaucaugguauaucuuuuuuccauccuuuuaccuauuucuaucuuuaaauuguguuucuuauacaaaguauacacuucggcuuugccuuuauauacaaucugauacucucugcucuuuaauuggauuguuuuaaaccaguuauguucaauguaaucguugacaugauuaaauuuaagucuaucaucuuguuauuuguuuuuacuuuggcccaucuauucuuuguucccuugaaaacucuuuuucugccuucuuuugaauuaaauacuuuuuaaauugcauuuuauuuucuuuguuggcuuauuaacauuguuuaguucaucauuuuaacaacuacuuucaaauuuauaguauguuuuuaaccuuaucacacuacacuuucgagugauacuauaccacuuuguaagauaggaaucuuaaaauagggcacugacauuucuauucuuauggacuuauucaacuggcauacauuuuacuuuuauauauuuaauaaacucuauaccaugauguuauuauuuuuguuuaaacacucaauauuggccaggcgugguggcucacgccuguaaucccagcacuuugggaggcugaggcgggaggaucaggaugucaggagguggagaccaucuuggcuaacaagcugaaacccugucucuaccaaaaauacaaaaaaauuagccaggcgugcuggcgggugucuguagucccagcuacucgggaggcugaggcaggagaauggcaugaacucgggaggcagagcuugcagugagccgagauugcgccacuucacuccagccugggugccagagcgagacucugucucaaaaauaaacaaacaaaaaaacacucaauauuuucaagagacuugauaaaauucuuaccuauuuacucuuauagcuaccauuuucuuugcccuucauucacauauguugaugcauauuucaaucuaaugucauuuuucuucaucauaaaauauauauuugaauacuguuuuuguaaugggcaagauauuauugauuuuuucaccuuuuguaugucugggaaaaugcuuuauguuuccuuuauuuuuuaaauuauuuuuugcugaguauaaaaguuuacauugauuuuucuuucagcauuuuaaaaauguaauuccacugauuucucucuuguauuauuuuauuuuuauuuauuuauugagacagagucucacccugucacccaggcuagagugcaguggugugaacauagcucuuugcagccuugaacucaugggauccaacuauccuccugccucagccccucagccuucugagcagcucagaguacaggcauguaccaccacacacagcuaguuuauuauuauuauuauuaucaucauuauuuguagagauggugucuuacaauguugcccaagcugcucacaaacuccuggccucaagccauccuccgaccacagccucccaaagugcugugauuacagacauaagccaccaugccuagccuuauauugcuuuaaaugagaaauauacuguuuccauaucuuuuuuacacuguacacaauguauuuuuccccucugacugcuucuaaaguauuaugguuauccuugaucuugaacuauaagauuauaauauauucuucgguggaauuuucuuuauguuucuuaugcucaguuuguuucacuucuuugaucuccgguuuuauagucuucaucaaauucagaauauuucuagcuauuauuucuucaaaauuuuuuuuaugcuaguugacauugucccacagcucaaugaagcucuuuucaaagguuuggauuuuuuuucugcuccaucaugauguuuuuauugcugugucuugaaguucacuaaucuacuucuccuaucauggcgaaucuaccacuagucccauccaguauauuuuucacagcagacauuguaguuuccaucucuaggaauuaguuugagucuuuuaaauuucuucuauggcucuauuugacuuauuaaaacaucuagaauacagucauaaagcuaucuuaaugucuuugcuaauuuuaacauuuguguccauucuaaaauuaguuuugauugauugcuuuguguccuuauuaugagucauaauuuccugcuucuuugcuuaccugguaauuugugauuggaugccagacacuguguauucugcuguguuagguucugguuauuuugguauuucuauaaauauucauaagcuuuguucugugacacaguuaaguuacuugaaacagcuucauccuuuugagucuugcuacaauuugucaggcaggacaaaacugguaaucauucuggggcuaaucauuucccaguacuaagguaagagucucauccuaucuccaguaccuccuaauuuaugagauuuuccagucuugcugguguaaacauuuguuagacccaaacguaugugaauacucagcacauucccuucuaauccuuuugaguggcucuuucaccagccucaggucucuuccucacauguacacacugaucaguacucagcugauuacaaaaggaggacuugcugaagaucuccagaauucucucucuguacagcccucuccucuucaguauucuguccugaaagucuagacacuucagauucucccaauugcaacucaguucuucaacucaaggaauccaccaggaucugacuggaaugccuuuccccugguguuccccgaaaacucccucagucuaguaggcuggggcaguauuauggcucaucucucaaagaucacuguacauugaagccuaguggcuacugccuuaaaaaacaugauuucauauauuuucagacaggguuaaaucuggccucaugccaucuucccaccucccuuacuccauaauugacuuucaacuuacaaucuuucaacuuuaagauggugcaaaagugauacacauucagaagugguaauucccacugaauaacgacacacagacacacagacauacacacugagaauauguuuuguuuacacuauuacaaauugcacugcaaucaauaucacuauauauguagcugguuccugccccuaguguguuugacuaggaaaagaaucuuaggaucauaggauucauacaucuucauccuauuucacugcugucccccaagucaggguccuccaacccuucuuugguggacucgcucucucaggcuauggagcuuucaugcccacacaugaccucaccauuuaaccaaugccaguugcagaguaagaaagcccagcucccuggcucaaaucaggacaaacuugugggguauguacauacuauagcuccucaagcuacucuccuaagggacauggccugaggucacaugauuuuaacuuuauuuagcccuuacuuuaugucuuucaauacaauuuguauugccaccaacaauuucaggcaguugcucuuaaaauguacuuacacuaucagucuuaugauacguaugacgcucuaauuaucaguuaguuuaauauguauugggguuuuuauuuccuaugacaguugccuguucugacgggguauucagagcuuuggcucguuuuuaaauuaugagauugcuuccauuauuacuauggaauucuucacauaagaugagugaaaguccauuaggaaauauauguuuuuucaacaaucuucucuaauacaugauacuuuuuucacuuaguuuuuggauuauaaguuuugucauuccaaagcuuuaauuuugaaaauaacugaauacaccauuuuccccuuuauagucuaaguuuguauguuuuaugaacgaaauccuucccuaauucaggaucuuaaggauuuaucuucuaaguuuucucuaaaauguuacacuuuuuaaauugggucucuaauucaucuguaauuaauuuuuaauaugugguaugaggcacauauuucaucuuuuuucuuaaggacaguaaaaaguucuagcaucauuuacucaguaacuuuucuaucuuuuuuuucccaugcaugugaugcacucauuuauauguggguucauuuaucugcuauuuuguucauuuggucuauuugacuuucccugcaugaauaucccuuuguuuuaacuacuguggcuuuaaaauaaagccuccuuacgagaaaaguaaauuuugacuaucuuugggaauuuugacuaauaugugaacuucagauucgucuuaccacagucuaugaaaaaucuguuccucuuuuuacugaaacaccauugaauuuauggauuaaucuuuggggaagugacaucuuuacuauauugauuucucucaucccaaacauuuuauaaauuccuuauuuauuuagcuguuacuuuaugucuuucaauaagguuucacgauuuuuucaugaaggucuuaugaaacuuuugcuagcucuauucagagguuuacagucuuugauucuuuguuucaaguacagaggggugcuguuguguuuuauauguuggccuaauauccagaaaccuuucucuuucauuauauuagcucuaauaucuuguuuguacuuuaaacaauuuuaagaacacugcuaucauuuaauaaugguaacaguuuugacuuuuugcuucuaauucuuauaauuuucuuuuccacguaucacuaucaugugcagaauaucaaguacagugaugaguacaauaaguugauaauggguaucauuuucuccugauuuuaaagaaaagauuccuugccuuuauaacuguauuuauuugcuguaaauguuuagucaauuccuugugauaccuacuguuuuagaguuuuuuuuuuaaaucaugaauggguaaacugaauuuuaucaaguacuuuauaugggcaguuaacaagaugaucacguuauuucaaaccauauuuuaaucugaugaauuauguuaaaaaccauuucuaaaaccaaaccaaacucacauuccugagauaaauccuacuuggucauuacaucuuuccauuuucuguaccuauaacucuagauggucucuggcuuaggaugguucaacuuacgaucuuucaacuuuaagacggugcaaaagugguacacauucagcagacacuauaacacaaauacccacagaacuguuuuucaauuucaguacaauauucaauaaauuacaugugauauucaacacuguauuuuaaaaacaggcuuuguguuagaugauuuugcccaauuguaggcuaacacgaguguucugagcauguuuaagguaagcuagacuaagaugugauguucaguagguuagauguauuaaaugcaucuucaacauguuauuuucaacuuaugguggggacauaggucagggagcaucuguguaucuaucuaccuuuacaguguauuuucaguuguaauugugauacgcauaguagucauuaucugacagcuuaacuccuauggaagucuucugugucacaccgcuucauagcuggaaagucuguauuuuaccaguguuaugcuuaacacguuugcuuucuuaagcaaugugauguuuaucaugcagugaauauuuguacuaguaaaugcuguuguuccaaccagauauucuuuuuccaauuuugugacuucaugaagcuuuugcuucuaacagcugauacccacaacccuucuuugguggacucucucucucaggcuauggagcuuccaagcccacacaugaccucacuccuuaaccaaugccaguugcagaguaugagagcccagcucccuggcucgaaucaggacaaccuugcaggguauguacauacuguagcuccucaagcugcucuccuaaaggacauggcuugaggucacaugaucuuaacuauccuacuuuucccauuuccuuaccagucauccaaagaacaauugcuuaguaagugacaugcaggugaagugcuuaucuuggguuauguuucugauaagccaacaucgaagaguagucuuauacauaagaacguaccuccuggaaauguacauuucaaggcuuuugacaaauuucuucccauaauaauugacaaauucauauuucuaucugcaaugugaacuauucuuucucuuuauccucccuaacauuggaggaguaugugcacauguguguaggugugcauauauacauacacacuguuacgaauugaauguuugugucccccuaaaauuuauagguugaaauuguagcccacaaugugaugguauuaggagguguggccuuugagaaacaauuagaucauaaggauagagcccucaugaaugggauuagcacccuuauaagaaacagcagagagaugaucucucugcucccuguugcgugggaacacaaagagaauauggcaguauacaaaccagaaagagugcccucaccagauauaggauuugcugcugccuucaucuuggccuuaacagccuccauaaccgugagaaauaaaugucuguuuaagcuucccagucuaugguauucugucauaggagcccaaacuaagacacauacauauauauuuuaauuuuucuuaacugaaaagugaaaaggauauuucauuguuauuuauauuuucuacguguucaauagugagguggaacauaauuuauacauuuauaauuccauacagugaagcuuucaccaaauauaugaauccauuccauacaucaggucacacaucugcuuuuaacaaccaagggguggccaggugcggugacucacaccuguaaucccaacacuugggaggccaaggcggguggauugcuugagcccaggaguuugagaccagccuagucaacagggcgaaacccugucucuacuaaaaauaaaaaaaaauuagccaggcaugguggcacacaccuguaaucccagcuacugggaaggcugaggcacaagaauggcuugaacccaggagguggagguugcacugagcugagaucaugccccagcacuccagccugggugacagaggaagacauagucucaaaaauaaaauaaaauaacuaaggggcaaggagcucacuaucucucgguguaguucaauuuaggguccagaucuuacugcuauuauucucuuccuaugcguaggaaauuuuaugcguaauuagcgcuuaauuugcauucugaaaguaacagaaaauuagccuaaucugucuuuaacaaaaugacucuucagauauguggagaaacuuagaccuguuucugcaaucucucuguucuacucccucaagacuuuucuucucuagaccuaaauucuucuguugcucuucacaagacaugguuaggaauucaaccaauaucucuucacuaguucuggucaguaugguucuaaauaggaugcuguuucaagaagucaaaguacgaauggcaaagaaacuuucccuugguaucagaaaaaaugugacuuuaaagaaauuuuuuaaacguuuuugaaauaucuuacuuaaauuucucagauuuuucuagacugaguuuuuguguccuaagauauuacuccaaauguccuaaacuuccagguacaguuuucauucccauuuuucugacaagauacuacuccaauuuuauuaaagaaugcugaagaaggacauucaguucaaagauauaauucuauuuagcaauaguguccaaacagucuuauugcaggaaaaaucucauauuaaguaucauaaaauuaauaggccacagagaaucuuaggguaaucuauaauaaaauaaauuuaguucugugcauuauguauucauaaaaauauccaugagauuuauuuuuauguucaaugguauaauauccauagagaagcagacuaaauauuuauucauauuucuguuuauauccuuaauacuuauagguuuguuuuucucauuaucauaauacaguguuaaaaaacauuuuagauccagaagagccaacucauuauugaaggagaagaauaaagucagagaauugacacuacccaacuucaagacuuacuauaaaucuacaguaaugaagacagugugguauuaguaaaaggagagacaaauagaugaauagaacaggacggagaucccagacauaggcccacauaaauacagugaacugaccuuucacaaaagagagaaggcaacagaauggagcaaagauacucuuuucaaaaagugguguuggaaaaacuggauauucacauuaaaaaaagcggucuagauauagaccuuacaccuucauaaaaaucaaaucaaaauggaucacagauguaaacauaaaaugcaaaacuauaaaacuucuaaaagauaacauaagagaaagccuagaugaccuugagcaugacaaugauauuuuagauacaucaaaggcaugauccaugaaagaaauaauugauaaacuagacuuauuaaaauuuaaaaugucugcuccaaaaaagauaaugucaagagaaugagaagacaauacacacacugggagaaaauauaugcaaaagauacaucugauaaagaacuguuauccaaaauauccaaagaauucuuaaaacucaacaagaaaauggauaaccuaauuuaaaaauuggccaaagaccuuaaaagauaucucaccaaauuagauauacagaugacaaauaagcauaugaaaagaugcuccacaucguaugucaucagggaauugcaaauuaaagcaacaagauggcacuacacacuucuuagaauggccaaaacacaaaacacugacagcaccaaaugcuggcgaggauguggagcaacaagaacucucauucauugcugguggaaaugcgaaaucauacagccacuuuggaagccaguuugguaguuucuuacaacacuaaacauacucuuaccauacaauccagcaaucaugcucugugguguuuacucaaaugaaaugaaaucauguguccacacaaaaaccugcauaugaauguuuauagcagcuuuauuuguaauugucaaagcuuggauguaaccaagauguccuucauuaugugaguggauaaauugguauauccagacaauggaauauuauucagcacugaaaagaaaugugccauuaagccaugaaaagacauagaagaaacuuaaaugcauuauuacuaagaagccaauaugaaagggcuacauacuguaugauucuaacuauaaguucugaaguuuaacuguaugacauuccauacgauucuaaguauguggcaaacaguaaaaagauuaguggucagugcuugagguuaagggggugggagguaugaacagguggagcacaaaggauuuuuaaaggauuuuuaaggcagugaaacuauucuguaugauaucagugguagacacauguuauuauacauuucuccuaauacauagaauacacaccaucaagagugaacccuaauguaaacuauguaucuuggaugauaauagggcaucaguguagguucuucaauuguaacaaauauaccacuauaguacugggucucacuggggaggcugugcacguguggggaugggauauuugguaacucucuauaauuucugcucaauuucucugugcaccuaaaacugcucuaaaaaauaaaguuuguaaauuuaaaaauauuuuauaggaccuugcaauggaagagaucuaaggccccuggguccuccuuucagaucuaucacggccacagucccacuguugcauauuuuccaucugcgagacucucuaagggggcagcuaauauuucuuuuuuuuuuuuuuuugagacccgcucugucgcccaggcuggagugcaguggcgccgucucgacucacugcaagcuccgccuccuggguucacaccauucuccugacucagccuccggaguagcugggacuacgggcgcccgccaccacgcccggcuaauuuuuuguauuuuuaguagagacgggguuucaccauguuagccaggauggucucgaucuccugaccuugugaucaugccgccugggccucccaaagugcugggauuacaggugugagccaccgcgcccggacgggggcagcuaauauuucuaaggcgaaaacaaacagagaauguuucaguuguucacacacaaaaggcaugugcaugcauauacguacaguuuauuuugugaauauuuaauacuguuucaaacugaccuauauauaugaggccacauuggcacaaacaguggaaguucugugcagcucuaugcaagguggauguguccaccccacuuuacaaaacugagaagagugauucucaugacuguccuggacuuaucuuccccaguaccuuucaggaacaggaauaauggucaacauucuacagaacaucacuuuguuuauuuucugcaagaaaagcccuggagaauagcagagcacuggaagguuucugcauaggauacuagcuguaggucaaagauguuuuccauacagcuaagggcaaauuacagagaauacagcuuggucucagugcucuuugaaggaguuuuagagagaaauggaaaaauguguggcuuuguagcaucauuacuuagcagaaaugugcaaagcaguugcaaagaaagcucucgccuuucuuuugcagaaagcucucaccuuucuuuugcagaugcucucugacaaucugcgcugcucaggcuuuucuuucucacaggguugcccuuuuccuuccacugucauugcugucuggucauuccuugggugcacugguugccagagcuuuauuuauauucuuuuuuccuuuuauagugcaauuucccaauauucucuuauacacaagguauauuucuucaugguuucuuccuuuucucuucguggggaacuuauauauauuauaacauuugggcucccuacagucuuccuucuuccuuugaugcccuccuuuuuuccccauuuucccuaccuugacucugagcuccaaugagacaaacuaucuccuguaacuuucuaaaauacuuaguucaaauuucauucaaacauucauuaagcaccugcuaaguuccaggcagcguccugaguguugggaauauaggaaugcauagagccauuugggaauucaaauagcuccaggccgaugugauaacugccaucuaaaaaacacuuugaaaauuagaguaaauaaauguuugaaauucaugaaugauugugaaaagcuuccccaagauagagcaauugggccaggucuggaaaaauaaauaaaaguuuuccagaggacgggaauagaagcauguaggcauuaaagagaagaguaucacauggcggaauggaucugugucauacgcucacagagggauucugacaagaacugaggcugguugauaaagaauacugcauaagaguuggauuauaaaaugaaggcaguuggaaaccaucuaaaaaguuuaagcaaaacagcacaugaucaguuuaauguucuaguaugauaauugucaacuguguacaguauagauuaaguaguaggugacauuaaggaaaaaacccauucagagauucuuguaauagcucauauaaaggaaaacgaaggucuaaauuaagguagcguagcgagaguuaagacuaaggaagaaacagaugugagauacaauuuuaagcauagugauaucaacaggggcuuguaugcugaauagaauggagaggaagaacucuaagauaacuaccugguuuucgcccugggcuauuuggguugauagugcaggcauccacuaagauagaaauacagaagcaauacgacaauugggagcauaaugaauuuaauuuuagauguacugaauuugggaugccuauggguguucacaucuaggaaauauuuggaaaguggucugaaggcucaggagagaguucugggcuagaaauagagauuugugagucacuggcacauacaguaaauauagaagauaaaucacgggaauagauuaaauuaccacgggaacauacguagaacaagggaucacggugaaaaaugggaccuggaggaaagcauauauuuaggaaauagaaugaagaccuaugaaaaaagacaaggcuaagucagagacaagugcagaaccgggugagaguggaaugguugaccacaagugcuuauguuaugacagucgaaacuggcuaacugugaaauccagaagagaguccgaguggacuaaagagagaaagcaaauccuugaaugucacagucaucuaaucauuagguuccuugaucaauaucagcaauuauagccagaagguagugcaccuugggggaaacacaaucuuucaaaaaaaaaaucuauauaagagaaaaaaagaagaaaggaccugagaaagcauaugaggaaauaucagaggaauauucuuuuuuccuucuuuuguuguuucugauaaugauguagaugauaauaaugauaaugaugauauaauuuuuagaauggaagaaauuuuaguaugcuugugggcucagaguauagauuucacuucaaggaauagauuaaagauauauauaaaaaagagagauaaacaugaaaguaggcuagaggcagaaagaaacaggaagagaaaugcccucuuaauguaucauuucugagaaugaaggaaauacacuaagauugaauggguuauugacaaaacugcagauaugaaggaucaaaacggagagauaugaggucuaacagccucaauguucaauaauaaaauaggcaguaaugacugauacuuacaaaguuccuacuaugugccaagcgcuauucuaacuguuuuuaagaaauacuaaaucauacagucuucacaaugauucuauaagguaggagccauuauuauuuuccuuucacagaugaagaaauaauaacaaagagaaguuaaaucaccuaggaucauaaaauagcuugcagagcaaaggcuugaacacagucuggauggugagugucuucucauaaccucugugcuacacagcugcucuaagcaggaagggauccaguggaaguggauggcaaucaguagggggguuuagaaaaaaauccuaggaaaugacugagcacauaacaauaaaaaagaaguaaaagaggccaggugcgguggcucacaccuguaaucccagcacuuugggaggccgaggugguggaucacuugaguucagguguucaagaccagccuggccaacauggugaaaccucaucucuacuaaaaauacaaaaauuagccagccauggugguggucgccuauaaucccagcuaguugggaggcugagguguaggaauugcuugaaccugggaggccgagguggcaaugagcugagaucgcaccacuugcacuccagccuaggugaaagagcaagacuccaucucaaaaaaaaaaaaaaaaaaaaaaaaacuaaaagaaaggcagcacuggggcucagaugcaacugaagaccauguguuagcaaugauaccaaccuguaucacuguaugaucguuuuuuaggaaguguucaucccauagguauaggaagaagaagguaaaggaaguaauaacaaguaucggaauuuugcuguaaaggugaggcacagaagcaggggagugacagacacaagaaagaugcugagucagcauuucagccacacugcaagagagagagucaaauagagaagaaggacggcagagaaaccaaggacaggaugacauggugggaggaauugaccagccuagagguaggcuggaaggcaggcuguuucucuugagggaaaaaagcuggagcaaugggagugaagauaaacuagaccaaguggaaagaaagaaggcuguggucagagcaagauacuacaccggaaauguaaagcuuagaaaaucuaguguuaagaguuacauauuaacugaggacuguuccauuguguucuacaacaguaucucaacugugaccauaauuguccucaacuguagcaauguaucccaggcucaggagauggucaagcaaaggcuguauuauccuaugguugagaaacaucacagugaauuaugcugaacaugcugaugauggaauugaagugccaaugaguacucauuagagucauucaacuaugauguccaggcaggaugaggaagaaaaugaauuugagagaguucucacagagauggagcuggaauuagaauguucuaguaggauuuuacacaaaaguaaaaauauauauauaauuccauuuugucaaacuauuccugcauuuacuuccuuugcccacagauggacgauaaucuccuuuauagacggaaaacuaugcguagcuuggcuucuccauaccccacauaguucugaggauuguuguguauuaaacaaauacuugcuaggcugcacacaucacugaauuuaccucugagaagcuccuuagaaaaaaaucacugaggugucaguucuucuugcaaaucagaaagaaguuucacaaaggacuugaccaaggcagaaaaauuagcuggauagagucagaucauaugcauaucauguggcaaucaaugauuaucuccuaagggccagcagaggacugggcacuguagaaaauauguuuuugcuacauggauuauaaacuuuuuucacuggaugcauacaaaaauuaauauagcauuacaugccacaagccagguuuuuuacucacaaaggcaagaguuugugugggguaugugugugauguuguguuauuaugcugaaugcggagaagauaagaacaaauuaaacaaguuaaaaaaacaaaaagcaccccccacaucucagaaaaauuucacuauaaaaaaugaagaaauuuucccacaugaucagguguucaucuggcaucacuacaagauguaauuaaucggccaggcaugguggcucaugccuguaguuccagcacuuugggaggccaaggcggguggaucaccugaggucaggaguucgagaucagccuggucaacauggugaaaccccaucucuacuaaaaauacaaaauuaaaaaaaaaauuagcugggcgugguguugggcaccuguaaucccagcuacucgggaggcugagacaggagaaucgccugaacccgggaggcagagguugcagugagccgagauugugccaaugcacuccagccugggcaacaagagcaaaauuccaucucaaaaaaaaaaaaaaagcaaaaagaaguaauucaucuuuucacacucuuucaaagcagucagaaaagugugagugagacuaaguaagaggaaaacagaaagauaaaugauugaauuuuuuaaucuagaggagaaauauggaaaccaucucaaauaagcauccuuugggagaaaaaauuaaaugaauguaaaaaagacaaagcagucaauuucaaaaaaaaaaaaaaaaaauuuuuuuuucaaaagaaacaaccgauaaaauaaaacagcuuccaaaauaacaaaucaggugcagcaggaccaaaaaaaaauuaaaaagagaacauauguauuaacauucuccucauacguaagacacagauuagauuucagaaagcaacacccccauuucucgcucucucuuucucuuucucuaagacuuuaaaagagaccaguauccccucagaacuguuggucuucugggcucagaaagauuagaaaaacuaaaaauaagauggaaaccugaugcccugagcaccagccagcagcagagcucuuucuauguaugauuugguugugaagggacuccauguaagaaauacauaacuggaauauuuccauaaacaaagcaaagaugugaagguuaaagaauuaaacaugaaucuuaugacagauucugcuguuuuucccccucaggguuagucuucaugaaugagucuauguuauggucaaccaagucauuaggagugauaaugcaucaaugucaggagcauucuaucauaucacuugucuuaauacggucuucaaggucaugguuuaaaaugccacaggauaacauuuauaaauauagucuucacaacccauuuucauauaaaugaucuuuugauacagccuuuccuaaauaauauucugacccaaacgagaaugguuaaauuauccaauaugaagucauuaaaauuaaaauuucacagggaaaauucaaauuaccacauuuauugauaguagagauuuauaguaauuugcuucuuauaaauagcaaaaccuuguuguuuaacuuucauucagcuucuuagccuggacauuugaauuuguacaccaacauaaagauaucucccaugucuccuaaagcauuauauaaaauacauuauaagagaagacagaagaagggagagagaaaaacaacaccucacugccauucaguccuugugcuuagaacaaaacaaaaugguaaaacugauuauucaggaagggcuguuuucaucugaaaagaaaacaaaauuaaaguaguuauuuuuauauguuaaaagguuuugguaauaucucauuuuccauuugcuuuucagauaaaacacagugcuguuuucucaucagauaaguuguggaaaagcaaacuacugguauugcaagacaacaauguuuauugcagcucuaguuaccugcaacaugaaaaaaacguaaaagggccaauauuucauauaaacaggacuuugucagccauagaaaagguuguauccuaacacagcaaaucugauguuuuuuuuuaauaaaggacgaaagcguaaguuuuaaaauaugacuauauguacuuauggaagugugucaaauugagaaaaugauagaugagaauaaaggaaggauauuuuuuaacccugucauuccuucagcaagcaaaguucuccauaucaauacuuuaucauaaucaucuccccauuacuuagaaaguaucacauggcuccugacuaucugaagauauucuauagacuaaacugcaagagauuuucaucauauuugaaaaaauaagaacaguaucugaagaacuguugaaaauauaacaauuguuucauucccugaaaaguauuacaaaaaacacaggaacaagaaaaaagucuuuccauauauauguuugcaaaauauggaccagcagagcaugguuaaguauacauguuucagcaaaguugcuagaggaaaagcucacccgccuccucaaaggagcagucacagcaggcaugacaaaagaaaacgguuuucauugggauuuaaagaaauguuuuuauucccuugagguuaaacuuaaaagaaaaacugagacacaugauccgguaacagauaauaaccccuggaaaaaccaugugaaacguuaaucucucagacauccuaguaacaauuacggaaaacaaagugucaucaacaguaaaaucauugacuuugauuguguauaccuagaagagggagcuccaagcuuugcuuuuuaacuaaauuuuuaggcugaacauuuuugugcuagccaagaucauuuaucuaauuccuagagagaaguuagaagacaccuguagcuuggugcgauaguaaacuucaccaauuugauuuaagucuucaauagucauuuguuaguuuccacgccguccugaugcucuuaggaguaaauucgugucucgggggggggaaaaaaaaagaucuggaaaaugcugcaggaaagcaccuaugauucaggccauacaucguucucuccuuaauccacaacagugcugucuaacauauaauucacuuucuucuuuaucauauuaaguauacuuuccaacuucucauguuuuuagcuaacucuagucuggggaaagucuuaaacagaucuucucaauaauguaugucuuaccuucuaaauggcaauggaggcuaaugaauuuuuaaagaaaaaaaaggacaauaguggagacaacuuaaaacauuuuauuaaguauauaaagguaagauuuagaaaauuuauaagccaguggguauuguaaugaagaaaacugaccaauuauuucuuuuacgauagaaaagauaaguaauuucuccaggcuaaaauuauagacaucuauuuuauuauacagaacucuggccuucuaaucaucucuccaagcaguggcacagaccccaaaaaccacuucugguggacugccuuggccugcugguggcacggccuuagaucacuuuagaagaaaaggguaauggccuucuauucaggcauguauucugcucagauugcuccauuucaggacagaaugucauuccucccagcuaacaggugaaaguguacagcuaauaacacagaacuaggacuguuucacaccauugcccuucaguuauucccacugauaacauguauugagcacucaguaagugcuaggcacuuugccugguuaguccuccaaaugccuuaugagaggaguacuguuaauagucucaauuuaugaucccuucauuaauuuacccaaauugccaaaggcuaaaaggucuuaccuccauuugacuacaucuguuauucugugaacuuucuauacggugcuuauccuagauuacuuguuucccaguauuuugugugucaaucuuaacccuaugccuacaccaagaggcuucaagucuuggaaaaagugcucuauaaauacaggaaacucuaaacuuuuuugaauggauggugcuucccauccuuuuuccuccucagugauuauucuggcuuuuuucucaguguauuuucuauacaauuauuuauuucaaaaaaaauccauauacuuuaccagaaaacuuauuuuuuuccauucuauaagacacuaugguuuaauuaauuucuggaauggauuaucaacuucaaagauaucauuuaguuauaagaaauuugagacugauaggaacucgagauauuuucaugauacuaguacagauagcaaugcuaaaauaaauguaaguauaucuuuauccagaaagcucaacccaaagcuaaagauuauuacaacaaauaacuguucuuacaguaaauuagugguaugaaguaauauuauaaaagaugaugaacaagauacugaagcuccguccaagugaaauacugucuuacaaauguaaaugguguucagagguaguaaugacucucaaaaguuaauaaaacaaugaaggaacuucagagucuuuguucacuaaaucuaugugggaagauaucagauauacucaagacccuuaaaacucaguaaacacauuuccuccauauccccaggaucuuggcacuaaaugugugaauauguucaucuuagaauggccugaaacaaucuuccugcccuucuuucugaaaaaaguucucuggcaagucucuaagccuacuauaaugugcuuuuaagacaucacuuuauuuacuuugaagggcauccaucaaucaugaaucuaggaaucacaagauaaacgaucuuaaaucaagacuaaaaaaaaauuaagaccacagaccugagcugggccagauugugagcauaucauuuuuguguuuauugaguuuauucuuugagaaaugggcccugcaauggcauugacagggaguauaagaggagaaagaugaauaguuugagcuggguuuagagaggaaacccaggcgaugcugaggaacugcccuuacaaaaaguugcuauucuugggcuggacucccauuccuagcagcgucacccugaguggcuuuugagccaugauguagaaagcaacacuugguaaaggaccucauaaaaugaggaccagagcauggaaaaugaugguuuuaugcaccugugugucagugacuagaagaguggacauuagugccauggaaugaaagagaaaagaggaaaagagcgagagaagugagaaacagaaagaggccaggaaagggaugaggaaggcaaggaaggaaugaaaagaaaggaagugugcaugggcagcauucagcacagugguuaagggcacacacuuugaagccagagggcugggcaugaaucugccucucugccuugggcauguuacguaacuucucggugccucagcuuccucaucucauuaaaaugggguuuaauaacucagcccacgguuucuuucaggcuuuccuauuaaauuaauucaaauaugguacaaucacuuugaaaaacagugugaagauuccuuaaaggacuaaaaguagaacuaccguuccauccagccaucccauuacuggguaucuacccaaagaaaaauaagucauuacauaaaaaagacacacgcgcacacacguuuauagcagcacaauucacaauugcaaaaauaugggaccuaccuaaaugccuauuaaacaaugaguggauaaagaaaaugugguauauauacaucauggaauacuacgcagccguaaaauggaaugaaacaauggccuuugcagcaacucagauagaguuggaggccauuauuuuaagugaaguaacucagcaauggaaaaccaaauaucauauguucucacucauaauuggaagcuaagccaugaggaugcaaaggcauaagaaugagaagaugaacucugaggacucagaaggaaggguggggguggugagggauaaaagacgacauauuggguacaguguacacugcucaggugauguguguaccaaaaucucagaaaucaccacuaaagaacuuguucauguaacaaaaaccaccugucucccaaaaacuguugaaauaaaauuuuaaacauuaaguuaaaaaaaauucaaaucuuuccaacagagaggaagcugagacuagauguaauggauagcaugaugugaaugguuuaaaaauaaaauucaaacuuaaaacagaaacauaacaaaaaaagaaaaagugcuaaaaaaaaagaaaagaaaagaaaagaaaaccuaaacaccuaaaagaagaaggcuuuguagaaaagaaaaacuaugagcaaggaaaauagggcauaaaacacuggcaugcaguuaaagaauagggaacuugccagaggccgagcggagaaauaagcagcagcaagccagaugccagauuaucacacaucugaccacaaggcugacagagcucacaguaauaaauaagaagggagggcagaguuuuaggaggugacacucuugacagaaaguaaucagaagaaugcaacacucuugacaguuugauaguacuugaagauguacuacaccacagagaagaggagaagccggugaugugcugaggccuacgaguguucagcacccggugcagacagcagagagaaaggaggaguacaggaugccacagaggccaacaaccccuucagggguuccauuucccuccaugggucgguuucagacuaacaucgacacuuuuguucuucacagaguuuuaggucacaaaugcccuuaaacucacaauuuucugagucuuuuuuagguucaucuaccaggaaugcuuacccuucccacucuuucuccaagcgugguugugacucagagugaccagccugaaugagugcuaagagaacacaaugcugagcucacaccccggaaacagcacccagggaugagcuagcacucuuggaaagcgggcagcaaauggauacugaagggaccugcaauguagaccagaggcaggaggagaaaauugcuccuaagggauguuggccauguuguccgggggagggagggaggggcuggagcagaggaagccagcauggagugcaggccaggguagacaagggcacacacugugcaaaugcauucauuaccaggaauuuaaaaacuaaaaaucucaucacugauaaacuuucuaauguaaaaaagccuuuuguuguuccuggccagcucugagacagaguaccauauauuaaaccaaucuuauguuuccauuuuuacauauuauaauaauaauauuauaagaauaaaagccaaauauauaacaauaauagcuaaauuuuauuccagaaauacuauaaaguaaacucagaaauaggaaaaauacauccacuauugucaguacuacuuauuuaacauugucuuggaaguguuauccaauacaguuaaacaaggcaaagcaauuagagacaggacaauuagaaaagaaaaggcagaauuaucccuaauuguaaauaagugucugaauaaccaagaaaaacaauugaaaaacuacugcaaacauuaagagauaaaaguaauauagaaaauguaaacauuaacauacagaaaagaaaaauuuuauauauacagaagaaaauacaucuaaaagauaggcauuuucaaauguauauuuaaugaaccaaaagaccucacuuauagcaggaaccaaaaaaauauaaacuauguauacagaaaugugcaagaggaagauauuugaacaccaguggaagauccaaagacucaaaaagauaggaaaaacugcguguucucaaguaggaacacuuuuccccaaaucauuaauucauauaaaccccauaaaauacuaccagcuuuuaaaacuaccagcuuuuaaaaaauuguuccggaugucuaugugagacuggugcauacacagagccagaaaauaaacugguuucaagugcauaugaaaaucugcuugcgccgggugcgguggcucacgccuguaaucccaacacuuugggaggcugaggcagauggaucaccuaaggucaggaguucgagaccagccuggacaacauggugaaaccccaucucuacuaaaaauauaaaaauuagccggacgugguggugugugccuguacucccuuugggaggcugaggaaggagaaucucuugaaccuaggaggcagagauuacagcgagcugaaaucgugccauugcacuccagccugggcgacaagagcaagacuccgucaaaaaaagaaaaaaaaaaaaaaagaaaaucuaccugcuucuacauuuuuauuuuuuaucucauuauauccuaaauuugaauaucaacaagaaucacuaaaauugacugaaacacacugaauauauuaaaaacccaggaauucauaaugacacuaaaagaaaaagacaacaagaaaaaaaaucaccacaacuacccauuaauuauggcuggauacuucuaggaaaccauccuccagaaauuagcaauucuaauuuuucuguauaaccucuuuuuaugaaccauaggauaaacagguagucugaguagaugaggcaaagucuuccuuuacagaagaaauccuacugauaaauccagaggaagaguaaaauuagaaugcaucacuauuuuguagcacccaaugaaauaaucaauuuaggaaacgguaacuagauaaagaguugacgggcaacuuuacgauggaggcagcaucugaacacaaugucaaucagacauucaugucuccuaagugauguaaugugaaauaaauagccuacaaagcauuuccucaaaacaagcaaacuugaaauauaaccaaguguuacaagcguauuuccaguuuaugggaauaaugaaugcucaaagaucagguuaaagaaaacaaugaagaaaaaaauaggacauccauuucaguuuccucagucaauguaauggaaaaacaaauguuuuggagaagucuugaccaaaaggucuacgaaaagcaaggacacuauaagagucuccaagucauuaguaauuaggaaaugcaaauuaaacuaugagauaccacuucauaccuauuaaaaugguuaaauaauuauuuuuaauuaccgaaaauaacaaguacuggcaaagauguagagcaauugaaaugaucguauauggcuuuggagaugcaaaaugacauagccacccuggaaaacaguucggugguuuugcauaaggcuaaacauacacuaaccacacagccuaguaaaccuaggucaauacuccuaggcauuuacccaaaagaaaugagauauacauccacacaaaaacauauauauauaucaacaagaaucacuaaaauugacugaaacacacugaauauaugaaaaacccaggaauucauaaugacacuaaaagaaaaagacaacaagaaaaaaaaucacaacuacccauuaauuaugacuggauacuucuaggaaaccauccucuagaaauuagcaauucuaauuuuucuguauaaacuuuuuuauaugaaccauaggauaaacagguagucugaguagaugaggcaaagucuuccuuuguugauauauauauuuuauauauauauauauguguguauaucagauuuauuuauaaucacacaaaacaagccaaaugacaaaacagcccaaaaguucaucaacugaugacuagauaaacaaacuguggcaacaaccaugugguagaauaaugcuaagccaugaaaagggaacaagcuacuaauauacaauaacauggugaauucaaaaauaauuaugcucagugaaagaagcuagacucaaaacacaacacauuacaugacuccauuuuuaucauauucuggaagagauacacaaaacuacagggucagaaaaacagauuuguggcugcaagaaacuaaggugaguggggaaaggaugaacuuaaaaaagcaugagaaaauuuccucauuaugauagugguuacauugauugcauacauuuguuacaauccacagaacugugcaccuagaagaaauacauuuuacugaauguuaauuauaccugaacaaaccuggcauugaaaagagggaagaaggcagaaaaaccuagaagauauggcacaugcaauauguggaacuuggauggauucugauuccaaccaacagcuacaaauauauauauauuuaaaacaaauuagaaaagaaucuaauugugguuugagcauuagacaccaaggagaaauuacuuuucauuucguaaggugggaaaauggcaucaagguuuucuuaagcccauauuccauauuuuuaagagauccauauuugagcaugcggagauaaaaugggagcuuuaaaauauucagaaaaagguaagagaaaaaagagagacaucuaaaacaugguaaaguuuguguaguucuagcaucuauaugauauguauaugguagguaauuacuaaaaaggauccagauacugauauaagcaacucucuacucuuguguacguuugaacacauuuaaaauuaaaacuuaaaauaauagucaacauuuacugaguauuuaccuugugccuggaaauauucuaagguuuuacauguuaacauauuuaauucuuaugacaaugauagaaaguuaaguacaauuauaaugcccauuuuacacacggaggcauucugccaaguuuaaaaaauucccccaaaucaaguagccaguaugaggcaggcuggcacaaggcucacauucuuaacuaguccagaacccccuuuuaaauuauagucuagacuacaugguuuucuuacagucuguguauauuaucucucaugcugguuaucagguuaauaccuacagcuguauuucuucauucuuauacauuuuucaguucuguauuugcacaccaaaguaaaggcaccauauugacugccuuccccaaaucauaacagaaugaguuagauuaagaaagaaacaaaaugugaaaguuagcauaacauuuagaauuuaaaacauuuauuugaaauacuuuagguuucuuuuugccagaagaaugauuuagucauaauaauaaaugugauuacgccacucguuccuuuucaguuuuguaugcauaccuucaaucuauuuuucucuaggccuucuuuuucuauugcugauaaugaaaaggcauacuguugugaacaggcuuaugaauauuaagauguuuuguacagaaauggcuaaucacuauuaggugaaaaaaaugggaagaggcaaaaucaaagucauaagcagaaacuaguauguuaccuuuuuuuuuucuuuugagauagagucuuccucuguccuccaggccggaguacagugguaccaucuugguucacugcaaccucugccuccaggguucaagcaauucuccugccucaaccucccuaguagcugcgauuacaggcauccaccaccaugcccagcuaauuucuguauguuaguagagaugggguuucaccauguuggccaggcuggucucuaacuccugaccucaagcaguccaccugccuuggccucccaaagugcugggauuaaaggcaagagccacugcgcccagccaaaacuaaaauaaguuuucauaaauuuaucuucaccagcauaauguuaagaauaaccacaggaccauauauuugauccuucucugagugacaugcuccaaggggaauguuuaacaagauuaccaagggacuuaauuuccaaaugaaaggucagccaugauacauucaucuuggcaauaacguaagggaauccuaauagcauuuugcuuuucagaguagcuauuaagaagguaaccaacuaaaauuccuuggagaaacagguuaaauauagcuucuuuuuugacagaaaaggaaacauggugguaaaaucaaguacuccacauuaaaaugcaaagcuauaaaugaauuuugacuugaauugagguuucugauuuuuuuucucaugcauauauaccaguagcaauuugucaccauuauccauucaucaggaaauacuacucuaggaaaaugauuacugagcucagauuacaaaggucaaccagagcuuuggucuucuucacauaagaaaaaguuuuacuaaggaucacuugucuucauacauuuccuuauauuucuccuuugucucuaugacuauuuaaaaagaaaaauaauuauauuugguauugguuuuauacuguggccacaacaaauuaccacaaaaggaacaaguuaagcaaugcaaauuuguuacuuuacaguucucuaggucagaagaaguccagcgugggucuuaccaggcuaaaguuaccacuuucauuuuuuucuggaggcucuagggaaaaauccauuuccuugcucauuggaguuguuggcugaauucaguuccuugaaguuguaggacuauuugcauuuucuugccggccgucagcuaagagucauuccggcuuccaccacugcauucuuuggcgcacagcccuuuuccaacucaaagccaauagcagugggugaaguacuuuucacaucagaucuuugugauccuucuucuguaauuaccucgcccucugaccacaauaaggaaagguucucugcuugucaggauucaugauuagauugggcccacccagauaauacaggacaaucucccaucuggagaaaguuucuccaacguugagaucaagaaauagauccuaaaaaacacugcauuccaauaucuaaucaagagaugggguugcuacaauggacaccucuugaccauaggaccagcucagacccuacuugcauuuccugaaacagugaagaggucugugguaacauccaagagaagagcauuugccauuaaauuuuccuuuuucagugucagauggucuccgagcuuguggcaacuuuguucagaagaaauguccuucacuugaggccaggugcgguggcucacaccuguaaucccggcacuuuggaaggccgaggcagguggauccccugaggucaggaguuuaagaccagccugaccaacauggagaaaccccgucucuacuaaaaauacaaaauuagccaggcguggugguacaugccuguaaucccagcuauucgggaggcugaggcaggagaaucgcuugaacccaggaggaggagguugcagugagccaagaucgugccauggcacuccagccugggcaacaagagugaacuccaucucgaaaaaauaaaauaaaaaauguccuuuacuugugcuuaagagcaaccaaagauuuggagguuagaucauacuguccugcaccccaagcaaauacauuuauauuuuaaaagcuuaauguuaaaauauuuaauuugaaugacaaagggagggugaggaaagauuauauuaaacugucccaccgauagagaaguucaggugucuaauucuaccuguaagccccuuuaaacacagaauuaaauccuucauaaaaccuugaaaaaguggugaaccucauucuagggccacaggggggauccagguagcagauaaaaaaaaugauuagaauucuaggaagaaaauaaguagcaggggaaggaaggaaggaaggaaggaagcgagggagggagggaaggaagggaagggaagggauagagggagggagggaaggaggaaggaaggaagaaaggaaggaaggaaggaaauuaagaaaaagaaaaaagagaaggaaaggaaggaaggaaagacaaggaaagaaaaaaggaaaaaaggaauaaagggaggaaggaaagaaagaggaggaagaaaaggaaagaaaagagaaaaaaggaaggaagaaaggaggaaggaagggaggaaugaaggaugaacaaccuaaguuauuaguaguaaugucaaauaugacaggaauaccaaacaacaugauguaaguagacuaaaauaauaguuauaaggcagagaaugccaggaugguuuuuaaaugaacagauauauacuauuuagaggccccacauuuaagacacaaaaagacuacagggaaggaaggagauaauauucaaaacauacccagcugaauauuaagguuaaauauaaagcuauagcaaacuuuaguuaagacaaacuuuagugacuuggagacugucaaacaggccccggaaacagaauagagaguccaggaacaggccugugcuauauagaaagccaauguaaggcagagagugcagggcaaaugaacugggagaaaauagucuucaaaugcuacugagacaacugguuacccaaacaauaaaaaauaaucagaucccuacuucacccauacagaaaaaaauauauucuaaauaaaucauagacuuacauguaaugaaaaauuuaaacuuugaggagaauauagaauaguuuccuuucuuuaagauuauaaacuauuccuaaacaagacagccuuugccugaaaaagaaacccacaaaagguaaguuaaaauaauuauuaauucacuaucuugaaaguauuagugucugaauauaccguuaaagaauaaauggcagguuauucucugggaggaaauauucgaaccuuauauaacauacaaagggauauuaucuugaaaauauaaugaaauucuacauauuaaaaaaagaccuauuaacuaauaggaaaaaaaacacaccaaauaucuaaacaggacauuuacagagcaaaauaaguaaucaaauauguacuucuaguuacagagccaguuagauguugcuaugaaguguuauaauagcuuucguucauuuacaauuuucauucaaauguugggcugucugugcccacuauuccacauaagaaucgguaauuuuugcaccucagugauuauuccuuauugaaggcagugacaaccaacauucacacguaugagcuuuguuuaaauaaucuguuugaauacuuuucaguuaucaaaugaauuuauaaaaaguuauuauuuucaguaaagguauuggauuaaaaggacacauaaucaacuucuuccuaaacauagggaaugaauuagacucagauuuucucauuuuuagaacaguaaauguauucacuugcaagggauuucaagaaggaaacgguuucacaaacacaugcaaagagacagcacuauugaguuggcaacaccuuaaaaugucacuuacuuuuauacaccugaccuaauaagguuucaaaaucaugggaggaaaaagucacuguuauuuuaaagcaccaaaguaauuaacauuuuaagauaauacuuagacuaucuacaaaaaaaaauuuagaauggauagggguaauucucccaacaauaaaaauauuauaccauuuacuuuauuauuuuugugcaauuuuugaagccugaaauaauuuguaauagccuccuucaagcaucaaaagguagacaucacuuauuugcuuguaacuugucauaucauuguaaagugacccaaaauaacauuucaaaaugaaaaccaugucuucgauauaaaucauuaucucaugaaacuugacuaaacuuacauuguuuaauuucuaaauauauuuugauguaacuaauauaauauuaaaaaugcuuaucuggaaaaauaaauagaauaaaaguuaacauacgucauuuauucacagaaugaagaaggcauuaaacauuuugaaacuacuuggggguaguaaacaacaaucauaccaggaauauauauuucuuagaguccaguuauaagaacuuucagaugaacacaguaucuuaauacuaucuaaaacacaugaauuaagcaagugaacuaugguucucacaugaaaauuuuaacuaacuuugauucaacugcuagauagaucaaagagaaaauaaugaacuguuacaagcuuaaagaaaacuuaaaacauaaaacccccaugaagaacauggcugcaaacuucuauccucacauuuucacuaacuuaaguaaaacguguuuauguuaaacuggauguuaugcucgaauaguuuuuaguaggccuuucuuucucaaaugauccauaguaaagucauuccuuggcagagaacaaucccugaccuucuucacuuauggaugaaaaacgauaauuuauuuuaaaauacauuguaaaugcauaagacuuuuuauuuaaacucaagaaacaauuguucuaaguauuucacaauggggccaauguagagugaaguuacagguucuagcaugagagaaaagcaaacacuaaaaaugagugauaucgucuaacaagaagcauacacaccccacacgccccauaaauuuaauuuggcauacuaauaccuagucuuacaagcagcacuuaaauauaugagccucaacuaacaaaucgaugagacucuuguuaugaaguccuuacagaaucaaagugaaauagagacuauaacuuuuuugaauaauauuuuaagcaacauggguacuuuaaaaaaccgagcuacagguaagauaaaauuaaaaagaauagauauuuaguucauugaguuuugaaagcuauauacacugauacaauuaccacucaaaacaagacaucaaaaaaggugaaauuuucauucccauaaacucuccuuuaacucuuuuuguaaaauucuucucccuucucucagguaaauucgauugauuucuaacagagcaaacacagcuagacaucuaaauauguauuuauuuggaaucuauuccauugaaauugccaccacuaaauuuuggauaucauuuagaaauguuuuuggagccugaauggugacaaacuucaucuuuuaagugucugauuuuugaaaaaaguccaaagucauucauaaguaaguccaaaaaaaggaaaugaauaauuacagggaacaaaagguggugaaauaguccagauaccuaagagccagucacugggcuaaccgcuuuagacuaauauucucauuugguguucacagcaguccugagagauaguuaagauuaucugucuuuugcagauaaggaaauugagguucaauaagguuuaguaacuuggccaggcuucuucauuuguagagccagcauuuaaguccagaucaauuucucuacaacagauacucuuguacuucaauccaagcaggcucuuuccauugguuaauauuguuuggaauaaaaaauaaauuaucagggcuuccugcuuuuucugucuacacuuugcaugcacuuagcugcauugugaugaguauugcgaugugcagcagcaaguccaaggugauggacaagugucuguccugggaaaagacaggccuacaucaagcagccugugaagauccugcuaugggcauagagacagcagcaauuccaccuuccugaagccacuguggauaauccacuggcaggauuuugaccugugcacacaugacgaauuucaccccacucucuauagcaacgagaucaaaaguaugaggaugccaguagagaaaaaaggaaguuucauauuccuugaggagggcauucaaaccaacucaguggagacaacacgauggcauuugacauccugucacccaaggaggcacagggaaccaggaaaugguggaaccucaagguuguuuuauuuuguuuauaacaucuuucugcuaugagaauguuaugggcagacacaggcaugaggaaucccuauaaccaguguggauauuucaacugggugaacauguaaaaauauuuagugauaauggauaaacuucgagaaccagauuacauuccaucauaggauucugcuugccagaagcccaccaacagcauucauguacaacauugaaacugaacauguuucuuucaaacuuaaagaaauaaacaagcaaaaaacaaaugacuucaccaaaaagugggcaaaggacacgaaccaacgcuuuucaaaagaagacauacacgaaaccaacaagcauaugaaaaaauucucaacaucacuaaucauucaaaaacugcaaaucagaacuacagcaagauaccaucucacacuagucagaauggcuauuauuacaaagucagaaaauaaaugauggugagauuagaaagaaaagggaacacuuauacacagcuggugggaauguaaauuagcuuagccauuuuggaaagcaguguagcaacuucucaaauaacuuaaaacagaauaaccauuucacccagcaaucucauuuuggauauacaccuaaagggauacaaaucauucuaccauaaagauacauucacauguauguucacugcagcccuacucaugaaagcacagacauggaaucaaacuaaaugcccaccaaugacagacuggauaaagaaauugugguacauacguaccacguaauacuacacagccauaaaaaugaaggagaucauguccucugcagcagcauggauugagcuggaggucauuacccuaagcgagcaaacacaggaacagaaaaccaaauaccacauguucucacuuaaaagugguaguuaaacauugaauacacauggacacaaagaaaagaacaacagauacaggagccuacuugaggguggaggguggaaggggggugaggacugaaaaacuaccuuuugaguacuaugcuuauuacgggugaugaaauaaucuguacaccaaacccccaugacacguaauuuacuuauaggacaaaccugcacauguaucccugaaccuaaaauaaauguuaaaagaagaaaagaaaaagaaaauguuccuuucaaaauguuugauguagcugaucaaagaucagaaaggaaacauuggauugaauguuuugcuuccacagugagacaucaauacuuuuccuugucucugcuagugaaugugaccagaugcuuacagaagacugacugacugaaucacuuuacagaaucucugaacauuuuuaaaacaauuuucaaugaccggguuuucagcaaugucuccauaauucccuuccugaacaagacaaucuugcuugagaggaaugugcaaguguugaucaauaaagacuauuucuuggaauuuggaaagaauccacacugcucuuaagacauccaaaaauuucugguagguuauuucuguaauaaaugccaggaccuagaggaguaggccuuauaccaccaauucacaagugcuaucaacaugaaaacacccccauuaauuuccaugaaaugaagauacuauuauuuaagauaaucugaagcagcuuauauaguuauacacaaaauauuuauuauuauuuucuuguguuguuaaagguuuucuguuuaguuuucuaaaauaaaaguguaaaacaggaauuuuaaaaaucgugguucuauguuuaauuuauuggaaaugugagucccucaucaguagaauuugguuugcagcugaaaccugcugaauagcagcaugcugcuaaugucugcugaauuucagguguucaucuguuucacuauggcuucuguuugagucaaauuguaacuuacagacuucagacuagguauauuucaggcuuuaaguuaguccacuuuucaaauaaaauucuccugcagugacaauacaggagauaucuuuaauugcauuuggguaugaggcuaggaacaaauaaaacuuaccaguaagauauguguugucagcauuggcgaugacacuuguugccuaucguuauggagacuuccuacuuugaaaaggauauugacaaaaaaaguucguuguaaggaauagcauucucuugcuuuacacagauucagccuucacgguuuuuauuacuugaacauccaacaguaauuuuguuuuaaaauucuucuuguuuuaaaaaauagauaaagauuuccagucugacgcuaaugaagaguucauaagcgguauggaggaacaaaaggcaaggaaaugccguauagaguguuuugaucaagacaaaagugaaauguaauuugaauuuuucauauuuaauuaucauauaauuaaugugccauaugugaaacauucuggccguggcagcaacuaaaaacugcaaaccacuugguaacagaacuuccuauguaaacauacccuucucagaaaaaagaaauuuaaaauuaagaauaaaugucacucuauuuuaauaaagcuaauuuucugaucaucacagacuuuuacaauaaaaggaauguaagaucauauacacuggccuuauaauuuuuuguuuuuuuaaacaaagucuuagugugucacccacgcuggaaugcagcagcgugaucuugguucacugcaaccuccaccucuuagguucaagugauucuagugccucaggcuccugaauagcugggacuacaggcgugggccaccacgcauggcuaauuuuuguauuuuuaguagagacaggauuuugccauguuugccaggcuggucucaaacuccugaccucaagugaucugcccgccucggccucccagagaguguugggauuacaggagugagccacugcaccuggcuuauaauuuuuuuuaaaugaggaaacuaaagcccagggcagcaaggagcagagccagaaauaaaacccaaguaccuuuauuccaaguccagguucuucuccuccacaucuauaguuuucaaacauuuucagcuuaacuuauuuuucucaaaaauaaucaaauacagaaguucaguauaaaacgaaaaucaaagcagagauguucugcuugaagcugguggagaccacaagucucaguccacucccuuucccuuccccagcaagacguacagaaaucgcucaagguugguugaauacuacuugaaaaccaucugcuuuaucaugccaucucauaaaauuacuggaagacagccaaguuaaaaagugugaaaaauuaaacgucaauacaaaagauaaacuaaaguucaauaaaacaauacaaaaacugucacaauucagcucauaauuaagcaccaaaucaaugaggccgaaaaugggcacgcugggaguucagaaaacaaagacaucacaguaugggcaguguucugcaggcagcuaccaaaaagaaggacugacuagggucuucaaguauagacaguacuaaaauaagaagguggucauagugaaagagggaaagguaagggaaauagcaucuccaaaagcauugaacaagaaaaaacaauauaauuucaauaaaagugaguagaucaacuaaggccaaguaaauggcugaggaagcugaaaggugaaguuaaacauguugggaccagauuaacucaaguuaaugaguucugacuguauccugcaggcuauggggaauuauugaagguuucugauuaagguaggaauaugaccaaaguguuuuuggaauuuuaguuaaaguguggugucaagauauuccaggggaaaaaaauggagaagaaagaucaguuaggaagcuauaugcagacauccaggcaugauaauuaucaauaucaguuuaaaagcugaaaagacaaaaagaaaggaacaaagaaaauagcaggaagcaagauuugaaaggacuuaggaugcucccugucauuccagguauugacagcacacucuggguaucuaucagggaucauuuaaaggggauucauaucucagaagacaauuaacuauagucccuuuccuguucugaaauuauaauucauuguaacagaugguugggaugguggggagccaaguacaaaagugugggugacuacaagaaugauagauacaauuuccaagguaagacacuuguuacugaccauuccaaaugagaaauggaaaacaggcccauuuccuuuuaccauguugaaauaauuuaagccaaaaaaccaaguagcauacuaugaugcauaauccuccagaaucagugcuucuaaugauuuagugaaccacauuuuucuaggcuauucauaaaagagauaguucagaagaaaacaaauuggguuguuaucacugcagauauaaaauauugcaaacauuuggucuuuucaagaagccacacaggcacagaacucaauagcaggcacaucacuuuggcauaugaauguaaacaauauacauacuuuggaguuuggauguuucauauuuacauuuucucugcuguggucuccugagggcaggaguauauuauuucauuguauuuguaacucuguaugacauuuaaucuacauauuucaugccauagaaaagagcugacuaauucaugcucuauuuuccucugcaaugaucucugaaucuguuuucuuuuuuuaauuuaguaaacacauagugggcuauccucauuuuguaaauuuauagcuaaauguuauucuaaaguauaguuuucugaauacccccaauaaaaugaguuucucaucuuuuuuccucuuuauaaaaguguucugaauucuaaaccuagugucaauuauuccuagugugauauacaaguacugucauaaucuccuaugcugauagguuacaaucggcaaauuucauguacagauucuuaauucccuuaucuaaauuggaugacaacaauuuguaaacaacaaucauuuggaagaaauucuuuuccacauuuacaaaggguccaucaagaauauuucaucauauaucccagaaauguuuaaagaaaaaaaucauuucuaggcaccugcuaaacaccugagacugugauuuuaagagcuuucccaaaagauacauaagagaaacuagcuauauuaucagagagaaaacuggcugcaagaggaauaaaacacugaccugguccacuggagacagugaugaaguuauauuccugaaagcuuuucaagaaauaauauauuacaguggguaacuuagaaauccaucucuuuaggguuacugagaaauccaucuaccguaauugcaauauaauugaugcauguggauacaaauuuauucaccacauugaaguucugguuuaagacauuaaggagucaagauauagaauaaauucucuaaauauuauaagguaaugcuguuguacuaugaggacuguucauaaugauuucuauuuacugcauucaggaggacacaauugcaaauaaauuagucauaauagaccacagucacauuuuaguuuagcuauguuaguuuagcuuuuagaauguauggcugagguaucuccacaauaaauaucaguacauucaauuuccaaagagauuuggcauaaaaaguauuuguaauauuuuauauuuaacuuacuuaaaaaaguaaagccugagccuacauauguuuuaaaucugacacugaauucaaauaugccaaaggaguuauuaaauggggaaauagaguuuccagugcaaauaccacacuuaagugacuuugguaguuacauuuuuggcgcugguaucaaguccuacauugcugcugugguaagaccugacagauccuacuagcaccugugaguuggaaaucaaaaauuaaguagaagguaaagcagcaaagaauacaagaaagguaccugaaucccuucauauauccuucagugcuucucaaggcaaagaauaaaacucaaacuguuuaguauggcauguuuucaugaccuguccccucucugcauuuacuaucuuccaucguuucucaguccucaggacauucagcuacugaaccauuucccuuauagccguaugcauucauaccucaagaccccccagccgacccuguucauucaucuacuuagcuaaaauggacuccuuaaccucucccugagagaacagcuacucccacaaggacuccugucauucacugugcauucaccugucacgcuaccuaacacaaucaugcuuucucuucuggcuggugaaagaagcaauaauaguguuuucuguaaaauucucaagacacaguaagaagugauuugaaaaaauaaaucaaugaaugauuaaauagacuucuucauauaaaaauagaaacguuaauauuaugucauuuuuauuuuuuugagacggggucuugcucuguaaccaaggcuguagugcagggguaugaucucaccucacugcaaccuuuacuuccugggcugaagcaauccucccguaucagccuccucaguggcuaggacuaugagcacauaccaucaugccuggcuuuuuuuuuuuuuuuuuuuuuuuuuuuuuguagaaacagaauguugccauguugcccaggcuggucucgaacuccugagcucaggugauccacccaccucagccucccaaagugcugggauuacaggugugagccaccgugccuggcccuaugugauauuuaaauacaaaauggguucaauauuuacucaauaaugaaauauuguuuuuuauuucaucaugaauucuuuaauuauaaaccugaagguucuuuucuuuucuuuccuuuucuuuucguuacuuuucuuuuuuugagagggagucucacucugucacccagguggagugcaguggcgcaaucuuggcucacugcaaccucugcuucccagguucaauuucccaccucagccucuugaguagcugggacuacaggcacgugccaccacuacuggcuaauuuuuugcauuuuuaguagagacgggguuucaccauguuggccaggcuggucuugaacuccugaccucuggugaucugcccaccugggccucccaaagugcugggauuacaggugugagccaccaugcccaggcugaagguacuuuuauaaauugaaaaaaugggaaauuaugacuaaacuucacugggggcauguacaggaaaguacaguucagaaugagaguuagcuauaaauuuacauaauaagaauaacucugaaauaauauuuauuuagcacuuacgaugugccagacauuauacugcuuggggaauagauacaaaggagagaacacugaaaacaugacuuuggagacauuggcaauauaccaggugagaaaaaaauuuaccaaccuacaauccauggugaaauacuguaauaaguguuacaugaugaauuaaacaaagauucgguguccuccuguggucaaggucuucaaugucuaccuucugcccugccaagucugcaggcauucucuaaaaauaguccagucuucucuggcucaguaauuugucuucagguaccaacuuucucccucaauuucaaaccauuuuuuccugauuagagccuccaguuuggauggucccugaaauuuuaaccauucaaguugaugauucauuauccgaguuuggcucuuucccacuaugcuguauuguggaauacaucccuuggcucuaccuucuguggucucaacacaagcaaugcccacccaaucucaggcugcaacuccagggaacucaucuaacauugcugcuucuacuuguauggggaggaagggucaucaaaccagaauaaagaggaaggugaaacucauuuugacugggaugagaggugaaggcuauacaagaacaacaacaguugaguuggcccuuacauauuugggcagaaauaugaaagaaaaauaagggaaggguagucuagguagaagggucuuccuguuggagcaauggcauaaaaugugaaucucaaaggcuuacucaggugaagucaaagagacuacucagcauuagucauauuaagucucauaucuaguaaauguagaaauagauaaaauacauuacaaauagcuaaaagugccaguuuaagauuuauuuuaaaaaucaaggaaaauuccaucuuuugaagaaaagaagagauaaaauccauuaggcaaagagaucacauuacaaaugacaacaacuucaacaacaacagcaaaggaaccacaggacuucauuaaauugcccucaugcaaucacaaagcucguugaguuccuuguuaagguauuuaagucaaauacauuuccuucuuccaacuuaauuuucucuucuaccaagagaaucauuuacuuccucaguggcaguuguuaaaguaucuacuuuauugaauguguuaugcuuucucuauauguuuacccaaauguguauuuguugggucuaguaucuuguuuucauuuacguucuugucaacguugaacauuugauauuuuaucaugaguuucauugauuaaaucauaaagaugccauaucuguuuuaacauauacuguuaaugagaguuguaaauauagaaggaauucuagcaacaagaaguuaaaguaggauucaauuucaaaagagaguauaacucaaaagguauuucauauuaucacaccgggcacauauaaauugaaacugaguacccaaaaaaagauaagaaaauaauauuauaauuggacuuucauuuuuuccuagaguuuuuccaguuacauuuuuucaucauuuuauaaaaaguauuguauuuucuuucacucaaauaaucauaauuaucucauaugacugccucccuaggugcagagccaacaacaagaaaguaaaaugaaagaaaccagcugagugugucagcauuucaucuuuuggguaucugcauaucaauauacaauuucaauaugcaauagauuugacuucccugaaaauaauaguggagagccacuuuguuuggcaacauuaaaaaaauuuccauuuuucucuuaaugaaaucauuuuucauaacaaagaguguuuuuuauaaaucaugcauuuggaucuaaauaaagaaaagcuuccuuuauuuauuuugcuccugcaacaugggaaaggucuuucuuuguggcuucaaacuuucaaaguuggaaaaggucagaaggcacaaucuggauuagguuaucaggaauuaauggugguaacuuuuucaugaaauacuuugaaagcugguagcuggcauuauggaacuguuugaagaccacauucacauaauagacccuagacaaauguuguuucaauuaauauuuaauagguaucuuuuaguucuucuccugcuugcuucuucuguauuaucuggcaccauugcccacagacuucuggauacauucucagggcaccccacucaccugguucacugcauaucuuuguggcuacuccuucauuuugucuuuucgggcuguuucaucugcuuauucuauguauguuaaagauccucagggcucuagucuuaauccccuauucugucuauauuuuuccuggaaaaucucuuuuacuauggucucaauaaccauuuaugcaucaauaaaccuaaacacgcagagaucucuccacugagcucuaaauuccuaucuccaacaaccuccuguauguuucuucuugaaagcuuucaagaaccucacaugaaacaaauuuguaacugaguuacuuguuuacuauacaaaauaaccauuucuccuccuguaugacuucaacaauugcacaaagccugagaauaaccuugacucuucuuuucacuuaccacuagcaugagugaagcaccaagccucaaagguucuaucuaccuccugaauaauugcuuaaauacuucugcgaguuuccagccuaccaccaauauccuaaaucaggccaucaucucuuacugcaucaacuuucuaagucuucuuccugcccagacaugcucucacugagacagccaaguauaaaggggucccuggagaacuucugacuggaccgcacacugagagaggagugugcacugggguggggccucaggaaguucguccauuugcaguggggaggagucuggccccuccucuuccuggauaguaccugagauucaaccugaggugggaaaccagcuaggaggacucucgcuuugcugagagucccuguuuccuuuuuuuuuuuccuuuucacccaauaaauucaauuuuucucacccuucaaagggucugcaagccaaauauuucaugaucgugugacaacccggcuuuuagcuaaggagaaaguccuacaacaccaccaccaccagaccaucaagaucauuuccaaaauuaaaauguaaauccaaucaagucauucccucacuuaaauccuugcucuccccaacugcccaaaaauauuuacauuuuaauauguucuguuauauccuuuaugauuacugcaaguccauacccuuauggaguuuacuauuucacugagagaggcagaaaauaaacagaacgcaaguaaauaaaacagugcuuaauuaaaauaacugaaauaaauauaugaaaggacugaaggaccuauaugcuaauagcucuuaauagcacuagcaugaagcuggaaucccagagcgaaagaagaagaagaaaaauauaacuucaggauacggcauaacuucagaaaaagcaaaguaugacauauauucuuucuacucuuugccacacauaauaaaccaaauucaggcacacuugagaaaaaaaugugaguucaccaauuuaaaaaauuuuaaugugugcuacaaagguguuauaaacuagacuagugugaaaaggugugaauuaacuuccuuuuuaugccauggaauucaaugcaaaugugcaugauccccagaguaggauuucuaaaauaagcuaagaaugcguaagcccccuccauuuaaaaagaaaauucaaucaucuucaccacuaccagcuuaaaauauucugucuccuaaggaaccucuguaaaaauauaucaauaagcagugacuauuauuaguucaccuuuuagagacagcguuccacuaauacgcaguuauaucauggaauauuaaauagcacagaguuaggaccugaguuucccauugacauuuauuucaaaaauauauaauauacuuuaaaaaauaauauuaauuuaaauuuuaaauuuaaaauauuaauuuuuaaaauaauauauuuuaaaaaucuuuaaaaguauauaacaaaaacaauacaaugaaauuuaauaggauguucuuuacaauaucagcucagcaugcgguuuuuaucaccucccuguaacgaaggcagcugcauuccuauuuugguaaugcugaaaguaggugauacgcaaacccacguguggcacagccaaacugggaugguggaaaaggaaugcuucuugugccaucuccaucuccauuggugcccucaggucagaccaggcuccaguaaugcauccuggagauggucuccauuaugaggauggaaaagagcaaugaccaggcccuaugccaacaaacaauguaaccugggaccauuaacauaccaggcaaucuagccuuuaauggcauuuguuauaaugacuuugaaugacaaauguacaauguagcaaaguauguuuuuuccaaauuaaugaaaacuaaauacaugcugcacuaguauacuugguaaguuccacauaacauaauuaugaguuagcuuaaagaacaguaugcaauucaaaacauuuuccacacuuuacagaggauuuucaaaacauucauaaauuauacaugaaaauaauauuugcauaauuagcauaaaauuuuauaugucuauguuccacaugaguaaaauaagauuguuuugaccaaauauggaaccugccccacccaaacuccuacauguggacuggagauggcagcccauuagagacaagcaaugauguugagagaaagggacgcaaucuaaguaguguuaauaugccuuucccuauacagugaaccugaaagagaaacaacuaacuauaguguauuguccugauuaucauguauaaaacacaacuuuuguuuuugaaaagucacuuuuuguccuaaggagacaaagguuauguuauuaccuagagcuugguggaugucuaucuggaccaaaaaacccugaaucccaucauaaauuauauaaauacuuuuuuauguaaguauaugcauuuauaaauguaucauaugcacaucaaauagaaaauaguacugagagaaugaaggaaaauauauauauauauauauauauauauacacaucuuuauuauuagguguuuuccuuuuuccaaaugccuaacaaaauauugucuguaaaacauuaugaaucacauauuggaucaugucagcuacguuuauacuuuagcuaucauaaugccaugaauacacaccuucuugguuagacagugcauauauuguuugcauauuuuauauucacauuccuaucuuagaaaagaggaauauauuagaaaauaaguuucauuaguauucuuuucucucuuuaucucugucacacacagacacacacagacauacacacacacacccaaguuuagcaacaacacucagcuuuuuuuaacaucuaacuccaauuuaucuagauguauucuuucaaauuaauaaaaaguaaagugauaucaugcuguucaacagagcaaguuucacauuugcauaauugcaugaguguggcuagaaauacaauauauacccaaagcauuucuuuucaugcuacacacguguuucuauaaauguuaaaguuaaaauaacuuuuagaguauaauuagcagcaauaauauucaaauuguagaugcgaaaugcuggguaauguuuuauuuuuucuagaauuuguauaaucucagucgucaauuucuguucaaacagauuguaggcagcuaggcacuuuuccucugucuccauucagagaaauuagaggcuaaaaaacccuaucaaguaaauuuucagucaagaugauuaacuaagaacauaaaugaacaaauaaauuuaccuaacuacauuauuuuaaaaacacaaacuuuaaaauggcaaccauaaauguuauaguaguuaagaauaaaagaguuauuucaaaauuuaccacaaagcuacuguaaucaaaacagucuaauaaugauauaaggauagacacacagacauuuugauuaauagaauagaauuaagauuccccaaauaacccuuacauuucuaucaauggaucuuugaagauaguguugaaacaauuggcuauccacauacaaaagaauguaguuggaugccuaccauauaugaaaauuaacuaaaaauugaucaaaaaucuauaaauauagaaguaaaaacuagaaaacucucagaagaaaauacaggcauaaauaugugugcuuuuggauuaggcaaucauuucuuagauaugacaccagaagagcaagaaaccaaaauaaaaacaaauacauuugacuuccucaaaauuaaaaacuuuugugcuucaaagcacaccaucaaaaaacugaaaagacauuucacagaauggaagaaaauuuuuucaaaucauauaucuaguaagacucuaauauccagaauauauaaaaaacuauuauaacucaauaauaaaaagacaaaugcaaauagcccaagaugggcaaagaucugaauagauauuucuccaaagaagcuauaugagggccaccaaguacaugaaaagaugcucaacaucaugagucauacuagaaaaaugcacaucucuaaaaucauuagacaugugguaucuccacaagaagauaccacuucacacucacuaccauggcuauaaucacaaagauaaaaaaacaacaagaauuagcaaagauguggagaaacuggaaucuucauacugcuggagggaaagaaaaauggugcaguaguauuagaaaauaauuuggcaaguugcucaaaaaauugaacuuagcguuaccaugcaacuaaacgauuccacuccuugguggacuauacauaccaagagaaaugaaaacauauguucauaaaagaaaacuuguguacuaaugcucauaguagcauuauucaugauugacaaaaaguagaaacacccaaaugcccaucaagggaugaauggauaaacaaaaugugguauaugcauaaaauagcauauuauucagccauaaaacgaaaugaaauauuuauaaaugcuacaacauugaugagccucaaaaauaggaggcuaaaggaaagaagccaggcacaaaggucauauauuauauaauucaguuuacauaacaugucgacaauaagcaaaucuguggaaacacugugcagacaguaagccuagagaugagaaaauuggagaaugauugcuauuauguaugggguuucuuuuggggguaaggaaaauauucuggaauuagauaguggugauaguuccacaaccuugcaaauauucuagaaaccacuauauuguacacuuuaaaagggugaauuuuaugguauguuaauuauauuucaauuaaaauguaaaaguauuauuaaaaugauacaauuuagaacaaaaaucucaggaauuauuaauacuaggugaaaucugggaugcuucuucauaaauggacaaucucugagguugagucaauagcugauggugaacauuuucuucgaucuaaggcguuuccaggauauauucacaacucagcuucuguagcucuuuagaucauuugguauuucauaugcuuuuccuaacauauucauacucuuuucucugaaauuuagaggcuuaagaaaucugcuuuuucuaggaaaagacauucuuuugccuuucuaauauccauccucuuuugcuuccuaauggccauagcauacaauagagagacacaucauuaucuauccaaccucugcaccugccacauacuccuauuguuuuuccuauucuuagaagccagcaaccugaauuaaagccaacuucaauaacacuuuaaaguggucuaacaaccagauucuuccaaggcuauuuccauauucuaaguguauggacauuuucacccugaacauucaaacacagccaccuguuuauucuuuccaugaccaccaccaaccuaauagagcugcuacacccaaucucuccuggucucugaaaacaaacuucuaaugccuuguaauucaucuuuuuccaucuccauuucacuuaauucuaaccuccaagguuguuaaugaccuccuaaugaccaaagccaguagauuuucccaaguuuugauacuaauuuacuucucugaagcauuuaauacuguuuaaaaagccacuugcuccaaguugucauuuucucuuuuaacuaagauugucaaaaaaaaaaaaauguagcugacguuucuucccuguucuguuucuaaugcacaaagacuuucuuggagaagugagucaggcgcuagagauguuaaauauacauaucauacauaauagcuguuugaucacaggcaaacuaacuucuaagagccccaacuuuuuuuuucuguaaaucggguguuuuucagaguuucuauaaaaaugauaugacauguuacauaugaauuuauuaucacuagccuggcacauaaaugguaguuuuuucguuauaguuaguauuauuuuaucaucuucaccacuauuauuauaaccuccuuuauaauaauuaacuuugaagucuuuaucuccaguucugcccucuuuuccaagcuccuguagaauucucugcuagauagaacuacuaguguucaaccuacuuccacguacucucuguccauccaaagugcauuugaucaucuuugucaggugccaagaaacaccacuacuucacugaugauaucaccaucuucacaguuuuaugguuugaaagccugguuucagcuuucauucuuuccuacuauggggaaaaaauauauucccaaguuuacucaacuaugucucugcaauauuucuuaagugcauucccugcccuccauuuccacacagaaaugaagccgggccucuguuauuucucacuuucaucagugguucucagacauggcaaaauaucacaaucaaaauccaaauccuuggaaccgccccacaucuacccaaucauaaacuccaaagaauaaggccuagaacucaaccauacugaaaagcucccaagugauucacauaaacugccagauuucaaauucaauggcacauaccaggaaagcacccucugauagucuaauuccaguaugagcucuuuccacuguuucuuuuuacccgguaaugccagcuauauucuuuagaaaguucagcuucucaaauuacugcucuaaaacacacucuaccucuccacuaucuauaaaguucaaccuuaauuauucagcauucauucaucaaaauuuuuuaagcaccuacaauaauaggugcugaguguaugaaaaccgaggauaaaauaaaauauuugagugguuaacaaccuaaagaugggaagagagaaagagugaugggaugggaggagacagagaaagagaggagagagaaaggagcagagaguaccagcauuuauucaauaccucuauccugcuagccaaaggaucuacacuuagaauuaauuuucuucuuaguuuggcaccacugucagguuucauucuuauucaccaccauuacccaagcuccaaugaaaauaaaaagcucccauuguuuccacaaaaacgcugagucuuugugcauguagguuugggcucauacuuacuuuaaaaggguguagaaagacuuucccuauacuaucucauuucacuguguccaaauccuugucaucuuucaugucccaaguaagccaauccugauugaccaaacagaaaauugguuuucugaguaucaggcacucuauaaggaacugaggcccuucuaccacauacaauaaauauuuuacauuuguuaucuucccuauuacacugcacgucccuuuagggaaggauucauaauggaucuuucauugaaucuuuacagcacuacuguaugucauaaaagcuuuaaacuaaugcauauaaacagauagagugacaaauaaugaauacuuuuguaaaaccugaauuuugguaccuauuaggcguguuaucagaccagaaguuuacuaagauggcauuauugauauaaaauaauagcugauuaaauuauaguuaauaaugagauaugcagucauuuuugcaucacuaaauggcagaaucaaucuguaaaaagauaucauguucaguguugacuuaagaacacuugugggcauguucaguuuuaaacuaagcuuuuauuagcccaggaaacuaccugaacauacuaagaauguuaucuaaauuucuuuagaaaaauuuaugcagaacuagaauaugcugauaaucauagucuggucuaaaacauggaagugucucuuugugaacguuuacguauguauaaaucucuauguguguaaacgcucuggagauucuguacaaugcugugaaauaugcauuauauuuaaaaacaaaacaacaucaagcccaacugucaccaggagaauccuaugcacagcuaaacagauaauucuacuaaacugaaaguuuucauuuaauuagguucaguaccacaguaguacacugacaaaaauaauagaugucaauaccaguuuaggaagccaauccuauguagacacaucugcagagaagccaauucaucucaauauaugaauccagggugaaaacaaaugaauuacauuauggauuuuagagucacaucagcucauauggauuaugccaccauaagcagagucaucauuuugaaagaagaaagccagccaaaucuaaagaaguuaauauaauuuuccaaggguuuaguacauccccuaaaagucuuccacacagagaauaaguaguucaaauuuuagguaacagaauggaaaugaaaccauuagaacagcauugaguuuaaaacuaaguaggcaaauuauaaguguaggucauuuuuuuuuuaacuaaggaaaccuaaaaagugaauuacauuuaauuuucaaaugggcaucucugcuagcuccuccaagaugucucuuguggauacuagcuuaaauuccagcauucagagcucacucaucacauucuguuuccaauuucugaaaugaaguacaacuaacacaauacacagcaagaaaauaaaugcauacaucagaauuaagagggccaccuuaggcccugaacucuccuaacgggcaaaaguuguagguuaugaaauaaagauaacucugccauaauuuaauuuuauguauugagggcuauugagagaauaauaaacaaaaaacugaccuauucuacuucccacaggggacaauaaaagaagaaaugagcuuaaauuccagcaacagagauuuugguuagauaugagaaaaaguucccugacagugaaugcuguaaggaucuagaauaggcugcccaaaaaggcuguagaauuuccuucucugaagaucuuuaagaaucagaaaaaaugcaagcauguaggguaacuuaacucaggagauagaaaaagauggguaaauuaagugacucaaaaagguacugcugauuuauuuccuauguuuuaaaaccaguacuucaaauaaaucuuauauugacugucugcaauaaaaaugaacauuuccaaacacugcuuuaccagcuccaaauuuaaaaacugagacucgaagagguuacauaaauaauuaggggaggcaguauuuacagcuaggcuucgcuaauucuaaauuccauuuaauggcacuauuuuacauauaagaagacaaaagguguuaacaauuuuguguuuauauugacaaguaccuaagugugguaugggcugcauuucagagaggcaugcuuaagcacuaaaaccugaacacacauauuuugugcacaacaauguaacuaagaauguaucaggggacuggcuucaauucaaaaaacuagaaaccgucagaaucaucucauguuuguugaacuagaugaaaaaggcagcuacaucuuccucuuuucauauacauggugaaccaagaauaaaagugcuagcuggggucaguacacauaaugcugcauucugcuagggagguccaagucaccacuauaaaaucuucuaugaaccagauaaauuuacauggaggaaauccucugauccucaacuaagggcucacuccuaacccuucccaguuacugaacaaaugcaugaaacccugccaauggugacaggacagaaugagagaauaaagaggguucaauauaaaucuaucauuauuauauuaacaagccauuauuacuagaaaaauaacuucuagaacuuguuucauuaaugagucagcagaaucuucaauuuauauggaggaggauauauuacucaaucauaaaaauaaggcaacagaaaauuaaaauaaaaacaaggacuauagucuaauucucuuugaaacucgaaguuaauguguuuugacaauaauuuuaaaaagguaccuuugcaaaaauuauaauggacccauuuauagaaccaaaaagguaucugagcaaguaaauuucuuacauuucacugagaaauuaaauccucaaaacugucaacaacaauauuuacauuuuucacauuuguuuacuuacucagcucagucuuugaauaaggagcuguaugaacuuuuucuuuagucaaggucaguggguaacacugagauguguuugcaauaugaacauuucuuguaucuuuugaguaauuauuauaucauugaccuugguaaauccuaaugugaaauauggaaacggcacauaacuaagaauaagaaauucaaugcucuagucagaauucuguucaugauacagaauucaguucacuauaaaucugcuucuugcaugaaauguuuuaauagcauuugagaauaaaauaauauauucuaacacaauucaaauaaaauagagcaguuaaaauguuaaaacacaggaaauuucuuaaaugagauccaugacugccucuucuaaauucguaguauguaaacucauauuaacuauugaaacuuacaacaugaaugaaagcuuuugaaguaaaacugucuuauuccuuaaagugaugccaguuucacucucaccuuucccuccccauucaagaggaugcuuuugagggaaaggcucaggguggggacuacuggguguuuucucagcuacacuauauuccaguguauggccuuauucaauaauuuucacauuuugcuuuugaaaaggcaagaguaaauuugccaagaaagagaaaagugauagaacaguuuuuugucaccuaggaauccuaaggaugucaccugcaucucaauuugcauaaaaauaggacccacaaaggaaugugcccuaaggcaaaaagagugcuagacucuugacugugaaaucugcuccuaauuccuaauaaacuuuuagccagguggguggcacugggcuuuagccucuaagggcucuuuuguuuugcaucuugaaaaugagcaaaugcaauuaaauggcugcuaaauggcauuuaaaauauccugauaccaacuaucaauaggcuuaauacccauuuugcucuguuuggauuuucuauuucaugccucuuggauaggacaggguaaauucacaaagaaagaaaacaaacauaagaaaacuaugaccauggaaguaucaccauucuccucauuuaugaaauaaugacaauaaccuccauuucuguggaacuguuuugagaacaggauuaauuuaauagagugucuagcacaauuugauguuggguaugaggugucuggagccuucuaucuuaaugaucuauuuuucacuuuuucuagagguauuccuguaggaaccuugaaaaucuaacagacauuggauccagaaucauugggcuuuuugaaacauccuauggccuggcaauggguaugacaaaacuaccuuaauaauuagaugugucagucccacuggaagauaagcuucagaauuaccccuaagcuaauguaagugcucucuauaguacaguguauaaaauuauaugguaauacuauauagcauauguccucucauaauuuucaggaucuccaucuacaguucuuuucccaaacaauccuaaggaagauauugugaucaauuaauacaaacuaaccuugagugauuuucuucaaauaauguugcaaaguaauuuaccucaauauguagaaggcuaucguaucaguuccaacauguauucugagucuuucaaauacagauuuguguuuuaaaaaaaaaaagguuucaugugccaucagguauugauggcuacaagaggggccagcacaugagugauaagcaauucuccauccaccuuggcuaaauggagacaaagcuuuacauucacaggucauugcaugcaagaaugauacagcagaucagauguaacccuucaacagcccaaaucuauuuguagugugaaaggaaaacaaaaaccuugggacccaaacucacuaugucaaauggaaaagucaagcuugagaacugaguugcaaaacugccuccuauuuuguuccuaaguagauagcugcaaagauagaaguccacauaccuccccagguggccucccuuacaaugugcucacaagaaaauucuuugugagccccaagauauuuacccuauuuuaugguuuguauuuguguccccacccaaaccucauauugaauuguaauccucagugauaagaggagaagccugguaguaggugaauggaucaagagggcagacaucccccuguuguucucaugauagugagugaguucucacaagaucugguuguuuaaaaguguauagcacuucacuaucucuuccuccuucuccagccauauaagaugugccugcuuccccuuugccuuccaccauaacuauaaguuucuugaggccccuccagccaugcuucauguuaagccugugcaacugugaaugaauuaaaccuuuuuucuuuauaaauuacccagucuccaguaguucuuuacagcaaugcaaaaacagaccaacacagaaaauucauaccaggaguggggcacugcuauaaagauacuugcaaauguggaagcaacuuuggaacuagguaacgggaagagguuggaacaguuuggcaggcucagaagaagacaggaagaugugaacaaguuuggaacguccuagagacuuguugaaugguuuugacaaaaauacugauagugauauggacagagauggccaagcugaugaggucucaauggagagaaggaacauauuuggaaauuugaacuugaaaguaaugauuuaggguaugagggggaagaaauuucuaagcagcaaaauauucaagagcuuauauucaagggcaaaaaaaugauugggaacuggaacucauauuuaaaagggaagcagaguuguaaaaguuuggaaaauuugcaaccuggccaugugguagaaaagaaaaacccauuuucuaagaaggaauucaagccagcugcagaaauuugcauuuguaaagaggagccaaauguugauagccaagauaauggggaaaaguccuugaaggaauuucaaagacuuuuguggcagccccucccauuacaggccuggaggccuaggagggaaaaaugguuuugugggucaggcccugggccccacugcucuacgcagccucaaaaaauaaugccuggcauugugguugcuccagcuccagccucagcuaaaagggaccaaggagcagcucaggcuguugcuucauagggugcaagccaaaagcuuugguggcuuccaugagauguuaagccucagggugugcagagugugagaguugaggcuugggagccucuaucuagauuucagaggaugaauggaaaugcccggauguccaggcagaagucuacuauggggcagagccuucagggagaaccucuacuagggcaguacagagaggaaauguggggcuggagccccuacacagaguccccacuggggaacugccuaguggagcugugagaagagggccaccaugcuccagacuccagaauuguagauuuacugacagcuugcaccaugugccuggaauagcugcagacacucaaugccaaccgguggaagcagccaagggggcucccagugccuugggagcccacccuugcaucacuguggucuggaugugagacacggagucaaaggagauuacuuuggagcuuuuagguuuaaugauuguccugcuggauuucagacuugcauggggccuguagucccuuuguuugggcugauuuuucccuuuuggaaugggaguauuuagccaaugccuguacccacauuguaucuuggaaguaacuaacugguuuugauuuuacaggcucauaggcagaagggauuugccuugucucaagugagacuuuggacuguggacuuugaguuaaugcugggaugaguuaagacuucgggggaauguugggaaugaaaugugagaagaauauaagauuugggaggggccagaggugaaaugauaugguuuggauuugugucccugcccaaauuucaugucaaauuauaaucaccaauguuggaggaagagccuguugggaggugacuggaucaugggggcagacuucccccuugcuguucucaugauagugaguucucacaagaucugguuguuuaaaagugugcagcaccucccacucccuucuuccuccuucuccguccauguaagaugugccugcuuccccuuugccuuccaccaugauuguaagcuuuuugaagccucccuagccauacuucauguacaacuuguggaacugugagucaauuaaaccucuauucuuuauaaauuacccagucacagguaauucuuuauagcaauuugagaauggcuuaauacacccugaaacagaguucuguugaauuucacucugacaauguaaauugacagcuugucuccacaguuuugggacuaacgcagguguagagguuauccuucugcucucaccugagacaaauguauauuugacugcuugcuugacucugcauuuacuuuaucuuauguaaaaauguaauucccugagcacccuccuuucacaaguaaaauguggauucaguaaauauuaaucaaaaccuuaaaaagaauguaaccucuugccucuuuuaucuacccucccccauuuuuccauuuccucuuuccccuguugccuucucuuuccccuuuaaauacugagguccucaaaaccucuuuggaaaaagcacagauaaucacagaugcuccugagguuuuguuucuuuuuccugggucuaucuucaaccuuggcaaaauaagcuuccaaauuugguagagacucaccucaguuuuuuucuuugguuugcagcagcuauauagugacgaauaguagaaaauauuaaaacagacacagcuauaagaacaagcugcaaauuuuuucucacuuccuacaguaauaauuuuuauuuauugaaauguuuuuuauugacuuaucaaauuaucacagauuccauuauuccucuauuccuccacucuucggugaugaaccugugguuaauauucccuguaaaggucuuuagauauagugggaagggcacagcaguccuuggaggcagaacugagucccaacugcaacucucccauucaucagcuaggugacuguggguauauuagguuucucaucuaugucuuaguuuauucacguuguaaggucuaaaggaacuaugcaguccuacuggaacauagcugagauucagacaaugcuaggaauccaaacccugcucgcaaugcaugguauuugguauaaaaagauacugaaugaaagaauaaaggaaagaauaaguaaaugaguguugcgcuuaauacagauguaauggucauacaacagggguaacauuugggcauuuuaauauuuggccuucucaucuacaauauuucuuuacuuuuauuucauaacauucugccauugcaauucggcuauggcuauggaguggaugauguggugugaggccuacauccuccuuucaauaccaagauacugauucccucacaugcuaagagugacgugcacugguggcucauugcugagucucccucaggaaauugucuuugacugcagaaaugugccuugcccagagucauggccucuucucaaggaaacacagcauccagugacugcucaauuuaaagguccgaaguucuagcccuuuuaccucaaaaagaauaacucugaagaaucauuucgucuccagaacucccaaggguaucagcugaagaucauaaagguaaccagagugcagaaaggggaaauucagacauuuugagaauaguuagaaacagaauuucacuugacauugauauccagggaacugaaacauuauugugcccccucccucaccuccuaccucuaauuagauuggagaaugcaagacagucaggcaauaaauggaguuccagcccaguucuggcucauaguggguccacuagguccacggaucuagccagugauuauuuuacuggcccuuauauaauuaaaacaaacauaccuguaaauagcagaacucucgguuuggcucuuucaucuuaaagucaagcauaagucucagauauugcccuccuccuaguucuuucaaaauaguauaucaaaaacaguaucauauaacaggggaaauagcagauaaagaaaccagggguagugguccucccaugauauccccaauuaauacaccaucuggcacuacaaaaaacagaugaguccugacagaugacaguaaacuuccacaaacuuaaccaaguaguaaucccaacugcagcuucagugucagaugugguauuuuuuuuauuaugacaaauuaauauagcuucauguauuuagccauugagcugauuaacauaucauuuuccaaaauacuggaaaagaguuuuguagcaguucauaguuacaugacaaagaaaagaguauauacuuauaaucuggcacuaggguuaaaccaauucucuagucuuuugucauacugaacucugaagggaucuaaaccauccuggauguucugcaaaacaucacauuuguauacuauguaaaugacuguaaguuaauuggaccagaugagcaaggagaaagcgcaaugcuuugcauuaagcucauuccacgugugugaauacugccccgacccaugugcuaagaggcaugaaaguuauaggaaccaugggaacuaauaauaaagcuccaccaaaagacauuuaaauucuauuuguugaaaaaacagucuauggccaaaccaaguuuccaaucccuauaucuuuuuuaaaugauauaacggaggaaggaacagagaauuugaaauaauaaagacagaauucagccuuaccugacuucugagaaauuuguuuuuggauggacaaucagaaauaagccugaguuucugaaguauuacuaugcaccguaugcccuguggacacauaaccauuaagcggcaacggaccuucaccaaaaugaacagccuuuuauuugaaagacauuucuauguggguuggcagcaucagacaggggucagcucaagugccugggauugggaguuggguacaugaugaacagagugacauggagaaggcugcagcagcuggcccaucauacaugcaagucagguaaagaggagcaggcacuguggggcaggccaggccagcugaaccuggcccaacagagaguguugcauucacagaacucuccacuuacucaagaaaucagagaagggaauauagaagcugagucauuaaugguccagucccagacauggaucgccuucuaggauaugguuguagauuucaccaaauucacuucucagcagaacauauacaaauaagugaugcauuaguacuaugagaacccaguuuccuuugagugucagcuucccaaacagaugugauucucuagauggagaaagguaaagaaucauagcugguggagaacuggccagauucagugacuaucauggaaaucaaaucaucaauuucuaacaauagcauuucugaagauaaacaauucuaugacauuaaaauggaagaaauggaaaggaaugauuucucauauuugucauuaaaaauggaaaugugaaaacaaacuagacaauuaucaggaaaaugagaagaaacauuuaagauaagaaacauucacacaaaacaaagugcuuaggagagucugugaaagugauaaauacuggggacacuguaucuuucaugcucauuaguacuuaaagaguauuuccguuaaguaugauucaaauguuaaaaguuuaaaacauaauuuaguuuaguggucaucaggcaaacuaugucaguaacaguaauaaacguacuaaaaccuuuuguuaaaacauucaccugauucaauuugcgagaacucaaacaggagauaaacccuacaaugauagcaauaaguuucuuacuuauaguacaucccuugguauaccuaaggguguaaauaaaaagacaaacaccaugaauaucaagaagaugcaaaauucuucaaaugcgguucucacuacauuaacaucauguaacucacacuggugagaaaucauaaguagguaaauaaugcauaagcaugugaaaaagucuuuagcugguucuaucacuuuuuuucuauauuagagaacucauacuggagacaaacuguauauauguaaucaguguggaaaaguguuugguauuuuccaugugguaguuucauuagacuugaaagaaaucauaccagagacaaacucagugauaguccugaacuuggaaaaucuuucagacagaacacucaccucauuaugcauuacagaacuuucauaagagggaggcccuacgaagauaaugaauuuaggaagucuuauauacagaggucucauguuauuaugcaucagauaauucacaauaggaugaaauaauacaaagacuaaaaaauacuucaguugaagcugucacauuuucuucacaucagaaaacccugcuggagagaagccauaugaaugacuugauuguggaaaauucuucagccagagcucugaccuuauugugugucaaaaaauagaaagagagcaaucauaugaauguugucaauguagaagucuucauccaaaagaauaacuucauaaaguaucaaacaauuucucauaugggagagcaauucuuaaaauguaaucauugugggacagcuuuuguuuauauaucuaaauuuauuagguaccagaugaagcauauuagagaaaacacucacuaauauacugaauauggaaaauuagucacaaagaguaauacauuuauuuugcaucaaagagucauucuggugagaagcccuguacuaccuauggagaaauguuuuaaacccuauuaugaucccuauuauguaccagagaacuaguccuaaagaaacacaagcacucacacacacacaaacacacacacacgcaugcaugcacauuacauuuuaguaaacaaguacaucaagcguucuuuucacaaauuccacaaauuucuaaaaaauuaguuggccuggaagcacuguugagcaggccuuaaggcuugaaucuggaaaggaaucauuacauaggcaaguuguugagauacaacccagcuuccuuaacuucuucaaaauaaauaaaaaugcuauuguagggagaacuguugcugagaagacuaaaauauguauauaguuauugcaacagaaguugcaauaauguacaaucaaucaguauuccagugaguuaacaugccauugcuuacuugauugcuccaccccuggggacaguugguaguuuuuaaacuguuguaugugucugcuauaaaccacauuuugguuuguagcagggcaguguaaagcaaucaaagaacaacacauuuauauuauucuuaguaccuauuuuuaauauauuugcauauuggaaagaauuaaaagagcagcuacagauuauaaacagaagcaauuugccagauaaagggacuauaaggaaauuacauuuuuauaacuuauucagugcuacgguaauaauaauuugaauacaauuguaaauacuuuuaaaaagaugguuucucuauucuacucugaaggaugcuuggauacaacuggcuggaaaacuuucccaugaauucuaaccuguuuuagguuggaguuacaguucugcucuaagacaugguuuuaaaaguuccugagaauuuaaggaugcuaaauucucuaacuuaggaccuagaaaaaacacuggaugacucaggggaagaugccaucugagugagaguaugugccucacucaguauuggcaauauuuauagcaacucugcucacaugaaaaaaacaaaccacucacuguacaaggcuaacucuaauguuagucuuguaucuuccuaaagaaaacaugguuaagaacagcaacuagaguuugacugcucagguucaaaccccaccucuuccccaacuagcugggcaaucuuggguaugguacuuagcuucucugugccugacuuacacacauccuucucugcuaaacugagauaauaguaguacuuacuucauaugauuguuguauuaaaugaguaaauauauaaagagcuuagaauagugccugacacauaugaagugcuuuauaauuacuaguuauauuuauucauauuauaaguauugcuccuaucuaauuuaagcuuguuugaguacuuauauuaugagcauaaaaaaguaagcuuuuacuucacuuucagucacuucacuuucacuccugauuugccuaaaucgagaguuaucaaccugggaaaucacugacaccuaguggguguauggauucauuugugaagaucaauaaacucacuuugaauaauauuuuuuuuaaaaaaagaaaacaacaucccccaacuacacaaauguguuuucaucauuuuaucauuuuaguguguuuauaguuaaaguguuugauguaauuaggauaugaggccaccugcuauaacaaaagccaacagaucaaggaguuaaaccaguuccuuuuucucucguguaacaguuggcauauacauaguucauauuugauguggcugcuccauaucacggaugugggcuccaucuauuguauuacuguggcauccucaauguacagcuuccauuuuguaaccuagguccucuuacuguaacucaacugagccuauggacagggaguggggaaggagaagugaaggcaugccgcuucucucuaagcauagggccuagaaguugcacacaaaacucagcuccuccuucacuggauauaacuuucugaauaaucacauguagcuguaagggaggcugggacauguauugcacuauguccaauucaggaguuguauuacuaaaaaaguaugugagagugaguaagggggcugacaacugucucugcaacggugcuaucaugugaugcugaauuuaaauauuguguagauauuuggaacugugaaaaauauuguguuuuuccuuuuucuuaucuuucuggauagccccggccuauugcucccucagguuauaacaaaacagaaccauuaucauaugcuccaauugggcacagaaugggacucucucugcaaguuagauguccuuugaauggaguuuuaagauugacaguugcuugcuuccucuuccaaagucagucuaccugagcugggaaguucacccagagcucaagcaagggaggccaaggcaauauuucuuuguuaggccacuugggcucuaaauaccugcuaagcauuuuccuuggguaacuccuagaauuuaagaagugauucaucuucauuuugggucucaugaaaaaaucaauauucuuugugucaccaagaaaaaauucugaagcuagacauauucucaccaagucacuaaaaccuaauauagcuaugucccugcacuuucauaaaaagcuuauuuucaaaaacugccuuuaucaguuacacaaauuugucuuaccuaucuucuaugcuacagaaggccucugaaguggcaccuagacuaggaacugguauaguuaccuucuagaccccagaaaucuucccauucccuuuaccaagaaaaguuuguuucaauugcuucacuuacaaaagaaaagaaaagaaagccauguucauggcuucccaagccaaaauagucauuuugugguuugucuuucagcucaagagauuauggacugacuucucuagacuuaaccuacaacucaacugauuuauugcaacuacacacuauucauucaaaaauuucccaaaccagcugggcgcgguggcucaugccuguaaucacagcacuuuggaaggccaaggcagguggaucacuugagguccagaguuugagaccagccuggccaauauggugaaacccuguaacuaccaaaaauacaaaaauuagcccagugugguggcgcacgccuguagucucagcuacucaggaggcugggcaagagaaucucuugaacccaggaggcaggguuugcagcgacccgagaucauaccacugaacuccagcagacagagugagacuccauuuccaagaaaaguccccaaaccuggaucuuguugacuaauuuuguccaacucuucccuuguccaagaauacuuguuguccuuuucuacuuuaauauuuuauaacgagaaauuuaaaucacaaagucuuuuuuuauucuuuaauauuuucaaauugguguuaaugaaauuuugguaucaugauaaaggcauaaaauggacuuuguaaaacagauggacacaauguuuuauuuccagguaguucugcacuauuauauagccuaugaaaccauuuucauuauaaaucauauuuucauauauaaucaucuauuaaaugaucuguucauugcuagugaagcauaaaaccaacacauuaaacaagguccaauugggugugacggaagcaguggagcuacuaaaaaaaaguugucagauugaaaaccaucaaaacagucaaaauaauaagugagucaaaaauguauuucuaacugcugcuuuuauaaccagcaagcuacagcugucuaucuuuaaaaacaucuuuaaagaaauauuugaauuaagguaacacuaaauuuacauauuaaucuucuuaagaagaaagguacaacaaugcuuaguuacugaaauaauaacuugauuucacauuucaaaguaaaauaaaauccuaacacucuuuuauaggauauccagcucauaacgauugcuuugucuuuuuuggauauuacacgguuuuguuucaaugaaacuuuacaaauauuuuaccaaacuucacaaauauguuuuaauggaaaauuaugaacguguuccgaaauaguaaaaguauauaucaaagaucuaaugucguacuugaaagucaauuuuacaucacaaaacagccagguuccagacaauucacuuaacacuguaagcuaaaguuuaugaaaauacuucccaagaagaaaaacagagcauuuauaaaugguugaaaaugaauuugaaauuuuaaaaacacaugaguuguuuuuaaaaugguagaaaaugcaaacaaacuauuaaauuuauuaaacuuacuaagccccuccauauucucauaaguugauaaaaauucuuagugacacauuaagcagagaaaugcacuacagugaaaaaaaucaggacauuaauauauaaagaaaauauucauuuuugauaguuuuuaaccaguuuacaggagauagugaaauggucuuacuaaaauaaauaaauauguguguguaugugcaugugagauuuccaaaauuaaagcagcucuguucuaugcuaacauuuguaaaauaagaauuugcuaauaguguuuaagguacuacgcuauaaacuuuaugugcauuaucuuuaauccuuuauagguuaguacuaucaucucauuuuacagauaaguaaauuagggcucagaaugcucauuaaaccugcccaguuuuagugagcaaugaagcugagauucaaaucugggaauuuugcuucaaagcucaacacagacaaaaaaauugagacauucuguuuaaaugucugcaaccuaauuucaaugcuuugaaaucacaaaaauacaaaagucaauuacauucaaaaaggaaaaguaacuuuugcugcuuaaguuugcaaaacucauaaagaauacuaaauagaauaguuauuuuaggauaaaucuuuuacuuuuaacaucagauaacauagugcauuuuguaauacaaaauuucuuucuuucgauuuugaagggcugaagaaauagcccauacuaggggaugaaaaauggggauuaauacuggcaguaggaaauugcagcagccagacaaaacccuucagguuaucuuggcaaguuuagcagugcugagaacauucacacaauauauacuacuuucgggcuaaaagguucggcacauuucaguugcagaaguauaaagccuaguuuuuaaaaagcuaaagagaaaaaaaaagaaauuauaaggccagaaagcucucaguugaaagcauuauuaguuuucuagcauuaugaaaaauuaucaccacaagcaccaugucacacauuccauaaaaauuaugaagacuggggccaggcacgguggcucacgccuguaaucccaacacuuugggaggcuaaggugggugaaucacgaggucaagagaucgacaccauccuggacaacauggugaaaccccgucucuacuacaaauacaaaaauuaguugggcgugguggcgcacaccuguagucccagcuacucaggaaacugaggcaggagaauugcuugaccccaggagguggagguugcagugagccaagaucaugccacugcacuccagccuggcaacagagagagacucugucucaaaaaaaaaaaaaaauuaugaagauuggggaaaugcaaaucguaaauguucuaauaagcugagacaccagccacuauuuaaccuauuaaucaacuccuaagccauaagaauuugggcuauauggcaaauauuucacucuguagcuaaauauauccuuuaguacauauuuuuaccaaguauaugaguguauauauauauauauauauauauauauauaugugugugugcguguguguauguguauauauguauacaaguauauguauguauuuauacauauguguaaacauuguguguguguauauauauauauauauaggauaucuguguguacauauaagagcuccaaaauuaaagcagcuccauucuauucuaacauuuguaaaauaagaauuugaaaaauuauucuuguguguguguacauauauauauauauacacacaaacucauauauauguguaauauauauguuuauacuuauacacaugaauauacuuucaagguuaaaaauguuaacaaaagacacauagggauaagcacaguuacauugcagacuuaaaaccuaacaaagaaauguuuuuucaggacaugucucauggacauuuuauacaagguaugaaaugcuaaaucacaagcaaaccaaucaaaacaauuugaucaacacaacauuaaaauuugacauuuaaucacaccaauccgauagcuauuaaauaaaagcuacccauuuccaacucuccauaccauguuaaguuguuucaagcaaauuauuugaucaaacuuacaguaaguaggaaaaguuaucaacacuucaaaguacucagaaauaaacaaaucacugaagaguuaaaugguguccaaaaacuacacaaagcaaagucacggaaucaaagaucuuuuuuaaauguauaagcgacuucauuaauauuuaacaaaauugaaucacauuugguucacuuauauuucaugugcucauuauaaauacauaacuaugacuuaaaaauguguuuguccugugaaucaacuaaaacaauugagucauccuacauaaagcaaguggcauucaugccacacuuuaggaaacaguaauguaaacgauuacaggaauacaauggggauuaguauaauuuuggguggggagauuuaaaggaaggauaguccaaacggagauggagucagcugaggggcaaaacucugcuucucuucuauuuauuucaagggcauauguugcacuuacucggugccagacacuguuuaaggugcucugcaaauauccaaucauugauucuuacuguaacccuaugagguaaguaauauuguuauaugcauuuuacagaugagaaagcuaagguacggugagggucagucacuugcccaagcuaguaaguggcagagccagguguuguaccuaaacacagcccacaccccuaaccacuaagugguacugcuuugaaugaccgaaaacugcccccuuuggauccuuuuucucuuacucauucccuuuugugauauaaguuuaauuauucuuucauacaaaaaaauauauaagguucuggggaaacaucagcaaacaaaagcaacagaguuccuguucucaugaagguugcagucuggugggacagaaaggaauuuaggaauuauauacaaauuaguguguaacugcuaauuaaaauaaauacuauuuaaaagccagguuuucuuaaugcacgugacaagaaacaagaccuggguggggcagucacagaaagaccuuccaaaaagagacacuaagcaggaggagcucuaaagauacugucauuaaccagguaaagaagugcaggagcuagaaaugcacagccccccuaauuuccaugcaguuguggucagccucauuuauugauguggaaguggaaggacagauaguucugguccacaagagucuuucaaacacugacaggcuugaggugaccagaagggaaaaaugagaucacaggauucaacaacugagggcaaacacacucccagcuggggguaaaaguagcauuuccaaaccucccuguuccugucuauccuaauaauaaagccacccacaguuuauuacaauauaaagauaaaaucagagugauuuacaaguaacauuguaucugaaaguaacauuguaucugaauucuuugagcugcuagaauucacauuacugcuuccaagggccucauacagucaaaaagguuuacagugauuuagccuucaugacuuuauauccagaggacccaggaccacagauaucaccuucuaucaccuccagcauuuccaauggccuucucgaggccuuucacacuuucuaaacacgcucuugaugugugaaggccaacagaagacacgaggaaagcaaaaguuucaacaauuaugaauagaucagaaaggcuacuuccugccauuugcaugccucacuccuauuaauauauuuccccauaguguugguucuguuuuuuaauaacagcacaacaccgcugacucacauucaccauauggucuucuuggacucccaggucucugucugcuguacuugugccugccuagcuagucuuuucuuaaccauuaucugugcaauuauuuggauauuuucauaccaaagaaaagcuuggauuuauccuuauugaucuugauuuugauguaagcagaucacuucucuagguuauuccauucucaaguaugcugcccucguucaggucuucauaaggccucaccugacuugcugcaagagccuccuaauugauuuaucugccaccaccuuucccaguuaugaucuucuguuugcacagucaucaugucaugcuucagacauuagagcacacuaauuagacagcuugccccuggaauagaaauaaagcucaaaucucucagaauagcauuuaagaccauauaaaaucuguucccagccuucuucugaccaaacucugaccccauguaauuuaaauaugaaccacacaugccuacucaccucucagcaauauucucugagcuccccuacuuugggucaugcucuccauucccauagaauguuacuauuuccagcccuaccugcuauuuccacucucaaaaucugcucgauagcaaggccauaucucuggauuuuccccauucaccccauccaacaugucucucuguccuccaugcuuccacaguauuuuguaucacuauuacaauccaguaauuccucaacaauuccaaagauaacuaaauaccacguuugcaauaaacaaggcuggcauguucaaguucucaacaacaacaauaaauaaauaaaggauuagagaaaaaaaucauaacagcuuuagucuauaaaauuacaggcgguauaagguuuuucaaagacacuuguuucugauauauugugguuaaaaguauacccugauaagguuuuuuuuucgaauaaucaucuuuauuacuaaugcugcagcauaauccuuccagaagcugauauguucacaguauuuauuaauagguuauagaguuugaaacaacaaguuugaguuuguguuuuaucuuuguuuuuuacaaacuaucuuaguguuuuaaaacauguuuuugugauccuggucuuacuccucuacauugagugaauggaguuuaaauagaucuucccucucuuggaaugaacagggucaccauuuuuccuuccaaaaguagaaucaauaauguucauauucgcuaaaugaaggaaacugaaguaagccaugcauauguaaaaugauguuagauuuucaacuugggguauaaaauuauaaaacccaaauguccaaaaccacagauccugaggggcuacugguauccaggaaaguuguaugcauaacuuucucuugaaaaaaaaaaaaaggcauaguaauucaagaaacaugugcuaaacaaaauuauguucuaggaugcaaauauaacugacaugguaaguauuuauggucuaaagguaaaagugguucugaugguuucugcauucuacuuuuacauagugcgggcagcaagcagccuuugcuacugggugaaccccugaauuugagcaagaaugaaaacugauuaccaagacggauuugguuccuaaggggaaaauaccuuaaccguucugcaaggaagccagucuucuccuaaaguuggguuuuccuaaggucauacacaugacaccucucaccauaacuggaaaaugcagaaaaaugaacaccccaagcauagacccuagcagcauaagaacaaagggauaaaagaacuaaaugugaugcaagagcacgggaaagggcaugaaaggauaggagugcaggaacugagcaugagcagagcauucugagacaagaaauguuaaaaucccagaguagcagaaaucuagggggaaacauuugcuuacaggcugaugagcauuugauucaagggcuuguuaauuucuagaaaugguggucauuacauaacaaggcagacugguggaucaggcaggucaaaucagucaguuaagcagucauuuuuucaacucaccaacagaacguccuucaauggggggugguuuaagcccuccacgugcaaauaaaaagggcagagacacugaggagagaacaggcaauuuugcaaacaguggcaagugagguaaacaacaugagaacccugagugaagaacaaaaggcaaacaggaaaaccaagagacacagauguaaguacaguaaaauccauggggaggcggaggugggcggauuguccgagcucaggaguucgagcccagccugggcaacacgcugaaaccccgucucuacuaaaauacaaaaaguuagcugggcauggcagcaugcaccuguaacaccagcuacucgggaggcugaggcaggagaacuccuugaacccgggggguagagguugcagugagugagccaagaucgcaccacugcacuccagccuuggugacagagcaaaacuccuucuccaaagaaaagaaaagaaaagaaaagaaaaaaaaaauccauggugaaagugacgacaguagaguaggggaugagcucaaagcaaaugcaugcauguaccccacccucaacacaaacacacacacacacacacacacacacacuucuuuagagauauuuagguguauauaugcuaacuuaggaaacuuuagaaaaccuuguuaugauauuauuagucaaaaaauauuuaagccacaguuucgcaauuuuaagauuguacuacugguaucuggaguaucugaaucucuggaucuuacuugccauuucauuaugaagcuguacacuauuagcuaggauggccaacuggagaauuaaccugaaugugccuauacuuuuccuaccaaucuggauggugacaaaccauacagcuugcaccuuaauagaaacagauauaugaucagaaucaaccaaauagcgaucaugcuuucaccucauuacacaacucagcucuugacaaauuaagaaaaccuagccacuugggaaagugaggcuggcaaugugaaucuagguauggcuuucuuuguauaucucugacuuuuugguaacuucucuucccugucagcagaccccaaucagugccucauuaccuugaccgaaucuucuucccugcugugaccccucugaaaauuaucugucuacguugcaucccuucaagaauuuggguaccauccaguuaacuuauaaaugucaaaaucagaaaagagcuugagagcuguucacguacguguccauucaaacauuccacaaacauuagugauauuuuauggcaaggcagaucuaaucaugguaauugggcuggcauuuuuuucaacucuucaacagagcugacaaugugcagcuauacaagagccuugaagauacaaaaaucuuaacuaucucccugcuguuaucuuuaauucuuucugggaauaccuucuaagcaccuugauuuuccucccccuucauauuugacccgucccuggaagcuaaaauucugauagcauucauaccuaaaaauacauuauuauuuauuuaaauuauauauaugauuauguaauuacauauccaaugggauaguaaggacaaauauaagaauaaaugauuuugaagggcauaauuuuuuuaaaugucaaguuuuacauucuacuuauaauaauuucuaaauuuauuuugccugguuauaaaagcaaaauaugggccgggugcaguggcucaccccuguaauccuagcacuuugggaggcugaggcaggcggaucacgaggucaggaguucgagaccagccuggccaacauggugaaacccugucucuacuaaaaauacaaaaaauuagcugggcgugguggcaggggccuauaaucccagcuacuccggaggcugaggcaggagaaucacuugaacccaggaggcagagguugcagugagccaagauugcaccacugaacuccagccagggcgacagucucaaaaaaaaaagagcaaaauauguucauugaaaaauaguuuauucauuuuucugaaagauuuaggguuuuuuauugacugauaagagcucauuagcuauuaaacagauuaagauuuugucuaucauauguuaaauuuuuuugcaugaauaguuuaucucuuuauuucaccgccuuuuaaaguaauuucuuaaaaauuaugucauacuuaaucugucaguuguuuacuuuuaaauuucuuccuuuuuaugcuuggaaaggccuucccuacucaauaucagauuaaauaguuauguguauuuuuuucuauuuguuuugcaggaguuuuuuuuuuucacccuucuuaccaacuaacuggcuauaaaaauauuaacagcaaaaaucagaaaugaaaaaauauuuauccagaacuugacauauuugaaagggaagccaauaaucacacaaguggaaagcuauauaaaacacagcugaaguuaucacaaagucaagaaaaauguuguauuucagaaacuggggacaacaagcacaauaucaaaaaugaaaaagaggaacucaggagaaaauauacuaucaguacuagaauaaauauaucuguaucuaggugaucauggguuaagaguagcaaaaauuaucuauaaaucuuuuuuauaauaaacuaacguucauuuaccucaacucuaugaggcuuacagggaaaaaaaaacuguucacaaguuuucauuuuaagauaauuaaauugaaaaagaauaccuauuaugagccugaaagacaaggaacuggauauaauuaaguacugcaggaagcuauauaaacuuauccuagcguuauaacaaacaauauggccauaaucacuagagccuucaacucgguaucuauacucuuaggauccuuaagcucaguuuuuaauagaaaguaaugcgcccaacgguguucauuucuaaacuguuuacaaauaaaagccaaaaauaauaaaaauguuuaaacauguaauaaaauguagccauaaaauaauaauuauuaaauauagauaacaauugggaacuaugacuuuuuaaaaugacauaaaaucauauguauucuaugacuacaaccauguugaaaaugaauauaaacaagccugaaaagaaacacagaaaugcaaacaacauacaucacaauuuugacaagaaggauaacacuucucuuuuaagaaaaauguccuuaguuauaauauuauuugugcagcaaacauaguuaauaaaaagcuuuauaaaggcucagaucaguauuuccucugguggauucugcaggaugccaguuguuauuccagcaaggccgagcaggagagggcagauugguagagagauuuugugccaaauuaauguaggauauauggauauaugauauuuaaguguaguuuaauuguguuuuguuguuuccucuuugggcuauuuguuugccuguuuaauggcagaaacucucagacacuauuuuagaagaaaaagcaagucguuucccaaguuuaccuauaaacagaaccugaucgauaaagcauuccuuaggacuaguaucccacaauaggugcuccucuagaucucugaauccauuaggaacaugugccauuauuaagaucucaaucaguuuaggggccacuugugucucucaucaucuauaacacaauuacaaaauuguauauuauuuaauauacucuaguuaguugauaaaauacaacccaugggaacucaguguguuuuuuucuaagucucaagaaugucuuaauauacuuuuagauacuguaaaauugauauuuccaaacauaccaaaacuucuauaaacuaccauucacuucauguuuuaaaacaguuaauauauugaaacugaauaaguuuacugaauaccuguauuuacugaccauaugcuaaauucugugauacacauuguaagguauacuuagaugaauaaagcuuaucccugcuuuaaagacauucucagucaagaguacagguuauguagcggguauggagccuggacaacaaauacaacaauaacucuaagaaaagguguaacaaaaauggggaacagauaaagggauauagcaguuaggaggagaaugagauggaagcauuuuaagggaucagauacaaauucaucaaggagcgagacugcauauuagaugaacuucaaugacauguagaaggucuccuagguagacaacaaaaaaugaguccaaggugcccugaagaagagccagggguaugggagaggaauauuucagacuugucagggaagaggguucccuuagaggagcaugauaaugucuuuuuggaaugggagcuaugagcuugagucuggaacacaggacccgugaguuacgguaggcuaaggcacuuacaguuaauuagguagccagagaaacacacugaaugcuuuuucagcaagauuagaacuucaaaaauuaaucaggugcaggugcauccagauuagggguuuuagcauuggagaaaugacaacucaggaacacagacagaaagacagagacagagacugagagagcagauuaaauucugugaugagaggacaguacagaauuaagcagcagcuuggcgguuuuuggauguuccaaaauaugucauucaaaaauacaucagcgagaaaaacaaagagauuagaaaguucauuugucaauaauagccaaugauggugaaagaaaaaucaauuaguuaaucagaagaaugcauucaggaagaaaauuuuuaaaguauuaaagcacauucaaugaauccaccuauacucaucuuuaaauuguaauucaaucacaguaguacuauagcaaaauagcacaauuauaauauaaauuuggaacauaggcuagaaggaaauaagacaagugaauacucucuuuuaccuccuaaauucacaggggucagagucgucacaaagcuuauuuaagcaucccaugaagucacuccccuaaugacuaguacagaauuacuuucuagggacagagcccaucccuauaauuuuauuuucugagacccagugggcugagagagccacauuacuuuauccauuaauccugacuguuuuuaaaaaaaguggaacagaaauuggucaguucagcaucuucaagcauaccauaauauaaugguagaauucuugagacuggagaagucauuuaccaaaccagcgucuguaacagaguucaggaaaacucuuuaggccuucucaauuaacauuauucauauggaggauuuauuuuuaaaaauauuuacuaaugucuggguacgguggcucaugccuguaaucccagaacuuugggaggccaaggcgggcagaucacgaggucaggaguucgagaccagccugaccaacauggugaaaccccgucucugcuaaaaauacaaaaauuaggugggcauuguggcacgcgccuguaaucccagcaacucaggaaccagaggcaggagaaucacuugaaccucggagacggagguugcagugagccgagaucaugccauugcacuccagccugggcaacagagugagacucugucucaaaaaaaaaaaaaaaauuuacuaacauaauuuuagccacucaugucaucuuuguaaauccaauaacaccucuguguguaucuuuugugucaaugcuuacacaccuugccucuuuuggaccuuaagcuaaaguccuuggacacccugcuguguauuauugcaggcauaaaacaagugugcaaggagacuguuuccguugcuauggaaauaucauuuaauuuccuaauuaguagguauauaaaugcaaaaccauagcauuugauuauuucugaaguuuggcaacaaagucuauuguucaugucugagaacaaagucucuauguuuucaacacuguuauucaaaguaagaauuuaaaacuuaaacugucuggcauuuuaaugcuuauaaauugauuugcugcacaugagagaaaugaaagaauaaacuaagaaaccuauguaagucauuuauucuuacccucaagcuauauauauauauauauauauauauauauauauauauauaugagcguaucuauuuacuaauaaauaaaaacuagugguggcauuucccuuacaaaagaacuucuuuaaaucauaacuucccuagugguuauaauuacaaagugagauuuuagcaguccaucuauuauauaaagcaaagcauaacugacaucuucuuuucuccccuccaucaaauuuuaucuaauuugggcuuugcaauaaaguaagaaagaauauaaauuauucagaugaagcacaaaguuuuaaaaaguguuaaaauucuaagacccauuucugucuaccuacucuaggaaacuaauucaccaaugaacucacuauccugaguguucugugcucaaacugcuccacuuaaaacaaagcacacuaaacugaaccuucucuuuaugcuucccucucacuucccuuucagcauccaagucugcuaaauaucuuuggaaacauacaacaucuaauuucuguuucacacugacucuucaauacuaucagguuucugaggugaccacuugacugaagcuacucuggcaaagaucaagugagauccacuucuuacucaacaaauacaguggccucuagcggccucucuauucuuuaaccucucugaucuaugcaacaacauuuuaugaucuccuuuccugccuggaaacaauggaaacuuggaaacucuuccuucacaacuuaaaaggaguuaaggaaaaaaaaaaucaaccagugaggcaccugccuuccccuucuccacucuucacuauucagauugugcagugugaaaacuagaaaugguuucucaguaaagagauauguuuccuuuuuaucgauaaacuauuucugcuaguuguauggacaguaacaguaaaauaucuuuguuuugcuggagaagugaggcauccuguuaacaagaaaugcugcuuuuuuuuguuuuacugaaaacauauuuugcacaaaccacuaaacccacaagaguuacaguuuagcuuagcaagcuucauuuguaaaauguuacccacgccaauaauugauucguguaguaaaauaaagaaugcagcuggaaggaaaauucugcuggcuuaaauaucagaaaucaggaugaagagaaaacaaagcuaaccucccaccacagaaagccuucagagcagaccacaaaguggacauggggucauuguuuagcugcugaucugaccaguuuccacagucucuucucaucaccagcagagcuccaguggcuccugagaccaggcugcacaacugcuacacuuuuagagcuacccaggagcuacaauccuaguccaccaaggaaugucccgguucagccuuuaucaucugcuugagucauuucuuacccuuccuuucucuuguugacgucauaacccagagaccucauggcuggaagcaguaaacagaugcaagauuugaucuuacaacugccucucuuugcuuguguaugcuuuggcuaaaaauccaaaccaaaagcuaaaaguaggaguaacauauuucuuuuccaaguguguuuucuuuuucauuuugcugacuuucuugacuucagagguaaauacccucauacgauuccucucuuucuuucccauuaaaugugucucauuauuugucacuuaagcagugguauuccugagaugcagaucccauacuuaaaaugcuuuaugcaaccuuagggcauuucaucuacuuccacagcuauaacugucaccuccuguuucacucuaaaauuucuaauuugaauaccaacagcucagaaguccagaucuuauuccuaaaugucuauugaagacuugcaucuggauguccuguaagcucuucauauuuuacaucaucaacaccaagcaucagcuaacuccugaauuauguuucgcacaagaagacaugugauaacguucacgguuagccuugucuuugccuuuguccugaaucucacauucagaugguuccuaagucuucuugcuucuguauaaucaguccuguugucuccuucccuaccaccuucucaugccucaucccuccucuaugcacucuggcaacuguaugauuuguugagccuuaaauuuacacugacauuccuaccuucaugcuuuccccucaaccuggaaugcuauuuccuaauuuaucuuuauaggaaaguuuuacauguucuucaaguuccuguugaaaugugaaucuucuugaccuuugucuaauucuguuuuacuuuaaacacuccuucaucacugcuaccuauaacuuccaauauaccucuacuccaugucauauuccucaguuuguuuacgggccgcacuuucccgcuauauaccauuagauguccuaaggguagaaaccaugucuuacuuaucuugguaucguaaauagacuaccuuaccuaagaaaggcaauuaagaaaugucuuuucagcuauauuguggcuagauauaaacauaauuaaaugucauuuucaaaguaaagaaauauucauuuugugauuauaugaacauaguacaauuguacucuacaaugugaauuggcuuuaaguucaacucuagugaaaaaauacaugauuuaauauuaugacaaggaguaauuucuacauuccaaauggaaaaacaaauaaaaccacaaauaauuauuugauuuguuugccuuacauuauaggcauaauucauaagcaauauuuaccauuuuaaaguguauaauucaguggauguuuuauaguauaugcacaaacaguauaugcaaccaucaccauuaucuaauuccagaauuugcaucaucucaaaacgaaaacucucagucugggcaauacagcaagaccuuucucuacaaaauaauaauaauaauaauaaucagccaagcaugguggcauaccccuauaaucccagcuacuguggagaccaaagggagaggaucgugugugucuaggaguucgagcugcaguaagcuaugguugcaccacugcacuuaaccugggcaacacagugagacccugucuccgugucuccaaaaaaaaaagaaaagaaaagaaaaagagaacguguacccauuagcguucauucuucauuccucccuucucccaaacccugacaaccacuaguuuuucucuacauagauuggugaauucuggacauuuuauauaaauucaaucaaacaauaugugauauuuugugucuggcuuucuuucacuucacacaaugucuucaaggauauccacguuucacguguaucaguacuuuuuccuauuuaugguggaauauuaucccauuguauaaauaugccuuauuuuguguguccauucuucaauuaauagacaucagauuuuucaacuuuuuggcuaucauaaauaaugcugcuauggauauaaauguacagaguuugguguggacauauguuuuugcagcuccuuaauacacaucuaagaauagaauuguugggucauaaggaaauuuuauauuuaacuuuuugagaaacuaccaaacuguuuuccaaauuagcggcaucauuuuauauucccccuuaaauuuacaaugacauuucuaccuucauguauaaggauuccaauuuccccauauuucucaccaacguuuauuaaauuuuuuuuuuuuugagacaaagucucagauggcgccaucucagcucacugcagccuccgccuccuggguucaagcuauucuccugccucagucuccugaguagcugagauuacaggugccaaccaccaggccugguuaauuuuuuuuuuuuuuuuuuuuuguauuuuuaguagagaagggucucaccauguuggccaggauggucucgaucuccugaccuugugauccaccgccuuggccucccaaagugcuggaauuacaggugugaggcaccgcgccuggccuaauauucuuuuauuagaacucgucuagcaggugugaucucguauuucauugcgguuuugaugugcauucacuugaugaugcugagcaucucuucgugugcuuauuugccauuuguauaucuucuuuggagaaaugucuauucuaguccuuuguccauuuuuaaauuuagguauucuuuuuacuauuaagcuguaaucauucuuuauaugguucuuuauaaauuuggaagaauagauucuuacugauaugauuuguaaauauguucucccauucuguggguugucuuuucacuuuccugaugcuguccuuugaugcauaaaaguuuuuaauuuugauaaagucaaauuuacauuauuuuucuucuauugcuugagcuuugggugucauaucuaaaaaucuacugccuaauacaagaaaccaaugccuaauccaaggucacuaagauuuacaccuauguuuucuuccaagaguuucauaguuagcucucauauuuaggucuauaaugcauauugaagucuaucauuaauuuuuguauaugggaggagaaagcgguccaaauucaucuuuuccauguaaauguuuauucaguugucucagcaccauuuguuuaaauaacuauucuuucccccauuaaauugucuugucacccuuguugaaaaaucaauuaaccauaaauauauggguuuauuucggaaugcucaauucuauuccaguaaaauaaaugccuaugcugaugucaauaccauuuagucucgauuauuauacuuuugcgguuaguuuugaaauuaagaagugugucuuccaacuuuguucaccuuuuuuaagauuguuucagacuauucuuauuuuacaaaugaauuuuagaaugagcauagcaauuucugcaaaaaaaaaaggaagcuaggauuuucacagcaauagcauugaaucucuaaaucaauuugccuuauuaacaauacuaagucuucccauuugugaacauacauauauuuccauuuuuuaggucuucuucaaauucuuuucaugauauuuuguagccucuaguaucuucacuaaguauuugcauuuucuugaguaaaacgcaaacaguaacaguauagauuguuuuauaauuacaauaaaguauaaaaauaaaaacuauuuaaaguuagcauuuuaccaguugaaacauuuuauaaugccacuuauaauuuugauaaaaaauauuuuaaauucauacucaaaaaggaguauuuauuucauaugguauuaacuugccuugguuaagaacagcucugcaacuguaagauaaaaugagcaacaauaaaacguauacaccuggauuuaagaagucagcuauucauaaacagcaaacaaaaaaauuauuuccaaaggcaaccagucaucaagaaaauuucaucauauagacagaagcauuucaaauuauucaagcaaacuagaacagaaaauagcuauauguuguuaacugagaguuuuauugaaacuuaucauauuaguauuacuuuaacucauccuuaugguauaauucuuuaagaaaaggcaguuaaccaaauuuuuaaacuagauucagugauucagcacuaauaaaagucucuugccauuccaugaaccacgacuuaccacuuguuacuaauuucacauacacagucaauauucuacaaagcaaaaugccuguuuucaacaguaaaaauuauaucaucuauuuaagcuaacuuauuagguugguacaaaaguaauugugguuuuugccauuacuuuuaauaauguaauguaauguaauaauguaauguaaaagcaaucuugccauuaccuuuaauggagaaaacagcaauuacuuuugcaccaaccuaauagaauggcucacaggguuuuaagaugauggguucauuaaugauaaaucaauacugauauguaugcagaaagacuagaccagaugaacaauuacaauucaaggcaauuagcccauuuucucaauuuguauaaucagugaaagauuuucauucaaaauaaccauuuucgugauuugaaaaaucaugaaaauacuacccauguuaagcuuccucucagguuugaauaagaagaucuuacugccaaaaaauaaaauucuauguggguacgaacuggagacuguaaaaucuucuuagugcugcuguacuggcuauuguaucaauacugacacauuucuaacaaacaaugauggauguggaaugaaggucucguauuagcacaacagcuucaaaaugcaaaugaugacaaaauauuuaaaaaauuagauauccaaacaauaaagucacuuggauaaauaaaaaaaguuuacuaucacaggcauuagcauaaucaaacauguugucaccaccauuagaucauuauucacucaacucuauccaagauauagaaaagacauggcccgugccuuugaauagcauacaaaaaaaaaaagcaccauggaauacugagaaacaucuauaaaagugccaaguaaauuucuggaagugaacauaugaaauucauguacacacuaugcuuacuccaaauggaaagauucacaaauauacugauauugguauaaauauacuuacguuacuauggaaaagacagauauugagaauaauuuuaaaagcaaaauaggugugucuggaguacaguauagacaguguauuuccaaucugaacagugucucauucacacuaaaucuaagauagaagacaaaaaauuauuuaaaauuagaagacacugaaauaaaaaguauauguuaucauuuucauguaaauaaggcuuguaagugggguguguguguguguauguguguguguguuuguguguauuuaaacuaugaacucuuaacauauaaaagagguaauacaaauugcuaagaaaaacacaagggcacguuuuuuuggaccaauaagguauuucaacaaagugacaggagacaaaaccaaauauaaaaaucaaaaagaauaauuucuacaucagcaauaaccuauuaggaaauauuaaagaauaaaaucccuuucccaacgguaauaaaaacucauacaagauagcaauaacacaaaaugagaaauauuuccuucuauaaagaaggcuauuuauguuacugaaggacacaaaaaagacuugaauaaagagaccugccaauggaaagauuaugaauugagaguugucacuucucccucaaaauuaucuuaaauuaaauauaauacuaacuaaaauacaguguuguuuucaaauugauaaccugauuaucauauucuucugaaaauaaagauguaaaaauagagaugaaacuuuggggaaagaaaccaucaccuacuagaaaucauaauaguaguuuuaauaguauaucauuaauucaggaauaacaacaaauuacuuauacccagagaauauaauucaguccuuaaauuaaaauaacuaagucaugcaaaaaaacuuggaaaacaugaacacacucaucacagcaaaggcaagacauuaggccauuagacagaaagcaaaugaaaagauaaccucuagaaaucugggaaacaaauuuaucuaaaaaagagguauucuucuuaccuauucauugguaaacuuuuacaaguuuaaaauuaucacguauuggcaaaaggguaaagaaauaugcacuuucauauuguugguggaagguacuaacaauuggaagagcaauuuggcacuauuacaauuuaaaauucacagaccuuaugacucaacaacugcauuuaugaguuuaccuuuaaaaaauacauuaguacauguagacaauaaaccuguauaaggauguucaucuuagcauuguuugaaauagcauaauagcacaaacaaacugaauguacauggaaauaaggauuaaauaaaccaugguacaaccacacuaucaaguaauaggcaagaguuaaaaaaaacaaugguguauauguuuuugagccaguguggagauaucuuuaaacuauauguaaaaugaaaauaaaguauagaacaucauguuaccauuuaagaaaaaaauauauauguauauacacagcuacacaaaccuucaccucuauuucuuugaagcagucuccuggggcccccaaaaucaaucuucugcccaugccacagcccauauugaaggcagaucaacccagacauuuuaucucuguagacagccaaaaauugaauacuuaaauuccaaaaaaaugcaauguuacacaaaaacuaauguagaggaagaauuuuuauuauggcaggaaacgcuuagauauauuuaguuaaaaauaauauacaaauuuauauauaccuaugaucucagcuguacuugaaaacacccucacuauauaacucagauauacucacggggggaaagaaauucaccaaauguucacugaauaguuggacugcagugauuuuuauuuuccagacucuuuuucuuguuauuuucuagauguucuacaaugggcauuuauuacuguaagugcaaaagacaaaacauguucuuuuugaaacaauguaucuucuguuauuggauucuugagauaccucuguauagauaaugccaaaauauuucucuacucccagccucuccccuucacucuagucucacuuuucagcuaccuaccgaguaguuaucagugucccagcuuuaguucuccugaaugugauuucuccaccucucccacugcugugcucauugaucucaucucccuggcaggccagcccugucccaguucccagaccaagacaggacugaaucugaaaguacuaauacaaggucacccccuccuccauacucuuauucccauccauugcugaagcaaaguugcugauucugugucagccuggauuuuugccccacgccacuguggcaucaguaccacacugcaggacacacucgaucauucugucugguauuaaacuguucagguauucaucuuauagccccuacuagauugucaacuuaugagacaaggcacugugucuuacucacguauggcuccaggaccgugccccucaaaacagugguuucgauaacuuguaggaaagcauuuguaaauggcuguuacauaugaccagaaaucugaggaucuguuugaagauggagcgaguucagagacuuaguugaaucaacaagcauuuaugaaggaauuacugugggcccagcaaugacacaggagaauacuagaaaaauggaaggugcggcuccuauccuuaagacagaaucuagagugguugagaacaccuuaggaaaaaaaguagaaaauaauuacuguuuuggcuucugccuuaacaagcaaaacaugaaaaucuucuugccugagguccugauuucacagaugggcaaacugcaaucgaauuugccugccuggauuccagacuacugccagcacugacuuuugcuuccugucccaacuccaugggccccaaugugcuuggcuuugcuugucacuauuuguaugcuugcccacuuuaaauuguucccuuggguccagauucccugccccuccaguucaugcugugggcuagaaucuaaauuuucuccuucuugugccacguugcccucugucaccuguuucugcauacacucucccacaauaaaaaguugugaccacaaucucagcuuuuugcuucaaccucuugccaaaaccugagaacaaggcaggccucuauaucaaauuguaacaaacacugcugcuuacuuacccaacaaucauuuaccucuuccucauuaaaagaauugcuacucuguucaucaguccccuaaccuccuccacccagugaaggcuaaucccauacauagucccagccaguaaauccugauuuagucuaagcgccuaucauucaugguauucccauuccccuugccauugacuagacugggaauguccaugugauucagugcuggccagugacauaagagagaagucugcaggagggcuuuuggcaaaaaccuccucauucugcaggaagagacgcugcugcugcaugacggugugcuaggaacuaaagaagugaucauagcaccggcugaggaagcagucaacaugcagacugagcacagacaagagaaauguagaaagcagaaauuaagcccaugucucccauccucugcauuucuugucauuuuagaaaucuuuuccaauguauuccccuuccucugcugccagguaacauauauuaaauagcgcaccuuaaaauuuauauauauauauauauauauauauauauauauauauauauauauauauauauauauauaucagcagcuuuguuuucuaucucaaagggguaacuuucaaauaggaauuugacagguauuuugguuguuuuuaguuugaagcuauuaugaguaugcuguuauuaauuuucaugcaaaaguccuuguacauauguuuucauuucaccugggaguggaguuucuggaucguaugguaagaguauuuuuaacauuaagagaaacugccaaacuguuucccaaaguauuacauucccaccagcaauguaugaguaucacaguugcuucacauccucuccaaaacuugguauugccagucuuuacaacuuagucauuuuaguguuuggauagugguaucacacugugguuuuaaauuuaauuauuucggugaauuauagaguuaucaugugcucauuagauauuuguauauuuucuugugugaaauaucucagcacauauuuuguucauuuuuuagauggauugccugucuucuuacugaguugcaagaguucuauacauagucuagauaaaguccuuugucaaacauacagagagagacauguaguucuaacaaaccuuuugucuuuugaagagcaaaacuucuuucuuuaacuuugauaaagucuaaugcauauuuucuuuuaaauuuuaugauuagugcuuuuuggguccuaagggaucuuugccuaauccaacaucacagauuaucuccuauauuuucuucuagaaguuuauguacucaaaaucauagauugaucccacaaacauuaugcucaaugcaaaaaggaauauaaaaaugagcacauauucugugauucaaccuauaucaauuucuagaauaggaaaaaagaaucuauagugacagagagcagaucagucggaagagaagauuuuaggguaacagauauauucuguaucuugaucgcacugcugguuacacagguguguuugucaauccacaacaaaguauucacuuaaaauggguacacuuuauuguauaaaacauaugcccaaaauuuuacuaaaauaauuuuaaugggaauuuggagcuggauugguaggaagacuggugaccaccagguccucugaaauagaauuuagggggauaagcaaggcuuugcuaugccugaggcagaaauauuaaccuuaaagcauauauaauuucuuaaauaaacauuacuucauucuaaaugcauaaaugccauauagucuuucacaaacauuggcauggccgaaacaagccaaccacacacugggagagucccuaaauagugguagcaacugacuuguaccuucaauguaggaagaaguuucaaaaugaaagagagggaaggauggagagauaagaaaagacagguuacuuagucccucacaguuugcccagagacugugaagcuaaauuugcaauuuuauugggaaagggaaagcauaugccacugaaggugaaguuuuuuuuuccuuaugcagcagaaguuuauguuucaaaagaaaaaacaaauggaacacaaugaaaacaaaucauuugccuugaaauuuuaagaaaaaaacacauguagaauuauagaauuuuauagcuagauauaagucuaagucacucaaaaggcagauaaaauaaauaaguguuggagaguuugaggcuuauuuaaucacauaacaaauuaauuagcugguugaaaaccuggaggggaauccaguugccuugguucagugugcuuauaaaauuauaaucucuagcucaaugagagcauugagcacagagcagguauuuucaaaaaauaccuguugaaugaauucaugcuagguaauauaauaaaaaaaauacaugaaaggcauaagugcaguagagagaugaauuuagacacagauuuauuuuuccccaagacucuuuuuuuuuuuuuuuuuuugagacggagucuuguucugucgcccaagcugaagugcaguggcaccaucucggcucacugcagccuccgccuccuggguucaagcgauucuccugccucagccucucaaguaacugggauuacagucgcccgucaccaugccuggcuaauuuuuguauuuuuaguagagacaggguuucaucauguuagccaggcuggucucaaacuccuggccucaggugaugugccugccucagccucccaaagugcugggauuacaggcaugagacacugcgccugggcuuccccaggaaauuugagucuuguauacacuucuuuaugccacuuccacauauuagaaaaaaaaaacauauuuugugaaauuacucuggcaauuaucaacgccugaagaaacagaaugaagugguaaacucuaaaagacuguaggauacccuuucccggaaacaauugaguacaauuagcucuuuauaaaguaguuaagggacauugcuacuuccucacugaaagauagauugaugauauuuaacaacugcuucaggcccuaugaauuuaagauaaacuuggaagacugaauuuucaccaaaugcuuacaaauaaaacaugggaacaucagauccucuggugauuucuggaguccuugugguuucugggugggauguggaagaacaacugacauagcuccaucaagaguccaugguuuuaguuccaaaacaucaaggggccauaaaaaagauauuggaccuacugcagauacauaaugaacaacauaaacucaacuugcagaauaugaacaucucagaagcuuucuauuaauuuucuauuauggcucuguggcccuugagaccauauacaacucaaggacuuuuuuaucucuagcccucuggcauguccacucauuuaauguagaaacacuguagcaaguuaggaucuuauuuaauguaucuccaucucaauacaucccauaaauguauuaccuggcuucccccaaaacugccuagcaaacaaaauagcccgaugucuacaaguagcaacauacugaaaaaucaacauaugauuuauauuacuuuuuuauccaugcucuaguuuuaaaaauuauucauugaaauuuacauauaaacuuacuuuaaagcaacuaaaacauagauuauaguagacaucgcagcaaaaauuuagaaaaccccuaauugaacagauaguuauacauccuucagcucaaaagagaaaacacaauuaauucauucugucucauccuuacuccaccucccuguuuggucaccacccucacguauggggaacauaccugcuuuuucacuccuguuaaugcaaguuuuccuaauaccugaaauguaauagucuaauaguuguguacgcagauaaggccuauuaauaaaaggaaaaauaaaauaguguucaauaguaaagcccuagaaaauuaaggugucugaaguuagacuaucacuauguuuuguaaaauguguuaugaguaauaauuucaaagagguauauaaugcaaauuuauggcugaguuagaauucagcucugagguaaaaauucacuuauaaggaaaauaaaaaugucaaaaaucucugguaguauaauauaaagcugacuagcagcaauacaucugaaaauguaugauuuagauuugcugaauuuuuaaaacaucaauuaagaaagaucucaacauaaaaaauaaaacuacuacagucuauggucuguuaguuuuuagaaguauauuuacauuaguuuuuagaaauauauuuguguuuaugacuaauauaucuuaagauaauauucaggaggacaauuuuguauauuauuugaacuacaaaacagaaauauaugagaaacauuuuacuauuugggagaaaacaauggaauugugucuauuaaaauggguuaaacaugagcaugauaaauacugauacuucaaacuuguggguaaaauuuucuggaaauccauuuuugaauaaaagaauucaauucauaucacuuaugcuguuggauaaagauuuuauggauaaauuuuucaaaauaguuuaugaaccucaacuaaaaacaaagguaugccaacagauguagccagugagcaucugucucuccacacagagaguauacuuaaccugcuccaugcaaauuccuuccuagacucucuauccucaucacacauuagucucacagccacaaaacugaaagagcaccauccauuuagaauuuauuaauaaucucggacaccaaugaaaaggggcuuuuguaauuaggaaaaguaaauaagccccuggaaauacaauuacccuaacaaguacuggcuucacauaggucaaaauacaauaauuuuaguuauuauacaacgagauauaguccuggaauauucaugggauaaggaaaaaugagggagaguucuaguaaccauaauauuaaaucuuuauuguucagcaaaggucaaguuuucccucugccuugaaguuaaaagaaaagaccuaagaauauucuggguccucacuaugacaccgaucauggauuccaugucucaggauggggcuuuaggugagauaaagaacugaaacuaccuccauggguagcugaaccuucuauguaaugaaauggaucccacacuagaaguugucuuaacccagugauaguauaauuacucugacuguauguacucuaccuuucaauacauucaccuguaugccaaaucuuccaguaaauagucucucuaauguucuucaaacacaccaugccuuuuccucccucucugcuuuuguuccagcccacccugcaugaaaucauucccaggagucucuguccaagcuccagugcuacuaccaaauauaauauuuucccagcuacacagacacccgucuucuucccaauuccucuaguacuuacuugcgcuucugucuuucuaguacauaaucauauauggucuuggaauguguuuaagugauuucuccuaauuauaauaauguuuacuuaauacauguuuuguuuguaccaaguacugagcuaaacacauuuaaccuuuaaagcaagcccaugaaucagagucccuuacaauuuucauuuuauagaugaaaaaacagauuuaaauuguacacaaggacaugauccuccuaagaacuagagccuguacucacaucuaaagcugucuccaaagaucuuguuacuugccacugugaaauaggaccucaugcaaaugccuguucuccucaacuagacuguaagcugaggucaaagagagugucuuuuacuucuuucuacuuucuuggaaugccucacaccacucagccuaggguuaggcagguguuaagagcucugagggagggagacacagagaauauauccggaauacauuuuacagggguccauaagaucuucuauuggcucuuuauuguaucaaguauuuuuaaagguccagucaacuaaagacagaagccucuagaaaugaaauucuucagaggaagucagucuuuaucugcaaacuggauuauagucaaggaggcaagcugcuuuucaaagacacuaguugcucuucuaaaaugcacauuuuauuaauuguacucaucucucuuaaaauuuugcuguaaaaaaauguuacuuuguuugcuaguucuuuaauaacuugguauguuuuguuuccacucaguggacuaauguuuacaaaggaggcaagugaaaaguaccuguguuucuauacuaagcacaguaucaaaaacuggggcauacacccacaccacucugcagaaaaacugcaacaaagaaagagcaaagcccauagaggggcugccaccuccccacauucacaacucugaagccccacaaagaacagcagacauacuggcaggggaaaagucuuuugaaagaaauuuggacaaaacuaacuuauuaugcucauguauaauuaacaugacagucuuucacuuguuucacgguauucuagggaaaggaacaccaacaaggaaaacacuccuaucuacaaguucacuauuaaguaaugcaagcauuccaauacacacaggguugacugcaaucugcaucaggauguugguaacacugguaauucaaccaagcuuuaguuacauggcugaagagucagccaagccauuaauggaauugcauuccuaccauggggaguugaaggaguccaucacuccuaauauuacacacuuccccagcacugacucaggugauuaacuaucagcucuucaucaaaucagcacucaaucacuuaggaaggcaauucucuucaucucaacuccugcuuuacacucccauaaaaugcaaaacugcauauugcacuacugucauauaauaauuuaaaugaaaagaaaaaaaucaauaauguguuccacagcauagugucuuacuggcaacuucaaagaauccaccauuaauuuuggucccucacacauacuccuuaaacacaaaacacagcuauucuaaagauauuaagguuuuuuggucuguuguuuuaggagaauauaaauagaacaaaauauaggcuucaaaauauccauuuuugauuuauacuuacacuguuggacccuucugagaugauaaauaugcuaaacauucugaggcauggcugucccgccauguaaaaauaaacuuuacagcagcaaugcuaacagaaagaauugucaaauugccaauaacauguauaauguaagggguuagaaugcaagcugaagagagcaagguaaauuauagcauucugugaaaauaagugauguaaaaccaacagcaauuuuaaauuauuaacaaugguuccgaagcuaauucaacuuuuccauugguguaagccacaaacagaaucacacagcauguuucucuuuaaacaucuucagggguccuacgaggugggugaaaauggguaagggugucuguuaaaggcucuaaugcagcuaaugccaucuaaaugguauauuuacaagccuguggaguauaaccucauuucuccaaaacugucuaaccauuauccuacuugagaaguuaacccaugaugaacaaaaguaccucucuuccacccuucugcucccuauuuucccaaaccuuucuaucuugguauuuuguaugcugagcaaaacauuccauaaauaaugcuguggugcacaggcauuaaaguuuagagaguuucugccuuugaaguagguagugacaggaccaaggacacacggguucaauuccaagccaaauaugaggcgggugguuugaaaaugucaaaccaaagaggccuaggggaaaagaacacaagcuuccacugccaccucccuuccucuccccuccccuuuuucucucuuguuccuuuccucucuucuccuuuuucguugugguuucucacggagacaaucaaagcagggaaggcuggauuuuaaauuggugagacacacacuggaaauauguaauucccagaagaaaaaaagaaacugcugaagagggguaugggggcuguuggcagcauguccaagugacaacccuccccacccccacccuaauauagcacaaauccacagauucuucuucgauccucuucucccuccaguucccaguacucuacccaacuugacccuucauccuaaaaauuuaggaaucugcagggcacccgcuguuuaagagugugucucucaguauaugcacccaauuuucuggaaccccugaauccggacaguuguagcaggcaagggaugcucccacccucccaccggggaagagguaagaaaggggggaagaagagauggagacaagaggaaagggaugcagagcugugcucuagggcgaguggcugcaaggaagacggggaagaaagaaagggugggaaggaaguggggcugggagagaggaagaaagggaugaaagaaaggcuggaagggagaaaggaggggagaggagagagggauguugggaaggaugagggagggaggguuggggagcggggaggggggaggauggagaggaugggagggagguggggagggagggaggcaggcagggauggaggaugcucugcccgggacucaccucugugggucggugggaguuucucgccuccuccucuuucucgcccguucccagcagcuggagugguaaucacagaagggacuggagaggcggcggcagggacaagggcagcagcugcugcagccgccucuggccgaggugcggugccgccugcucugcccgcccgccugggucuccgccucacucggggcuggaagcgaagccgcuccccccuccccccgcccgccccgcguccugcccaagcgcgagcggcagcggcccggaucgccgcuag

SEQ ID NO: 191634 - RNA, 47901 nt, Homo sapiens
gcggacgaaggcucagguguccagggagacgcggggaagcggggaggugacggcacagggcgggaaggggccgcggggucucuggauccuucucuggggguucuauaacuugcugccgaccacaagccaugcugagucuuauccagaaagacuuauccagaagguagugagcgagaaaauagcucgagcacuugcccgcuaucugcaucugccuuuuggacuccuugggggaaauaaaacaaucguguacaguugggaggcucuucguuuucaccaucaguugacuccaucaguuauaacuaacacaguuaucaaaguuuaugaagaaccuaaacugucacaacaaaguucaauaauuuauaauacuauuaagugggcagaaguuauauguaccuuuuagacacuugaccaacuuaucuuucuugaaaacauuuagccagaguaguacaggaaucuagguuuugggacauuccccuuuguuuauuuucuuuuuucaccaguuauuugcaaaaacuaauaguaauauauacaacacaaagaagcaugauagagauucaugacacuguagaugguaccaguaaugguguuagauauagugucgucauuuugaaguaccuuugaguucuuaaauacagguguaaggcagcauaaaguuguuuaaauaaaaugugcugcucugaguuggaauuguagcuuaaugaggaauacgguuuuugguuagucuugagagcuaaaaucuuccuauuauuuuuuauugucauuaaagugauuuuuauuaauuuauugagaaguaaaaaauguauauacuuauaguguacaacaugauguuugaaaugugucuacagugacuaaauggagcuaauuaacauuugcuuuaccuuagguacuuacuuuuuuuuguggugagaacacuuacuaucuacucuuacuaauuuucaaguaugcaaugcauuguuauuaauuuuagucaccguguuguagaauagaauuccucuugucuaauuaaaaugugugcccuuugaccaguaucuucccaacuacccucaaccucacucagucccuucuaaccacuacucgacucucugcuucugugauuucugauuuccacuuuuuuagauuacauaugugagaucaugugguguuugucucucugugccugucuuauuucauguaacauaauguccuccagguuuaugaucuucgugauuucuuggucuuucuugugaccuucuauuugucuaaaguuuucaugaccuuuuauauuuguuuucugguuaaacuuuguagaugaaaguugaagucaggaguuccuuuucucuugccuucuagaauagugguucucaaacucuuugggaauuggaccucuuuuagacucuuagaaaugauuaaggauuccaaagagcuuuuguuucaguagguuauaccuaucaauauuuaucacacuaaaaauaaaauuuauuaauucacuuacaaaaaaucuauuacauguaaggauaaguaagauuuuugugaaaaguauuaccccaaaaaaggaagaguagcauuguuuucaauuuacagaucucuuuaaugucuggcaaaauauuaauagaagacagaugaauugucauagguguuucugcuuuuaaucucuugugcuauuuuguuuugguugaaguauuugaagaaaauacagccucugacagauacaugauuaagacgaguacuuaauagcauuuuuagaucauugaggguguugugcuuuaauauaacacagcucaacaaguaauaaacuaacccuucuuaaaaguuaguugcgggccgggcacaguggcucacaccuguaaucccagcacuuuaggaggccgaggcagguguaucaagagaucaggaguucgagcccagccuggccaacauggugaaaccccaucucuacuaaaaauacaaaaauuagccaggcaugguggugggugccuguaaucccagcuacucaggaggcugaggcagagaaucacuugaacccgggaggcagagguugcagugagcugagauugugccacuacacucuagccugggugacagagugagacuuuaucucaaaaaaaaaaaaaaaaaaaaaaaaaaaaguugccaaauggauucuuaaaccauaugauuaaauuuggggugcucuuaccuuaaaacucuguucuguuuuguacuuuggaucuuuuacucaugaacgauugguaacaucuugcauuauuuggaagguauucauuagcugaguuugcagaucuugcaaauguuggagcauuuuauuguacaauaccaaaaaaaucauaguauuaccacugauuaaucagucuguaaguacuggaaagcuguuagguucacaguagagaauauaaguuuuccaaaaucucaauuuucacuugaaaucucucauuuuauugauaggcacaaccgggcucauguuuugagaaaauguuugucagauagccaugucugaauaaucgguuuguuagucauucuuucaaguaaaauggugaugcuucuuaaaaacaacgucuaguucagcuugcaacucagucacacaaaugcuuuuccuuaaggcagccauugcauuucaagaugcagcaaaagugccuuaugaauacuuugauuuugucacaaagaauauuaaacauguguacucaagggucaaaauuuaauaaaauaacaauuuuuuaauuaguucaugaagagcaacuggcuuuuuucugccaugugagguaaggaaaaauaccauaacugcuacuacaaauugauucauucaugccaagagccuagcaguuuuacccaucacugccuuuacuucauuauauaaauaucaacaugguaaaaagaacaaauaacauguuauuauugugaugaaaguaguuuuaauuucacagacucucugaaagagucucaaggaccuccagggauugauaaaccaugcuuuaagacccacugcuuugguguuaauccacuuuggaaacagguauggguugucauaaaugacaauaucuaagaaagaugugagcugcagcuauauuuuuuuuaguguuuuaaauuuugauuuuacuccagccuuuuuugaacuguauguaggucuucuaacuaagguagaaaauuaaaauuaaugaguaguauguaaucuuauguuuuaagguuacucauaaagauugcaaauuuauuguggauuaagaaauccuuucuugucaauaaugucaagaauuccuuuauuuuguucauucaauuuucacaacaccccuguggguuuuaucuugguguuaucuuuguuuaacagauuaauugaauuuaacagacuauuuaccuucccaaaucaugcauugaaaagauggacccaugguuuaauauugaccaaagugcucguuacaauauuucucgccaccagccguugaaauauggcauacuauaaagagagccuaaguucugaaguugccugggauuagguugacagcccugcuucuccacugcccgaguugguguucuuuauccucucaauccuuagugaacucaucagaaauugcauuuacuuuauagaauuacagguauuaaauaagucauguaaaacagguuucagugugccuaguacauaguauacauuaaauauuuuucuuuucuacuuauucacaaucauuacuauucuaaauauuacuucauuuuuugucgcuuuuuuuuucucuaaugccuccuucccuuuucucauugcauacuuuuggaaauauauuauuagaugccuagauaauacaaauagggucuuuguacacuuaguagaucauucaguugcuuaagaaagaaaguuggaggaagaucaauaugucuacuuuaauauauggacuaggauuaaaacaccguauuauacauaugccauguguuguucagaauuucaauuaauaauuccauuauuuugacucuuuuuuguuguauuuuuaaaauguccuguuagaauccagaacccuugauguguccacagaugaagaggauaaaauacaucacuccucagaaaguaaggaugaucaggguuugucuucugacaguucuagcucucuuggagaaaaagaacuuucaucaacagguuaguaauuuguaugauuuugguuaagaauuuuauuuuuaauauaguguuuuugauauaguuauuaaugacauaacaaacucuagugacauggggcaaguaggucauuaaugaugauugucagagugccaaaauugcucauuuuuauuacauuuuaacaugcacaggucagacagcuuauaaguagcagggcuaggauucaaacccaguuuguucuggagccuguauucuucuuaaucacugugcuauacugggugauugacauugauacuugaaggaugguaagaauuugucagggaggauguuucagguauaggauguagcauaucugaaacucuagggaagguauguaauaugugcaggaagcuaaaaauagcucuggcugaaaguauuugguugcgaguuuaaggaaaagaaaacaggaaggacaaguuggagucagauuauacagggcuuagggaaccacugaaaauuuuauacagaugacaugaauguuuuugugucuuagaaagaucagucuaguucagggguuggcaaaucuggcccaccaccuguuuuuguaaacaaaguuuuauuaaaacacaaucacagucuuucaguuacuuaauauuugugggugcuuuugcacugcagcagcagaguugagaaguugccacaaagacccuauggcccgcaaagugaaaaauauuuaucuggcgucuuacagagguuuauaacuuguuuugugccguggacuccuuuuucagucuagugaagccuaagaucccuucugagaaaauaaaguaaaauacauagcuuuguagaggaaacaaauuauauugaaauaaaauuauuaaaauauauuuuaugacgcuuguaauauaguaauaagugcuucugugcuucuuuuuuuuuuuuuuuuuuuuugagauggagucucacucugucgcccaggcuggagugcaguggcgcaaucuggguucacugcaagcuccgccucccagguucacgucauucuccugccuuagccucuugaguagcuaggacuauaggccaccacgccuggcuaauuuuuuguauuuuuaguagagaugggguuucaccguguuagccaagauggucucgaucuccugaccucuugaucugcccaccucggacucucaaagugcugggauuacagacgugagccaccacgcccggccauaagugcuucuuuauuagccuauuaaauaacaacaaccaguagcucuguaaccuuguaauuuuguuucuucuccauguccacaagguacagaaauacuaagcgauuaagccaauauuaagaacugaaaucuaguaaacaguugaagccuugucuggauucuagauacagugcuauucaguaaaauuuucugugguuuggaaaaauuuucuaucuucacuguccauaugguagccacuagucacaaguggcuguugagcucuugaaauguggcuauagcgagacugagaaauugaauuuuuaguuauauuugaauacucacauagggcuaguggcuacuguaccaaacaaugcuacuauaaaagauggcggauuagacuaggugccauggcucaugucugcaguuugggaggccgagguggauggaucaccugaggucaggaguuugagaccaaccuggccaaaauggugaaacccuggcuuuacuaaaaauguaaaaauuagccaggcaugguggcaugcaccuguaauucaggggacugaggcaaaagaauugcuugaaccugggaggcagagguugcagugagcagagaucaugccagugcacuccagccugggcaacagagcaagacuccaucucaaaaccaaacaaacaaaaaaagaugguggauuaaacaggauaaggcagugguuguaaaguguuggcagcacugcccccaccuuaggagagagggcagcguuugaaaaugugugggauuauuuaaaugauuauaguaguugaguuguugcuggcacauagugcccuagaggcaagggaugauaaaugucuuaacaggagugcagaacaguucagcgcagugaauugcccauccccuaugcacauugagaaacgcugauuaaaaauugaaaacuuguccugugaggaacaccugaaaguucgaaggacuuauuggcuggcgaagaaaagauggaggaauguguuaauuuuaagggcuggcauguggaagaagagcauuuauuuguguuccgaugaauaacugccucaaaauagucccucuagcagagauuacuuguuacuaauagaagaugauaauuuaccucucagcccuagaugauugcauaucagauaggaugauauaugugaagaauuauucauaaguuauaaauuuguaaaaacaugauguauuuauuauugaacaauaugcugacauuauugauuccuccuaugucugcccagcaucugcugugugagaacccuugaacgagguauugaauaugcagaaacaggacaaacgcaauacucuucucuuccuugguuuuuuacuucuuuauuuuuacuugagcaguuaccuuuauguagcacuaauaucuuacuagugugucccauugcuugugacuuacuaauuaaacccuaccgagucaccugcaagaaaaucacuuccaaaauaaguauuucuguguccacauucauacacuugaguauuugaaccuaaaugucuuaucuuaauccugccugcacauuaaaauccucuagggagcuauaaaaacauacuucugcucagcucugccucagaucaacaucugaaucacugguauagaggccuggguaugucaagcuucucaggugacucugauguguagccagggucgagaauugcuacuauaaccugcugugaugguuuugaaucuuaaaugcuuugggaggaggaagagacaccugaccuucaucaugucccugacaguagucuauaaauaauuacuaaucuauaaaaaagcaaaucacuucauuuucuauuacuuguucuugaugaauauuuauugacuucuagugauuucuuuauugcuucaugauucacucaaggacuuuuaauuuucccuagggcugaugucaagcauauuggucugugauuucuaaaaucuuucucuuuuuuuguuuguuucaaacaugggagcuuuugugcaucuccaaguacauggcauuuuucuguuuauuucucaaagaauuugggucaacuugugggaaaguuuagaaaauuucacuucagccucaguagcuugacaucuuuuuaguaguuugaagugcuuaaaauggugaaaauuucucucgcuguuucuuuaauguaguauuuuucuuaagaaaccguuuuuuccagaaugaagauaaauuucagcuuagaucaugcaugaagaaacucguuuuaaauuggaagaguuuaugcuaaugauauuuaugcuguacaaaauaaagaaaaaaaauaagacucucuuaagaguuguugucauuuaaaauuuuucaccugguaaaugagccugauuauuuucuuuacacuucuuaaugucucauguuuauucacguggggcucacuacagaaccgcagaggcuaauuuggcuuugcucuguuacuguuuguaguauguuugugauuucuuguaaguguggguaggagggaaggaggaaggaggacaucauaguguaguaucucucuuacuugguaagucaggcuggucugucauugauccuucuaacuucuguagcucucacugauuggggaacaccacacucagcccucuccacaucccugcgcugacaaucucagagcuuccagaaaugagaaauagcgaccccucaacaaagugagcaguaccugaugaguaagagaguuaaaagauaaaaugaagcaguuucaguauauuuucugauacuucuagauuuguuugauuuuucuaaguuguauuuaaucucuauuaaguuuucuuccuuugcugauacagauuuugagccauuuauuaaagucacauucauauaucaaaauagcaaauaauuuaggaaaauggugcuuuuuucuuuuucuuaaaugugaggaauauuuacuuacauuggucuuugguuuuuaguguccucgucuuuguuuccuucaguuaagaucccagaugcagcuuuuauucaggcagcccgcagaaaacgugaauuggccagggcccaagaugacuauauuucuuuggauguacaacauaccuccuccaucucugguaugaagagagagagcgaagaugacccugagagugagccugaugaccaugaaaagagaauaccauuuacucuaagaccucaaacacuuagacaaaggauggcugaggaaucaaguauggauuuaccaauauaugaagauuaggauauuuuuuauuagaauauaauaugagagaaucuccauaaaaaauguaauaugcuggcucacauuuuauaguguugauaaugguuuuuaacaucgauuugguccaugauauugugaccucuaaaagauguaucuguaucaaaauguuauuaucaaggaguauguguaauaauguuuauuaaugccugaccucccaccuugauguuuuuggacagguuaaaaaaaaugugcaguaucuuacuuucaaagcauugaaaacgaucguuuuuaccuguauaaauauauuuuuuuuaacauggaagcaucuauagagauuuuagaugucauguauuaaaaucuucccugcuguaauaaaaaauuuccucuaccaauaauacuaagccuuaaaggacuguuuucauauuucucauuuaugauauaugcauuugaccaagguuuugguaacuuuaaauaauauuuuuuucagaaaaggacuuaguuccuuacaauuuauuuuuaaguguuuggauucucagguaguaauugagagaucuuugauaagaaaaaccaaacauuucauucuuucucaguuuuuuacaauauagggcuauaguguuuugagugggacaguuuagugauaggagugcagguuauggagucagaucccaggauccagcuuccagcuucaacauaguccuaagacaguuacuuaaccucccaauauuugcauuuccucauuugugaaaugagggcaguaauagugccuucuucccagaauuauuaugaagaauaaauaacacgucaaguggugcuaagccuuuguauaaucucaaaaaauguuggcuugcugcaauuaaaauggaaaaauacuaaacguuuacaugugagcuuuuuuuccgcuaguaagcagaaaugaagaaacaagugaagaaagucaggaagaugaaaagcaagauacuugggaacaacagcaaaugaggaaagcaguuaaaaucauagagguaaucauuuuuuaucccauguguauuagauuccuguggcugcuauaacaaauuaccacaaacuuggugacucaaaagaacacacauuuauucucucacagcguggaggccaaaaucugaagucaagguauuggcagcaccuugcuucuuccaaaggcccugggggguuguggggagcgguaauucuuccuugccuuuugcaacuucuggucauuccagguguuucuuggcuugugacuacauaacuccucucucugccucugucuucacguggcuuuuuccaugucucuacuguguguuuuucucguaaggauacuugucauuggguuuagggccuacucagauaauccaagauccuucacuuaauuacaaccacaaagacucuuuuuccaaauaaggucauguuugcacuuuccagggauuaugucauggauguaucuuuugggaggccuccauucaacccacuacacugugcauauuaucuuauuuuccacuagauuauaaauaccuuccacuugaggguacuauuuuuuuaaucuuuaauuuuauaguaauugacaguuuauauuguacaggugcuuaaaaguaaaguuuagcccucaagcuuuacuuuuaaacgccuguucuguauaauacaaauauauccaauuuucucuuuggagacuguuuuuuucacuucacaauacaacagagacaucucaccgcaaugguauaucuacuucgacuacaccuuaaugauuucauagcaaucuagugaauagauaauauauaucauuuauauauuaaaucucauuaugugauuucucauauaauuuuuuauuguagugaacccuaugguaaauauuauacacaaauauguuauaccuauauuaugauauguaacuguuacauuucugcauacacaaauaauaguuuuguguuuuauuuaauuuuuuaaaagauguaaacaaaguaaauauccaacaauaggggucuugguacaauacaguaaggugggaugaagugcuaaaaaugguaucagaaaccaaagcucgggaggcugagucagguggaucacuugaguacaaagaagacuagccugggcaacauagccaaacccugccgcuacaaaaaauacaaaaauuagccagucaugguggcacacaccuguaguccuagcugcuuggggggcugaagugggaggauugcuugagcccaggaggucaaggcugcagugagccaagaucacgccacugcgcuucagcgugggugacagagugagacccugucucauuuaagaaaaaaaaaaaaaaacaacguuaaagcccagauuuggccaggcauaguggcucacaccuguuacuccagcacuucggaaggccaagguggaaggaucacuucagcccaguaguuugagaccagccugaacaacacagugagaccugaacucuacuaaaaacaaauaaaacuagccaggcaugguggcgcaugccuauagucccagccacuugcggggcugagcugggaggaucacuugagcccaggaguucugggugcagugagcuaugaucacaccacugcacuccagucugggcaacagagugagacccugucacuaaaaauaaauaaaugaaugaaugaaugaauguaaaguuuaaacaaguagugagcuuugaaacauaacaaauguacuguacuugggguuaaaaguccuagauuugggcugugggucugcugcuagaauauaaguucugugaggucaagaauugcaaucauaguguacaucagagauucccaaacuuucucauucauggagauguuagugucuugguaauuuuaucaugauacuuguaagccaaaagaaguaccaaacaguucuauuuauuaaguaguccaaagaauuuuauacaauuuauguccuaagaacuaaccauuuggaaaaaauaauacagauaaauugaaggcaaaacauuuuuaucuuuuuuuaaauaaccaaaauuccuuacuaaugagauguguguuccuguuaggcauugcaugacuuuucagaccuuggagucagauuggacacugucacucucauuuccauacugauguucacacaauacuuguuuuuaucauagcauccucccaaaacccagcuccacaaauaugacuucaucaaaaggaauggaacacauucuuuuuuuuuuuuuuuuugagacagaguuucucuuugucgccuaggcuggaguacaguggcaugaucucggcucacugcaaccuccacuucccagguucaagcaauucucaugccucagcuuccugaguagcugggacuacacguacauaccaccaugccugacugauuuuuuguauuuuaguagagaugggguuucaucauguugccuaggcuggucucaaacuccugagcucaggcagucugcccaccucaaccucccaaagugcuaggauuacagguaugagccacugugucuggccauauggaacacauucuaauguaacugugaacuaagagcuaguaguccaacagauguugaguauuacgguuuuucccuaaaaaauuuaaaaugucucacuacaccccuuuaaauuugcuaggaugccuuugcacacaguuuaggaaccacaauaugcaugcaauuuugaauucugauuuccuugcuugacauauuauaaauuaucuucucuuguuuuuauaucguuauaacaacugauuuuaauagcuauauaauauucacuggagucacugaaucauaaucuuaaccauucuucauuuuggacauuuuagguuauuugcaaucugauuuuuuuaauuaacaaauaagaaucagugaauauuuaauuauuuuccuccucuccuuucuuuuguucagauguguguuuuugaacuauuccuuuguaauaauugccaagaguuguauuacuaaucgagaugaacauuuuuauggcacuuaguauauuuuucucuauugccauuuaaagaaaacuuagcucaaucuguaaugucgccaauaucaugggaauauuuuaccauaaucuugcccucuucagguccaaguauaguuggugaaaauggaaucucacacuuauuugauuuucauuuuuauugcuaaugugaguacauuuacugauuccuuuauugaaaaucuaccauuugccacuguguuacuuuccuguggcuccuguaacaaauuacugcagacuugguggcuuaaaacaauagaaguuuauucgcucugaggucuggaggccagaaguccaaaaucauaaugucaguagagcaaccccccuuuccagaaacucuguaggagaauccauuccuugacucuucuaguuucugguggcuguuggcaugccuuggcuuguggccacaucucucuuuguugcaucuucacaucugcuucuucucuugugucccaaaauucccuaucucuuaggaugguacauguaauuguauucagaccccaucgggauaauccaggauauacaccacaucucaaagucuuaauuacaucuuuugccauauaaugaacaugaacaugaaugugaacauguuuucauggggucaccauuagccugcuacggccaguuacaaugauguacaaccucugcaggaagggagacaacuaaacaaaacaauuauagugaaauccuacaggugcugugacagaacucugugcaggguccugagguggcacaaaggagcaagugggugaucaguuuuauaggagggaagguaagugaggaagucugagaaagcauuuauggaaguggugauauuugaauggguuauugacugcaaaauaucaagaguguuuggagauuuuguagauaugcguagagcuggaugggaggcuuggugagaacugaaaugacaaaagaugaugcuucauggaaaauauaaaaagaauagcuaagccagugaaauuggcuaaauaucuggucaguuuucuucaugugucuuuguguaaaauagagguucuucaggaucuuuugaacauuccaagcauggaggagcugugauuagacagaggacacuaaugugaaacauaccauguuauaagauauauguuaggagugcauuucuuuacaaggaccagaaaacccaaauaagaaugucuuggcugggcgugguggcucaugccuguaaucccaauacuuugggaggccacggcaggcagaugacgaggucaggagauugagaccauccuggcuaacacagugaaaccccaugucuacuaaaaauacaaaaaaauucaccaggcaugguggcaggcgccuguagucccagcuacucgggaggcugaggcaggagaauggcgugaacccaggaggcggagcuugcagugagccgagauugugccacuggacucuagccugggcaacagaacgagacuccaucucaaaaaaaaaagaaagaaugucuuaaagaaaaguaaaaacuuuaccuacaaacccuccagcacacuuccauuuacuuuucauugacuagaauggaguugcaguuaaauagguacuucuaucauggaaauagguguuaggucagccagacaggucugucuacuccacaaauuaauauucaugaaggauuguuguuucuuaaaaaacugggugacuuucugagaguacauuagaccauaaccaaaauuagcuucaaaacuaaacuuuuuuaaaaauguaauuuuuagaauuugcuucuuaaauaugaauuuaaacuucuaaauuuuaaaacugaauuuaaaaacauuuuauugggaccaugaaaaauuacaaagacauggaauuuuuuagcuugaagagaccuuggaucauccagucccuuuacaugcuauuaauguuucaaagguaaaugaaauaaaugguuuuguaaaaaucuauuuuuacuuuuuuaggaaagagacauagaucuuuccuguggcaauggaucuucaaaagugaagaaauuugauacuuccauuucauuuccgccaguaaauuuagaaauuauaaagaagcaauuaaauacuaggugagcaauacucauuuugaaauuuacauuuguccuagauauuuaauacuaaagauauaacacuauauucuuuuagauuauuaaguacugauauuaaacagacuuaugggggggaaaaaggaucuccuguguuaucauacuaacacaauuuauuucauuuuuguauacacuagucccccccauaucugcauuuuugccuucuaugguuucaguuaucgguagugaaaccaugguccaaaaauauugaauggaaaauuccagaaauaaacaauucauauguuuuaaauugcaugcuguucuaaguagugugaugacaucuugagcugcccugcuucauccugcccaggaugagaaucauccuuuuguccagcaucucuuugcucuguaagccagcagccuguuagucacauaguaaccaucucaguuaucagaucaacuauugcaguaucacagugcuuguguucagguaacccuuauuuuacuuaauaauugccccacagugcagguguacuguauguaauauauaaauuaaacuuuaucauaguuaccuauguauagggaaaaaacagcauauauaggcuuugguauuauuugcauucacugggggucuuggaaccuauccccaugauuaaggggugacuacgauaugucuuuuuagucuuuauaacauauuuuacgugguuaaaaucaguaaauacaaaauucuacuuuucuauuuaauaugauuauaagcauuuuucuauauuaccaaaaagccuuuaauuuuuuuaaaaaaacuaucauguuuguccauauaguuguuauaucauaauuaaauacuucucuguuggacauuuugaucuagaacaggagucagcaagucgucuuuuuguguaaaaggcuggauaguaaauauuuuaggcuuuaagggcuagaugauugcuguuguaacugcucaacucuauguuacagcaugaaaacagccauagacaauauguaaacauauaagcauguauguguuccaauauaacuuuauuuauaaaaacaaaggauggacugguaguuugccagcccccuagaauacaaagauaaccuugcaugagggauaaaaaagaggcagcagaucauugauuuaucguagcauuuuauuuuaucuggauaacuuuauuauauuuuauuuuuuauuaacuagguuuuuuauuuuaaaaagaccauacacucucauuguuaaaaaauaaaauaaccaguggaaaggauauacagaacgaaguaaauuaccacccucccuagaggaacccauugcuaccaguuucuuauguuuuguuccagaaguggucuauauguauaucuuuauaagcacauguauacuuauauauucccguuuuuauacaaaaaaggacauuauauacccugcucuguaccuaguuuuuuccacaugauauuuacuuacaaguucacugcuauagucaaaaauauucuacuuaacuaaaacauuuuauuaauaaugccuacuauacauuauuaucuugauuaauuucuuaauucucacucuccuuuauauaaagcaaagaaagauucugaaagacaaaugcaagaaaacuugaagagagaauauuuggccuaagcaagugcuaaaggguuuccuuuuauugugguguucuuugcuuaucuagucuauaaacccagauuuauaugauugucaguuuccuugguggucuuugaaaauauuuacauuagauugcuacuuuuaaaagaguaugaaaaauaaacuaauuuuuauuuuauuuauuuagauuaacauuacuacaggaaacucaccgcucacaccugagggaguaugaaaaauacguacaagaugucaaaagcucaaagaguaccauccagaaccuagagaguucaucaaaucaagcucuaaauuguaaauucuauaaaagcaugaaaauuuauguggaaaauuuaauugacugccuuaaugaaaagguacauaucaauauuuauuuauaucauuuccuuuuuuggagaaaaccccuugugcaauuaagaaaagucuaaaucucacaauuagauacuuuucucuaguauuuuuccuacacauuuuuaaaauaagaugauagcauucucuuaauguuggauauucaaguuuuuugcaacuauuuuauuauuguaaguaacauuguauaaaauuuuguauauaaauuuuuguuauaauuucuucuguuuaaggaaaauuccuugaaaaugaagucaaauaaaaugaauuauuaagucuaaauauuuuuaaggcuuaugaaacauuacaaaauugaccuccagaaagauugugccaguuuuauuaguuuacuagauuaggaauaaauggauuuuguuuuuacauaucauauuuugaucucaagcaaacucuuugguuuucugcuugugaauuauuuguuucuugucuuugcccuuuuaucuuugugguucuuaguggaaauuuuuuucuuuuucuuuucugguuuuguuagaguaugaacaauucuuuauagcuuaaaauuuuuuaauguuuuauccuacuuaaugugaacuuaccaguuuugucuuuugaauuuguuuguaaugguuuuucuuucaacauucagauguuuugaaauuuuuguuuuuaguuuuuguuuuaugcauacuaaguuuuuacauuggggcaggccuucaguugucuguuuuuaaaaauagauuaaccauuucaauaaauuauucucuacuuuccacauuuuuguuauuuuuauuuuauuuauuuuucuagugagggggacagagucucgcucugucacccaggcuggacuguaguagcacgaucucagcucaaugcaaccucugccuccuagguucaagcgauucucgugccucagccucccaaguagcugggacuacaggcgugcaccaccacacccagcuaauguuuuguauuuuuaguagagacgggguuucgccauguugcccaagcuggucuggaacucccgagcucaggcaauccaccugucucagccucccaaagugcuaggguuauaggccugagccacugcacucagcccacauuauuuuuuguuuauaauuaaaacaaugagaugcuuugucccaauuguuguuuuaaguuggcuaucuucuacuaucacuugguaguuacuuucugaaguauuuauuacaauguaauuuucuuuuuucauuugcccuugaaaaauuacacuguuaaaauuuugucagccugugcauuaauguacucauagcagcagcuguggaguaucaauggaguaggaggaauuguugcuccccaaaauaugagaguuucaauuucaacaagucucauuucuguaucacaucacaacuuacuuaccugacucugguuaguuuuucuccauuccccgauuuuucaaauuucaccagcuuugagugcccccaccuacuuuccacacccucagccuggaaaacaucuguacccuucauuuuuuccuauucuucugucucaaaaaaaaaucuucuaucucaaacuuuaaugcauguuccugacuccaucccauuugguuucuuuuuuuuuuuuucuuuugagacagagccucacucuguugcccaggcuggagugcaguggugugaucucagcucacuguaaccuccaccuccagaguucaagcgauucuccugccucagucuccugaguagcugggauugaaggcaggugccacugcgccuggcuaauuuuuguacuguuaguagagaagggguuucgcuauguuggccaggcuggccuugaacuccugaccucaggugaucuacccaccucccaaagugcugggauaacaggcaugagcuaccacauccuggcccccauuuaguuuaucuaucucugauaauuguaacaguuccaguagacuaagucaauuuucugauuuuuuaauauuaaaaguauuggcagcuaggucuguugcacacaauguuuuauacuucagaugugauaguauugggaauguuucuuugagaauuaagcauauaaauaugcuuauguaucuucuaaauauuacuuuuauauauauauauauauauauauauuucauuaucgaugaccugcaaaauguuacuuauauguguauuucagauuaucaacauccaagaaauagaaucauccaugcaugcacuccuuuuaaaacaagcuaugaccuuuaugaaacgcaggcaagaugaauuaaaacaugaaucaacguauuuacaacaguuaucacguuaguguuuuucguguuccauacaauuuauuauucauuaagcuaaauuaugugaagaauaaaaauauuuuuauuuuuauaaacauguuuuucauguauuuucccacaaacccuuuacccaccaacuuccaaaaacucaaaacauuuagaaauaggacuuaagaauguuuuaaauuaaguccaagacucaaaaauaaacaugacuuccaguuauuuacuauuucagacagaauauguacauagccauuuagagaauguuuugagacaaguucacauaauucuggaggcucugucagaagucuaacuucauaguuucagagcccuuuuacagauugguucuggugaguuucaauacagauuuuaagaucucauuauauaaaauacggaugccuccucuuuuuuuuuucgcauugauuuuguacuuucagagauaucuuccuuugauuaaggugcuaucaggagauagugaaagaccauaaccaaguagcuaguaaaugcaaaggcaaagugacuuucagugaaacacacaacccuuaguggaucauaaauaaugguauuacguauuaaaauaagaaauaauaugaauagaauacaguaaucccucuaaucugcaguuuugcuuuccacaguuucagucaacaaugguccaaaaaugaauaaguacaguacaauaagauauuuugagagagagauacccaacauucguauaacuuacaauauauuauuuucauuguucuacuuuauugcuauuguuagucucuuacagugccuaauuuauaaauuaaacuuuaucauagguguguauauagaggaaaaaacaaauaggguuuggugcuauaugcaguuucaggcaucgacugggguucuuagaagguguccccugcagauuaggggggacuccuguauuggcaaagccaauauuucuugcauuuggcuauggaaaaaaacugguagaaacuacuggaaaagaauaugagaaaacgaaacuuugugguagaacuuuguugcuguucucaacaacagcaaaaguacaccagccaaaguacauuuuuaggcuaaugaaccucaugccuguuaauauugcaauaaagaguuaacauugaaaugucauugcauaauuaauugcaaaauuuaagcauauuuauguauuuacauaugcauauguuuauacauccaugauauuaccuuuauuuucaaagcauuuuacuuuuuucuuuugagaauuuguaguaugaagucaauuuuauuuauuaacaggcaaagaugagacauccacaaguggaaacuucucaguagaugaaaaaacucaguggauuuuagaagagauugaaucucgaagguaccuauauaaagugaagauuuaaagaaagcaucauugagcaaguacuuuucacuacugaaauauaauuaaccacaugaugucauuaacuauaccugauauacauuauuaauuuguaagaauaauagaaaagcaaaauuuaguaaaaccacccuugacugcuuuaaagacacauugguguauuuggaucaguuaaaaggaauggguaaaaugacauuuaucaggcugggaauuccuuguaacuagaaaccgguccuaauuauaauuacccccucuucggaaucugguuagcccaugggaauguccuaaaugggaaugucuuauaagagaaaacaaaacaaaacaaaaaaugcagaaccaccaacucaaacuaaugaaacuaaaaaugucaaaaauauuaauaaaauugugcgcugauaugauaguauauuucuggccauuuaaaauaaaugauaaaauuacuuauuuucagcaagagguuaaaaaaaauuuaggcauuuauuuucagcaagaacuacuuacuuuuuguuuauuuuugguuuguugcaaaauauaggacaaaaagaagacaagcaagggugcuuucugggaauuguaaccaucaggaaggaacaucuagugaugaugaacugccuucagcagagaugauugacuuccaaaaaagccaaggucaguuaccaaguuucuaauauaucaugguuugaguuuugaaauggugagaaacacuuugcugggauugcccuuaauaaguacauaagcuauauaaaacaguuggguaaauucaggaaaaaugaaacacauuuuuccucuguaagacucuuuucucugaaaaaauggaguaaaaugaaggaaggaacauugugaguauucuuacaucuucauaguuuuuucucuuagacguucuccaauuaauaaugaacaucuucauuucauuucuuuaccacacauacuuucuauauugucauuuuuaacuuaaaacauuugaauuuggugaaacuuuuuagcaugaugagaagaugcauauaguugaaaaauucuaggcucuggauuuaaauaaauuuggguucuaagggagauuuuuuucuguguaaucuuagacaaauuuuuugaccucccuaaauuugauguuguuuugucuguaaauaaguagacuauaccuauaugguauggaagauagcuacgaugguaaaaugagauuaauguauuucugcguauagcagggguauauaugguaacuucuauuaguguugauauuauuacuuuguugauaaagugauuuaauaaaaauuuauauuaauauaaaaggacaaauuuuagcucaauugauuacaguccaucaugaccguguuuuuaaggaagcauacuuaaaguucacaacuuaaaaugcauaaagagacuuauuuuguuuacaggugacauuuuacagaaacagaagaaaguuuuugaagaagugcaagaugauuuuuguaacauccagaauauuuuguugaaauuucagcaauggcgagaaaaguuuccugacuccuauuaugaagcuuucauuaguuuaugcauaccaaagcuuuuaaauccccuaauacgaguucaguugauugauuggaauccucuuaagguauuuaugcuuaacauaugaaaaauuauccugauuauauuaguugcuuaaauucccuuacuauuguguuaggcauuaaauaccuuacccuuagagucggagcugaaauuuagagcuuuggaacaauagucagaaaaugugugcuuucggcuacauucuucuuuucuuggcugucacuugauuuuuaggcuaagcaucauuaacaucaguaaagcaaacacauuuuuuuuuagcuucuuguacauuaaauuuaaaauccucccagaaaguauaagguacuguuggguuuggagaaaguagauauaaaagccuuguuucaagaauucuuaaguuggagaugacauacugggaagaguugcuuaggguuguguugagaagguggaaugcaagccuuugaagaguuuaugggguaaacaggaugaaucagaaagggaaagguguuucauaaagguguaaagggagaaguauuaguucaggagcuagaaauugcacagauauuuagauccuaaguuaaggaauauaaacucuguucacugaauuugacugacuaaaagaaaaaaaaagaaguaugaacucagcaacugccuacuguguaauaggaccuuuaacuaaaucacauacaaauuacauauuuaugcuuagugaauugaaggggccagaaauaaacuuugcuugaaguggaugaauuuuuuuuauaaacaaauuccauggcuguuucaagugccuaacaaauuuguauuuugcuccaagcagaguacuugccaugugguagggucuaaaggcuccggcacacacuagguaguuguugaguguuuguugugugauugaaugcaugaaaugcagcuucuucuuauguuacuuagacaccaugucucagucaugcuguccugcaauccugccuagccuugguggucuaguguuaaaauagggaauuaaucucuucugauccuuagaaaagcucuggugauuauugaaaaaaauaauaacuauuuaaaaauacacuaauguugaaagauuucuuuauaacuuuuguaauuuucuuuguaaguuggaauccacagguuuaaaagagaugccaugguucaaaucuguagaagaauuuauggauagcaguguggaagauucaaagaaggaaaguaguucagauaaaaaagucuugucugcaaucaucaacaaaacaauuauuccccgacuuacagguacugcuucguaaccuugguaaaauuaaauuauuuucugacagaguauauaagguuguuaauuucuguuauauucacaaaguuuuuucauaaguuuuuaaucucaaggaaauguuauauguaguaaaaaucaacagcugucaaauguaaggugguuaaaaaauuuguguuuguacaggugguuggcuaccaaacugcuaauacucagauugaucacuaauccucaucugacguaucaucagcaguuccaacaguugacccuucuuucuuccuagaaacacugucuuuacuuggcuaccaaaauaccacacucuuaguuuccugcccaccucucuggucuuugcugucugcuugucaccucuuugacuuccaagugcuacaguaucucuggauucaggucacuuaccuucucuguucuauuuacuucagucacuuaguauuuaaagucaguuuaguguuuguggcauucccgcugcuuuuauggcacuucagucauuuuuuagcacacuuccauccauacuacauguguccuuuuuuccccuuaacuucucuaauuguguuucuuauccuuuucuuuaaaaccauugcuucaucugggaguggugguucaugccuguaauccuggaacuuuaggaggccaaggcagguagaucaccugaggucaggaguucaagaccagccuggccaccauggcgaaaccucgucucuacuaaaaauacaaaaaacuagcugggugugguagcaggcaccuguaaucccagcuacucaggaggcugaggcaggagaauugcuuaaaccugggaggcgaagguugcggugagccgagaucgugccauugcacuccagccugggugacaagagugaaacuccgucucaaaaaaaaaaaaaauugcuucauuucacucacauuugccacuagcagcuaugagcacuuaacauuaaugcuugugcuucagaccuuagcaugaagucuuuuguuuuaccuguguacuugauaaggauccguuucacuaugucacugagaaagaaauuugacagcaaagacugcaaaacucuuauuuaauuuuuuguguguuuguuuuugagacagggucuuccucugucacccagacuggaguacaguggugugaacauugcucaagucagucuugaauuccuggggucaagugauccuacugccucagccucccaauuagcuaggacuccaggcgcgugccaccauacccagcuaauuuuuaaaagauuuuuuuagagacagggucuugcucuguugcccaggcuagucucaaacuccuggccucaagagacccuuccccuaagcuucccaaagcacugggauuauaggcaugagucaccaugcccagccuagaaguuggaagcaauuagccuuauaauugcuucuuaggcaacuugauuauaagauuuuggcuggguggaguugcucaugccuguaaucccagcacuuugcaaggccgaggcagaaggaucgcuugagcacaggaguuccagaccagccuuggcaacgaggugaaaccccaucucuauuuauaaauuuaaaauuuaaaaaaaauaaaaaauaaaaacuuucaagauuuuauuucaaugaaacuuauggugcauuugugggguguguuagaaaguuacuauuuuuaacuaacucuacuaaugauagaaugcaugugccuaguuuaagcacucugcugaaaaaaucuaaauacuaaugaugaaacagucccacaaauaaguagcuuugugagaaauuaacacugacugaguccaaauagugauugaauucuacauauauuucaaagauagcacuaacagaaugugcuaauggauugguugugcagcaagagagaaagagaggaaucaagaauggguccauugaggaauuggccugagcaacuggaaggacagaggugccauuuccugaaaugaaaaagucugacaggaguaagcuuaauguggggagcuguauuagcauagcagcucaguuugggacauguugauuuugaaguaccuguaaucuaaguggacaugucaagucaguuguugaauacaugagucuuaaagggggagguccagucagaagguauaaguuuggaauuuauccacaugacauuuauugauggcauuuaauguauaaaauugacuuugaauaccaagcgagugaauauaaaccgaaaagagaagguaagugaccugaauccugagauacuauagcacugggaagucaaagagaugacaagcagacagcaaagaccagagaggugggcaggaaacuaagagugugguauuuuggaagccaaguaaagacaguguuucuaggaagaaagaagggucaacuguuggaauuguugaugauaagucagaugaggauuagaaucaaucauuggaguuugcuaugugaaugucaucugugauuugcuaagagcgcauuagguaggcugauaagagauaaggccuaauuaaagggaaagcaagaacaagugagaagagagaaacuggagauagaaguuuagauaguacuuugaggaauuuuguuguaaaagauaggagggaaauggaacaauacuagaggaggaaguagggcuaagggggauuuuuuguuuguuuauuauuauacuuuaaguucugggguacaugugcagaacgugcagguuuguuacauagguguacacgugccauaguguuugcugcacucaucaacuugucaucuacauuagguauuucuccuaaugcuaucccaccccaguccccugacccccaaaaggccccggugugugauguuccgcucccuguccauguguucucauuguucagcucccacuuaugagugagaacgugcaguguuugguuuuguguucugguguuaguuugcugagaaugaugguuuccagcuucauccauguccaugucccugcaaaggacauaaacucauccuguuuuauggcugcauaguauuccaugguguacaugugccacauuuucuuaauccagucuaucauugaugggcauuuggguugguuccaagucuuugcuauugugaauagugccacaauaaacauacaugugcaugugucuuuauagcagcaugaauuuauaauccuuuggguauauacucaguaauagcauggcuggguuaaaugguauuucuaguucuagauccuugagcagucgccacacugucuuccacaaugguugaacuaguuuacagucccaccaacaguguaaaaguguucuauuucuccacauccucucuuuuaauugugauguuaggaugucgauuuuagaucuuuccugcuuucuguugugggcauuuagugcuauaaauuucccucuacacacugcuuuaaaugugucccagggauucugguacguuguguguuuguucucaugguuucaaagaacaucuuuacuucugccuccauuucuuuauuuacccaguagucauucaggagcaggcuguuaaguuuccauauaguugugcgguuuugagugaguuucuuaaucuugaguucuaauuugauuguacuguggucugagagacuguuuguuaugauuuccauucuuuugcauuugcugaggaguguuuuacuuccaauuauguggucaguuuuagaauaagugugauguggugcuaagaaaaauguauauucugucgauuugggguggagaguucuauagaugucuauuaggucugcuugguccagagcugaguucaauuccuggauaucuuuguuaauuuucuguuucauugaucugucuguuaucgacagugggauguuaaaggcucccacuauuauugugugggagucuaagucucuuuguaggucucuaagaacuugcuuuaugaaucugaucugagugcugcuguauugggugcguauuuauuuaggaugguuagcucuuacuguugcacugaucccuucaccauuauguaauacccuucuuugucucuuuugaucuuugcuggcuuaaagucuguuuuaucagagacuaggacugcaacucaugcuuuuuuuucuuuuuucuuuuuuuuuuuuuuuuuuuuugcuuuccauuuacuugguaaauauuccuccaucccuuuauuuugagccagugugugucucuuuacaugagaugggucuccugaauacagcacauugaugggucuugacacuuuauucaauuugccagucugugucuuuuaauuggggcuuuuagcccauuuacuuuuaaaguuaauauuguuaugugugaauuugauccugucauuaugaugcuagcuggucauuuugcucauuaguugacgcaguuucuucauagcguugauggucuuuacaauucgguauguuuuugcagcgucugguaccaguuguaccuuuccauguuuagcgcuuccuucaggagcucuuguaaggcaggccugguggugacaaaaucucucagcauuugcuugucuguaaaggauuuuauuuuuccuuugcuuaugaagcuuaguuuggcuggauaugaaauucuggauugaaaauucauuucuuuaagaauguugaauauuggcccccagucucuuguagcuuguaggguuucugcagagagauccgcuguuagucugaugggcuuccauuuguggguaacccaaccuuucuuucuggcugcccuuaacuuuuuuuccuucauuucaaccuuggugaaucugacaauuaugugucuugggguugcucuucucgaggaguaucuuugugguguucucuguauuuccugaauuugaauguuggccugccuugcuguguuggggaaguucuuccggauaauguccugaagaguguuuuccaacuugguuccauucuccccaucacuuucagguacaccaaucaaacauagauuuggucuuuucacauagucccauauuucuuggaggcuuuguuuguuucuuuucacuuuuuucucuaaacuugucuucucgcuuuauuucauugaggugaucuucagucucugauauccuuucuuccacuugaucgauucagcuauugauaccuguguaugcuucacgacauucucaugcaguguuuuucagcuucaucaggucauuuguauucuucucuaaacugguuauuuuaguuagcaauaccucuaaccuuuuuucaagguucuuagcuuccuuccauuggguuagaacaugcuccuuuagcucagaggaguuuguuauuacccaccuucugaagccuacuucugucacuucgucaaacucauucuccauccgguuuuguucccuugcuggugaugaguugugauucuuugaagaacgggcauucugguuuuuggaauuuucagccuuuuugcacugguuucuccccaucuuuguggauuuaucuaccuuuggucuuugauguuggugaccuucagauggggucucuuaggguacauccuuuuuguugaugcugauacuauucuuuucuguuuguuaguuuugcuuuuaacagucaggccccucagcuguaggucugcuggaguuugcuggagguccacuccagacccuguuugccuggguaucaccagcggaggcugcagaacagcaaagauugcugcuuguuccuuccucuggaagcuucgucucagagggucauccgccagaugccaggcagagcucuccucugugaggugucugucggccccuacugggaggugucucccagacaggauacacaggggucagggacccacuugaggaggcagugugucccuuagcagagcucgaacacugugcugagagaaccacugcugucuucagaacugucaggcaaggacguuuaagucugcugaagcugcgcccacagccaccccuuuccccaggugcucuguccauggaagauggggguuuuaucucuaagucccugacuggggcugcuggcuuuuuucagagaugcucugcccagagaagaggagucuagagaggcagucuggccgcaguggccuugcugagcuucggugggcucugcccaggucgaacuucccgguggcuuuguuuacacugugaggcauaaaccggcuacugaagccucagcaguggcggacaccccuccgccuaccaagcugaagcaucucagguugggcucagacugcugugcuggcagugagaauuucaagucaguggaucuuagcuugcugggcuccgugggggugggacccaccaagccagacuacuuggcucccugucuucagccccuuuuccaggguggugaaugguucuguuucucuggcguuccaggugccacugggguaugaaaaaauaaaaauuaaaaaaaaagccugcagcuaguuugaugucugcccaaacagccacccaguuuugugcaugaaacccacagcccuggugggguaggcacuggagggaaucuccuggucugccgguugcgaagaccgugggaaaaacacaguaucugggcuggagugcacuguuccuccuggcacgguuucucguggcaucccuuagauaagggagagaauuccccaaccccuugugcuucccaggugaggcaacacccaaccuugcuucagcucacccucugugggcugcacccacuguccaaccaggcccaaugagaugaacuggguaccucaguuggaaaugcagaaaucaccggccuucuacguccaucucgcugggagcuguagacuggagcuguuccuauucggccaucuuggcagccuccuuacacugagggggauuauuuuuaauacaagauaaauaguuguuuguagggugauggaaaaaaucuaguacaagugaugucaauaccaaaguggaaggacaguguucugggaacaggaucuuagacuaagccaaaaggcuugggaucucauccacaaaauaaacaguuugccugaaguggugggagugugggugccucauccauaggaauaggagacaaguuagagcauaucggcacagauguagguagguguguagaugcugugguaggagcuucauagugcugcuuuucugauugcuucuauuuucuuagcaaauuaggaaguaauuagcugaaagagaaugcaagggaguagaaaaaauaaaguaggaaauaaucaucuagaaggaaaaaguccaucaacugagagagagauaacggagaggggagaagguaugaaguaaucaucuaggugagagggagagugaauggaccugagagacagagagagagagaggcucacucaaguuguauagugaucaaguuaauguguuuguuuuuccagccacuuuuuaucugcaugguugcaggcagagacucagugacaaggugaacuuaacuauaaagagcuguaguuuagccagaggaguuuaacaaagcccaagaagaacaaggaaauugaagauguaugcaaauauguaaugguaauaauuggccauggaacuuaaacugaauaaggagggaaguaguguuuguuaaaggucuugauuauuuguauaugaaaagcaaaacaaucuaguaaauacauuguguaccacugaaauauuuguuucagacuuuguagaauuccuuugggauccuuugucaaccucacagacaacaaguuuaauaacacauugcagagugauucuugaagaacauuccacuugugaaaaugaaguuaguaaaagcagacagguaauaauuucuagaguugcgaacuccaugaucuaucucuaaaucauuauaauuuucuuacagaucuugguuuauaaaagaugcagaagugauuaucagaaaacuguuugggggaaaacauauuuacuuuugauuuauagaaacuagacuuuuucucagacugcacugagaugaaaaaaaaauuuuuuaaacuggacuuggcuauuuuuuaucuuuauaauaauaagaugaaagaauauaccuugauacuucucaacacugugauaggagugguaaucauuuuaaauuauagacauacauguaaggacccagauuaugacuuucauuccuauuagcuuacuuuucucuguucagugaucugauuuguguucucauggcccaggcagccaucuuucaggauuaugaauauacacuggcccugcagagaugaaccgguauaaauucauuagugcaaauucauuucuucuaaaggaagacaacaauacucauuaccuuuguucuuuuggcaaaaauccaguggcauuguggcuuugcuugaacaaugguuucaaaauuagacugacacuuauuguauuaacuaguuauuuguagucuaccaaauaauaguagucucuuuaaggauucaaaguucaguaaaacagaucuuaaucuuacaaugaucuagaauugaauucagugaacauaagacauauuggggaacuuuuuagagugauguugcugagaaucuucucacucuuucauuguagcauuuuuuuuuauuguuuguugaugagauuguagauucaugcaguuuuaugaguaaaccaauuuuagguugagcuuuaggaaauuaaggagaaauugacagacuggagaaugcccggaguagaaugacagaggugguugaaaagcaaggaggcauaucauauucauauuaugagcaccauuaaguuuuagcccuuggaacugugauuacaaaggaggauagcuguaagaaaugaaagggagaaaagggauaccagccuaauucugccuucaagaagcauguaaucucagagaaaauaagaugcacauaaacuguaacuuaaaacuggaagugaaaaggagaaguagggaagauaacaaacacuuauuuaauuccaauuguguacuaggcacucuguaaggucuuguaccugucaucuuaaucccagcagcccuauuuaaaaaaugggugaucgccagguauggcagaucacgccuguauaucugagugcuuugggaggcugaggcaggaggaucucuucaggccaagaguucaagaccagccugggcaucauagcaagauccaucucuaccaaaaaaauaaaaauuagcugggcucccccuugagcccaggaguugaagcugcauugagccuugauugugccaccacacugcagccugggcaacagcaaaacccugucucuuaaaaggaugacagccucauuuuauagaugaagaaaaugaaucuuuaaaacuaguugucacagugcuacuaugaaugagcacuaggauuugaacuuggauagucugccucuaaagcccaaguuugccucacugaccauguugccuccccuugagcagcauagauaaaguacugugucuucaggagagagacaggagagagagguuaccuucagcaguggggauaaggaaauaauuuaucuuagggguggcauuugaacuguggcuugagggaaagaauaggauuucaacauguggcaacagagagagaggcauuuucugcuuaccuccaauaggauaaaaacucaaguaaaauagauggaaacuguugcaggaauuagagauauuuaauuugaaagauguacagagagaugcuguuuguauucaaagaagguauagauuuauucugugcuguuaugcagcauagaaccaagauuaguaguuaaaagcuacaaagaagcagauauauaauccugcauuugcuuuccauauaguauuguuuaguuauaaccuaaauguaaaucauuaugcuuuaccauuuguuaaauacuuucacauugucucauuugauccucauaacccugugaaauguauuuauuuuaauugcauuuuuacagaugaagcuggggcccagaaggguuaagucauuuuugaaauacuugaauacuaagugguagaccuggcucuuugugaucacugaagcccuucagcaguauuauggauucacucaugaagucuuuuuuuuuuuuuugaggcggagucuugcucugucacccaggcuggagugcaguggugugaucuuggcucacugcaaccuccgccucccagguucaagcaauucuccugccucagccucccgaguagcugggacuacaggcaccugccaccaugccuggcuaauuuugugugcuuuuaguagagacgggguuucacuguauuagccaggaugguauugaucuccugaccuugugauccgcccaccucggccucccaaagugcugggauuacaggcaaacucaagcaguuuuuauaauggauguuuuuauucugaaaccgcucugcugugaauguagaaaauggguuguuuucauaagcaggagaauagauuacaucaggguuuucagucucagcacuacauuggcauuuggaacagauaauuuuuuguugugaggguuuguccugugcacuauaguaugcuuagcagcaucccuggcuugugcccacuagguggcaguagcacuccccggucuucacaaccaaaaaugucuacacauugucagguauucccuagggauggcaaaauggcacuugguagagaaucacuuacacuauauaaugccccauguugcuaagacaguucaccagugggaucacuccauuucuucagugaugaaagagaaugagguucaagaaugaaaauugagucagacaacauaguuucuguuuucaaaguuagaaggaaaugcuguaagcuaaugccugguaauaauaguuuugauucugacuaaaaaucuaaaguaaauuauuauagaggaagauuaugaauacuuaaauuuaaaaagcaguaauuacuauaaucugucauugauaggauucccaaauacaaaugauacuuaacauuguuuauugaagcaaauuguuauuaugauuguucuuagggauuaaauggggaaauauaagcuuaaguaaaccuaaaaaauaauggccaguagggcauuggcuaccuauggggagucuguuaguauuagauaucuucucagcuuugcccuguucaauauuuuuauugaacuggauaaggaguuaaaauacauacuaaugaaaugugucagugacaaaaagcuaggaauucuguaagacuuguggaugguagaauuagaauccaagaagauuucaaaagauuguagaaaauugacugauucaagaaauugugaaaaaauaaaugcaugucccacccaugcguuuaaaaauucaacuauauaaguaaaagaugagagagacacaguuuugaagcagcauaaguaagacagauuauaaucaauaaacccagcgugagucagcagugucacuugaguaacagaaaacagguacaugggaguuucuccuaguaugugugugcuauuuugaguaagaauggcauauuuggugauaauacccacagauuagaccuuccugggaauauugcauuuaauuuucgguguaagcauauuaaguggagagugucuuaagauaguaugggaaagagaagauguaaaaaaaaaaaaaguaugauauucaucuuaaaaucuagaaaauugucauguggaaguggggcuaguucuauucuauaugaucccaagaaguaaaccaagaccaaggaguggaagcugugggagggaaaaguuuguuaacucucauuguuaacugaaaucuaauaguccaaaguuaugggcagccucaggagauaaugauccccuaucagcaaaugguuuuagacauggcugguggaccauuuaguagaaaugugaaaauaagucuaaacaucacuugggaguucagauagauuuucagacucauuuuuuguuuuuucuuuuuuaucaacagaaucuauuucaaauaaaucuuacgcaauccgauacgcaaacacacauacagaaguaaaacugcuccuacuguugugagcaccugccuuuauucuuccccaaccauccccaacauuuguccaggccauccugggauuaccuccauggauauagagaacagcauaaaaaccauuggcaucacacaagugccucuuuaaagcuguuucaaaguauauauauauacacaaaggguuguaugugagucugaaagugugauucagaaugcuuguuaaaacuguuuggagaaccuuauuuuccaucaaacaaaugauguuauuuaauacuuagaaaaguuaauaucucacgguuuuaaaauaugugaauuuaugggagguuucuuuucuuuuuuuuguuuuuuuuuuuuuuuuugacagaaccuuacucugucacccaggcuggagugcaguggugcaaucucagcucacugcaaccuccaccuccuguguucaagcgauucuugugccucagccugccaagcagcugggauuacaagcaugugccaccauguguggcuaauuuuuucuauuuuuaguagagacaggguuucaccauguuggccaggcuggucucaaacuccuggccucaagugacccacccaccucagccucccaaagugcuaggauuacaggcaugagccacggcaaccggccagugaauuuauguuuuguuuuaaacaauuuauuuggaaauauuaauacuuugaaagaaaacuuucaugaauaagaguaguauuuccauauucccuuuaccaagauuuacuugucauuaauauuuugccccauuggcuuuaucauuagcccuuccauuuuaaauauauacauacaauauguuuucuccugaguacugagaacagggugcauauuuguuaagacaaggauauuauguuauauaaccagaguaguuagcaauuucaguaaauuuaucaacacuuaaucuaccauccauauuccacuuuugccaguugauucaauaauguccuuuauaacauuuucaauagaacuauuuuaagaaacaaaauuuaaacaauaugggaacauuugucaaggccagcauccaaaaucauuaaaauuaaaugaaaaaaaucaaagcagcuuuuuuuguaucaugaacaccuaacucaguaaguuacauaaacucagaugcuauuuuuuggagauacugucuagaaaaugcuuuuuuuucuuugaacagaauucagaauguuuaaagaauggaguaaaauacaacugaguuuuaauuuuuaacauuaaauaaauguugauauauggccacuugaggaauauguuauagauaauuaaguggaaagagaaacgacuucaggucaugcuuuuuaagaaaaauauauuugaauucuacauuuauggauaauucaguuaguauauaguaugugacaguugaauuugugcuguauacauugucauugacuuaaaaauuaacuuuuacucuaauguguaguaugccauuuuuauuuuucaaauaugaauaagaauaucauuauauaaauaauauaaauauugcuaauauaugaaaaaaauaaacacucauugucuuucauccuaguacaaggauuaauaccaucguaggauauuuucauccuggcuuuuuuuucaaaguuauaauccuaauaggcauguaaguuaguauacuacuucugcuuaauguuaucucauugcguauuuauaguugucuguuacuguagucaucauaaucuucagcuaaaguuuaugauagauucacuggagcgauguaacaucuccuuaaaauucccugugauugaauaguuuggucauuuccaauuuuuuuauguacaaacaaaauggauuucccuaaguggauuuuccaacaaaggacccacagcuggaguauauaaaagacuuguacaaaucaguaauaaaaagacagaaccuaauacaaaaaaauagcaauguuggcaagcagcuuaauuagguacuuugcaaaacggcuugccaaguggcaaauaggaauaugaaaagaugcccaacagcacauuacucaaugauaauuaaaugagaauuaaaacaacaaaaugaaauaugacugcauacccacuauaauugcaaacauuaaaaaacaagaaaaugccaauuaucguaaguauguagugaaacaggauuuauuuuauacugcaggaaugauguaaaugggaugccacuauucuagaaaccguuugguuuuuuguacguaguugaacguauggacaugaacuguacuccagccauuccauuucuauuuauauacccauuagaaauguaugaccaugcauacuaaaugacauguacaagaauuuuuauggcagcauuauuuauaauagccaccaaaccagaaaucaccuaaguguuccaucaauaguauucaugcaacaaaauacuauauagcaaugaaauugauccaacuauacccauauguagcaacauggauaaauaagguuuuuuuuguacccaauugauaguuauuuuaacagcugguuaugugaguguggauaaauuuguacugcaguuaaaauuacuuuuuuuuugguaaauacauuucuaucuucuaucacugaugcuuuucaaauuuguaauaauaggauuuacuuaaauccauuguuucaagaaugaaaaaggcaguagaagaugauguuuuuauuccucuguauccaaagagguaagcgcuguuaauuucuagauuguuggaaauagcugaucauagaauacagauuuguuuaagaaugcaaugcaaaagaaacuacaguguuuuauuuuuuguuuuguuuuuuguguuucuuuuuuuuuuuucuuuugagacugagucucacucugucgcccaggcuggagugcaguggcgcgaucucggcucacugcaagcuccgccucccagguucacgccauucuccugccucagccucccauggcugggacuacaggcgcccgccaccacgcccggcuaauuuuuuguauauuuaguagagaugggguuucaccauguuagccaggauggucucgaucuccugaccuugugauccgcccgccuuggccucccaaagugcugggauuacaggcgugagccaccgcgcccggccaacuauaguguuuucaaaacauguguacacauacucuaugaggaugcaaauugagauuucaacaaauauuucucagugacuuacauaaagccgugcuuuaucuuggcgcuuagaugaauuuuguuugguugguuuugguuuugguuuuacauauauccuaggaacauagcaggugauauagagugguaaagagcacacguccacuguuaguagguauuuuuaugcacuuguuuucucaucuauaaaauaaggauaaaauuagugccuaccucacaggauauuagggagaugaagagaaugcucagaacacaacagggccuagcacagaggaagcacaaugcugaggaacgagaaacugcaccuguaaauucugcagucacuuuaaauuauaaaacgaguauuugauguaugaucauaacuuugcuaagaagccaucaguuauaaugaugcaugaacuguagcaauccagugaguagugacaggauggaggagcuuuauggagggggaagaaaggaaccucaaagcuuucugauucauuuugaaucaugagaugucuacauguaaaaauucugccuugguaaacuuuguuuauaauguuuuagauaaugcauucacaugguucagauguaugaaugugauauauuaguuauuuguuuauaaauauauauuuuauaaacauauuuauaaauauauaaauauauauuuuauaaacauauuuauaaauauauaaauauauauuuuauaaacauauuuauaaauauauaaauauauauuuuauaaacauauuuauaaauauauaaauauauauuuuauaaacauauuuauaaauauauaaauauauauuuuauaaauaaauauauauuuuauuuauaaaauaaaauaaacaaucucuauuuauauuccauuaaggcuuaguuugguugguuuaaaagaaagucugaucuuaaacucugguucugaaagacuaauaguucuuugcauuuucucuucucuuucguuuguuucuaauuagugcuguagaaaacaaaacaucaccucauucaaaguuccaagaaagacaguucuggucaggccuaaaggugagcaaaaacugcaaaaaugaaaaggcaauuuuuguaaaaauccuguuuacuauagaacaaagaacaacaaacuucuucuauaagaauuagauaguauuuuaggcuuuguggucacauggucucugucgaauuacucaacucugccgcuguagcacaaaaacagucauaguacauaaacaaaugaacauggcuguuugaauaaaacuuaugaacacugaaauuugaaugucauauaauuuccucaugguacaaaauauuuuguuuaaagacaguuuuaaaacguccuugaaaaguguuaaaaccauucuuagcucacggacccuauaaaaacaggcaacaggauggauuuaacccacaagcuauauaguuggcuaaccccuggccuuaaaauuauugcuaagucaguggcaguagggaugagaaggagaagaagguucaaacaauguuugggaggaagcauugaaaggagucgauaacugaucaagggaagauaagaucuauuuuguacauaaugaagauauaugugggacaaauagagauacagaggucuaggaggugguuggauacauaagucugaauuucaggagacagaucugagcuagagauuugggaguccacuaccuguagguaauauuuggagccauggucaugaauggcaagcugcguaaggagacuggaugaagcaugagaaguaggccaaggacagaaccucgggaaauacuaacagaagaggagaacauggaggcuucagggaaucuguagaaucaauuaugagccuuaggaugaucacaagagaauggccucaaggaagcuaaaugaaagauuuucaagaaugaagaaaagaguguuaaaugccaccaaagaguauuaagagaaagacugaaacacuguuuauuggauuugacaauuagaaggauauaggugaccucaccaagaguaguuuuaauagugugaauuaauauuugucaugugguugaaucagggaaaaggcuuucugggaagagggaacaacaucaacaaugagauaaaaugugaaaaagcauuacauuuuaguaaaacagcauguaguucagcacucagaguaaugaauauaguacugcaaaaaaagaaacaccuuaaaauucacagaaagaucugaauuuaguagagggaaaggacaaccaauauuuuauuagaauuuauuaugguuacuuaauccaaguuaucuucaaacucaaaggugauuauaaaucuuuauguaucagaggaaugaagcucucagcguugauugccuucucaaggucacauguugguaauggcggcccuaguuuugacaguaguucuuuaugaaucacgugguccuguggucuuauacuugauggcccccggcuuugagagaaaauggauugggaaggaagauuauugaucuggaaaggcucuagugaaguuauuugagauagauuuggggaugguuauccuagaaaaugaaaauaagaugagcaaauacauggaguuuggaaagaaucaaguauuuauucagagauauuguauucuaaaauugacaguuccaacagggcuaauuguagugagaauuuuaguuugaccaacucuucauguuuguuagagacuauuacaguuucucuuuggagaaaagguacauauuuacuugauauuuuauuuuagcucuuccgcaauauucuucuuuggaauggacuccuuacagaugacaccuugcaagaacuaggacuagggaagcugcuaaaucguuaccuuauuauagcacuucucaaugccacaccugggccagaugugguuaaaaagugcaaccagguaaguugugaaggaagacugauucuaauuuuaucauuucuaaaaaauuuagcuauuaaaaucuauuauuuagcaaaauaauuaaaugugugguacucauauauagacaaaugggccaggcacaguggcucaugccuguaaucccagcacuuugggaggcugaggcaggcggauugcgugaggucaggaguuugagaccagccucaccaacauggugaaacuccgucucuacuaaagauacaaaaauuagccaggugcgguggcuaacaccuguaaucccagcuacuuggguggcugaggcagaagaaucgccugaacccaggaggcagacguugcagugagccgccauugcacuccagccugggugacaagagcaaaacuccaucucaaaaaaaaaaauugacaaaugaauuuaacaaagcuaaaaugcagagccgcucuucuguauuuaagaaagaguauacugguuugaaauauccccaguagggaaaggaaaaauuacuuaauaaaugaugcuagauggcuggcuguuuacaaaaagaauguuaaguccucaccucucacuauacaccaaaaaaauuucagguaaaauuuuaaaaaauguaaaaaugaaacuauaaaauauacuaagaugguaaaugacuauauuugagagugagggaguuccuucuaaacuuaaaggcaaaagaagaaauuaugagaaaaaguaauaaauuugaaaaaauauaaaacuuuaguggaucaaaaagguauugggauuaauugauuauuauuaaaacuggggaauguguucauugggcucauuauacuauucuuucuacugcuguuuguguuugaaauuuuguauaauagaaaguuagaaaaguuaagaaucuaggaaauaaaaaguuguuaacauguaacaaguguuaauauucacauuaaauaaaaaagcucuuuacaauuuaguaaauaauucaaauguucugacuaaaaauggccaaaacacgugcaacaguaaagucaccuaaaaggauauguaaaacuaaccuuaaaauaugugaaaauaauuaauaguacuaauaaucagagaaauggaaauuauuuauaggaaggauauuuacuugaccaguuguguuggcaaacauuuuuuggcguuguuauuuuacuuacgauuuccaguguuauaaacacaggaaaacaacaguuccaucauugcaggggcaccauucacuguaugcagugcagugguucuggaaaacagucuccugcacugggggaaggagggauacagcucuuuuggagaguauuuuggcaugauggauacaaaacuuuuaaagcuuauauucuuugacuuagccaaaguaaguuaagucaaaaauuagagaugcacauauagauuuuaaguacaaagaauauuguuauagcauuauuuauaauagaaaauaguuggaaacaccuacauaucccuaaaaacaugauggucuucucauaagauaaaaaugugaaaggaaaauaaaucucagaaccugucucagauacuuuuggguucacaaaaguuauguuuuugaagaauuuuuaagaauaugggaaaauaauuauuuuauaauuaaaaacacauacacacuaaacuguucccagauagaauaggguccaucugcuuguucuugcagcccaauaacaagaugcagacagacugggaaagaaaggagcuuauuuuugcaaccaguuacagggaaaagguuguagcaacucaccagaccaacugaaaguuacaauuugguuuuuuguuuuguuuuguuuuguuuuguuuuguuuucuuuagcacuuauaugcauucuaagcuccaugcuacaugggagagugcaucuacaagugagaguguuucauucagucuguacaaucuaacuaccgucuggggucuguaaagcuuucucuaaagucuuggaaaguuuuuuaaucuuaagugggcccugguacaaagaguauguguaagaaugcuuucauuauuugaucagacuuuaggaucugggaaaacucaggcagggucuuaauggguuuguuuucgcauuccaguucuuguacucaggcaccaguuucucuagcucuuuaauguuuaacuuacacauucaucaaaauuauagaaaaggguuaguggaaauugauucaucugguugcuaauggaaaccuagucugccauaaaacuauauaucaauuaguagccaaccaugauuguucuggcuauaguuuuuauaucauaguuuuaagcauuauauauuaaaaauuuaaaucaucauccauguaauguuguucagguuuaguuuaguccccuuugaccauagggucuauuaugaaguggagaagaggaaauauauuuacacagcauucuuuccacagcauaugguuagaaaaccaggccaagaaaaucgacuuuuagugcugggaucauuaacgcaaaagcuacaugguuaaaugagaauuuuacugagacuuguaauacaaaacaaggggaaaacaagugcaaaugacauucaauaguaaagggugguuuuaaaacuuuuaaaaagaguuuacauaacaaaacuuguaggaucuucugccuuaggcagucagugugucaguauuuuuccugaauaguugaaacaggugauuaaggaguagaauucuuuuuccucaaccauguuuuaaaugcugaccaaucuuagaaagagcgcauuccagaacguuuauuuaauauacuguauaauauauagggugcauuuuaauuuuuuccccaacucucugcuuucuauauugaucuugauguuaccaaauguagcauaaucuguaugauuaucuaggaauuuccuugaauagugugauauugugacaggccagguuuccauuagcaaacagaacgaucaguuuccaagaacccguuacuauaacguuaaugaaaguguaagcuaaacauuaaaaaacuggagaaacuggugccugaguacaaaacuggaaugcaaaaaccaacccauuaagaaccugccuggguuuucucagccccugaaaucugauggaauaauaaaagcauucuuacacauacaccucauucugucuuaagauuaagaaacuuuccaagacucucgagaaagcuuuccagacccuagucccuagcuaaagaugagauagagauugaaugcaacacucccacuugcaguuacaaucccacacguagcacggagcuuuaaauauauacaagcacuagaaaaaagcuuagaacuuugaguuggucuggugaguuacucugaccucccuucuuucccaauugucugcaucucguuuucggaccucaagagcaggcagccauacuuuguucucuccgggaacaauaucaaguuuuuuuccuuucuccccuuuucccucccuucuuuacccuuguuucugcuaugaggaaguuuuuuuuuuuuuuacuuuuuaaauuuuuucuaacauuuuucuguuuuuaccaaaacuuuucucaaaaucuuguauuacucuuaggaugacaaugauaaaauguaauuuccauuuccaaaagaaaaauugaaugcaccuacauugauucauucugcugcuuuacaauuaaggcaauguauuacacugauagaagauuaaaaacauaauuaauuuaucuuucauucuuuguaucuuagaaucacccauuugguuccuuaacuccauauagaucauaugcuaggccauccaauuucuuuauaaaauaauagugaauguauguauuuuagaguuguauugaccaaauauuuugugucuagacauuuuugguuuuuaguuguaaauuauguuuuguacagauuuaaugacucacaaauacaagaauauagaaagaauuacuaguacuaccagggaguguucauagagaguaguguauuuuaaguucuuagcauuaaagaaugaauuccaaaauauauguagccuuggacacaaagggaaaucuuuagaaauuuuuauuuaaccauaaacuauaaaauggggagaaugauacucagcuuacaguaucacuaugagauuauauuagcaagauuucuuagauaacugucauuguaaaccagccauguguuuugauuaacagguagcagcaugucuaccagaaaaaugguuugaaaauucugccaugaggacaucuauuccacagcuagaaaacuucauucaguuuuuauugcagucugcacauaaauuaucuagaagugaauucagguaaugcauauuuuauuuucacuucuauaaagagaguucauggauucuguaugcucucaacaacuuuuagaaagauuuguauuuuuacuguacuuuuaaaaauuuguuaaaacuuuguagaguuaguagauauuuuuaugguuaccuuugggauggcuuaugcauauccauauuuuaaaauguaaaucucccccaaauuaagcaaauucaaaaaacuauagcacaggggaauauagaauuaaaacuauaaaucaaaaacauuuuauuaagcacuuuuuaaauguguuuuuaauuuuccuguccauuuuuagagacucaacaguuguuaaguacaggucuccagcuugguauuuauccagcaguagcuagcucucuguucugaauguuucguucacagcaccagcuguuugggggcuuaaauacagugguauuccuguuaacucccucuccaaaaaaaauuuuuaagcccagauuuggccgggcaugguggcucacgccuguaauguuagcacuuugggaggcugaggcaggaggaucacuugagcccaggaguuugagaacagccugggaaacauagcaagacccugucucuagaacaaaaaauuuaaaaauuagcuaggcaugguggcaugcgccugagucccagcuacugaggaugcagaggugggaagauugcuugagccugagagguugaggcugcagugagcuaugauugugccacuguacuccagucugaccagcagagccaagaccaagucccuuuaaaaaaaaaaaaaaucagauuuguauuauuugcuaaugucaugaugugugaauauacucccaccauugcuuccaccacaaugucucauacaagcuaauagcaacgcagcacuacugaaauuucugauagacuuacuauaugcuuuucuaccuuuuacaguaauucacauugaaauuugccagaauacauccacuaaugaucuguauuugaacuuuauaauuaaguggagauggcagcaucucucuguguuuuaugcuacuuuagauauuggcuuaagguaaagcuuuuguuuuagauuaacaacugaugaucagguucugaauugaccgcuguucccucauacauugcauuuuuaaagggagaaauuuguuuuguuuuucagggaugaagucgaagaaauaauucuuauuuuggugaaaauaaaagcuuugaaucaagcagaauccuucauaggagagcaucaccuagaccaucuuaaaucacuaauuaaagaagauugaauaaacuuuauuggaaaaugcuaaaauuuuaauauaguuacacucaguuccuuuguuugagaagaagcuggugccucucucuucuuuauucccuguaauagaagguaggauuugaaaaaaagcaggacuccaccucuguauucccccgugcuuuaccuucuggcaucaugaaaagcugccaugauucugugguguucuaaggaauuaaaugcacuggagcuuuaagagcucaacguguuucccuuugauucuuuuggcuggucuuucaauuuucuuaagaggggaacuggagaaaccuugcuaaagguuuuagcuuaagugagcaugcuacuaagucuucuguccugaaccacaauaauaucuuuuaguucucuuuaacuaccuuuauuuaaaaauaagucaauaugaaaaucucaguuggagugaauuauuugcuaaguauuaaaugauuaaggcaugugccgauugucaaauuauccuucagaaaucuguaccaauuuaauguaccaacauaagcauaagugagugccaaugaaucccuaccagcaguaguuauuauccuuuuuaaaaaugcauugaaaauuugaaagguaaaaaucuuauuuuaauagcguauuuuguguuggcuauuagagaguaaacauauugguuuuggccauuuguaauuauuucugaaauauccaucuuuuucuuauggacuuuaagaccuuuauauuuuuaaagauauugauuuuuugcccaugcuuguggcagaaguuuuccuuauuugccauuuuucuuuuauuuuuuuuuuaauuguauuuuuugagacagggucuggcucugucacccaggcuggagaguaguggcacaaucucggcucacugcaaccucugccuucugggcucaagcaauccucccacuucaaccucccaaguagcugggacuauaggcaugcgccaccaugcccagcugauuuuuguaauuuuuuguagagaugggguuucgugacauugcccaggcuggucucgaacucuugagcucaagcagucuacccaccuugaccucccaaagugcugggauuacaggcuugagcaaccauguuuggccuuucuuuuaaauuuguugauguuuuuugaagcauuaagucauuacuuauuagcaaguuacuauuuuguuuuuuugucauuggugguaggacuaagaaggaaacagauauuuuaaauacucacaacaugugauucauuuucugauaaaauauuugucuaauaaaacagaggcaagauaauuuaaucaaaagaaauuaagaaaauuuuccaaaaauguuaguuuacuaguaauuuuucuaagucuacuuauuaaauaacuuaagggaaacuguaaauauauuuugcaaauuguuguucaaaagauaauuggaaaaaauugaauauauuguaggauuugaauauacagccuacuuuuaugucaccucuaccuucaaaacuacauauaauuuauuuuaggaguuggauuuguuaugucuguugcagugaggacuugugauucacugguaugaagaauuuuuugauguuuauauuaguaacaaaauuauacaaggauagaaucucaucuagaaaaugcaaacuauuguugaaaagcaguuagcauuuccacacaaccgcuguccccagagauaacugcuguuuucauuuuaauguuauccuuuuagaccuuuucucuauuuacaaaaauguuacguguuucuauguguacauaguuuuggguuuuuuuuuuuuuuuuacguaaguggcagacacuuuauugcacaugaaauuuguaauuuuuuucuauuuaaguacacauuuggaaauuauccucugacuuuuggauuuuuaacuaaauauguuggacguguuccuuuauauauuuaaguucagcacagaaacuuuccuaccuuuuuguggaagauaaaauauuaaaacugcuuucaaaacuacaa

SEQ ID NO: 191635 - RNA, 15426 nt, Homo sapiens
uguauaaaaaagauaauaggguuuauuccuggaaaguaagguuguuuuaacauuagucaaccaguguaaucacucacgaacagaauaaaggagaaaauccacaucucgaugacugcagaaccaaucaucucaauuauuaccgaaaaaguguuugacaaaauucagcacccccucauacuacaaaaaccuuucggcaaaguaggaauauaaauuccucaaucugauaaaaggcaucugugagaaaaaucuauaccuaacaucauauauaauggugaaauauuaaagcaaggaugucugcucucaccauuucuguucaacauuguucuagaagacauagucauacaaucagucaagauaaaagaaggcauaaacauugaaacacaagaguuaagauagucauuaguuggccagacaucccaacacuuugugagacugagcugggaggaucguuugaggccaggaguucaagaucagccuuggcaacaagcuuguuguaaacauuaagagaaaugaaaugucuuguacagcaucggcacauaggagccuucuaaugaggagccuaucccugaaaaagugaaagauauaucauuuuucuaauccuucgaauaggauaaacuaaguuuuugaucucucugaguuauucaaaaggcucagggauuuauuucccaucacaacacuacaagguaguuuagaaaauauacauacuugagcaacaugguggaguaggcacauugaaaaacaagcaggggcuggguguggugguucacgcguguaauugcagcacuuugggaagcugaaaugagaggauggcuugaggccagaaguucaagaccagccuggucaguauagugagaccccaaucccuaaaaaauauauauauauuuuuuaaagcaggaacaggcauagccaauuuuaucagaacucugaaaaacaguaaaaaguuuauagcaaugaagcaaaugcugagucaagaacaggcaacuuuaaaauggcaagaaagcuuugugacauuucugcuugcccuucccccacaagcucccugguguugcagcagucuugaaaucagcaacugcauucugucuuggacccugauccccauuucuagaggaagcugagcagaacuuacaaauucuuguuuaagucucugguagccugucuggggcuacuuaaaggauugacagagcacucaucguaagcaguaggcaaugcuugaaaaaaguguaaggugaacuaacaaccgcaaacaccugggucgaaagacuauggucaagauauccaaaaaaccaucuauguucugugagaaaaagcugcaaaggaguuucuuugggaaauuagaauauucaacagcacauacagggagauuuagaaaacuacgugcauacacagcaagaagcaugcucagacaagaucugcaaagacccuacgcuuuugggccugauuguuaggcucaguacaagccuggcuaaguauuaauggaaaagcccagcacagaaccaaucuacaaagacuggaaagacugggagagagauuuuucugcuaguuuuaacuccuuucaaggaaaucuaugucaaacuauuaaacacaaacuaaggaacagagacuucagugaugacacacagaaggaauacagucuuugcaaaaauaguuuggaaaugacugcacauguagcaauagacugcuacaaucuucaauaauaaaaauaaaacuaacucucaggaaggggggaauaucugauuuucagggccaccacguuaugauguucaaacauacaguuuucaacaacaaaaagacagcauacaaagacacaggaaaguauggcucauugaaaacaaaauaaugaaaaccaucccugaagaaacacagacauuggacuuacuaugcaaagacuuuaaacaauugucuuaaauaagcccaaagagcuaaaggaaaacauggacaaagaacuaaaggaagaaagagacauaugaacaaaaugagaauaucaauaaagacacagacguuauaaaaaggaaccaaagauaaaucuuggagcugaaaaguacaguaacugaaauaaauucacuagaggaguucaacaguugaucugaacagggagaagaaucaacaaacuugaaaaaaauaaaaagaagggcaacugcaauaaucaagucugaggaacaaaagagaacacagccuaagaaacuggugagacagcaucaaacagaccaacauauacauuaagaauauuucagaaggaaaagaaagaagcagugaaaaaaauugaagaaauaauagccaaauauguccaaaauuugauaaaagacauaaaucuaugacuccaagaaacucaacaaacucuaagugggauaaacucagagacccacacugagccgcguuauaaucaaacugucaaaagacaaaagcugagcaaauccgaaaagcaauaagacagaacugacucaucaagaaugaggaauccucaaauuuuauaacaucuaauaucucaugagaaaccaugaagucagaagguagugggaugacauauuuaaagugcugaaagaaaaauacuguuaccaaaaauucauguaucuggcaaaauuauccaucaaaaauaagggagaaaucaagacauucucagauaaaacaaaagcugagggaguuuauuacaauuagacuugcccugcaagaaaugcauaagggaauccuuugggccgaaauggaagggcacuagacaguaacucaaaucuauauaaugaaauaaggauccaaaauaagauaaauauauugacaaauauaaaagucaguauuacuaucauacuguuuucuaacuccacuuuuuauuuccuaaaugauuuaaaagacaaacucauacaaauaacuauaaauuauuuauuaggcaauuugugccaucaauaacauaaggggggcaggggcagagcuuuacaggaguagagauuuuguaugcuauugaagguaaauugguaucaguuuaaauuagauuguuuuaaguguaggauguuaacuauaauccccauagcaaccacaaauaaaacaucuaacaaauauacacaaaggggaguggaaagagaaucagacuaguucacuacaaaaaaacagaaaagaaggccauaaagaggaaaugaggggccaaaaaaguauaugacauauagaagaaguguuaaaugguagaagaaaguccuuccuuaauuacuuuaaaugcaaauggauuaaauuuuccaaucaaaaggcagaaauuggcagaauggacagaaaaaacaaaacaaaacaagauagugauaugcugucuacaagagacuauagcuccaaagacacaaauacauggaacacauagaaaaagauacucugugcaaaaauuuuuuuaaaaaaagagaaccuuaacacauuguaaaccaccuugaccuaagagacauauagaaaacuacagucaacaauagcaugauaaauauuuugcucaaguguaugaggaacauucuccaggacagaccaucuaucaggccacacaccaauucucaaaaacauuaaaaucauacuaaguaucuucucuaaucacaauggaaugaacuuggaaaucaauaacaaaaaaacagugggaaauucauaaacauguagaaauuaacacacucaaccaggggaucgaagaagaaaucacaagagaaauaaaacaugacauuaucuagcaauucuacucaagauguauacccaaaagaacuuagaaacaggcaaucaaauacauacuuguuaugucaauguuuacugcagcauuauucacaauagccaaaagguagacauaucccaguguucaucagaagauggaugaacaaaauguauauacauacaauggaauauuauuuagucauaaaaacaaaugaaauucugacacaugccacaacauggaugaaucuuaaggacugcuugaggccaggaacucaagaccagcaugggaaacauagcaagaccacaucucuacaaaaaacaaaaucagccaggcgcaguuaaugugugccuauagucuuagcuacucaaggaggauugcuugagcccaggauuuugaggcugcaaugagcuaugaucacaccacugcacuccuaccugagugauagaaugagaccuugucucaaagauaaaaagaaagauuugagguuaccugggguugggagagauacaggaaugagguuauugcucaacaguuacagaguuucaguuuggggugaugagaaaauuuuggaaauaguaguaauaauuucacaacauugugauguaauuaaugccucugacuuguaaauuuaaaauguuuacaauggcaaauuauguuuuauauauauauccuaccacaauaaaaaaaaaaagcuuuagauuaugcacauuuaauuuuauuucugggggaagauuugcuuuacuucuggggaaaaauucacaagaauuuuaaagauauuccuacagaguaaaaagcaugauuguuuacauguuuuugagcaccuguacuuacaagcugaucauacauuugcagagcuuuagguccuaaaauauacugucccaucuaccauucuaccaagauugaaguguguuuaucaagacagaaaaagaacagguuuuaauagcuaucuucuaacaagauaaagagaagaaaaauauaagauauaggcucuuguuaaccuuuuauuuugagagguucuuuugagagguuaucucagcaaauaaucuaaacaagugaaggauaggauaucuauuacuuguugacaguaguuagaugacuauauaaucauuagugaaaaagaucaaggaaguagcugaaagcugcugucugacagaccccuagacaaucuccuuccuggacagaccccuccaggaaggagauuggaagccucuauucuagggaaucugacaaaaccaaaauauucauguggaggaggggacucccaaaaaagcccauucagauaauccuaaagacagccccuucccacaacccaaaggcuuuccaagcuuuuuagucccucuuucaaccauaagaagacagccaaagauuaucagauauccuggaaaagucugaaauauagacaacaaaaaauaaauacagaaagaaauuuggaggaaauagaugcgcaaacaauuuuaaaugaaaaaaaaauacacuauauugaauaccccuuaucugugaacaaauccauagauaaaggcuuuuugguuguaagaaaaggaacuucuacaaaucaagaaggggucuuaagauuuuaaaauacaauagcaaagaguuggaagauugagcuaaagagcuaaaaaacagagacuggggucaagggagggagguaagaaaauagauacccagugcuggauauccaacauccaaauaauaguugggagaacaaagcagcagagaauaaaucaucaaccaaugcuaaguguuucccagaacugacagaaaugaguuacuaucuggaaggguucaccuaaaacccaauacaauggauaaauauagacccacaccaagacacaucaucaugaaauuuaugauggggaaaucaaaauggcauuggauuucucaauacaacaauagaaacaaagaaaauggagcaacaauauuuuuaaaguccugaaggaaaauuaccuccuaccuaaacguauaaaguaucaaucaaacaugagacaugcaaggucucaaaaauuuuaccuccacacaaacuuccucuagaagcuaccaaaggaugugcugcagcaaaacaaguuaguacucaauaaaauggaaaacauggaauccagaaaacagcugagcgcaggaaagaaguuagucccaagacagcuaggaaccagagggcagaucugaagguaacucaauggauaggcugagaguugccuucaagauuuaggauaguacuguauuuuuuaaccugaggaacaguauauccaggugaguauggaccaaauuacauguuuuucuuuagcaugugugcuuauaccccagcuuuccaauccaugcugcauggaucagcaacaacacucauaucauaccaaagguauuguuuuaaccuaauccuaagauacagaguuugauucaucaugcugugagcaucaaaaaacaguuuacuuccucuaaccacauuucugcaacauccagcuacccaguauaauccugccagauaccuuguggugagccuucuguuuagcagaacucacucauaaccuuagccaugaauuugcucaaaauuggccucuguaaacucucagaggaagcugaagccagacuaugacccaaagacuguaacguuucccuugaagccuucaugcaauaauaguaauacugccccuuuauacuugcuaacagguuuuuuuuuucagguuuuucaaaauuaaauauauuguugaagaauauauguguuggcaguaaacuaaaagaaaugcaagggaauaauuaacaagucaagaugauauuuacauuuaaaaaggagagagauacaauugcagauuuacuggagucuucugagaucuuauuaaauguuuuauuucuuaacauuccuacauauuaauaaauguucuauuucuuaaccugauaguggguacaugaauguuuauuauucuguaaaucauauugugcuuaugaauuguuucacaauuaaaaaaaaaauucaucccaccuauucccuuugcucagguuccaugcucauuaaagaccauucuggugaugcucugacuucuauuguagcuuugccuccaauaagcaaauggacauugguccauuuggcauguguaauucucuuuuuagaguaauaaacugguguacaaguuuuauuuuagaaaaaaaguauuaauaaaacaaugaaugcuuaguucacuuaauuacuauguucuuauaaaugaaauuaaauuggucucaaaauauauccucuuagagccaauguaucuucugcaacuaaccaaauucauucucagaaucaagaccuuuucgacgcuucaauuuccuuccauauugcagcuucaauuuuugaaguaucauauucccucaucauaucaaauucaagccauggcugauuccacuucugagcuucuuucauuugcuguucaguuaaacaaagaucaaaucugauuccuuuaauauuaaaauuuggacguucccagcguuuagaccagggcuuaggcuucauuuuuacuuucagcuaaggaagauuaaaaaaaaaaaaaaaaaaaaagcaauaauuaggcugauaggcaugagcaaaaauucuucugaaguuuucauuaagaugauucuuucuuucuuauuuuauacuugaacuucuaguuucaaauguauaacccauaccucauuaacaggaacuuuuugguuaggcucuuguacuacuggcuucauauucacaucaaaagugcuauauucaggaagggcaucucguaaguauagcaagcuaucauccagccguuucucuaauuugaccaccugaaucuccuggacccgaggauuauaaaguucaaagcaaaucucgacaccuaaauagaacagaaaacauauucuuacaaucuaaguccacguuccuauacauguuucauacugcaguaaaagcauuucauaaaggaauuagcacaaaguuuugcauguagaaaaugugccguuaauuugaaauuuuuaagauaaagauuacugaaagaaauagaaauaagcuaaaauccauuuaaauauaaaguuagaaagucugaauuggaaugauagucuaaaaaagaaaaaaauggcuucuagaaauauguugagucacauaucucuucaauucucauaguaguaacuucagagaaagucugaauucuucccuaugucacguuuuuuaucucccaauuacuugaagaaaaaucaaucuuccauguuaagaguaauaagacuaaugguacaaaagaaguaaaauauuaaguuccaacuuugguuagaagcuccuuugauuaaggauuaguggauuaaagggauggagagaacuaguuuugccuuuugcccuuccaccuuucaccaugugagggcacagugcuuggcccuuccagagcacacagcaacaaggcaccaucuuggaugcagggaaggaggccucaccaaauacaaaaccugccagcaccuugaacuuagauuucccagccucccgaacugugagaaauaaauuucuguucuuucuaaauuacccagccuguagcauuuuguuacaacagcacgaacagaauaagccaccagaaauguaaaccagagagacugcacaaaugcaagcagaugauggugacauggaugagggugauagcaauguagagggaagaacaggcaaaauugugauauauuuuuuggagacugugccaagaaaacuugauugacugcaugugugaaaguaaguggguaggcagagugguaccauuuauggaaauagaaaagacugugaauggaacaccuugcaaggggaaauaaagaguucugcuuucaacuuaugcugguaagacauccaaauagaguguugaucagauaguugcagauaguugcaaaucuggaacuuaaaaagggucaguccuggaguuauaaauuuggaaguuaucauuauacagaugguauacaaagccaccgaacaagaaggaaacacuaaugcaggaagcagugauggggaagguugaggcagguuacaacagucagacauacuacagagaauggcaagagggagcuaauccuuuuugaguauucuguguccaguacuucaaauacaguaucucacaguugauuggcuagaaccauguagaguagaaacuauuacuaucuuaaugcuuaaagaaaaucaaaugacucacuccuaugcucauuuacuucuauuacaaggccucuccaaguauuugaccagauugaaggcacaaaucaauuaaguccugcugaauuccugcacgcacagcccacugucauuacagaauaagcaagacagcaacugcuuucacauuuucaauuucuuugaaaauaagaauacuuuguuguuggaacuucaugaagcacacaacuugauaaacguaauuguuccugccauuuuaauuaauaaucuugcuagaguuuuacuccuuguuccucuauuaggcauaguauauaaacacaauuuugccuuuuuaaaauuccucccaagucauauaagacagugauaauuuuguuuugugucauaacauaaaguaaaauguggguauucauuuuaggagcaaguaauucaugaagacauuaaagguuugucuuaaaguuuuacucauggguuauuugcuccuaaaacaaauauccccauacugcuuuauaguaauuuauuccccucuuugauguugccaugguuugcaaagucuacuucuaaugacuguuguuccaauaacauaagaagccuucaagagaaagaaguccaucaaccauauuuaaucauuaacuucaaaucucaauccauucuaaagccacaggcuccacaucuucccucagagucuccuuuuacuuucaaauuucagauuucuuaucccaggaugcagaaacaaaaaggaauccugagauaacauuuucuagacaaugaaaaugaugaaauaaaacuuaccuuguccuucgauaacauuccuaaggaugaaaguagcuccaaguccucuuccugaucucugaaugcaaauccccagaaacuggcugauuuuuccacuggcauaugggucagcuguaguaacacgaagaauacuuccuacaaauucaaaagagaagugaacuuuuuuuucagcacacccagcugagaaguaaacuuuauauaagaugcagaaacaaacaaauagcauuucuagauaacuuaacuuccuaaauguuuuaauguaggaauaaauacuucauaugagcauaacccagauauguaaaaaacaaucuucuuuugcuuuuuaagaaaacuaaccauccaaucacaaacuagccauccuaauuacuaauaauaaaaacauacagcucuuacugaccaacauagaacucuggaauguggaguacuuuucuccuuucuaacauaucuuuucuuucuauuugaaauuucagaggaucuguucuuccccuucgaggaaugaauucaggacucaagaaccuguaaaaaauacaaauaaauaauuaaaaguaaacucaaaaggcugcuagaagaaaaauuguugcuuuucaaagaaauuaaauaugauauugauguauuuuauucuucauugucuaaauaaaagucaaucuuauuucuaaaauuguuaaugcucaugaaaauagcuaacaauuccugaguacucaccugguauuuuguuaaaagcuuuaugaaacaucuauagcauaaauuaauccuucuagcaaccauguggguuuggugucaucuccuuuuuacagagcaagaaacugaagcuugaaaaagguaaauaacuaacccauugcuacauuagcuauaaaucugucaaaucaagauuuaaauguagguauguuggucagucuccaaagccuauaaccauuacuacaggccucacacugagcuauacaugcuauaauaaauuaugucagaaaagacaucaacauauaaaucacuaauuauaaauugacuuuuaaaaugaucuuccugaucagagaagauggcccuggagauggugcugaaggaccuggggcaucugcaggcuuguuggcuguguuugcuggucaagacuauagaccaguuugaauaugaagguucugacaacuguaacaccuaucuacagacgaagaguaacugagaugguauaugacugcacuagcucuuccuuugauggaaucauugcaaugaugaguccagaggacagcuaggucuccaaguggcagcgagucaguaacuuuaagccagguacauaugcggugucauucacuggucaccugccccaaggaaucguguaggagcugaaaagucgaggagagaccuacaaauccagagacacagcugcagcacaucgugucccugaaccauuuucucuuccuuggaugacaggugcgggugggagggauuuggguugguggauuaacagaucgaacugaagagaaaguaggaugcugauuuuccuauccauggcccagggaugcaccuugcccauggcaaggacucuaggucaaaugccaauaaauaugaaccucuagaaaguucuuaaggccaugauacauuccuugccucccucucccuuucucuuaggcacaguaagagcuuguuuaugcuguaagaaucuucccagaacagcagaggcccuucuacucccuacugacugucucugagccuucuguacugcagccuuucuagugugcuuccuugcuuccaaucagaaggugcuguccagaggcuagguaaucccaucagcuugguaguccuggggucucgugguuguaucuuucugcccucuagaccuggcacagcaguaucccuugaagaaauccugaggcuucauagugcucuucgcuccuugaccacguuuaauaauucuugcuuuucccccuccucgucucuucucuucuguuuaccgcucuuccuauaccuuaggccagucucacaucccugcauuucacauucuccuaacuggagacccuugggccuuaggcaacugcuggguccuagucugccuuguuugugccucuguaggagguaaguccuuccuuuucuccucuggccuaguaggggaccuuggguaaugucccauuuuggccaaggugagguauucguuuuagaauaaaaaauucaccauaaauucucauuuacuuaaauuuccacagaaauccuguuaguguccccguuuugauuucccuaaguugcugguucucccucuguaaaaagagaaugauuagacccugccuguuuaccucaggauuguugugauuguagaaaugaagcuaugugaaaauuguguaagucuuacaaaggugaaauccuuuugcuuaaaaaauaauaaucuucuuuuuuucuucuuuaacugauuuuaagcucauuaugaaauauuuaaucuacauaaaaaguauaaaugacaguacaaugaauauucaugucuuuaccacccaccucaagaaauaaauuaucaauauuguggaagccccuguguauuuaggauaguucauuacuauccuaaauuuggugauuauucccaugaauuucuuucucuuccucaauuuucuacuuugaaaauuuuaaagccuaccaaaaaauaguaauacaaugaacaccuguagaucuuucauccacuuuuaccaacugcuaaaauuuugcuauauuugcuuuauauacacauaucauuuuuuucugaaccauuugaaaaugucagccaggugugguagcuuacgucuguuaucccaacacuugggaggccgaggaggguagaucguuugagcccaggaguuccagaccagccuaggcaacauagugagaccucauucuacaacaaaaaaauuuuuaaaauagccaggcaugguggcgggcaccuguagucccagccacuugggagacugaguagggaggggcccaggaguaggaguugcagagccaagaucaugccacugcacuccagccuggaugacaaagcaaggcucugucucaaaaaaauggaacagcaaggcauuucaucccucaauaauuuagaaggcuuaugcuaagaauaaggacuugcuccuauauuaucacgauacccuucugacaccuauaaaagucagcauuaauuugauaacauaaucuaauacaaagguauccaaucaucuggcuucccugggacacacuggaggaauuaucuugagccacacauaaaagacaccaacaauagcugguaagcuuaaaaaaaaaaggcacaaaaaaaaucucauauguuuuaagaaaguuuacagauuuguguugggccacauuuaaagcuguccugggcuguggguuggacaagcuuggucuaauacagaguucauacucaaauguaugucauuauccugggaagguauuuuacaucuauucguugcccaauucaaaauacaaucaagcuucacacauauuuggucauuagucucucagacuaggacuuuuuuccaacuuuguauuuuuauaacauuaacuuuuuugaacagucaaggccuacuaucucaucucuggauucuggauuguuuccacaugccuagacuaagguuaaauaauuuuaguaagaauauuacagggagaugaugugaacaacuuauucugucacaucaggagacacauaauaucaacugguaccaauacugguaaaguuagguuugacuguuuggcaaaguuucagaaggccccccuuacauuucuuuuuacuuuucauaugcauguaugucugggcaacauauauuguuucguauaauuuuguuuuuguuuuuuucugagacagagucuugcucuaucgcccaggcuggagugcaguggcacgaucucggcucacugcaaccucggcauccuguguucaagcaauucuucugccucagccucucgaguaacugggauuauaggcacaugccaccacaccuggcuaauuuuuuuuuuuuuuuguacuuuuaguagaaauggggguuucgccauguuggccaggcuggucucgaacuccugacuucgugaucugcccuccucggccucccaaagugcugggauaacagucgugagccaccgcacccggccuauaguuuuaaaacuucauaaaaauagcauccuacuacauuaaugauucuaaagguuuuuuuuacacacagauuugugaaaaucuuccauguuuaaaagugagcucuaauucacucauuuuucacugcuauacaauauucugucauaugaauguauuugccuguucaccuacugauggauaucuaggcugccucuaaauuuuguuacaaaaaauacuguuacauucauucucgugcuugucuccuuguacauacacguuaggaguuuaaguugugugcuuucugagugagaagguauacacaacuuaaacuuaguaaauucugucaaauuguucucuagagcauauaauuuacauuccuauuuaagugaauucuauuaaaugccacuguuuaaaagagauauuccauuucuacccucaaaagcaaaguuuuaugaagaaauauuuucugaaucucuuaguucucuaacuccaaguuuacuucuauuuaaauccguggaauauuuuaaauguuaaaaaaagaaaagaaaaaaaaaagccaggcgugguaccaguaguuccagcuacucuggagccugaggcgggaggaucacuugagcccagaaauuugaggcugcagugagcuaaaaucaccacugcacuccagccugggagacugagagagacucugucuaaaaaaaauuuaaaaaauaaaaaaauuaaaaaucccagaaguaauccaaucaauaaucuacagcccuuucaaaaagccuauaaucauaucagguuuuuccucugaaaacuggcuuuuuaaaaagguugcuacauagcucucuuuucagaccuuaaguccuuuaaauuuacauguaccuccaagauuaccaccauucauauaaguuuuuauucacacuauuuugaugaguaaguuucagacacaauuuaguggccaguuuuacugugcuuugucugccaaaacuuccaaccuaaaccauagcaaauuuuuuaaguuggccaaucgauuccuauccaggguuaagggucuuuugagagaaaagaagagcucuuggacguaaacagguauaaacaggauauaccucagagaaaaacucugguacaggacaaauaccacagagaaaagaguuuaaaauauggggaaccccuacuugaaguucugacucaauaaaacugcaaagaaguucaaugcuggcuuggggagaagugagaaagaaagaacaguguggugcgcuggcucuugaauccuacacaccugcucgugcagggggaggugcagcccccaccuuagagccgggaccucgaacgcgaacgcgcucacgcgcgcaccgaccccaguugccggccuagcgccagggcagugccucaccugcguuccgguuccacggggcggugcuuguccacgaugaccgguuucggcggcgguuggaacgcaccgggcucggaaggcccagugcucugcugccggacaggccccgcguggaccccugcgggagcggacgacggaggucagaacucucgugccaacccugagaucccgcagagccccgcaaucucccccaacccggcgucccacgggggaccaacgcugggguugccucugaucuccagguucgccucccccauccugacccugggccccuaacgcgccccagcucgcaaguccggcuccacuuacugcaggcgauagaggccggcggggggagcagaguccuggcggcuuggaaacuccggccuaggcccauugcagcccagugccccgcugcaaugcaggccgccaugccagcuagcucacgucaagacuac

SEQ ID NO: 191636 - RNA, 15426 nt, Homo sapiens
guagucuugacgugagcuagcuggcauggcggccugcauugcagcggggcacugggcugcaaugggccuaggccggaguuuccaagccgccaggacucugcuccccccgccggccucuaucgccugcaguaaguggagccggacuugcgagcuggggcgcguuaggggcccagggucaggaugggggaggcgaaccuggagaucagaggcaaccccagcguuggucccccgugggacgccggguugggggagauugcggggcucugcgggaucucaggguuggcacgagaguucugaccuccgucguccgcucccgcagggguccacgcggggccuguccggcagcagagcacugggccuuccgagcccggugcguuccaaccgccgccgaaaccggucaucguggacaagcaccgccccguggaaccggaacgcaggugaggcacugcccuggcgcuaggccggcaacuggggucggugcgcgcgugagcgcguucgcguucgaggucccggcucuaaggugggggcugcaccucccccugcacgagcagguguguaggauucaagagccagcgcaccacacuguucuuucuuucucacuucuccccaagccagcauugaacuucuuugcaguuuuauugagucagaacuucaaguagggguuccccauauuuuaaacucuuuucucugugguauuuguccuguaccagaguuuuucucugagguauauccuguuuauaccuguuuacguccaagagcucuucuuuucucucaaaagacccuuaacccuggauaggaaucgauuggccaacuuaaaaaauuugcuaugguuuagguuggaaguuuuggcagacaaagcacaguaaaacuggccacuaaauugugucugaaacuuacucaucaaaauagugugaauaaaaacuuauaugaauggugguaaucuuggagguacauguaaauuuaaaggacuuaaggucugaaaagagagcuauguagcaaccuuuuuaaaaagccaguuuucagaggaaaaaccugauaugauuauaggcuuuuugaaagggcuguagauuauugauuggauuacuucugggauuuuuaauuuuuuuauuuuuuaaauuuuuuuuagacagagucucucucagucucccaggcuggagugcaguggugauuuuagcucacugcagccucaaauuucugggcucaagugauccucccgccucaggcuccagaguagcuggaacuacugguaccacgccuggcuuuuuuuuuucuuuucuuuuuuuaacauuuaaaauauuccacggauuuaaauagaaguaaacuuggaguuagagaacuaagagauucagaaaauauuucuucauaaaacuuugcuuuugaggguagaaauggaauaucucuuuuaaacaguggcauuuaauagaauucacuuaaauaggaauguaaauuauaugcucuagagaacaauuugacagaauuuacuaaguuuaaguuguguauaccuucucacucagaaagcacacaacuuaaacuccuaacguguauguacaaggagacaagcacgagaaugaauguaacaguauuuuuuguaacaaaauuuagaggcagccuagauauccaucaguaggugaacaggcaaauacauucauaugacagaauauuguauagcagugaaaaaugagugaauuagagcucacuuuuaaacauggaagauuuucacaaaucuguguguaaaaaaaaccuuuagaaucauuaauguaguaggaugcuauuuuuaugaaguuuuaaaacuauaggccgggugcgguggcucacgacuguuaucccagcacuuugggaggccgaggagggcagaucacgaagucaggaguucgagaccagccuggccaacauggcgaaacccccauuucuacuaaaaguacaaaaaaaaaaaaaaauuagccaggugugguggcaugugccuauaaucccaguuacucgagaggcugaggcagaagaauugcuugaacacaggaugccgagguugcagugagccgagaucgugccacugcacuccagccugggcgauagagcaagacucugucucagaaaaaaacaaaaacaaaauuauacgaaacaauauauguugcccagacauacaugcauaugaaaaguaaaaagaaauguaaggggggccuucugaaacuuugccaaacagucaaaccuaacuuuaccaguauugguaccaguugauauuaugugucuccugaugugacagaauaaguuguucacaucaucucccuguaauauucuuacuaaaauuauuuaaccuuagucuaggcauguggaaacaauccagaauccagagaugagauaguaggccuugacuguucaaaaaaguuaauguuauaaaaauacaaaguuggaaaaaaguccuagucugagagacuaaugaccaaauaugugugaagcuugauuguauuuugaauugggcaacgaauagauguaaaauaccuucccaggauaaugacauacauuugaguaugaacucuguauuagaccaagcuuguccaacccacagcccaggacagcuuuaaauguggcccaacacaaaucuguaaacuuucuuaaaacauaugagauuuuuuuugugccuuuuuuuuuuaagcuuaccagcuauuguuggugucuuuuauguguggcucaagauaauuccuccagugugucccagggaagccagaugauuggauaccuuuguauuagauuauguuaucaaauuaaugcugacuuuuauaggugucagaaggguaucgugauaauauaggagcaaguccuuauucuuagcauaagccuucuaaauuauugagggaugaaaugccuugcuguuccauuuuuuugagacagagccuugcuuugucauccaggcuggagugcaguggcaugaucuuggcucugcaacuccuacuccugggccccucccuacucagucucccaaguggcugggacuacaggugcccgccaccaugccuggcuauuuuaaaaauuuuuuuguuguagaaugaggucucacuauguugccuaggcuggucuggaacuccugggcucaaacgaucuacccuccucggccucccaaguguugggauaacagacguaagcuaccacaccuggcugacauuuucaaaugguucagaaaaaaaugauauguguauauaaagcaaauauagcaaaauuuuagcaguugguaaaaguggaugaaagaucuacagguguucauuguauuacuauuuuuugguaggcuuuaaaauuuucaaaguagaaaauugaggaagagaaagaaauucaugggaauaaucaccaaauuuaggauaguaaugaacuauccuaaauacacaggggcuuccacaauauugauaauuuauuucuugaggugggugguaaagacaugaauauucauuguacugucauuuauacuuuuuauguagauuaaauauuucauaaugagcuuaaaaucaguuaaagaagaaaaaaagaagauuauuauuuuuuaagcaaaaggauuucaccuuuguaagacuuacacaauuuucacauagcuucauuucuacaaucacaacaauccugagguaaacaggcagggucuaaucauucucuuuuuacagagggagaaccagcaacuuagggaaaucaaaacggggacacuaacaggauuucuguggaaauuuaaguaaaugagaauuuauggugaauuuuuuauucuaaaacgaauaccucaccuuggccaaaaugggacauuacccaagguccccuacuaggccagaggagaaaaggaaggacuuaccuccuacagaggcacaaacaaggcagacuaggacccagcaguugccuaaggcccaagggucuccaguuaggagaaugugaaaugcagggaugugagacuggccuaagguauaggaagagcgguaaacagaagagaagagacgaggagggggaaaagcaagaauuauuaaacguggucaaggagcgaagagcacuaugaagccucaggauuucuucaagggauacugcugugccaggucuagagggcagaaagauacaaccacgagaccccaggacuaccaagcugaugggauuaccuagccucuggacagcaccuucugauuggaagcaaggaagcacacuagaaaggcugcaguacagaaggcucagagacagucaguagggaguagaagggccucugcuguucugggaagauucuuacagcauaaacaagcucuuacugugccuaagagaaagggagagggaggcaaggaauguaucauggccuuaagaacuuucuagagguucauauuuauuggcauuugaccuagaguccuugccaugggcaaggugcaucccugggccauggauaggaaaaucagcauccuacuuucucuucaguucgaucuguuaauccaccaacccaaaucccucccacccgcaccugucauccaaggaagagaaaaugguucagggacacgaugugcugcagcugugucucuggauuuguaggucucuccucgacuuuucagcuccuacacgauuccuuggggcaggugaccagugaaugacaccgcauauguaccuggcuuaaaguuacugacucgcugccacuuggagaccuagcuguccucuggacucaucauugcaaugauuccaucaaaggaagagcuagugcagucauauaccaucucaguuacucuucgucuguagauagguguuacaguugucagaaccuucauauucaaacuggucuauagucuugaccagcaaacacagccaacaagccugcagaugccccagguccuucagcaccaucuccagggccaucuucucugaucaggaagaucauuuuaaaagucaauuuauaauuagugauuuauauguugaugucuuuucugacauaauuuauuauagcauguauagcucagugugaggccuguaguaaugguuauaggcuuuggagacugaccaacauaccuacauuuaaaucuugauuugacagauuuauagcuaauguagcaauggguuaguuauuuaccuuuuucaagcuucaguuucuugcucuguaaaaaggagaugacaccaaacccacaugguugcuagaaggauuaauuuaugcuauagauguuucauaaagcuuuuaacaaaauaccaggugaguacucaggaauuguuagcuauuuucaugagcauuaacaauuuuagaaauaagauugacuuuuauuuagacaaugaagaauaaaauacaucaauaucauauuuaauuucuuugaaaagcaacaauuuuucuucuagcagccuuuugaguuuacuuuuaauuauuuauuuguauuuuuuacagguucuugaguccugaauucauuccucgaaggggaagaacagauccucugaaauuucaaauagaaagaaaagauauguuagaaaggagaaaaguacuccacauuccagaguucuauguuggucaguaagagcuguauguuuuuauuauuaguaauuaggauggcuaguuugugauuggaugguuaguuuucuuaaaaagcaaaagaagauuguuuuuuacauaucuggguuaugcucauaugaaguauuuauuccuacauuaaaacauuuaggaaguuaaguuaucuagaaaugcuauuuguuuguuucugcaucuuauauaaaguuuacuucucagcugggugugcugaaaaaaaaguucacuucucuuuugaauuuguaggaaguauucuucguguuacuacagcugacccauaugccaguggaaaaaucagccaguuucuggggauuugcauucagagaucaggaagaggacuuggagcuacuuucauccuuaggaauguuaucgaaggacaagguaaguuuuauuucaucauuuucauugucuagaaaauguuaucucaggauuccuuuuuguuucugcauccugggauaagaaaucugaaauuugaaaguaaaaggagacucugagggaagauguggagccuguggcuuuagaauggauugagauuugaaguuaaugauuaaauaugguugauggacuucuuucucuugaaggcuucuuauguuauuggaacaacagucauuagaaguagacuuugcaaaccauggcaacaucaaagaggggaauaaauuacuauaaagcaguauggggauauuuguuuuaggagcaaauaacccaugaguaaaacuuuaagacaaaccuuuaaugucuucaugaauuacuugcuccuaaaaugaauacccacauuuuacuuuauguuaugacacaaaacaaaauuaucacugucuuauaugacuugggaggaauuuuaaaaaggcaaaauuguguuuauauacuaugccuaauagaggaacaaggaguaaaacucuagcaagauuauuaauuaaaauggcaggaacaauuacguuuaucaaguugugugcuucaugaaguuccaacaacaaaguauucuuauuuucaaagaaauugaaaaugugaaagcaguugcugucuugcuuauucuguaaugacagugggcugugcgugcaggaauucagcaggacuuaauugauuugugccuucaaucuggucaaauacuuggagaggccuuguaauagaaguaaaugagcauaggagugagucauuugauuuucuuuaagcauuaagauaguaauaguuucuacucuacaugguucuagccaaucaacugugagauacuguauuugaaguacuggacacagaauacucaaaaaggauuagcucccucuugccauucucuguaguaugucugacuguuguaaccugccucaaccuuccccaucacugcuuccugcauuaguguuuccuucuuguucgguggcuuuguauaccaucuguauaaugauaacuuccaaauuuauaacuccaggacugacccuuuuuaaguuccagauuugcaacuaucugcaacuaucugaucaacacucuauuuggaugucuuaccagcauaaguugaaagcagaacucuuuauuuccccuugcaagguguuccauucacagucuuuucuauuuccauaaaugguaccacucugccuacccacuuacuuucacacaugcagucaaucaaguuuucuuggcacagucuccaaaaaauauaucacaauuuugccuguucuucccucuacauugcuaucacccucauccaugucaccaucaucugcuugcauuugugcagucucucugguuuacauuucugguggcuuauucuguucgugcuguuguaacaaaaugcuacaggcuggguaauuuagaaagaacagaaauuuauuucucacaguucgggaggcugggaaaucuaaguucaaggugcuggcagguuuuguauuuggugaggccuccuucccugcauccaagauggugccuuguugcugugugcucuggaagggccaagcacugugcccucacauggugaaagguggaagggcaaaaggcaaaacuaguucucuccaucccuuuaauccacuaauccuuaaucaaaggagcuucuaaccaaaguuggaacuuaauauuuuacuucuuuuguaccauuagucuuauuacucuuaacauggaagauugauuuuucuucaaguaauugggagauaaaaaacgugacauagggaagaauucagacuuucucugaaguuacuacuaugagaauugaagagauaugugacucaacauauuucuagaagccauuuuuuucuuuuuuagacuaucauuccaauucagacuuucuaacuuuauauuuaaauggauuuuagcuuauuucuauuucuuucaguaaucuuuaucuuaaaaauuucaaauuaacggcacauuuucuacaugcaaaacuuugugcuaauuccuuuaugaaaugcuuuuacugcaguaugaaacauguauaggaacguggacuuagauuguaagaauauguuuucuguucuauuuaggugucgagauuugcuuugaacuuuauaauccucggguccaggagauucagguggucaaauuagagaaacggcuggaugauagcuugcuauacuuacgagaugcccuuccugaauauagcacuuuugaugugaauaugaagccaguaguacaagagccuaaccaaaaaguuccuguuaaugagguauggguuauacauuugaaacuagaaguucaaguauaaaauaagaaagaaagaaucaucuuaaugaaaacuucagaagaauuuuugcucaugccuaucagccuaauuauugcuuuuuuuuuuuuuuuuuuuuuaaucuuccuuagcugaaaguaaaaaugaagccuaagcccuggucuaaacgcugggaacguccaaauuuuaauauuaaaggaaucagauuugaucuuuguuuaacugaacagcaaaugaaagaagcucagaaguggaaucagccauggcuugaauuugauaugaugagggaauaugauacuucaaaaauugaagcugcaauauggaaggaaauugaagcgucgaaaaggucuugauucugagaaugaauuugguuaguugcagaagauacauuggcucuaagaggauauauuuugagaccaauuuaauuucauuuauaagaacauaguaauuaagugaacuaagcauucauuguuuuauuaauacuuuuuuucuaaaauaaaacuuguacaccaguuuauuacucuaaaaagagaauuacacaugccaaauggaccaauguccauuugcuuauuggaggcaaagcuacaauagaagucagagcaucaccagaauggucuuuaaugagcauggaaccugagcaaagggaauaggugggaugaauuuuuuuuuuaauugugaaacaauucauaagcacaauaugauuuacagaauaauaaacauucauguacccacuaucagguuaagaaauagaacauuuauuaauauguaggaauguuaagaaauaaaacauuuaauaagaucucagaagacuccaguaaaucugcaauuguaucucucuccuuuuuaaauguaaauaucaucuugacuuguuaauuauucccuugcauuucuuuuaguuuacugccaacacauauauucuucaacaauauauuuaauuuugaaaaaccugaaaaaaaaaaccuguuagcaaguauaaaggggcaguauuacuauuauugcaugaaggcuucaagggaaacguuacagucuuugggucauagucuggcuucagcuuccucugagaguuuacagaggccaauuuugagcaaauucauggcuaagguuaugagugaguucugcuaaacagaaggcucaccacaagguaucuggcaggauuauacuggguagcuggauguugcagaaaugugguuagaggaaguaaacuguuuuuugaugcucacagcaugaugaaucaaacucuguaucuuaggauuagguuaaaacaauaccuuugguaugauaugaguguuguugcugauccaugcagcauggauuggaaagcugggguauaagcacacaugcuaaagaaaaacauguaauuugguccauacucaccuggauauacuguuccucagguuaaaaaauacaguacuauccuaaaucuugaaggcaacucucagccuauccauugaguuaccuucagaucugcccucugguuccuagcugucuugggacuaacuucuuuccugcgcucagcuguuuucuggauuccauguuuuccauuuuauugaguacuaacuuguuuugcugcagcacauccuuugguagcuucuagaggaaguuuguguggagguaaaauuuuugagaccuugcaugucucauguuugauugauacuuuauacguuuagguaggagguaauuuuccuucaggacuuuaaaaauauuguugcuccauuuucuuuguuucuauuguuguauugagaaauccaaugccauuuugauuuccccaucauaaauuucaugaugaugugucuuggugugggucuauauuuauccauuguauuggguuuuaggugaacccuuccagauaguaacucauuucugucaguucugggaaacacuuagcauugguugaugauuuauucucugcugcuuuguucucccaacuauuauuuggauguuggauauccagcacuggguaucuauuuucuuaccucccucccuugaccccagucucuguuuuuuagcucuuuagcucaaucuuccaacucuuugcuauuguauuuuaaaaucuuaagaccccuucuugauuuguagaaguuccuuuucuuacaaccaaaaagccuuuaucuauggauuuguucacagauaagggguauucaauauaguguauuuuuuuuucauuuaaaauuguuugcgcaucuauuuccuccaaauuucuuucuguauuuauuuuuuguugucuauauuucagacuuuuccaggauaucugauaaucuuuggcugucuucuuaugguugaaagagggacuaaaaagcuuggaaagccuuuggguugugggaaggggcugucuuuaggauuaucugaaugggcuuuuuugggaguccccuccuccacaugaauauuuugguuuugucagauucccuagaauagaggcuuccaaucuccuuccuggaggggucuguccaggaaggagauugucuaggggucugucagacagcagcuuucagcuacuuccuugaucuuuuucacuaaugauuauauagucaucuaacuacugucaacaaguaauagauauccuauccuucacuuguuuagauuauuugcugagauaaccucucaaaagaaccucucaaaauaaaagguuaacaagagccuauaucuuauauuuuucuucucuuuaucuuguuagaagauagcuauuaaaaccuguucuuuuucugucuugauaaacacacuucaaucuugguagaaugguagaugggacaguauauuuuaggaccuaaagcucugcaaauguaugaucagcuuguaaguacaggugcucaaaaacauguaaacaaucaugcuuuuuacucuguaggaauaucuuuaaaauucuugugaauuuuuccccagaaguaaagcaaaucuucccccagaaauaaaauuaaaugugcauaaucuaaagcuuuuuuuuuuuauugugguaggauauauauauaaaacauaauuugccauuguaaacauuuuaaauuuacaagucagaggcauuaauuacaucacaauguugugaaauuauuacuacuauuuccaaaauuuucucaucaccccaaacugaaacucuguaacuguugagcaauaaccucauuccuguaucucucccaaccccagguaaccucaaaucuuucuuuuuaucuuugagacaaggucucauucuaucacucagguaggagugcaguggugugaucauagcucauugcagccucaaaauccugggcucaagcaauccuccuugaguagcuaagacuauaggcacacauuaacugcgccuggcugauuuuguuuuuuguagagauguggucuugcuauguuucccaugcuggucuugaguuccuggccucaagcaguccuuaagauucauccauguuguggcaugugucagaauuucauuuguuuuuaugacuaaauaauauuccauuguauguauauacauuuuguucauccaucuucugaugaacacugggauaugucuaccuuuuggcuauugugaauaaugcugcaguaaacauugacauaacaaguauguauuugauugccuguuucuaaguucuuuuggguauacaucuugaguagaauugcuagauaaugucauguuuuauuucucuugugauuucuucuucgauccccugguugaguguguuaauuucuacauguuuaugaauuucccacuguuuuuuuguuauugauuuccaaguucauuccauugugauuagagaagauacuuaguaugauuuuaauguuuuugagaauugguguguggccugauagauggucuguccuggagaauguuccucauacacuugagcaaaauauuuaucaugcuauuguugacuguaguuuucuauaugucucuuaggucaaggugguuuacaauguguuaagguucucuuuuuuuaaaaaaauuuuugcacagaguaucuuuuucuauguguuccauguauuugugucuuuggagcuauagucucuuguagacagcauaucacuaucuuguuuuguuuuguuuuuucuguccauucugccaauuucugccuuuugauuggaaaauuuaauccauuugcauuuaaaguaauuaaggaaggacuuucuucuaccauuuaacacuucuucuauaugucauauacuuuuuuggccccucauuuccucuuuauggccuucuuuucuguuuuuuuguagugaacuagucugauucucuuuccacuccccuuuguguauauuuguuagauguuuuauuugugguugcuauggggauuauaguuaacauccuacacuuaaaacaaucuaauuuaaacugauaccaauuuaccuucaauagcauacaaaaucucuacuccuguaaagcucugccccugccccccuuauguuauugauggcacaaauugccuaauaaauaauuuauaguuauuuguaugaguuugucuuuuaaaucauuuaggaaauaaaaaguggaguuagaaaacaguaugauaguaauacugacuuuuauauuugucaauauauuuaucuuauuuuggauccuuauuucauuauauagauuugaguuacugucuagugcccuuccauuucggcccaaaggauucccuuaugcauuucuugcagggcaagucuaauuguaauaaacucccucagcuuuuguuuuaucugagaaugucuugauuucucccuuauuuuugauggauaauuuugccagauacaugaauuuuugguaacaguauuuuucuuucagcacuuuaaauaugucaucccacuaccuucugacuucaugguuucucaugagauauuagauguuauaaaauuugaggauuccucauucuugaugagucaguucugucuuauugcuuuucggauuugcucagcuuuugucuuuugacaguuugauuauaacgcggcucagugugggucucugaguuuaucccacuuagaguuuguugaguuucuuggagucauagauuuaugucuuuuaucaaauuuuggacauauuuggcuauuauuucuucaauuuuuuucacugcuucuuucuuuuccuucugaaauauucuuaauguauauguuggucuguuugaugcugucucaccaguuucuuaggcuguguucucuuuuguuccucagacuugauuauugcaguugcccuucuuuuuauuuuuuucaaguuuguugauucuucucccuguucagaucaacuguugaacuccucuagugaauuuauuucaguuacuguacuuuucagcuccaagauuuaucuuugguuccuuuuuauaacgucugugucuuuauugauauucucauuuuguucauaugucucuuucuuccuuuaguucuuuguccauguuuuccuuuagcucuuugggcuuauuuaagacaauuguuuaaagucuuugcauaguaaguccaaugucuguguuucuucagggaugguuuucauuauuuuguuuucaaugagccauacuuuccugugucuuuguaugcugucuuuuuguuguugaaaacuguauguuugaacaucauaacgugguggcccugaaaaucagauauuccccccuuccugagaguuaguuuuauuuuuauuauugaagauuguagcagucuauugcuacaugugcagucauuuccaaacuauuuuugcaaagacuguauuccuucugugugucaucacugaagucucuguuccuuaguuuguguuuaauaguuugacauagauuuccuugaaaggaguuaaaacuagcagaaaaaucucucucccagucuuuccagucuuuguagauugguucugugcugggcuuuuccauuaauacuuagccaggcuuguacugagccuaacaaucaggcccaaaagcguagggucuuugcagaucuugucugagcaugcuucuugcuguguaugcacguaguuuucuaaaucucccuguaugugcuguugaauauucuaauuucccaaagaaacuccuuugcagcuuuuucucacagaacauagaugguuuuuuggauaucuugaccauagucuuucgacccagguguuugcgguuguuaguucaccuuacacuuuuuucaagcauugccuacugcuuacgaugagugcucugucaauccuuuaaguagccccagacaggcuaccagagacuuaaacaagaauuuguaaguucugcucagcuuccucuagaaauggggaucaggguccaagacagaaugcaguugcugauuucaagacugcugcaacaccagggagcuugugggggaagggcaagcagaaaugucacaaagcuuucuugccauuuuaaaguugccuguucuugacucagcauuugcuucauugcuauaaacuuuuuacuguuuuucagaguucugauaaaauuggcuaugccuguuccugcuuuaaaaaauauauauauauuuuuuagggauuggggucucacuauacugaccaggcuggucuugaacuucuggccucaagccauccucucauuucagcuucccaaagugcugcaauuacacgcgugaaccaccacacccagccccugcuuguuuuucaaugugccuacuccaccauguugcucaaguauguauauuuucuaaacuaccuuguaguguugugaugggaaauaaaucccugagccuuuugaauaacucagagagaucaaaaacuuaguuuauccuauucgaaggauuagaaaaaugauauaucuuucacuuuuucagggauaggcuccucauuagaaggcuccuaugugccgaugcuguacaagacauuucauuucucuuaauguuuacaacaagcuuguugccaaggcugaucuugaacuccuggccucaaacgauccucccagcucagucucacaaaguguugggaugucuggccaacuaaugacuaucuuaacucuuguguuucaauguuuaugccuucuuuuaucuugacugauuguaugacuaugucuucuagaacaauguugaacagaaauggugagagcagacauccuugcuuuaauauuucaccauuauauaugauguuagguauagauuuuucucacagaugccuuuuaucagauugaggaauuuauauuccuacuuugccgaaagguuuuuguaguaugagggggugcugaauuuugucaaacacuuuuucgguaauaauugagaugauugguucugcagucaucgagauguggauuuucuccuuuauucuguucgugagugauuacacugguugacuaauguuaaaacaaccuuacuuuccaggaauaaacccuauuaucuuuuuuauaca

SEQ ID NO: 191637 - RNA, 11085 nt, Homo sapiens
cggcggccgcgcgcagcacgcucaaggccgggauggcggcggcggcggcggcaggaagcgggacgccccgagaggaggagggaccugcuggggaggcagcggccucgcagccccaggccccaacgagugugccuggggcucgucucucgagguugccucuggcgcgagugaaggccuuggugaaggcagaucccgacgugacgcuagcgggacaggaagccaucuucauucuggcacgagccgcggugcgccugcagcgcgagggcaugcgggagugggggagguggaguguggggcggggccucggggccucccgcgggcggggcuuagggcggcguggcccggguuuugagaugugggcguggacccggaaggcggaggaaaggggccggggaccugugcgaguuuuguuaacacuccucccucuuguugaggaccuggauagugagugacuuuaauuuguaucuccagggccucguacagaacuuguaggagucuuuagugaaugagggagaauacugggaagaggguagcggaauggaucuucaugaaguccaggacaaucuuagcuuccagaacauuuucuugccccgagccuuucuucucccuuucugcccccacccacaaaccggagcccucaccuccucaguguguuagaacccauuacuaaaacuuugcuuuuuuacuucacaggaacuguuuguggagaccauugcaaaagaugccuacuguugcgcucagcagggaaaaaggaaaacccuucagaggagagacuuggguagaguggcacugcagugucuggggacagacaagggagggcugggcugguuuccccuugugcagguugagaagacgucacucugaucugagaggugccacagcgucucuccccaggaugguuucuguuggccacagugccaggaagcccuaccuguagaggcugucugcuugggguggcggggcagugugugaaggugucugggguugccguagcggacuggaucccuucauaccuucugccaaauugcaccagaaaaagauauuucuuuuucaccuagcaacuggggauuugauuucugacucuugucuggcugggaacccucaccuggguaagauuucguauaccguauucucaugcgcccugcgucuauugccacguucuucucugacaacuuuaagagcaaagcgaauaaauaauuuagggguaauuuaggaggcccccaacccccgcguugaaugguauuugccuaugcuuuucuuaacucuucuagggagacagcuaauauauauaagaguugcugguagaguagauauggaucucaaggcagcaagggacgcaucuuauaaaugcccucauuugcccaaagccucaugcccuucacugcagauugugcuguuuucugacugaggucagcauggcugaaguuagucaggugucucuuuuccuuguguuucagauaaugcaauagaagcuguggaugaauuugcuuuucuggaaggugaguucccucucagugggcaaucauuuccgccugucuuuugcauguugaugugaaauucaaaaucucauaaaacggaugccugcuucuuguuuguguagggauaauucuccgcacuugcuauuaggauagaaaaaaguaacuugcuaaaccuagugagguucaguuuucucccuuggggaauuaaaauuucuaccugaaaauugcuaaccauaaagaaauaggagggaauauaaagaucccaguggaguuagaugaauucgaaaguucgauuccuacuuugaucgccaucccuaaaugucaggcuugcccccccucaucauguuacagaucagaaacaauuguuaacauuuaaagggucaccgcuuguucuuuuuucuucaacaaucugugugaagugauuauuuugcugcaauaagacuuguacuugucuguauuuuuaggagucauggauuaacuuguguacuaacuaaauuuugucauuaaaaaagaaaauauuugaaauaccuaauuuuagcuaccuagccucagagcgauuucugcuacuuaauucuucagucugaucagcuuacucuucacuacacguauguagucaugugcugcguaauaacuuuuuggucagccauggacugcucacaugaggguggucccaucagauuauaauggagcugaaaaauuccuuuugcccagugagguaguggucauaacauccuaaugaaauacauuaccuuuucuauguuuagauuuguuuaaauacacuuauccucauguuacaguugccuacaguauucaguacaguaacaugcuguucagguuuguaaccugacaacaauagguauacccuguagacuaaguguguaguaggcuauaccaucuagcuuuguguaaguacccucuaugguguucacacaguggugaaaucgccugaagaugugaugcauuucucaggauguauccuuguuguugagcgacacauguauuuugauugaauagcuuagcaaaagccauguauccuuauucucccaggguguucucauuaccuccuucaagccuuauuaccuuuagaaauaucuugauuuauuccacucuuuuuuacuccuuuguucugcaucucccugucaaccuaggccccugguccuuuugauagauauuuuuuaaaugucuuauuagauagauagacuaccauggccaacucuaugucuagacuauugagcauucuuuuaauuugcagauuuuucuucagccucucuuuccaccuacucauuuuucuuaaaauuaacuuuuguuaguccuaccuaaggcaggcacuccuugugacagacuuucuguaaguucugcagucaaaaauguuuggagccuacuuuaccucuucauuuuuaauuaccagcuuuucaaagacaugagugauaugaucagauuuguauuuuaagugcacaacauugcugcccuggggaaaauaaacuggaggguacuaggaauagaagugggguggucuuauguaguuuuccacucuagccucuaucacagcauagugcuuagcuuggauuuuuaauaaauggccauuuauugaaugauugguguguuuauuuucauccucugccuucauccucauuuaucucuguaauugaaucccuuugcucuguccuacauugguagaucugaauguuagccaucauagccccuguggauucagucugcauuauauuauuuuuuacuggguaaaauaaauguucuuauguccuuagguguguauggucuaaguaaauacauuuuuuucguuuuuauaauacauauccauacuugaaaaucaaaucguuaccuaauggcuuauaaugaaguacagcugccguccacccacuguuuuguuuguguuuugagcuuuucuggugguuacguuuauuucuaacuaauaugcuuacccauugguuugucagcuguagacgguauguauugacuuccugcugugauaaaugaagauuuggcuaaccuguagaaccccauaaauccccugcugucuuucugauuuuugguaguuguaucacuaguuuuaguuucuuuaccuuuacaguuuauauaacauacuaggaugucuuugguuguuguguccaauuuuuaauguauuccuugacuccccaguuuguaaaguaugacuauuagugcauguaucccuuuucccuuucuaguucacaucuagcuaucaauuuguguuaucuaguaauuugacauugucaaagcuaauaacauuuguaucuuaucacaauuaaaucuuccaugcuuuaucucugguugauuguagaaguugaaaacuaggacuguaaacagucuuucucuaccuucucucugucccuuaauuccucauucagguccccucccugcaaacaacuguuacuaguuuucuucuguaaucuggauauuuuaugcaaauauguuuguauguguauauguauauucuuuuucuaagucauaugaaauacaacguauguaaagugugugcuguaaauguaaagucaauaaaugauaaaaugaacacucucguaaccaccaucuuggccaagagauaggguauugucagcccccagagucccacguauauucauucuucaucauaccuauucucauccccuuucccgacauuacuguuuccuaacuuuuuugguaauuacuuccuuuucuuuauagcuuacuauauaagcaugcaucccugaacacuaagguuuaguuuuguuuuguugaacucucugcaaauggaaccaaaccguaugcauucguuggccaacaucugucacacaacuguuuuaaguuaacacauuuaugagauucaucugugugauugcacauaacucauuuguucguguuccuugcuauaugacaguaccacaauugaacuauuuuaauguugauauuugggaaaccuuauuucuccuauuauaaacaauuugcugugaacaaucuuguacauauuucucuaggguggauguauauguguguauaaaauauauaauacugcugggaccuaggcuauauagaguauucguaucuccaucuuuggcagguacugcugaacuuccuguauuccaauucacguuccuaccagcagugcaugauaauucccauugcuucucauucuuacccacacuugguauuaccagaguuuuuuauuuuugacaagcuguuauugaauguaagugauaguugcaugugguguuaauucguauugcccugauugugggugacauugggcgucuuuucauauacaugcccauuuuuuuuugaggggugucuucuauuuuucuguuagcuauuuuuguccuuuuucuuauugacuuauaaaaaugcuugcuguauuuuauuucauuuuuauuuauuuauuuuuuugacguggagucuugcuuugucauccaggcuggaaugcaguggcaugaucucugcucaaugcagcccccccucccacguucaagagauucucacguaacugggacuacaggcguguaccaccacgccuggcuaauuuuggcauuuuuuugguagagaugggguuucacuguguuggccaggcuggucucgaacuccugaccucaagugaucugccugccuccgccuuccaaggugcugggauuacaggugugagccacugcgcccagccgugcuuguuauauuuuagauaugaaucuuuuuuaguauaugagacguaucuuuuccugccuuuucacuccuuaaaagguugucuuuugauacgcauuaaaauauaaagguaaucaaauguaucaauuuuuuuccuuauaacuaaugcuauuuguguucauuuuagaaaauauucccuacuguauugucaugaagacauucuguauaugcuaaaaucuuuauaguuuugucuuucauaacaguggaguugaauuuuuguguauuggguuggggguccagucucauuugugucuucauauuuagauauccgcuuguccauaucgucaucucacugcuuugcagugcuaccuuucuuaucaaucaaggcuguuucuggccuuucuguucucuuccauugaucuauuuguaucucuuuuccauugauggguauucucacaucaguacuauacugucucaguuaugguagcuuuaucugagagagcagaucuucccaccuuguuuuuuucuaaguaucuuugcuauuuuugaaucuuugcauuuucauguacauuuuagaaucugucaaauuccacaaaaagagauauuaauugggauuguauugaauuuauaaauuacuguggggaagaaacgauaucuuuacaauagugaaccuuucauuuuauaaauauggucuacuuuaacauuuauuaauauuuaguuuuuaauaaauuauuuuaccugaagaaaucuugauguauuuuguuaaauguuguucuguaaguacuuaauauuuuugaugauauuguuaaugguaucuuucuaaagaaaauuuuauuuucuaaauauugcuguuuuuagaaauauaauugauuuuauguuaauuuugcaacuagcaucuuucuuagcuguuauucuuaguuuuuuuacuuaaaaauuuuguuuugauguaguucuuaauaauuugaaugacauaucuguugauuuuugaauuucuuuaauuacauaguaguauaucaucugccaauaauaauaauuuugugaaguucuuuccaauccuuaucuuuauauauuuuuuucuugcccuacugaacuggcuagaaucucuaguacaguguugcauggaagugguaagagcaggcauuuuugacuuccaagggaaagcuuucaguauuuaccuaguaauuaugcuuacuguagauuuuauguagauuuuuuaacagauuaugaauguugcaucccuguuuauaaaagagauuagucuuuuuuuuucauacugugugugagcuucauacaauucauuggcaauuauacacuuuuuaucuauuuuuuuuuuuuuuuuggugggggauggagucucacucuguugcccaggguggaguacagugguacgaucucagcucauugcaaccucugccuccuggguucaagugauucuccugccucagccucucgaguagcugggauuacaggcucgcaccaccacaccccaauaauuuuuguauuuuaguagagaugggguuuugccauguuggucaggcuggucuugaacuccugaccucagguguucaagguccacccgccucagccucccaaaguguugggauuacaggcgugagccaccgcgccuggcccacuuuuuaucuuaucuauucucuggaaaacuuauugaaagauuggaauuauuuuguuuuugaauauuugauggaauucagugaugcuguuagagggguugcaaugccaaauuugguuauuguauaauuuagauuuucuguguucuuacugaauuucuucugucugcuuauuuuaccuguuucaaagaguuauguguuaaaacucuacugcuaugauuauggacuauuucuacuuauauuucugggucuauucuuucauuauauauuaugaaaccaugugauuagauauauacaaauuuaauguuguuauauauuguuggugauugagccuuuuauauuuguaaauuggcuauuguuauuucuaacugcuuugagcccuaaagucuauuuuguuuaauauuauuaaagcuuaucagcuuucuuuaguuaguauuuauuugcacgguacggauuuuuguaaaucuuuuaauuuuuaucuuuccauauauuugugaacagaauuuaacuggauuauuuuccuaaauucagacagucugugucuauaacuggagcacgucauuuauuuauguuuaauguaauuggucauaucuaugaguuugaauucuauugucuuauuuuguccugcuuuuuauuugcuuguuuuauguuuuguuuuuuuuuucucucaauuuuuggccuucuuuuggauuauuauuugauuuuuuucccucuaucagcuuggaaguuauaugcucuauuucuauucuuuuagugauuaucaguuacuauguaaguccuuaauuuaucaaagccuauuuaguaccuuuccccucauucucaacaaauugagaucucaggauccauuaacucaauuuucaaauuccucgucuccuaauuuaugugcuguuauugucauguauuuuuguuuugucuuugucaaucuacauaaggcauuuuuauuccugaauuaugcagucaaugauauauggauuuagucacauacuaccuuugcuuuucuuuccuuucuggauuauuauuauuuuugagacaguuucauuucgucacccaggcuggagugcaguggugcgaucucagcucacugcaaccucugccuccuggguucaagugauucucaugucucagccucccaaguagcuggaauuacaggcaugcaccaccaagccuggcuaguuuuuuuuguauuuuuaguagagaugggguuucaccauguugaccaggcuagucucaaacuccugaccucaagucaucugccugccuuggccucccaagugcugggauuacaggcgugagcugcugugcuuggccuccuuucuguauuuccgauccuccauuugugaucauuuucuucuuccugaaauaaaucauuuagaacuucauuuaguauggucugguaacugacucucucauuuuuuucuuaugaaaaugccuugaauuucauuguuggaggauaauuuguugaauauaaauucuagguggaaaauuauuuucuuuuagcacauugaagcuaucauuuuacugcuuuuuuuuuuggcuucuauguuuucuauagagaaauuaccuguuuguaauucuuuugaagcuaguuuauccuuuuuguuuuuugucugcuuuuaagauuuucacuuugauuuucugugguuucacucugauguacagagguguggauuucuuuuuauguaguuuguuugagcuucuugaaucuauagauuaaugucuuucaucuguccuggaaaauucucagcgagugucucuucagcuauuggcucugccuuguucuuuccugugucucucucugggauucccauuaaauauauguaaaaacucaaucauaauuuugccucucuaguaugcauucuguguaauuuuuucugaucuuccaguuuauucucuccauuugucucauuuccuuuaaacuauuuuuuuuguuuuuuuuuuuuaguuucaguuuuuguauuuuucaguacugugaguucuguuugguuccuuuccaaaucuguugucuuuuuuuuuagcuuaauaaaguaucaagcaauuuuugugaguacuuuuuguuguucuuauuuucugcagguauuuugaaguuugucuuuuaguucuguaaacauaguaaacacaguuguuuuauagugaauguuccauccaauauaugaccuaauauucaaagccuuuugaguuuuuuguuugcuagucugugccgaaucuaacauccauagucucuugagacugucuuuuugucuguuguuucuuuugguacugucacauggccuuuuaucccccuauaugccuaucuuuggauaaugguuauuuucuuuaaaaaguauuuguuagauaaguugaggccauauggugauacuuucuccaaagaaaauuuccauuugcuccugaagccaccuacagccauuaucagugcaggacuucugaauccagaucuaagacuugaagguuucuggacuaucauacugauaugaacucaggcugcaggccugugaaggggcacugauuaaauuccaguucguccuuacucugagggggcagccuuuugggcucuagcuuaagaaagaugggugucagacuuccuuacuuggguagacucagggauuugacucuugguuccuucagccuacacaaauaaccgcccaguuucucagcuuuuucagauuggcagaugucaugagagcagaaguaacauuagaggcuggguuuguuuuguguucuuacugucucuagauuucacauuugcuuuuucuugaugucucuucaauuccugaagauuuccuuuucuuauauauuuuauuuagcuuucucaguugaucucaacaggaacuugccauuaugaaaagcaccucuauuuuuuuuuaaauuagaaguguuuuugcuuuauuuuucuuauguuuuuauuuucccuauauuaucuaggucauuaaaaaaaguuuugguauccuuucaacuguguagcuuucuucagauaccuggugauuuucauucuauuuaagaauaagggaauaaggcuguuugguaacuguguguguguguaugggaugagggggugguuguugccuggcagcuuugcuuuagggugaacaggggugggaccagauguuguccugggugaccccgaggguaugaaugcagaaugcuuugcugugggaagcuggcaguuuuagaggcuguucuaguuuucuccauauaguucauuugguucuuuagaagagagcccugugaucuuuguuuuuuuuuuuuuuccaaguuagguuuaaaugccugucuucugguuguccugccuguggggaggguuguggggagauaggggcaacuguuugucauacagacccucuggucauuaacccauuuucaucucacaucaccauuccuggugacuugagccuggagcuuccucaugguucuuuuaggcauaugggccuccuuuucugcugcagcccccucuguucauucuaggcuccuuuuuccucugcucuauuuauaagcauacuuugaucagguuucuguuacucaguuuuuuguugaaauccauuaacugccagugggccccuauuuguuguagauuuauacuuuuuaaacuuuuuuaccuuuugaauggaaucuuggaugggagggcauacguacuugugggcccagucccccaucuggaacugaaacuuucuaaaaagauuauaaacucuuuaauuagagaguuuaccucauuuauuuuauauucuuuucuuauauggucuucaucaauguucauuaacuaacacaacgacuucuuagcccuuuucccacuucuaauucuagcucuuccgacuaguaugcuuaauuccuaacugcccaccaucuguaaugacauguuuucccuggggauauuuuggauggaucauccucaaaauuaguauuuuggucuuagagaacugcugccaauaccggagccucuucugcauuaaguuugcccagcuuguuacacuaauccagcuucugagguccccugauauacucauugcucuuuguauguuuagguacuuuagauugauugccgagcggggcaguuuugugagccuucaucugaagccuucaguucaccccucugcacaggccucagcuuugaagaacggagucuuugcacuuacacacacucuuccuguucugccuucaccuaugccgggauaagcagagaucucaucaauuagcucuucucugcaaggucuuccacuauuucugucugucuuccauaucaagccuggaugcagcugcugcugcuuagagcagagaugaagaaaguguucugcauaaguggcuuccugaaugaugaggaccagaauaaagguuuuugaucaaccuca

SEQ ID NO: 191638 - RNA, 16735 nt, Homo sapiens
uucagaaauucauaccauaccagacagauguguuuuauuaaaaaagaaagaaaacccuuuaaucagaaagucugauuaaauucaauaguaacucaaacucuuaaaaaauuucuggaaaagucaacaggauacauacaucacagaaaagcaggcagcugcugacaguucuuugguggaaaaguaaguugcguacuuacccaagcugcccaaaugauuaucaagccaaguuuguuuuucaaaaauagguuuuaagauacaccaaagaaacuauacaauacaaaaauuuaacaaugaaguuaaaguauauagcaaaagccaaauaugacaacacacauguauaauguagaaaagaauccuuucaguccuagaaaacuaaaauggggagaacuuacugaaggguaacauacauaaaaugaguacuaauagcaaggaauaauccuaaacauuuucccaauaaacugacuaagccucaaaaggacagcuuaggaaaaugauuaacaugcaguuuuucuuuuuuccuagccaauucaguucuacuuagauaaaucugguugccaaucaauacauauauaaauuaauuuuuuucugcucaauuacuaccauuuuuucuuuuucaccuuuucccuaauuuucucuagcaacacuuuuccuuugguuugaucaguugaacucaaaagguuugguaccuaaaaugaguaucaacuguuauugcaauagcacuugggaaaugcaauccuagaaaaggcgaauguguaacugaggugcuugacaaagugaagcauccauccuccauaugguaaugucucccauauuaaucacuagguuaauggcugcuccuggcuagaucacaggacccugcaugauacuggaaugcucccuggugagguacugcagagguaugugcagaaacacccacccauuuaagcuuucaauaaauacaaggcaucauuuuaaaccauuucaguagaauaaauuaaaaauauugcauuucuauuggccugcuuugcuucuugagcuggccuggagugcuguuugugacacagaagacacaguaguuaauuaguggcuaccccaagcucuuuagacuucagcacuucucgcucuucaagccucagcaccuuuuuugcagcaauaaugguauucuucauuagcauugccacugucauggggccaacaccuccaggaacuggagugauauacccagcuuuuugucugacuccuacauagaaacaagacaggcaggcugcuuuaguuauggcaaaggacauguguguacuuuaauauauuauuaaacaagcaugcaaggaaaaaguaacauacauaagcauaaaacucaaaaaucacaucuacaucauucaagguuuugugaacacacuaguaaaauaacaugcacauacagaguuguucaaggaauauuuauacaucuaaguaaccuauaaagaaaucuauuaaagaaauaucuaguagguuaacugugugggaguuguaaguauaacaauaauaagcauuaccucaauaccugccuauagcauuuucuuaauuuaauuuuaaguauaauuuguccaaagcagaaagcacaguaauuuuuuaaaagugagaaguuaaaaaaaaaauuaaccuaauguuaaagugaaaauccuuacauaccuaggcauggguuugacugcuuuaauaaaaacagaaagcuaggaauaggauuaucagcauaggccggguacagugguucaugccaguaaucccagcacucuggggggcugaggcagggugugaggugggggagauuguuugaggccaggaguuugaaaccagccugggcaacauggugaaaccccaucucuacaaaaaauacaaaaauuagccaagugaggugacaugugccuauagucccagcuacucaggaagcugaggcaggagaauugcucaagcccaggaggcagagguugcaguaagcugagauccugccacuguacuccagccugggcaacagagagggauccugucucaaaaaaaaaaaaaaaaaaaaaaaaggaaagaaaaaaaggauuaucagcauaaaacucggauaaacauucuaucuuaagaacugaaaggagaggccaggugcaguggcucacaccuguaauccuagcacuguuaaaggcugaggcaggcggaucacuugaggccaggaguucaagaccaaccuggccaacacagccaaauucaucucuacugaaaauacaaaaaauuagccggcaugguggcucaugucuguaaucccagcuacuuggguggcuaaggcagaagaaucacuugaaccugggagguggagguugcagugagcagagaucacaccacugcacuacagccugggcaacagagugagacucugccucuuaaaaaaaaaaacagaacugaaagaagaaaucuacuaguauauucuaguauuucagggguaugguuuuuuccuggaccauuuuaacuuucuaggccugugaucucucagugugaaaaugagaaaucucuaacacuuuuugggaaacuccaugguuuagaaaaaucacuucaucaaauuuucaaacuuguuaaaagucaagaaauugcuugaauuaugaaauaagucuaaggaaaaaaacaauucccugaaaaguuuauaacugcucuccaucacuaugauaaaacaccuaaaauaauucuagaaaagccauaauuuuaaaaagguuucucuaauucuuaugaaaagccuacuaaggccaggugcaguggcucauaccuguaaucccggcacuuugggaggccaagacggguggaucacuugaggccaggaguuccagaccagccuggccaacauggugaaaccccgucucuacuaaaaauacacaaaauuaguugggcgugguggcccaugccuguaguccuggcuacuggggaggcuugaagcacaagaaucgcuugaagcugugagguggaggcugcagugagccgagauggugccacugcacuccagccugggugacagagugagacugucucaaaaaaaaaaaaaaaaaaaaaagagaaagaaacgaaggaagaaagggguggggggagaggaggggaggggaggggaaggaaggaagggagagagauggagggaaggaaggaaagaaagaaggaagggaaggagagagggagggaaaagcauacugacugggcgcaguggcucacaccuauaaucccaacacuuugggagucccagcuacucgggaggcugaggcagaagaauagcuugaacccaggaggcagagguugcagugagccgagaucgcgccacugcacuccagccugggcaacagagugagacucccaucucaaaaaaaaaaaaaaaaaaaaaaguaaauaaucuauccuaaauguccaugaaagguaguauuuauugauuucauuuuuaaaaauaaaauuucaccauuuaccuucaaaauccacaucuccaaccaacuuggguuuggcaguuacaggaucgugaacucuauuuauucccacaucaaugacugcugcuccuuccuugaucauaucugcugugaucagauuuggaauaccuggaaauggagaaaggaaagaucaacuuaguacugaaaacagucuaccugucagauucuugucuaacuucaauuucaagagacccugaagaacuaaucaacauguuuuauuaaaaccuguuaaaaauauuaacuaaggaacuauuuacuuuuauuauuuuuuuauuuuggcuccugacaggaaacaaaaggaaccauuuaaacuuuauacaguaaauauuaauauaaauauuuugaagcuuuaggaauaacauucacccaucuagacuauaauggacugccagaaaccgguauuccaaucacaacucuauccucaucuuuguaggcagcucaaagaaucauuacaaggggaaugaugaauagcagcuaggcaggcgaauucuaagaugagggguacaaccuccucuucugaggugaaguccuucccuccaucccccuuguguucuuaccugcagcagauauuacaauaucugcaagaauuguauguuucuucaacugcucuuugggaguauaucgaugagauauuguaacaguggcaucaccuagaaagaaaaaaauagaugucuugauuucugacacaaagcugggauuggauuaggucucaacuagucaagucauuguagaaacucaacaucucugaaaaauaauugacuuacggccaggugcaguggcucacgccuguaaucccagcacuuugggaggccgaggugggcagaucaccaggucaggaguucgaggccaaccuggccaacauggugaaaccccgucucuacuaaaaauacaaaaauuagcugggcgugguggcgcaugccuguaaucccagcuacuugggaggcugaggcaugagaaucacuugaaccuggaagguggagguugcagugagccaagauugugccacugcacuagccugggcaacagggcaagacuccaucuccaggaaaaaaaaaaaaaaaaacugacuuaauggcuugugccauguuuucugaacagcuaauugucauuuacuuuuuuaaaauuaauaccuaauaucauauagcuuuaacccauuggucccagcucgacuguuuugagucauauaauuaaauuuauucauccuauuuuuaaagccuuucaagaauuuuaccuuuucuaagcaaaauaucacuaaaauuacucaagguuguuuuaaguauguugaaagauaguugaaaguauauaguuuugccuuuauuucugauauaaucauguaaggucauuauuacaauaauuaugugauaacugauugacgaggcuuuaccuuagaaccaauuaacagaaccugacaggacacauuacagucauaccaauccaauccuuugcaacggcuaaagauuuuuuuccacuaaaugacacaguaucuuugaauaagaauugcuccuuagcuccagcuaucaaagcuauagcugaaauuuucuaauugccuacaaccaugcuuauacucaaaacuuaaauuuauuucugaagcuaguuacaugauaaaugaauaauaaagaaacucaggugacacugggugcagcuucucuacaaagguuacucccugaauugucuguuaacaaaauuucaacaaauacaaaguauaacagaguuaauacuuccaaacaugcacaggauggcuucugaaaguucuuacauggggaaaaaaggacaguguucccugaaagcaauuuccuuaccuccgggacguucaugcgccccaucugugugcaguaacauugcaaugggcauuccaacguuuuuugaccuuccagccacaaccacauucuucccuaggguuggaaugccuauaaaaauauauguauugacauuaaaaguagugccaguccaaaggaaaacaaagucagauggccuagaacaugaacccaauuuugccucaucagucaacuggagcuguaacuugcuacacauaauaagggcuaaaagaaaacaggagaaagcauacuacaggcuacaaaauguuacaggaaugugcacugucaccacuaucaaaucuuaaauuuccuucacugagggcuggggcgguggcucacaccuguaaucccagcaggagggaggauugcuugaggccagggaggcuaagguaggagaauugcuugaggccaggaguuugagaccagccugggcagcaugaugaaaccucugacucuuaaagaaaaaauuaaaaagaaaaauagaggccacgcgcgauggcucacaccuguaaucccagcacuuugggaggccaaggcagguggaucacaaggucaggagaucaagaccauccuggcuaacacggugaaaccccgucuguacuaaaaauacgagaaaaaaaaaaaguuagccaggcaugguggugggcaccuguagucccagcuacucaggaggcugaggcaggagaauggcaugaacucaggagguggagcuugcagugagucgagaucacgccacugcacuccagccugggcaacagagcaagacuccgucucaaaaacaaaaaaaaagaaaaagaaaaauagaaaauuuccuucacugagacuucuggauuaaaaagcaaaaacugucauaggcaacuguuaagggcaggcacgauggcucaugccuauaaucccagcacucugggaggcugagggggcggaucaccugaggccuaguucgagaccagcuuggucaauauggugaaaccugucucuacuagaaauaaaaaaauuagcugggcaugguggcacgugccuguaaucccagcuacucaggaggcugaggcaugagaaucgcuugaacucaggaggcagaggcugcagugagccaagaucgcgccacugcacuccagccugggugacagagcaagacccugucucaaaaaaaacaaaaaacaaaaaaaaaacuguuaagagagguaaacuuuggggaguaagacuagaggauaugcaguaggguuuccacucuuugggacuguaugaguuuuuaccauuugccaguacuacuuuuauaauauuaacacagacaugcaauucugggauauaccuaccaguucgcuugauuauuucccacacaccccauggaguagccgguaacauggaauacugauccaaacacauucguccuacauuaauuacaugaaagccaucaacauccuugucuggagaaacagcauugcagauccuucucucaucaauaugcucugaaaaagaaauuggcacaguugccuuaaaucaccaccgcauagucagcacugccugacuccagcuuaucugcuucgcaaggaaaucuauucuucuacagcuugccucugagauguacuucaucugcauggaaggaacucgcauaagcaaagccaaacaccaauagcaaagccaauaucgucuaucacagcugcuucccuccacuguccuuuguaucaagaccacaauacuaaaucaaggcguaauugguauucugaguuggucugucccauuucuaauaaaauauucacucuuuugaguuuauuuugccuuuaagccaaauccacaugaagaaccagguguauaaaguaacaaggccuuuuuaccccucagaaaccauuuuagguagggcaugguaguucaugccuguaaucccagcacuuugggaagcacagaguccaagaccagcccaggcaacacagacagacuuucauuucuaggaaaaauguaaaaauuagcugggcaugguggacaugccuauaguccuagcuauuugggaggcuaaggcaggaggaucccuugaacccaggagcuugagcaugcaaugagcuaugauuguaccauugcacucuagccugggugacagagugagacaaggaaaggagagggaggaggagggggauggggagggagagagagagggagggagagggaaaggagcagaagcagcagcaaucauguuaaauggaguccaaaacucaccuggaagaggcaacugaacaaggaggccaucuacauuaucaucauuauucaguuuauugauuaaauucaacaauucuuccucugaaauugaagcugguuucauaauugucucacuguugauuccuauuauaagaaauuuugagguuaaaaaaauuuuugaggcauuuaaugagcacugcuauguugccuaccauacuuggcuaccauacggguuuuguaucaucacacucaucccuaaaagcugaaguagcucaaggaaccuaaaaaaguaacuucacaaauauauacaccagagaauacuagcuuaacacauccuguauaccucauucuaugcaaucuucauuaaccuuauuuuacagacagacugaggcucagagagguuuaaaaauaagcgagcuaggccaggcacaguagcucacgccuguaaucccagcacuuugggaggccaaggccagcggaucacgaggucaggagauggagaccauccuggcuaacacggugaaaacccgucucuacuaaaaauacaaaaaauuagccaggcuugguggaacgcgccuguagucccagcuacuugggaggcugaggcaggagaaucgcuugaaccugggaggcggggguugcagugagcugagaucgcaccacugcauuccagccugcgcaacagagcgagacuccgucucuaaauaaauaaauaaauaaauaagcgagcuaauaauacagccagucuuucugguuccaaaauccauguucuuuuuuucugcaccacacuaccucccaaugucuuaaaaugccauggcuuggccaggcacaguggcucacgccuguaaucccagcacuuugggaggcugaggcaggcgcagaucaccugaggcagguggaucaccuaaggucgggaguucgacaccagccugaccaacauggagaaaccccaucucuacuaaaaauacaaaauucgccaggcaugguggcccaugccuauaaucccagcuacucgguaggcugaggcaggagaauuacuugaacccgggaggcggagguugcggagagccgagaucacgccguugcacuccagccugggcaacaagagcgaaaugccgucucaaaaaacaaaacaaaaugccauggcuugccauuaucuagagguuucuaaaggcuuucaauuaaaagagcaggaggccucacuccucaauaauaaagaacagagaaaaccacaggcuuacaggccaguaaccccacccagccacgcgagugguuucacagcccuucgaaggaaaggccaccugcugcucagaccacaggcccacagaugggcaggcagaggcauaucugagccugcccacccaccucuuguccacagagacacaguaaucugugguaccgugagaccuagaacacaaaccccaucauccagaccugaacugcuucuaaacugcauguuuggcuuuagaaccaaucggugaagaacuugaaagcuauuucccagaagucagagucauuuccuucaaaucuacgacuguguuccugaccucaucacugaggucaccuaauacuguauugcucaaucaugcccccuaagccucuaaggcuuuaagcugcaaacacucaaacaccuccacuggagacccauuauugcucaaggaaagcaaauguaaaaugcauucagggucaccuaucaaauauaaagacuaagaacagaauguagcuuauauucuuuccagaagccacagagaauaccaaccaguaucuccuguccuacuguauaaaccccgaaagauauagucugauuuccuaugacaaaguuuugggauacaguucaaucacauuagccuccucugcuuggguuuccuaaucagaaaaaagaaaucauaaauuagaauggacuuugccucauauaaaccucaacugaaccgcagucgaggucucagaaggacacauacccacaacugcagcugcccugguuuuguugaggacauaggagugacuugcaggauucucgccaaccaggaucacacucagguguggccguuuguugccugaggccacccacucuucuaccuccugccgcacuuccugcuugaucugcugggccaguuuccuuccagaaaugacaacagcuucauuucugcagaaggcaacagagucacaaaaccaaauaacuugaauuuuuauaaaaacuaaaacucugccagguguaguggcuuaugccuguaaucccagcacuucgggaggccggggcaggaggauggcuugagcccaggaguuugagacuggccugggcaacauggcaaaacccugucucugcuaaauaaauaaauaaaugaaugaauauauccagcuacauauggagggggauaaaguugauagaaaucauuauuaucauuaauuugaagcucagggaguuuaagugacugacagcgcuuggucaagcugagucucacaucagucugggcucuuaacugcuacaccacccugcgcccugaucauuacuaaguguuuuacaguuuuaauuugcaauuguuugaccccucaccaugagguuaaauaguuuuucuuaucugcuuauaugccauuuguaguucguguuuugucccuguuguuagcagccaggcauguauuucaaaucauuucccagucaacugacuucauuuuuauggugguuuaaaucgauaaauuauauucuguaguugaauaaacaaacaauauaggccgggcacgauggcucacguuuguaaucccagcacuuugggaggccgaggagggcagaucacaagguaaggaguucgagaccagccuggccaacacaugaaacccugucucuacuaaaaauacaaaaauuagcugggcguaguggugggcuccuguaaucccagcuacucagguggcugaggcaggagaaucacuugaaaccaggaggcagagguugcggugagcugagauugugccacugcacuccagccucggugacagagcuagacuccgucucaaaaauaaacaaacaaacaaacaacauacuggacaggucaaacaucaaaaugaccaccacuccccacagucccuucuggggaagacuuuccugguaagaauaggggcagggcaggggacuggaggaagcuccuucucacaguuggcaaugugcucuucccagggaccccaccauaucauccaaagcugacagaccaggagugaguaugugacgccaagggcaacaaucucuaggcuggccagugguccaguuggcgcaaaagcuuagcucaacagagcagugagaguuaguugaaccaguaagagcucgucccugaggcaguucaaacuagaaccacagaacaaagacagaaagaauaggcagaauaauagucacaccaaugggagacaacagggcaagaaaucagaaaacuguugcugagguggggagcaagaagaaaaaucaggaucuagaagaaccuccaguucccaaaaccauguucagcugcccgaaaggcugucucuucccaaagagaacugcuuaugcaacucuuccuggguuccaugaaacccaaauguggaagagucccaguuuuccuauuuucacacauguccuuacaguaaagugcccauuacuuaaagaugagcaucuggcccagcgugguagcucaagccuguaaucccagcacuuuaggaggccgaggaggguggauugcuugaggucaggaguuccagaccagccuggucaacauggcaaaaccccgucucugcuaaaaauacaaaaauuagccaggcaugguggugcgcgccuauaaucccagcuacucaggaggcugaggcaggagaauugcuugaacccaggaggcagagguuacagugagcugauaucaccccacugcacucuagccugggcgacagagaaagacugcaucucaaaaaacuaaacuaaacuaaacuaacuaaacuaaacuaaacuaaacuaaacuaaacuaaacuaaacuaaacuaaacuaaacuaaacuagaugagcaucucuuccuuaaguaaaaugaucccauuaaaaaaagccuuucccuuuagaucucuguccuuggugucaugaagacugcucuaaccucaagaccaaugaaguaaucuccucuuauauucuaaaaccuaacaucaagguacugaauauccuguagggucagauaaaauuaauucucaagauaacugcuaauuuauuuauuuauuuuuuuugagacagagucuugcucuguugcccaggcuggagcaaucucagcucacugcagccucccaaguucaugcaauucuccagcuuuugccuccauagcugagaauacaggcacccaccacugcacccggccaguaacugcuaauuuaaaugggauuuuaaagcuuucacaaucuuuaggccuucaauaaguguuuuuuauugcauuaugauuaaauaccaacuuuaaaccaaaucucaacaucuuagauauaaugcaauaaucuuauauauaaacuuuaucuuaaucuguauugcaucuugugaaguauuaaauuauuauaaucuggccaggcacgguggcucaugccuguaauccuagcauuuugggaggccaaggugggcagaucacuugaggucagggguuugagaccagccuggccaacauggcaaaaccccgccucuacuaaaaauacaaaaauuugccaggcaugguggcaggacccuguaauuguaaucucagcuacucgggagcugagguaggagaauaucucgaacccaggaggcauagguugcagugagccaagaucacgccacugcacuccagacuguguaacagggcaagacuccaucucaaaaaaagaaaaaaguuacaaucuuacagcaaaucaaauacuuuuacccugauuuuauauaauacuagcauggcacaacauauaauagcauuuaauuauacccaugguauaugaagaaauugaaaacauauuaauauucacaauuccauuucagaauuagagucgaagaggacuucauuaaaaggguuuugcaggccgggcaugguggcucacaucuguaaucccaacacuucgggaagccaagguaggcagaucaugaggucaggagauugagaccauccuggcucauauggugaaaccccgucucuacuaaaaauacaaaaaauuagccgggcaugguggcacgcaccuguagacccagcuacuugggaggcugaggcaggagaaucgauugaacccgggaggcagagguugcagugagcagagacugccgugagcggagaucgugccacugcacuccagccugggcaacagagucagacuccaucucaaaaaaaaaaaauuaaaauagggggguuuugcugauacaaauacaccuggcaacauuccucauuccugauuuguauuaguaccuggaaugcccaccgcaggccaaaaauacauuccuaauccuggaacacuacagagugaaagacuacuuuaaaacggcuuagaacagucauuuauguugaaugaaauaacaaacauauauaaugugccaggcauauauguucaauaaaacuaauuucuuacucuuuucucuugguuuuauauauauauguauauauacacacacauacacauguauccuuaaaauagauacacuuacacauaaggagauauauauaaguauauacacuauauguauaucuagucagugagaaugacuuagcuugcaccucauaaaaaguuucuuuugaaagcaguaaacuuagagaaaaugguauuagcacauucagauaaaaucauauacugaaguuaaggacacaggguucugggaaaagccaguguuccaagucccaaacuuugcuuccaaaagcagguucuggauguuaugccaauuugcuuaaaaaaaaaaaaagaaaagaaagaaaaacagucaaagaguaacaagaaccaaaaacaaagucacaugcaaugaauaucuuucauaguauaacugucagcccuccucugcuucccacaacucugcaaaaugugaaauacagccuugggagugagucauuaacuaauuuagcaucaucucuuuugccaaggggcagauuaacugcuaccccaaaauaaacagggaaauggagagucagcuaagucccacggggaauccaaaauuguaacuauauuagcuaacauuuaucccagaauuaaaugcauucacagauguguuuagaaaaaauucccagggcugggcaugguggcacaggccuuguaaucccagcauuuugggaggccaaguucaagacuagcgugggcaacauggugagaccccaucucuacuaaaaguuaaaaaaaaaaaaaauuagccaggcauggugguaugcuccuguggucccaguuacucacaagcugaggugggaggaucacuugagcccaggaggucaaggcugcaguaagccgugauugcagcacugcacuccaaccugaccuagggagagauuccccugccaaaaaagaaaaaaaaaaaggaaagaaaaaaaucccauuaagauagguaaucaacagaauaggaagaagucaagaggacuguucaaauaaaauccaaaacuguggcucaugccuguaaucccugcauuuugggaggucaagguggguggaucauuugaggucaggaggucgagaccagccuggccaacauggugaaacccugucucuacuaaaaauacaaaaauuagcagggcaugguggugugcgccuauagucccagcuguuugggaggcugagguaggagaacagcuugaacccaggaggcagagguugcagugagccaagauugcaccauugcacuccagccugggcaacaaaguaagacuccgucucaaaaaauaaaauaaaauucaaaacuaaaauccaagugaguagcaucuucacuuuccuuuuaauucaauagcuuacaguacuguaauuuuccaugagaaauuaguaucaggacauuuuacaauucauaaucaagugauuuagggaagaguuguuaucaauuauuaaugggaaaaauaaugagugaaggaagacauaauggagaaaggaacaaacaucuauuaaacacuagguguuuugcuuacacuuuaacauauauuacucuguuaccuugggacuauuauaauaacacuguaauacagaagaugaaacugaggauaguagaaacaagauucaaaggcaaacuucugccucuaaaguccauugacuuccuaaucccacugucuccuaggcuacuauuucuccaaccauagguuuauguuccugaaacucucauaccauccaacaaagaaaaaaaaaaaaagaaugcagacucauauuuuuaaaaggauacaacuuuuuaaaaauaagcaguauuuaaaaauaaacaguauuuuaaaaaauaagcagcaguaagaaagcaauaugugggaauuguaaauagcaaaugugcaguacagauaauauggauugcuuucagagauguggaugaagcuuacuuguucuuucagaaagguagugaaaagagcauuuguuauuggagaguguagacaaacuggcccaguucuuuagguaaugaaugagagcaucuuuauaaaucucuuuuggaccauggaagccuaggaaaggucugguccacagucacaugaggccagcacucaggaagagggagaaggggagaaaacacacaguaacgaaacaugggggaggucaagagucagaccagggaaaacccugaaaguccccucccacguuuuccuucaagaacucauugcuccaacaagcagcgccuuugaaauauuucuaacagcauuuccgcacugacuggaaauuacacgcguguucugccccuugucaggaacaugagcuccauuaagaacaguuuuucucaucuuugaauucgcacagcuuggcauagugucugguacacagugaacguuagaugaaaaaaagaaggggcugauguuguaaggugcagggcucuaacaaugccaacaaugccagcgcucuaaugaccgaccaaaucaccuucccaaggaaacccaaaaaugcaaacagagcuuuuccuuuccuccuccccuguauauuuuucccaauuuuguuauugugguaaaauucacauaacauaaaccuuaucaacuuuuuuuuuuuuuuuuuuuuuugagacagggucucgcucugucgcccagacuggagggcaguggugcaaucacggcucacugcagccucgaacuccugggcucaagcgauucucgugccucagccucggcgcgugucaccacgcccggcccaucuuaaccauuuuuaagugcaguucagugguauuaaauacguucauauguugugcaaccaucaccaccauccaucuucagaacucuucaucuuguaaaacugaaauucugcaaguaccgcugaaauauggguacuugucacucuccauucccccuuucccuaaggcccugggagccucccggauguuugccaccucuauguacgcagcccggcacugacaggcucuggugggcugcagccaaagcuagggugcccagaguccguucauguuccuggcagagcggaggcagcgcgggccacucccaccggcggagggaggagggcggcgcggggaccccgagcaagucggcuccgcgauuucaucagcugcagcagcgcccuccgccgcuaggguccccgcaaggacaacucgccgagggcugcucuuuuggaacccucgccuguucucccccagacgacucucagcaucccagccagaggcggccggcgcugucggaaggcuccgcguaaacugaugccuucgcguuccgcacgccacccccgucccgcccgccgacuggccacgggccccggcgacgccccgagucgcaggagagcggcucccuccgaaaggcgggcuucggguaccagcccuccgcgccgaggaagcgccccagucgagagcugcggcggcgcucggugccacgucgccccgccacaccccucagcggccaccaccgccggggcggagauguucgggaaggacuucccucggugucccucgggggcccggcgugccccucgcccuccguuccccucagcuuuccgcgcugaccgagcucugugacccucuuaccgaacugccgcgagguggaaagggcgaaggcgaagggagcagcugugcgcgggcugcagcagccgggcagccaaagcagacauuagagaagucgcagccauagaccgcgccggugacugcgccgggagggaagcgcgcgcgcgggccacgcgguuauacugcggccucguggcaggcccc

SEQ ID NO: 191639 - RNA, 22785 nt, Homo sapiens
gcgaggugggguaggcgggcaaggcgggcgccgagguuugcaaaggcucgcagcggccagaaacccggcuccgagcggcggcggcccggcuuccgcugcccgugagcuaaggacgguccgcucccucuagccagcuccgaauccugauccaggcgggggccaggggccccucgccuccccucugaggaccgaagaugagcuuccucuugugaguggggucgggccgcgggcgccgggccugcgggccgagguugugggggaggccuccccggaccugaggcgagggcucggccugggggccgaggcgggggcgggguagcuggcguuuguuuugccucuguucggguccgcgggggaggccgagauguugggagaggccgacagagaugaaggucgaaguaaaggaaacggagcgugaaggcuggggaguagaaaggccccggggccgucgcgccuccaaacuuuuccgcccgagcgcccccgagggcggggagacgaucugggggcggagccgcgagcccccaguuucucuugucucgagcuucuagaaaccguccuugccgacuuaacucguugcucgguuauagguccaguuucauuauugucgguguuaaaugccgccccaggagaaugugcguugccgcaguuugagaagcuugaaguuaagaugcuggccuuggagucggaucguucuguccaguucugauucugcccacuuacuggcuuugauuuuaaccaacuucucuuguccucgguagaauccuguguuuuuaaucauuauguaauauaccauacagcauuauuauauaguacauugcaguauuauaaauaauuuggaaaguuaaaacaaauucauagucccauugcagaaacacaguauugccauuuuagugcacuacagcaauuaacuugauaggcauaccuuagaaucucauuuuagagauaaugccugagcccaaccaaacaaggcuaaaaugaaaaagcuuguaaauucccugaugauucuuaugcacauuaagguuugagaagcauugcucuggcacaguauuuuuuauucucaggugucucucucuaccuuguauauugcuuaaauguguguuuugugauugaauaauuauccaauuuuaguuauggauguaauccacaugcuugacauuuuuauuaaauacaauauaaaaacacuauauaguuuuuuuuuuauuuuuuauaaccagaguuuacccacuuuauugugagaaacugggauuccuuccaguauuuacuauuauaaaauagcacuacucagaauauguuuaucugcgucucauuuuccuuccuuuggguuauucucguaaaugaauggucucuaaaauacgauuaccuugucaaaaagccuguaugauuuagauuuaacuuccauauuaauagaaguauuccucccuccuccacuuuuuucuuacgaguugauauuuaauuagugaaugcacaguugcuuuguggaccuuaauacgagacuuuuucuuuuuuuuuauuuuuugagacggaguuucgcucuguccuccaggcuagagugcaauggcacggucucggcucacugcaaccucugccuccggggauggcacggucucggcucacugcaaccucugccucccggguucaagcgacucuccugccucacacucccgaguagcugggauuacaggcgccggccaccacaccuggcucauuuuuguauuuuuaguggagacuggguuucaucauguuggccaggcuggucucgaacuccugaccucagaugauccacucccgcacucggccgagacuuucuuuuuuuaaaacuuggccuucuugauggacacuugaguuguucccgcuuuuuggccauuaugaauaaugcugcugugaacauaugugacagguuuuugcguggauguauguguucauaucucuuggguauauacuuaggagcagaauugcuggcuuaagugguaacuauguuuaaccuuuugaggaacugccaaacuucaaagugcugcaccauuuuacauucccauaaguacucuaugagggguccaauuuccccacaccucucauagcacuuguuaauuuucuuuuuuuuuuuuuuugagacagagucuugcucugucgcccaggcuggagugcaguggcucaaucucggcucacuguaagcuccgccucccggguucacgccauucuccugccucagucucccaaguagcugggacuacaggcgccugccaccaugccuggcuaauauuuuguguuuuuaguagagacgggguuucaccguguuagccaagauggucucaauauccugaccuagugauccgcccaccucggccucccaaagugcagggauuacacgcgugagccacugcgcccggccuugccuguuuuuaaauugggcugucuuuuugaguuguaggacuucuuuauacauucuagauacaagucuuuaucacaucuaugauuugcaaauauuuucuuccuuguucaauauaguuuuuuuuaucauguuaaaaacuuuucagauaugauuuuuaguguuuucaucauucuuuuuuaccuccuuuuuuuuuuuuuuuuuuuuuuugagacagggucucacucuguugccuaggcuggagugcaguggugcgaucucagcucacugcaaccucugcaucccggguucaagcaauucuccugccucagccucccaaguagcugggauuacaggcacuugccaccacgcccggcuaguuuguguguguguguguguguguguguguguguguguguguguaguagaggcgggguuucacuauguuggucaggguggucucaaacuccugaccucaagugauccacccgccuugcccucccagagugcugggauuacaggugugagccacugcacccggcucuuuuuuacuucuuaaucagucuuauuuaaauuccaaauuacucagguaaaguaaaaguccauaguucuauuccauuccucuuccuagaaguaaucaccaguuuugaugaguuuaguuuuugauauuuucuauguauuuacaaaaugggcuccugcuguacguuugguuguguauuauguuuaaccauguauuagaucuuucccugugaauacguguacucugucugguuuucuuaacuucuauacaauauuccaugauauggauguaccauacuuuaauucaauccucuacugauaaacuugaggauugcuucuagguuucucccuauuaaaaacaaucuuggaaaaaaauucuuauccauaucuagaggagauauuuagaaguagaauggauggcuugaggagcuuuucaguauuaauagauacuaccauauugcccucccaaaauguuacacuuuauacuuucaccaguaguguauuaaaauacuaguuucucuguacccuaguccaguggucccuaaccuuuuuggcaccagggaccaguuuuguggaagacaauuuuuccacagaucugguuggggagaugguuucuggaugauucaaaugcauuacauugauugugcacuuuauuucuauuaugacauuggaauauauaaugaaauaauucuaccacucaucauaauguauaaucagugggagcucugagcaacuagacaaucccaucuggggguaaugggagagagugacagaucaucaggcuuuagauucucauaaggcacaugcaauuuagaucccuugcaugcacaguucacaguaguguucacgcuccugugagaaccuaaugccucugcugauaugacaagagguggagcucaggugguaaugccagcaauggggagcagcuguaaauacagaugaagcuuugcugcuugcucacugcucaucuccuucugugggcuccagucuguguccuugggguugggggccccuacccuaguccacauuuaauguaaucauuuaaacuuuugacauucagauuagggaaaaaauaaaucuuacuuuaauugaacaguuuuucucaugcucauugauugucauacuucugaauugccuauucaucuccuuagccuauuuuucuaaaggauuccuuauauucuuaacgaguuacagaagcccucuauuauccaguucauccuuuguaauauauguuacaaguacuuuuauuugguuacuugucuuuuugcucuguuaugaaaguuuuaauugauacuauuugaaaucuguccacuuuuucuuugagguuucugaguuuugugcaggaagacuuuauggauggugugagauaggaauaaaaacauuuuuuccucaauaacgaguugugccugucucauuuauuuucccuauuauaaacuuaaagauguuaguguuucuuuuacugugguuugcuuucaaggcgucucaaauauuuugauauagaauacuggauuuuugaacuaaaccucccugcgccauuuucuuuuuaucuuccccaccccccauuccgccuuacuauguuguccuggcuggucucaaacuccugggcucaagaaauccuccugccuuggucucucaaauggcugggauuagaggugugagcgacugcacuuggcuccaccauuuucuuuuuucuuuucuuuucuuuuuuuuuuuuuuuugagacggagucucacucuguugccaagcuggagugcaguggugcaagcuuggcucacugcaaccuccgccuccuggguucaagccauucuccugccucagcuucccgaguagcugggacuacaggcgugugccaccacgcccagcuaauuuuuguacuuguuuuuuaguggagacgggguuucaccauguugggcaggauagucucaaucucuugaccucgugauccacugccucggccucccaaagugcugggauuacaggugugagccaccgcaccuagccauggccccaucauuuucuuuuuuuuuuuuuuuuuuuuugagacggaguuucgcucugucgcccaggcuggagugcaguggugcgaucucgacucacugcaagcuccgccucccggguucaccccauucuccugccucagccucccguguagcugggacuacaggcgcccuccaccacgcccggcuaauuuuuguauuuuuaguagagacgggguuucaccguguuagccaggauggucucgaucuccugaccucgugauccacccgucucggccucccaaagugcugggauuacaggcgugagccaccgcgcccggcauggccccaucauuuucuauagcacuuugggaggcugaggcggguguaucacuugaggucaggaguucgacaccagccuggcaaacauggcaaaaucccaucucuacuaaaaaaaaaaaaaauuagcugggugugguggugcaugccuauaaucccagcuacucgagaggcugaggcaggagaaucgcuugaacccaggagguggagauugcagugagccgagauugugccacuacauuccagccugggugacagaguaagacuacaucucaaaaaaaaaaaaaaaaaaaaaaccgaaauugaggccaaaagaagguucaguuucucaagaagacacaguuagugucagaucaagaacuaaaauccaggauguuucucuguaccagacuucuucagagggcauaguaaaauugccuuauuuguggaauugugcugcuaaucuugcuuuuacaggcaggggaaaaaaagcauucuuguauugugaucaucaucuuccuaucuuggcauuuuucagagaguguuuuuguuuuuuuugagacugagucuugcucugucaccugggcuggagugcagugaugcgauuucagcuuacugcaaccucugccucccagguucaagccauucuucugccucagccucccaaguagcugggacuacaggugugcgccaucaugcuuggcuaauuuuuguauuuuuaguagacgugugguuucaccauguuggucaggcuggucuugaacuccugaccucaggugaucccaaagugcugggauuacaggcaugagccaccaugccuggcccagagaguauuuuuuauuuuauuuuuacaggcuacuuuauauaccuaaaauuauguuguucuaccuguucuacuuccagucuuaaaaauucauauacuugcacuuuuaaucuuacagcagcagccgcucuucuaaaacauucaaaccaaagaagaauaucccugaaggaucucaucaguaugaacucuuaaaacaugcagaagcaacucuaggaagugggaaucugagacaagcuguuauguugccugagggagaggaucucaaugaauggauugcugugaacaguaaguuuuaaaauguaacuuugcuguuuucuagaaagguuuugcuaaaaucucuuuguuaaugaauuuucuuuuacaguuagaacuguuuuaauauaacaaauuaucuguaaagaaacauuaaguacaaauacauccaaagcuauguugcucuuuucagaguacuaggugguaguuugugagguugaguagagggagcugaggagaaaugaugagugcuuuugggcaauuucuaagaagaauaguaugaaaagcugaguaaggucagauaaaagauugauaaaugaaaagauuaugccuguuguggucugugacuuuguagcaaauccaucuacaguuuuacuuccacucccagcaguacucaucagccugcauauccagaaaagucaauugcaguucauauggacaguugauuguugugacuuagaguggcagagggaauugagagauugggagaaaauggagggaucugagcugaaagucacuuuaaguucaagagaacaagugcaugacaugggacaauaugcuaaggcuagagauuugaaugugagagucucucauuucugagaugauaucauuucuggguaauaaaguuuaaauuagagauuucagauguuccaggaauaaaaaguuuaaauaaaaaguuuaaaacuuuuuauuuauuuauuuauuuauuuauuuuugagauggagucuugcucuguugcccagacuggagugcaauggcucaaucuugcuucacugcaaccuccaccucccggguucaagccauucuccugucucagucuccugaguagcugggauuacaggcacacgccaccacacccagcuaauuuuuuacauuuuaguagagacaagguuucaccauguugcccaggcuggucuugaacuccucagcucaggcaaucugccugcuuuggccucccaaagugcuaggauuacaggcaugagccaccacgcccagccuaaaacuucuuaauggaaaauuucaaacauauaaaaguagacuaaguacagugaauuccagguauucauuccauuacccagcuccaacaaauaucaguuugugaccaauuuuucuucuucuauaugucacccugauuauuuuaagcaaaucccagacaugauguuuuaucuauaaauauuucaguaagguaugucuaaaagacaagaacuuguaaagauaaugacaaugccauccuccuuuaacuuaucaaauaucuggucaguguucacauuuuucaugacugucccauaaauguuucuuuuauuuuuuauuuuuuuuuuauuuuauuuuuugagauggagucuugcucugucacccaagcuggagugcaguggcgaaaucuuggcucacugcaaccuccaccuccaccucccggguuuaagcaauucuccugccucagccuccccaguagcugagggauuacagguguccgccaccacgcccggcuaauuuuuguauuuuuaguagagaggagguuuugccauguuggccaggcuggucucgaacuccugaccucaagugaucugcccgccucagccucccaaagugcagggauuacaggcgugagccaccgcaccuggccaaauguuuucuuuuuaaaauuuuuuugcuuuaaaaaucuaugcuuuguuuaaaucaggauccaaagaggccuguguguaugcuucuugaaucucuuuuuuuuucuucagagauggggucuugcuuuguugcccaggcuggagugcagugacaugaucauagcucacugcagccucaacuucuggacucaagugauccucccaccucacccguccgaguagcugggacuacaggcucacaccaccaugcccugcuaauuuuuuuuuuuuuuuuugagauggaaucuugcucugucgcacaggcuggcgcgaucucagcucauugcaaccuccuccuccuguguucaggugauucuucugccucagccuccugaguagcugggacuacaggugcccgccaccacaccuggcuaauuuuucuauuuuuaguagagacgagguuuugccauguuagccaggcuggucucgaacuccugacuucagguaauccacccaccauggccucccaaagugcuggaaaaaacccagccaaaaaaaaaccuuuuuuaaaaaacuuuauucagggccgggcaugguggcucacgccuguaaucccagcacuuugggaggccgaggcaggcggaucacgaggucaggagauugagaccauccuggccaacaugguaaaaccccaucucuacuaaaaauacaaaaauuuagcuaggugugguggcacgcaccuguagucccagcuacuuggaggcugaggcaggagaaucacuucccgggagguggagguugcagugagcugagguugugccacugcacuauagccugggcgacagagcaagacuccaucuuaaaaaaacacacacacacaaaaacaaacaaacaaacaaaacuuuauucagauuaucaucuguuauucugaagucauuuauugaccuucagccuuagauuuuucuuugagacuuaacugcuguagaucagcaguucucaaauuuuuuggucucagauccacuuacccucuuaaaaaauuauugauucccauaaauauguaccauucuguguuaauuaaaaaaguaaaauacaagcugggcaugguggcucaugucuguaaucccagcacuuugggaggcugagguuggcagaucacuugaggucaggaguucgagaccagccuaggcaacauggugaaacaccagcucuacuaaaaauacaaaaauuugcugggugugguggcacacaccuguaaucccagcuacugaggaggcugaggcaggagaauugcuugaaccugggagacggggguugcagugagccaagaucgcaccacugcacuccagccugggcaacagagugagacccagucgggggaaaaacaagguaaaauacaaaaaauacaaaaaaaauuauugagaaccccaaagagcuuuuaauuauauuggguauaucucgugauacucuguuggaaauuaaaacugagaagauguaaauaguuauuuuuauuuuuuauuuucucucgagacaguaucgcccugucgcccaggcuggagugcagugucacgaucuuggcucacugcagcugccuccuggcuucaagcaguucucccaccucagucuccagaguagcugggauuacaggcaugugcuaccaugcccggcuaauuuuuguauuuucaguagagacgggguuuuggcauguuggccagguuguucuagaacuccuggccucaagugauccgccugccucauccucccaaagugcugggauuacaggcgugagccacugcacccggcccaaauucauuuuaaaauaacaauaauaaacccauuacauguuaccauaaauauguuuuuacgaaaaaugacuauuuuccauaacaaauuuuagugagaaguauggcauuguuuuauauuuuugcaaaucuuauuuaaugucuggcuuaauagacaccuggauucuuauauccguuucuguauucagucuguugugauauuacacaucauggagccucuggaaaacaccauugugcccucuugagagaguaagagugaaaagaacaauuaaaaugguuugaccuuacagauccucccucagauaggggauuccuggaccacguuuugagaauagcucuucuagaccaaaccaacuuccaccugggcauauuuuuuguuuugagugaauauugaauaccuaaguguuacuuucuuagaaacaugacuaagaggaagauuuauaagugagggaguuuuguauaaaauuccuuuuacaagauagcauuuuaaaaaaaucuauuuguuuuuuaagaaacuuggaaaauaccuaguuguuuuuagguacuucuuuagacaggagacuaaaacuuuuuauuuauuuauuuuuucgagacaggguuguccaggcuggacugcagugguacccucacagcucucugcaaccuugaacuccuagucucaagggauccuuccacuucagcguccugaguagcugggacuacaggcgugugccaccauggcuaacuaauuuuuuaaaauuuucaauagagaccggggucuagcuguguugcccagacuggucucaaauccuggccucuuaaagugcugugauuauaggcgugagccacugcaccuagccuaaaacauuuuuugaaacuuuccaaggcuuaugugguucucuuugcauagaguauacucacucaguaaaguuuauuuacucacccccugccucuuccauuuuauucuggaucuagcugaagcucccucaggaaguacccccugacuacuuccaacucuucaugacuuugccuuuucucuguagcauuuaucguuggccuuuggauccugucuucuuauaucuuguacuauuauugcuauuuuuauuuugagacagugucucugucacccaggcuggagugcaguagcaccaucacagcucacggcaaccucagccuccugggcucaagcaguccucucgccucagccuccuacauagcugggacuguaggugugcaccaccacgccuggcuaauuuuuuaaaaauuuuuguagagauggaaucucacucuguugccuaggcuggucuugaauuccugggcucaaccaguccuucuaccucagcuucccaaagugcugggauuacaggcaugagccaccaugccuggccauaucuuauauuauucaucucuuuuaauuuuguccuuucuguuagcuagagacuccagggcaggggacuuuaucugaaguauuuuguccucaguaugcuguagaccucaaaaacaaauguuuaugauuaauuagaucuuuuaaaugccucuggauacagcuggugcaccuucucccucacaguauauuccacaacauguuuugucucuuuccuaacacaaaugguauuaucugguccaaagugguaaacuauggauuuuucauucccuuggauguaaucauauuguauauccaaaggauauaauagucaucguuaaguuagaauuaucuccaguaucuuauuuuccugcuguuacaugcgaguggaucaugaggucaggaguucaagaccagccuggccaacauggugaaacccugucucuacuaaaaauaccaaaacaaaauuagcugggcgugguggcaugcaccuguaauccgaacuacuugggaggcugaggcaggagaauugcuugaacccgggaagcggagguugcagugagccaagauugcaccagccugggcaacagaacaagacuguuucagagaaaaaaaaaaguguaguauacuacaaguuacaguaucauuggauuauugaaugucucaaggguucagcuaagaaccuaaauguauugucuguuuuuccuucaacuggaggucucauauuuuguguuuacacagacauuuugacacaauucuauuaucucugcagcuguggauuucuuuaaccagaucaacauguuauauggaacuauuacagaauucugcacugaagcaagcuguccagucaugucugcagguccgagguacauauacugccuauuauauagguguuuggauuaguuuuacuuuaucaccaauugauagaaauuaaacaguuaagauuuguuauccguuugugugaaggugauucaguuuuauugguucuugacuacucaccuguaagcuuuuaguuauuguguaauuuuaaaauuuuauuuauuuugagacagagucucgcucuguugccaggcuggauugcagugugugauccuggcucacuaacaaccucugccuuccggguucaagcgguucucaugccucagccucccgaguggcugggauuacaggccugugccaccacucccagcuaauuugugcauuuuuaguagaaaugggguuuugccauguuccccagggcuggucucaaacuccuggccucaagugaucugcccaccucggccucgcaaagugcugggauuaaaggugugagccacugcaccuggccagcuauuaguuauuauuaaauacuuuaguauguggguacucccuguuuucauuuuuauguugcaucauaguaagucugaauguuuuauuauaggaauaaacagaaauuugaguuacauuugucuugaauugcaaacauuuuauuuuuucaauuuuauuaauaacauuuauguuuccuguuucuaguuuuuaaaugaauuucuuggaagaguuuuuaguugaucuuuuaauauuugauuauuuuuucuugugcuuauuuaguauuuaaagcagcacaauuuagaaguaauuaucuggcuugaagaugcuagauuuaaaaacauuuugacuuuaauaaauuucaagaaauacugaaaaagauggaacucuaucacucauaauauuaaguccaucauaugaugggauuaauguuugcuguguuuccuuccaguuucuuuuuuuuuucuuauaauaaaugacugauuuuaugugaugauagauguuaucaagauguuugcuucuuagaaaagauuguccuuucugacuuugcuacaaguguaaaggaaaaaagaucccuaaugaguuuguaguucuauuuuuauuauaauauuuuaggaagaauguuuuuauuuuauauuguguuaaguuuuauuauucaagcuuuaaaagaaaugaaaauaaacaggaaaauuaaacuuaccuauggcucaaaugcuuuacacagugauguuuuguauaacucuuguuaauccuucuagcucggcaaagguaaggggggaaaguaugcaugccuaauguauaucucuaacaccuggcccccaaaacagaguuuuauaaucuuggguccauugaugauaauaaauugaugaccaagaaucucagaagaauguaguggauccaucggcuccaugcccagcccucagcaaccuucugcuuuacaggaaugcaguuccuuuguguuucccagggcuguguuguuaauaaaacaucuauccuggcauugccuccugccacauuaucucccuuuuuucuuccaguuauaacugucacuuucuggauaauuacauagggaacucacaguaaucuucaguagaacuuaaggugauuuauuaaaguuagauguaacuucuauugacaaaaugugaaugaaccuguuuuaaucacaacuugcacauuuguuaauauuuuugaaaaauuuaucaguaaaacauuuuucucuucagauaugaauaucacugggcagaugguacuaauauuaaaaagccaaucaaauguucugcaccaaaauacauugacuauuugaugacuuggguucaagaucagcuugaugaugaaacucuuuuuccuucuaagauuggugaguuaacauugucgaaguauucuuucuuuuuuuaaaauuuuauuuuauuaauauaaauagaguuggggggguuugcuguguuguccagguuggucucaaacuccuggccucaagugauccuccugccuuggccucccacagugcugggauuacagguuugagccaccguauccagccuguuucucuuuuugaaugauaaaucugcucuuuuuaacauuguuauacuuguagagacugccaaauucuccuccaaaaaguuuguaccaacauguacuccccccagcccuguuuguguuugccaguguuucuucaccaacacugguuauuacucauuuuuuaauauuuucuaauuugguuaaauuucuguuuuaauaugcauuuaaaaaauguugaugagauugagcauuuuagccuuuuuguuuguuuuauugaucauuguguguuuucuguuuauaucuuucaucuauuucuguguaaaggauauuagcgcuuugucguauguguuguauaucuuuuuccccggguuaccuuuugucucauuuuguucauggaguauuuuugcuguacacaaccuuacuauuuuguccuauuauaucuuuuaugacuugauuuuaauauaacaauuagaaagcuuuucccugcuucaagauuauaaaaauauuuauucauguuuucuuuuuuuauuuuuuuauuuuuugagacagagucucacucuguugcccaggcuggagugcagcggcacaaucuuggcucacugcaaucuccaccucccagguucaagcaguucucaugccucagucccuggguagcugggacuacaggcacaugccaccaugcccagcuaauuuuuguauuuuuaguagagaugggguuucaccauguuggccaggcuggucuugaacgccugaccucaagugaucuaccugccuuggcaucccaaaguguugggauuacaggcaugagccaccacgccuggcugggaaguuuuuuuucccugaaugcuacauuaauuuuuuuccaaauggaaauacuagucaguuugucccauuaccauuuauuaaacacauuugccuuuucuccccugauuaucuuaugugcacaacaaauugccauauauuuuugcauguuuuagucucuuuaucuguuccuauagaaauuccacacguuggugacuguggcucugcaucuguuagcaucuuguaaggcuggucucccuuccucgcucuucuuuuucagaauauucacagcuauucugggauauuuguuuuuccaaagaacuuagaaacauuuugucaaggugaaaaaaaaauuagauuuuaauuaugacuauauuuaauuuuuauagauagggauucuuuuuacugaaucuuccuagccaagaacaagauauuguucauuuauucaugucuuuagcuuuauuuucucuuguaaaauucuguaguuuaugucaguuguucaaguuucuuaauuuuauucuagggauuuuaugucuuuuauugauaaucugguuuccagcugguuauuuaguauauaggaaagcuguugguuuuuauuguaauuuauuuuuaauuuuuuuugagacagggucucacucuguuccccagccuggagugcaggggugugaucacagcucucugcagccuugaucuccugggcuccagugauccucccaccuuagcuucccaaguaacugggacuguaggcacgcaccacuacaccuggcuaauuuuguuuauuuuuuguagagaugaggucucauuauguugcccaggcuggucucgaacuccagggcucaagcaucccuccuuccuuggccuuccaaaaguguuggaauuacaggugucagccaccaggacuggccagcuguugauuuuuauuuaaauuuuauaauuaaccaucagacucuuuuucuguuaguuuuugguugguucucuugaauuuuuaaaguauacaacugugucauauuaagauaguguucauuuugucucuuccuuucugauaauguauucuuguuuuuacgcuugcuuaucugauugcacugagugguauuucaagcgcaaugccgaguaauggugaugauggcagacauccguuucuugccuucuuacuauuaugcaaguacuucuaguauuucugcaguaagccgaaaucuuggcuuuugguuagagguguauggauuuuuaaaaaauuauauuaaugaaaaauauccaccauuuauauuacaaaaauuguucuuaacgaggaauggcuauagaguuuaucagaugcuuuuccaguaucuguugccuaugaccauaagguuuucuccauuuuuuaauaaaaauauucugcuggaagaguauuuguuaauauuuugauuaagaguuuggcaucaguauucauggaugaaaucacuccuugucauuuucaacuuaagaguauuuuaugagcaacauauuuuugaauuccuuuuugcagucuuauagaggcuuuucaggacaacaguuuuuuuccaaguuguuaacauuuggucuguuuguuguuggucaguuuuuccauucugcuauuaaaccuuuuauuuccuuucucauauaucuuuauuuuauauugacugugcuugaauauaucuguuaaauucagcuuggaaaguguuuagauuuaaacaaauuacuuauuucuuuacucauuaaagucucugcuuauggaagguaaauaauucuuuugauuuauccucuuuucucucuuuuuuguuuggagacagggucucacucugucacccaggcuggagggcaguggcacagucucggcucuacugcaaccuccacuuccuggguugaagcgauucucgugccucagccuccaaguagcugggacuacaggcgcccaccaccacaccuggcuaguuuuuguaguuuuagguagagacaggguuucaccauguuggccaggcuggucucgaacuccugaccucaagugauucacccacuuuggccucccaaagugcuggaauuacaggcaugagccaccaugccuggcuuuuuucucacuuucuuguucuuaaauaauucauucugauccaccaccucuuaaucccacuccccugccauuaggcuauuaucugcaucuuacuuuugccaguuauuuagucucagacagaacuguuuaucauuaauuuuuuacuaauauaugcacauuauuaauauccuuuuauuagaaagaugcccauuuauacauucugauaaaaaaagauguuugauuuugaaaucuacuuuuuuuuuugagacagacucucacucuguugcccaggcuagagugcaguggugcaguuacagcucacuguggacuugaccucccaggcgcaagugguccuucuacaucagccacuugaguagcugagaccacaggcacgugugccaccacgcccagcuaauuuucaauuuuuuguagacacgaggucucacuguguugcccagacuggucucaaacuucuaggcccaagcaaccuuucugcuucagucucccaaagagcuugagauuacaggcaugagccacugcaccuggccagaauacugcuuuuuuuuuuuuuugaggcggagucucacucuguugcccaggcuggagugcaguggcaugaucucagcacacugcaagcuccgccucccggguucacgccauucugccauucuccugucucagccucccgaguagcugggacuacaggugccgccaccacgccuggcuaauuuuuguauuuuuaguagagacaggguuucacuguguuagccaggauggucucgaucuccugaccucaugauccgcccgccucggccucccaaagugcugggauuacaggcaugagccacugcacccggccagaaaucugcuuuuucaauacaugaauacaagauccugcccaggaaaacaugccuguaagcuccaggauaaugucugaaaagucacguuaaugaggacugggguggugguggagaauaaccacaaacaucagcaaaauaaguuucagguuauugagaacuggcugggaaaaaaaugcaaggaaagaguguuuuaagccuuuguuuucugaaaaauugaaaaaaagaauguguuucaagaguagcguuguggaacaggccuuuaaggccaacuaauguagguuuauuuuuauuuuuauuuuuugagauggagucucacucugccgcccagacuggagugcaguggcggcaaucuuggcucacugcaaccuccgccuccuggguucaagcgauucuucugccucagccauuugaguagcuaggauuacaggccuuagucaccacgucuggcuaauuuuuguauuuuuaguagagacaggguuucaccauguuggucaggcuggucucgaacuccugaccugucugucccuguuuucuaauggacuuugauauugucagccaaaauucucaggaauguaaccaguuggauccccaucuccacugcuuggaaggauaccaaacucuacccccguuguuuucuaaaaagagauuucuuuuuuuuuuugagacggagucucgcucugucacccaggcuggagugcaguggcgcgaucucggcucacugcaaccuccaccucccggguucaagcaauucucugccucagccucccgaguagcugggauuacaguugccugccaccaccccuggcuaauuuuuguauuuuuaguagagaugggguuucaccauguuggccaagcuggucucuuuggccaggcuggucuugaccuccugaccucgugaucugccccccucggccucccaaagugcugggauuacaggcgugagccacugugcccggcugccuuuuuauuuugcuuaggagaguuuccaguccucauugagagagugcguauguauguaauuucuucuuuuuuuuccuaagggaugagguuuuaccuuguugcucaggcuuaucuugaacucaggcuuaugagcucaggcaaucuguccacuacggccucucaacgugcuggauuacaggcacgagccaccacacggagccaguguaauuucuuuagaguuacaaauuacaaaguaaaaauauuuaugaucaaaauacuuacucuuguugcauuuaauuucagaaagaaacucucuaauauuaaagaacuaaaucccaguacuuugggaagccaaggcaggcagaucacuugaggccaggaauucgagaccaggcuggccaacauggcaaaaacccaucuguacuaaaaauacaaaaaucagccagguguaguagugcacgccuguagucccagcuacuuuggaggcugaggugggcagauugcuuaagccugggagguggagguaacaaugaaccaugaucaugcuacugaacuccagccugggugacagagugaggcucagucuccgggguggggggggggacaaaaaacaaaaaacuaaaacuacaggauuuuugaacuuugauuuagcagcaucuuacauaauuugauaccugugccuaaggcagucagaaaaaagugugguacuuugugaggauugggguuuggguuuucauuuccuuggcuuuaaaaaauauauacagagguagguuuguguguauuuaugaauguguguguuuauauguugcaggugcucauggcaguguguaaacuuucugcuguuaggcugggcaugccuguaauccuagcacuuuaagagguugaggcgggcagauugcuugagcucaggaguucaagaccagccugggcaacauggcaaaaccccaucucuacaaaaaauacaaaaaauuagcugggcaugguggcguguagugcagguuauuuggggggccaaggugggaggaucaguugagcccaggaggucgaggcugcagugagcugagauugcaccacugccugagugacaaagugagacccugucacaaauaaacaacuuucuacuguuagauaaccaaauaauuguuucauauguguauuuaauugcaggugucccauuucccaaaaacuuuaugucuguggcaaagacuauucuaaagcgucuguucaggguuuaugcccauauuuaucaccagcacuuugauucugugaugcagcugcaagaggaggcccaccucaacaccuccuuuaagcacuuuauuuucuuuguucagguaaguugauccauguugauuucuguguccugugacuuggacuuauuuggauugggaacuucaacaaagagcugugugucuuaguuauagauguagagccaauuacaggcaagcuucucuuuucuguuuuguucucuuuuccacauuauuuauuuuauugaugugugcagcaguauaaaaagguaucacccccauuugggccuucugccucuggccacccuaggucugugguuaggauuauccauucaggguuguggccuguugcuuuguggacccuuagucagaauuggaacuuuuuuuuuuuuuuuuuuugagacagggucucacucuguggcccaggcuagagugcaauggcgugaucuuggcucacugcaaccuccgccuccuggguucaagugauucuccugccucggccucccgaauagcugugauuacaggugcccaccaccacccccaacuaauuuuuguauuuuuaguagagacgggguuucccauguuggccaggcuggucucgaacuccugauccacccaccucggccucccaaagugcuggaauuacaggccugagccacagcacccggccagaauuggaacuuuaaaaaaucaaaauaauucacauuguuugaaaaagauaucaaagaauugguaugccuuuagccuaacuuuagagauacuuauauuuugcauauugaauuacauauacaugucugucuagauauuuuaugaugaaaaaaccugguagcuuuauaguagauacuguguauuauaguuuuguguacuguaccaugcucuuccugaucuuccuucucagauuguugcauaaaaggucuacuggcccuuuaucaaaaauucaguuuguaguuuucagguaguuucuuuuuuuuuuuuccccccucuuuuuuuuuuuuuuggagacagagucuugcucugucgcccagacuggagugcaguggcacgaucucggcuaacugcaaccuuugccuccuggguucaagcaguucuccugccucagccuccucaguagcugggauuauaggcaccugccaccacgcccggcuaauuuuuauguuuacuagaaaugggguuucaccauguuggcuaggcugaucucgaacuccugaccucaaaugauccacccaccuuguccucccaaaaugcugggauuacaggcaugagccaccaugcccggccuuuuucggguaauuuuaauguaaauuuaaauauauauacaguuuugauuuuaauguuuaacacaaugaggaucauacugauaccuagaguugguucuuuaauaagucucccauuguaaaaauaugggaaaaaacaaacucccuuuauccuacuauacucucaccacacagaacgcuucugugaccaaacauggggacugucccucacacaccaagcaagugaucauuucuacaguggacaccagaugaauguccuauaauuugauucaauuuugauaaugucuaucuggagguagcaucagauccuacaaguuugagagcucagucccacaagacugccccccauuugggauaucaaucaaaaguaauacauugucaccuauaccucugacuauaaaccaggguucccacaacccccuccuuggguuugauuaguuugcuagagccgcuuauagaacucagggaaauacuuaucucuaccuguuuauuaugaaagauguuaacaaaagauacagaugaacagccagauggaagagauguguagggccaaaggagaaggggcuuccaugcucucuccaggcaugccaugcuccaggaaccuccacguguucagcuaucuggaagcucuccugagcccuguuuuuuguguuuuuauggaggcuucauuacuugcccaugauugauuaaauaauuggccauugaugaucaacucaaccuucagccagcccuuuccccuccccagaggcugugaucugggaaggggagagggcuggcugaagguugaccaguucccauccugaagcuuuauaggagccuccagccaccagucaucucauuagcauacaagauacucuuagcacucuggugauuccaacaaggguuuuaggagcuguguguaaagaaaaaggaagaccaaauacuuauaucacaauaucauaccuauauuuuuaaaaagagagggcuggacgugguggcuuaccccuguaauccuagcacuuugggauuugggaugccaaggugggcagaucacuugaggccaaaguucaguaccagccuuggcaacauagaccacaucuguacaaaaaagaaaaaaaaaagaaaaagaauaaaugccuacuuuaaaauguucacagagguuauuucaucauucuuuuggacuucagaaaacuagaguugggaaucccuucuccaaaagacauuuacagaguuucaguuuuagauccauuuuuaauuguuauuuuucuucucuuuuuaggaguuuaaucugauugauaggcgugagcuggcaccucuucaagaauuaauagagaaacuuggaucaaaagacagauaaauguuucuucuagaacacaguuacccccuugcuucaucuauugcuagaacuaucucauugcuaucuguuauagacuagugauacaaacuuuaagaaaacaggauaaaaagauacccauugccugugucuacugauaaaauuaucccaaagguagguuggugugauaguuuccgaguaagaccuuaaggacacagccaaaucuuaaguacugugugaccacucuuguuguuaucacauagucauacuugguuguaauaugugaugguuaaccuguagcuuauaaauuuacuuauuauucuuuuacucauuuacucagucauuucuuuacaagaaaaugauugaaucuguuuuaggugacagcacaauggacauuaagaauuuccaucaauaauuuaugaauaaguuuccagaacaaauuuccuaauaacacaaucagauugguuuuauucuuuuauuuuacgaauaaaaaauguauuuuucagua

SEQ ID NO: 191640 - RNA, 103301 nt, Homo sapiens
ggcgcgcaugcgugcagcucuuuggaggcgguagcguuuucggcgucgagacuggaggcugagugcuaaacuguguggggcgcggaugggauccagcuguuagucggguaggcauagguaggaccgcugcccuguggggaguaggggguuggaaggcggaggccgguaucguggggguccugagcccuuccugugagauccgggccgacuauuguaucugugucgcagcggcuccgcacaaaauggcggcgggcagacggcgggggcgggaggagguugggggacccccgggaugggaagggaagcugugcugugcugcccugcuccgucguuuauucacuucgcuacccgggagggcccguccggguacucgugaaggacccugccucgagaagagcugccugacgccguugcacugggccgaggaucgugaagagcccuuuggcgaggccgaggcggccccuuccccagcagcgcccggccugccgaggcugcgcugggccugacagccgaggaagcgguggugagggaaugccgagcagggaggaagcguucccgucgggcccgaagaggcgguggaguuugagccgagcccucugaccagcgacauugugcaagaagcguggagagaagagcguguuuguguuugggguuggggagggggugucgggaugaaggagggaauguuaggauccagcggcuuuuccgggcugguguucugugcugcguagugcagguaugaaaccaaagaaaauaucaccucugugggagacugaggacucauaaaugguugugauaccuaacaguauuuccaaauuucucagaggaauugugaaaacagaacguuagugaauuguuuuugugugauucuuagcuugggccccguucucuuaaaggaagggggaauguauauaucacagacuggaauccuugagaacguuugaaauagaucuuuuguuguuugagguaauuguuaaugagggauacuucaguauuacaaaaucauggauugagcuauagagugaaggcuaccugaagcuaauuuuucuuaaucuuaaaauuuguccuuaggcgaaguuuggggccaggaccagaaauuguaguaguuuaaaggagucccgaugaaaaacuugucaccaggauccagcgauuuauguucaaguacuuuuuccaacgagcucuggaauuuugcacaaaaaauuuucugcuuuuuccccucauuuguuguaaaggauuauuuuuucagggauguugugcuugcugguucagauuuacaauuaaaaauugauaaccuggagaaaaggauugaccaaaaaaaggugaauuuaaggaaguuuucggagaaaaacaaacauguaaaugacauucaaauagcuuuaaauuuuguuaaugauuagacauuugagacuuaguggacuuauguugcugucuuuuaaaaaaguuugacagcauuuuauauuuuauuuuguacuccauauucuguaauauguacuucuaaauaauuacagggcgucccagcauguuauacauuaaaauaugcugggccauuccuuccuuggggauuuauuugucuuggaaccaagaaaggguaaauauaacaguuggaagaaaucacaaaaucuuauucguuuuuauuaacuaguuuucauaauguguuuauggucacauauuuauuguauauugguuguauuuguuuuguaauccuuuuuugcauuuuguuuuggaggguguauacggcagguacucuagguuaaaaagguuuagguacuguaguuuaaaaaagucaucacuuuguacuugacuaucuuaggguuuuucuugggugcucuuaaguaggugaucuccggaaauuuuguuuuuauguaaguggaagaaaaugagacaaguaguuuaguggaaagagaauaggcuuugcagucggaagaucuggauucacaucucccuuuuccucaguaugugugagacuuugguaaauuauuuuagucuuucuugagcuuuuguuuccuuaucucuaaaauggugacauuauuacuuccugcuugggauuuuugugagugacuguuaagugagacaguguauggaaagcucguauuccuuggcacauacuaggugcuuaauguuagcuguuacuuguauuucaaaauugaagugcuuaggcagcauuguuugauagaaaauuauaaucuguggguauucucuucuaauuaaacggcuuaaaaggauuuagaguaauagaauuuuggaguugaaaggcccucuaaucuaacuuucauuaaaauauuuugugcuucuauaaacuuuuuacaugccuuucuuguagaacuuaucaauauauauuguaaccauuuauaugauuguuacguuagucuuuguaucuuucccagugccugguauguauuagaugcucagauguugagugaaugaacucagcugguagucaccagagccuggacucuaaaucaugcucuuuccacuguaccuuaauguauacugauuaagguuuggacuaaauuuguccaaauccuuaauaaaaugccuuauauacuuagaaacaguacuuccaguauugguacccaguaacauagcuugggcuguuuugcaaggaaacaggcgcuaaugaaugcugccauguagugguuuuagagacucuccaaauugaaaguaauuauguuuguggcuaaagcuaauaagcccucauguguauccagcuuaucuacucuuaauugcuuuaacuuuguuuaguguuuugaaauuugugauggaaaauuaaaauggaaggaaaauaaguauauagaagaugagaagagaauaauggaaaggaaaaagagugaggaaaaggugagauguagaaauaaaacacacaacuguaauaaugcgggugagggccgggugcgguggcucaugccuguaaucccagcacuuugggaggcgaggugggcggaucaggucaggagaucuagaccauccuggcuaacacggugaauccccaucucuacuaaaaauagaaaaaaaauuagccgggcgugguggcgggcgccuguagucccagcgacucgggaggcugaggcaggagaauggcgugaacccgggagguggagguugcagugagccgagauugcgccacugcacuccagccugggcgacagagcuagacuccgucuccaaaaaaaaaaacaaaaaaaacuccggugaggguuaagaauaauaaggguuuugguuugaaaagaaaguccaggguuuugguuugaaaagaaaguccaggaaacaggagaaauagcuuuaacguacauuauguuuuuuugcuuuguuuuugagacaggaucucacucuuucucuaaggccaccaugguucccugcggccucuaccuccugggugcaagcgauguuccugccucagucuccugaguaguugggacaacaggcacacguccccacacuuggcuaaucuuuuuuaaaaaaauucauagagacaaggucuugcuguauugcccaggcuggucucaaacuccuggacucaaaccauccucccaccuuaacccgccuaaauugcugggauuacaggugugagcuauugcgcccagccuguuuucuucaugguuacccuaaggaacauauauuuuggauuauuuuuuaauucuuuugaaccaaaauauauuuauuguucauucaaguuuuaaaaaaaauuuccuaucuuauuuccacagucgguuaaacuuuuagcuaacuugccuauugucucugcugaguuaaaguugccaacuuuuguuuuaaauauuuuuaccaaaaaaaaagaaacaaaaccauuuuacuauggaaaauuuuaaacauauacaaaaguagagagaaugauacuaauucauucaugugccuguccaguuucaauuaucuagcuaauggucagucuuguuucaucucuacuugcuuauuuuuaaacaaaugcuucuaucaguucaauauauaguucagaauuuucucuagaguguuuagaagaaaacaugcauauuacacguaaaacaacaguaacuaugaguaauuaauuuuaaugucagauauucagacagauaucaaauuuccccaguuguaacucacuaccucccacccccaugcauaugugguaaagguuguuggagucaggauccaacuaauguucauaauucauuuauaauugguuacgauugauaacucucaagucuauaaacuccccaccuaccuuuucuuagaguuuacuugaagaaaaacuuugcuuuuuauacauuauuuagauaaucuuuugcuucaucagcaucugaauucaugaauuuugaugugacuuuaaaaauguacuugauaaggccggggcacgguggcucacgccuguaaucccagcacuuugggaggccgaggcaggcggaucaucugaggucgggagcuuaagaccagccugaccaacauggagaaaccccgucucuacuaaaaauacaaaauuagcuggggugguggugcaugucuguaaucccagcuacucgggaggcugagguaggagaaucgcuugaagccgggaggcggagguugcggugagccgagauuugcgcccuugcacuccaaccagggcaacaagagugaaauuccaucuccaaaaaaaaaaaaaaaaaaaaaaaaaaaaccaaaaaaacacaagugcuuguuaaacaaauugcuagaucucaauauaggaaauacugaaagaaagguggauguaagcaauuaacuccuaugucuaauauaauuuucaaaaauuacucgucuuacuaaaagaaagaaacaccuauuaagcauuuuguuuacuguugagcauuuuuugagcaccuguugcaugucaggauuuacaauuuuaguuaaucuucacagcagcauucccaauggguacuguuguuucauuuucacaggaugaaacaggcuuggauuaaccagcuugcuccggguaacauuguuagcaagcagugggaccagaguuauuucacaggaugaaauaggcuuggauuaaccagcuugcucaggguaacauuguuagcaagcagcaggaccagaguuaaaacacugaauguagggucuaaguucuuaaagacugugcugcacuaccucucuaaagcugaauuaguagugcuaaauuuuacuuaaggaguuaacuaauuuugcaugaagucauucacuggcaccccuccuagcaggguggguaucuucagaucaguggaaauuuccccaaagauuagauuauuauggauugcauaauaggcugacuaacagucaauaguuaggaagugaacaugauguagaaaagaagggccaaauccaaaaauguguuuaaggcugaugcucuuuauuauacugcagguuuucugccucuugccauauugccuauaguuuuuuuuuuuuuuuugacuuuguauaaaguaagaagaucacauaguccaauguuggacaugaaauguugugccauuaacuauauuugaaugaauuuaagugacagguggugggggaguucccugucuccugcauauaugguuuuuucccgaaaaguuugacauuaaguugcauauauugugguccuuuaucucuaaauacuucaguguguauuuccuaaaaauauuuucuuucacagucauaguuaccaacuucaaugaauuucacguuuauaaaauccuuuuuuauuuuuuugaggaagugucuggcucugucaccuaggcuggaguccagugagugaucucggcucacugcaaucucugccuccugggcucaagcgauccucccaaguggcugggaguacuggcucaggcgcgcaccaccaugccuggcuacguuuuauauuuuuuguagagaugggauuuugccauguugcccaggcuggucucgaacuccugagcucaagcauuccaccugucucggccucccaaaguaguaagauuacgugcaugagccaaugcgcagccuauaaaauuauucagucuacuauuuguauucugguuuuugucaauugacccaauauuguuuuuuauagcaguuuuuuuuucccccuccaguacaggacuaaacuaagaucagauguugcauuuaguuguuaugucuuuuuaaucuuccuuagucuggaacauuuccauagucugccuuuaucuuuugugaaguugacauuuuugaagaauacaaucugcuuugcuuuucucuuuaauagagcacuucucauuuuggauuuaucugauguuuccucuugauuagauguagauuauaugucccugggcagaaaaaucacguaacuaaugcuauguccccaggauaucagaucuggagauuuaccauuuccauuugcccuucaugcaugauacuaugugugagcauaugcuaugguuaaagugcuuguuuccccccacucccccuggaauuaaucucuggagagacguuuuaagaccaugcaaauauccugcucauuagaauuuaccucuguaacacccacucaugauucuuaccugaaccauccuuuacuaugaugguugcaaaaugauuuucuacuccaacuguuauucuacauuuaguaguagguacucagcacucuauaagagcuucccuucuuccgcauugauuaauuuauugcuauguauuuauggacucuguuuuuuccaguguuugauaauuuauuacucuucaguucuuucuugcuuucuccuauuuccuauuuguauuucuugucuuucacaaugaaagcccuaaguuccuagcaccaucaaaacauuuacuuacuugcucaaacuuaugauguaucuaaaguaguuucagaauugcuucauccauaccacuacaaaaaauaaaauuacuaaaaagagugaaaauucguuauucuucucuuucccuuagcuccaucaaaacugagguacauaaaucguuuuuuauuuauuuauuuuccuggggggcuguaacacucgggguguggccuccugugagguacauaaauugaauagugguuuauaaguucuuggauuaguuuucuuuuuccccuucaauguauugugguaugcauuugaaauaugauuggauuaguuugcuuucaguguuagauauuuuucuccaucccauccuuacugauuuuaaaaauauauguaaauuguuaacauguuuccaaagguuaaaacuguauaguaagaugcuccuugaaauaacauuaccauaucccuucaauccuuucuauccauuaccccuuauagauuaccagcuucaucguuuucuguauuauucuuccuuuguuucuuugugcuaaccauaaagagguauauguauguuuuccuguuuuccuuuuuuguuuaacacaaaagauggcauacuguaugcucaucugcacuuguaaagacuucaaggcuuaaggcuuuuaaugcauuuagucgguuuagguuuuuuuuuuuuuuuuuuauugagacggagucucacuugcacccaggcuggagugcaguggcaccaucucagugcacugcagccuccaccucccaggugcaaguagauucuccugccucagccuccugaguggcugggauuacaggcgccugccagcacacccggcuaauuuuuauauuuuuaguagagacaggguuucaccauguuggucaggcuggucuugaauuccugaccuggugauccgcccuccucagccucccaaagugcugggauuacaggcaugagccaccgcgcccggccaguuuagguauauuuaauugaagauuuuagaacccacuuuagguaaauggaaacauuuuuuggccauguuacuccaugaagaaaagcaaauaaccaaauggcagagagggcaaggaugaguuaggcuucagaaacaauugggacuggauauugaauaccuucauuauugucuuuacuucuuggucuugcuuaccucuguuccaguggcuuuuguuguuguuguuguuuuauggugcaguuucucaguaaagcaguaaauagggcuguuaacagcauuugaauuuuagaaacaucuaccacuuuucucauuucuaguuuaacaaaaaauccuagggaagauuucuuuguuccagcuuggauaagguguuuccucuugggcuaaccuguuacacuuacuaggaguguuuagagcaaggccaccagugcacaucugcgggggagcaucauuuacaauaaauacaauguugugcucuagaggccuguuuacguaugcaggucacaugcuccuaagaaauaaaaagguauaucuuacaauagcccauuuaucaaaaaaucauuuuccugaaauugguaacaauauuaaaucauugcuauaugggauuaaugccugguucucauggagaucucuuaacauugugcauuagcaguuuuccauuuuuuuucaaaucugaaaucaugguguuuaucaauccuugcaguuaguagugaaauuugguguugcccuucaugaugccaaauaacguuucuaauuuucugcuuauuuuugcuuucuguuucauugacuguuucuuugaaggcaccacauuuuggcauuuuaacgugaaacaugguacucucugucaacacuuguggcacccucagaauuguuacuugcaugccuuuugugagacaagagaggacaaagacuaauaguaaagaaguuggcugaguggcuuuaucugcgugguaggagagaucagcagauugaguaccaggaaagcacagaaugacauguuaguuuuuauagcugaauaaacaaucagccucuucuauuaacuacccauuguaauaacugcauucuuaaguaccaaagugaauuuauauauucugagacaaacagugcucuaacaaagcaguaucaaaugagguauauggguguaugucuagaaaaauaauguuagugguaguuuucccuuugugggaagauuauagaauacuuuuuuuucuuuccugcauguuauagggugguuuuucuuuuuggggggcggauuuugaaacuguauugcuuuuuuaugauuagaaauaaaguuauaaaguagauuuacacuuaauguaucugguauauggaaagaacaccaaugggagauguuguaaucuuguuacuuccuagcuguguuuuacuuaaugugugaacuggaauuccuuuccucuuaaggucauugugaagcucagacgagauaauauuuaaagugcuuuguaaacuuuaaaguaguguaaguccaaaaguaugguguuugauauaaaucuuuuccuuauaagucugauggagccauuaucugauggauugauuuuugaugaugguuuuggauaaagucugcccauaucuguaaagaaaauuaagggcucccuuccuucugaaagacugcaucaaaauaauaggcaguucuugguugucugugguauuggagaucucagaaauaccucacaggaucuaauagcgcuaucuuuucaauucaucaagccguuucaucauggcuuccucaagaacccaguuucuacuauguuucugaaagaauuuuuaugguugacauuauauugaauauuucuuguuuuacagugguauguuuuaguucuuaaaaggacauaaaugagaguuauuaguuacuuguuaaaacaguucaaagguucagcauguuuugucacuauuaaguauccaguuuuugaaaaauaguaaauuuagaaaaauaaaaugucaacugaaaagagcaaauaguauacuucuaauuuuguacaguguuuaauauaccccacccccccaucaugcgugcaugaacguacacuaaaguagaugaaacuauaccagaguauuaauuuacucugggugaugguuuuauugguaaggauuuuguuugcagcuuuauuguuucuguaacaagcacacauuacuuacauaacuaggaauaaaacauuuauuuuaaaggguuaaugcuacuuaauugcaguuuuuuccccaacaaguuaauaguuaagaacccugaucucaacucuucguuuuuccagguuauuuauuucauaagaugacuauccauaaaucuuccgaugaacgaaccucuuuaugaccagagcuccugggguuaaaggagaaagguuuuauaauggcugucuuaauuuguuuggugguuuuccagguauuaaugccaaauuugccuuuguuuaguuucuguuucuuaucacacuguuuucagguuacaucauuaucuuaaaaaggcagaggcuuuauuuucuucguugugauauaaccuaauucuuagagguuucuuaccaagaucacuuugcuuguuuugcuuaauuuuauuuucuaaauuuuacaaauuaauauuuuccaccaaaagguggaacgaaacaaagacagcaaaauaucaaacuguuuaguaauaguuaaaaaagucaagugggaaggaagguugaggcugaggcaggagaaucgcuugaacccaggagguggagguuucagugagcugaggcugcgucacugcacuccagccugggugacagugagacucugucucaaaaaaaaaaaaaaaaaaagucauacuaauauuuaggacuuaaacuuuuuauuuuggaaaucuucagaaauguaaaaaaagcacagauaaauucuuagggacucagcuuccacaaccaguauuuuuacgugucuugcuucaucaaauucccuucaucuaccaccaccaccgccccuugccccacuacacauguucacucuuucccucaccuccgcccagauuauuuuaaagaaaaucucagacacauuauuuuacucauuaagcacuugagccuguaacuuuugccucuuuuugccagugcaucugugaaucuacauagguaacuguagauuuaaaguuuauaauagccaaagaaaaggcauugggaugaugaugguggugagaggaaaaagaaaaguacauacgagaaguauugacaggaauacacugaauuuuauaguuagaaauggagauuuuugugcgugcgugugugugugugucuuggcaauuugguaagggaauugguguagagagagcagaggauugaaaaagccacuaaaaacaguagcugacauauggcauaagggauguugguuccuaacacuuuuuuucugucuucauagcugacgucuaucaaauaguccugagggugcgaagacuaauguuuuagcugaagcuauuuuuuuuugucuugaauauuaugccuuugucagaaauauguaguuaauaaguuauaauuuacuuuuuaucauuuccaguacaacugucuuacaguauuuuauccaaagacuuuaggauacuccaaauuuuugaaaauuugauaaacauguuuaguaagacauuguuauuugaaaucucauuuguacuaguuuccucaaaacuguagaagaugccauccuacaaaacucaauucaagcauuucugucuuccagaaauccuuuucugauaccucagccuuguuauaauacugacaaacguuacugaaauuuguuuuuuuucuguuagauuguuggcacuuuggcuauaggaacgcaacuguauuuuauuuggcuuugaaacuaaaaaguagccuggugacugucauguuaggcucucagaagauauuuaauacauugagugaauaauucugagcuuacuccuuuccacuaaaaacaaaaaggggaaaaagaagggucuguuaggauguaucuccucaccccaccccacaguggcaugcaggauuuagauggaaacuuguaagaaggaaauuugugaccuacugucauucccaauuaaauguuccugccugccaauaaguaaaacagaaacaacaaaaaucaguguuuagcaaaauugagauguauggaagugaucgaguagaaggcauuaggcauguagcaguguaggagagccaguagcuaaaaauuaaauggaauagaagagagauuagauugucuccuaaccaugugaauugaggccuuaaaaauguagauucugacaccccuaaauagaauuucuuaaccuuuuugggucauagaccuuuuugacaaguagaugacagacucuuauaguuugaauuugaauuuucugcuuucugcuccccucuccccaccaaaaaaacucacguuuuccuguuguaucacaccaucuccuguuaaaauuaacagcuugccgccaggcgcgguggcucaugccuguaauccuggcacuuugggaggcugaggcggguggaucacaaggucaggagaucgagaccauccuggguaacauggugaaaccccgucucuacuaaaaauaaaaauaaucagccgggugugguggcacgcaccuguagucccagcuacucaggagggcgagacaggagaauugcuugaaccugggaagcggagguugcagugagccaagaucacgccacugcacuccagcuugggcgacagagcgagacuccgucucaaaaaaaauaaaaauaaaauaacagcuugcccucuacuuuuaguauccaaauucugaaacucucuccaacccagaauaauuuuccuaucuuuuuuguauggauucugauucuggucauuaaaagccuuuacguaguagugucccuuuuucugagggagauacguucuaaggaccugccaguggaugcugaaaauacagauguacuauaguuuauuugaccaguuuccagucucucugcaagcuuuuauaauugcagaagcaugaaaagggaaguuuucaagagauuucuaacuauauauuguaucauuuugguuacccuaauuucaugagauacuagcuccaucuuaaaaaguagaguguuagcuauaugaaggagagaucuguucuggcuguaauaucuuuggucaguaauuauuuuguaugaauaaaggcugaauuugaacuuauucucuagauuuauugcuaagaaaacuuucucaaaauuucuugggaguacuuaacauuuaaaaaacugucuugaauggccugauacuuaaucuuguaauuuuauucccuugaauugauugagaaggacauacauaaaaguuaagugacaaaguagaagugcuguugguggggcaccuaaguuaaauuugaaaaaauaaggcuucagaauuauguaauugcaaaaggaaacuauaauaccuuauaaauagaaagcuugaaguauaaauaacaagcauccuuuuaguuaaaacauuuuauuuggaguggauaugaaugguagaagacaaacuuugcuaaaugauuaaaaauguagcuaaccuuuuuaauuaaaagugaaaauugugcaaaugaaauaugaguauacaguagucuccccuuauccauggcuauacuuucugcaguuaguuaccuguagucaaccaccauccaaaaauaggugaguaugguaugagaaugacauuuugagagcaaccacauucauaaaacuuucauuaugcuauauuuuaauuauuuuuaauuguuaaucucuuacuguagcugauuuauaaauuaaauguuaucacagguauggauauauaggaaaaaacacaguauauauaggauuuaguaccaucuaugguuucaggcauccauuggggaucuuagaaugcauccaccucagagaaggggugaccauuauacuccuuaaauuucauucacaaagaaaaggcaacauaaugcuuacuuuuuuuaaccauugaagauauguuauuuggcauauaggucauaggcagauauuuuauuuauaugaauuuuuugagacagugucugcuuugccaccuaggcuggaguacagugguggaaacagcucagugcagccuugacauccugaacucaagcaguccuaccaccucagccuccugaguagcuaguuggaaaaaaccaacaugcuugguuuuuucauuuuuguagagaugaggucucaccauguugcccaggcuggccucgaacuccugggcucaaagcaguccuccugccuuggccucccaaaguauugggauuacaggugugagccaccuguauuuuuuuuuguagagacaggauuuugucauguugcccaggcuggucuugaaccccugggcucagagcagucggccugccuuggccucccaaagugcuaggacuaccggcgugagugagcuaccucaccuggccucucauagacuuuaauaugcuaauagacauuguuccccucuaaaaggcaaguaugguggccuucaaacuuucuuggccaggcaacaucuuuguagaagaccacucuuagaguacucuaguauucuggagaauacaguuugucaggggcaguugucuuaaccuucuauaaauguguacuugaaucauuguaaugcaauguugggcacauuaggaaauacacaguacauuuuugccuuuaaggaauuuuaaauggagauuguuccaaaugauacuuauucacaauuccauuuaguaauuagaucacucugauugaaauuuguucuuuugcuguuuuauuuugggggagaaacauuauuugaaagagcuugugcuuaugaaguuauaagaggagucuucaccaaauggaauaagugguucagaaagcauuguaauaacuacaugauaaacugcuuacauaagcaaugcguaucuuuuaggauugggugaagacaguuguuuuuggaagauauuuuauuauguagaagguaggcacaauuucauaugauucaugauuguuuaaaaagaccgugaguuuguuacaaaugaacuuuuuaacagaauguagguaucauuguuugguaagcuugugucugcagcuuguaucuggugaaucaaaagccuguguauuugauguguuuuuguguuucauucuaauuugaaaauuaaccugugcauguuacuaaugaguacuuuggaugugaccagauaguuuaacaaauacuugaggaucuuuugaguaggaguaggguuuauaugccugggggauaagacuuagccaugaacauaaaccuucaacugacauuagguuguugaaaaagaccaugugugugugagugcaaaaacauaagauaguaagaauccaaaaauggugcaagcaauaaauaaagguuauugaaugccgggcgacguggcucauaccccagcacuuugggaggucaaggcaaguggaucacuugagaucaggaguuugagaccagccuggccgacaugacgaaaccccaucucuacuaaaaauacaaaaaauuagccagguagcaugguggcacaugccuguaaucccagcuacucgggaggcugaggcaggagaauggcuugaacccaagagguggagguugcagugagccgagauugcgccauuggacuccagccugagugacaaagugcaucccugucuuuaaaaaaagaaaaaaaaaagaaagauuauuggaagacucacucuuggcauugguagucaagggagguugaaugggggugaccuugaaggaugaauaaagucaggugagcguccagggcaagguuuguuuuugauuggaagagaugaagagauuugggaagaauaggaacaaaggcauagcaaaaauaccugucugauaaaauuagagagauugguuagauugguuggaccuuaaacaauaaagcuaagaaaugaagggaaugagauauuuguggauuuuugaacagaggaguuguguggugaaaauguccuuuugcaaagguuaaaugugguggcagcaugcaaaaugauuggagggaaggguguuaaccagauaaagaccauuuucccagccaaauuaacaauuacuaacauuauauauaaauagagaaaaguguauaguaaaguaacggaugaaauuguggcuugaaccagacagugaugguuagcaaauaggauccaugauguugauguuuauaacaauuguagaugccucaagaccucacauuuuccaccaugcauuucaaucacacauaaaagugagguccugauagcaccagcauagucuauaugcucauacauuuuuuaauuguagaaaaggcaaguuguguggcugcugaccuugguccugaaugguagcuaaaguacuguuuucugagaagaguguugaaggggguaguacagucugaugggcuggucagcaaccaguuuuaacuaauaaagugccuggaaacuguaaguuacuuuuacucacaucuguuaaugguuaagagcacagauuacuggaccagauaaccuugaauacaaaucucagcacagucacuuuucuuuguaaguuacuuuaccugugugugccuuagugucuuccucuguaaaacuguacauaucucaggacuguugugagcaucaaaugacccauuccauuuaaaguucauagaacgcugacugacacguggacagugcucuauauaguuaaucauuauugucauccauauauauucguccauacugcgucuauggauggaauccaagggaaggguuacugguuuuguuauguauuauguucuauguuauaacgaauuccaugccauugcauacuguuuucuuagacucuguagucagguuauuggcaacaaauuuuuaucuuacaagaaacaacuauuuaauaauaggaacauaaguguaguuuaauugcccuaugggauuuauuagaugucaaggcugauuccaaggaagauuguguuuuacaaaaaugggucuuuuaggcuuacaguucuuacuuucauuauuuguauaucugauaacaugcguauuaaaugugugcauuuauaaguauuuuaaugccuucaucuuuuuuuuccccaguauuacagcgugaaauaaauucccaguauuuuucaagauuauguaaaaggaguuguaauuacugcucagcaccuaggacagcacccagugcaacacaauguacaugaacucuggcuugagguuuggggcuuguguucugcauucaggaaagaaaagaagagaaaguuuuugggaaauuuaaaucuucguaagcccuuacucuaaaaguauaugaaaugcagaaugguuucauggcuuuauuucaaaauguuuuacacuggcuguagaacccacuucaugaaguaguuugaguuaaaaugaucuaauauuuguguuuuaacuuucagcuuuguguuauucuuggaaaauuucgcaccacuugugaauuccuugaaccugggcauugcaaacccacuucuguugggcccaucuccuuugcacuuugcucagauuaagacucaguuggcgcuucagcagcugaaugccguugccucacaugguucaacaccaccuuauacuuuauuaaaucaggcuuucuugaaaauagccaugucgagacccagguuuaauccucgaggagacuuuccacuucaaaggccacgagcaccuaacccuucugggaugaggccuccaggaccauuuaugaggccuggaucuaugggucucccaagauuuuacccagcagggagagcacguggaauuccacacagauuugcuggccaugaaucuuaucagaacauggggccacagagaaugaauguucagguaacucaacacagaacugauccaagauugaccaaagaaaaacuggauuuucaugaagcacaacagaagaaggggaagccucaugguagccggugggaugaugagccucauauaucugcaucaguggcagugaaacagaguucuguaacacagguuacagagcagagucccaaaguacagagccgcuauacaaaagagagugccucaaguaucuuagcaaguuuuggauuaucuaaugaagaccuagaagaacuuagucgcuauccugaugaacaacuaacuccugaaaauaugccauuaauuuugagggauauaagaaugcgaaaaauggggcgccgauuaccuaauuuaccuucucagagcagaaauaaagaaacacuugguagugaagcaguuucaaguaaugugaucgauuaugggcaugcaagcaaauauggcuacacagaagauccacuugaaguacguauuuaugauccugaaauuccaacugaugaggucgagaaugaauuucagucacagcagaacauuucugcaucuguucccaauccaaaugugauauguaauucuauguuuccuguugaagacguauuucgccaaauggacuuccccggugaguccuccaauaaucgguccuuuuucucaguugagaguggaaccaagaugucaggcuuacacauuucaggaggacagucaguccuugaacccauaaaauccgucaaccaauccauuaaccaaacaguuagccagacaaugagucaaucucugauuccuccaucuaugaaccagcaaccuuuuucgucggaauuaauuucaucuguaagccagcaagagcggaucccacaugaaccugugauuaauucaucuaacguacauguuggaucaagaggaaguaaaaagaauuaccagucacaggcugacauucccauucggucucccuuugguauugugaaagcauccuggcuaccaaaguuuucacaugcugaugcccagaagaugaagagacuuccaacuccuucuaugaugaaugauuauuaugcagcaucuccaagaauauuuccacauuuguguucucuguguaacguagaauguagucauuugaaggugaguguuuuuaaaaaaagaucacuguauaaugaugcucagcgccaguuuucucuaaauucugauauguaugcugcuuguuaacuaggcguuaaggaaauggcagaagguaauuuuaauugcaaccucaauacauaguuguaaucuuaaguagcccuggccuuaguacugaauugaauuuuaggcuuacuguauuccuaugaccgggcacaccauauuuuaguaguguguccauuuauuuugaacuuuuaguuaucccacuuacgcaacauaaaauuuauguaacauaagcugcguacuuacaagacaaugucacauggaaucaccuuucucuaaaaggaucuguuaguauaaaaauacaaagagaugguauaacccauuuguaaugcacacauuuaagagacaguauauuauagccuugcacauauacaccugucuugggauaaagacaauuaauguugauuuaaauauuuccugacuuuauguagacuagugauuuuuaguauuuuuugagaagaagcuuucuaaaauaacuucauagcaaaaauaagucaaggugcaguaauuauucugggaccagcuguggacucagaaaauaguguaaaaugauagaaauuuguagagaaaaaucuuuaaaaaauaaagaugauuuagguaguuugauaguauaguuagaaggaaguauuuugcagaggcagugaaguguacuauaauguagaacauacuguucagucguaaucauugguagauuugagcaggaauuuccaaguaaauuuuauuuacuuacguaugguuggcaaucacuguuucuucuauuuacuaaugugauuuauagauuuagauuguaaagggucagaagagaauauacuaacaugggaaaaagcuuugauucaaggccauggccuggaauugguuguauacuuaggcuuaaaaaucuguguguuaacgcucuuguucuuuucuuccagugcugccuuucgauuuucuuuucauuauuuacucacuagguuuucgucaacaugaaucugauaauuagaucuguugguauuuucuuaagguuaacuccagcaaaagaaagcagcauucuaccccauuuuagccagaugugccaaauucuauuaaaauaauaguugccuuauuccaucagaagggauagcaaaguccuuacaagggaaagucuuagaauaauucauaucaccuaauuguaaucuguaaguagcccuggccuaaguagugaauugaguguuugucuguauucuugugacugggcauaccacauaauuuuuuuuaauugauuuugaacuuuuaauuaaucauaaugaauccaagaaaauacaucuuuaaauaaagaacuugaaguuuuguauucuguagaguagaaaagguguacauuuaauuuaguauguacuuauggauaccaguuuuguacuugacuccaauuagguacuggggcagaaaugaggaacuguguaaaauuuuagauguuauuaagcaguuuauucagucuuauuggggagaaaaauuaugcucccaagacauuuaaaacaauuagaagacaacaagugguuuugugauugauuuaacuuguuuggauaugcuguaggggacagagauuucugucuugauuucaggcauguaucacucaggccagcaucaucaauuuaccaauuuaaucauuaccaauuugccaauuuaauuauuuuaacuauuguauuuguaacaguauguguuuaaaaauaaguauaaauaugcauccugacaucaaaagacuuuuauagccuaguuagacuaauggaaugucaguuacuaaaugcacuaagucugucuugacuagaaugaugugggagagaagacuucauggaguagguugaagaugggucuugaauugaggcuuuagauaugccuguauaaagaggaggagggggccgggcacaguggcucacugccuguaaucccagcacuuugggaggccgagacagguggaucaccugaggucaggaguucaagaccacccuuacugacauggugaaauccugucucuacuaaaaauacaagaauuagccggguguggucaugcgcaccuguaauuccagcuacucaggaggcugaggcagagaaucgcuugaacccaggaggcagaagguugcagugagccgagaucgcgccgcugcacuccagccugggugacagagcgagacuccaucucaaaaaaaauaaaaaaaauaaaaaaaaaaaaaaagaagaggaggguuggcggcaacaacauacagagaggcagagguccggagagaagacuacauuucauugugguaggaggcaguugggaaagagugaugagcguauuagaaauaaguacgaaaggcuuugaagagcuagccuaggaguuuagacuugaggugagaggcauuagaaagcuaaauaaguuuguugauaagugaagugacauguuggaaguauauuuuagggagaucugacugaaguaugcaggguaaauagaaaugagaugauguggaguaggacuuccacuuggaagcuucuuuaauuguucaaguauaagaugguaaaaaccuggguuaauaggauaaaaguaaaaauuugagaggaaaggaaaucauuuagucaucauuagagcucaccuagauagauugccauuaaaaaacagacacaccuuuuaacagcacaacagaauggggcucaucuaaguaaugaauuuuucacuacuaaguggccaaaugauagggauuugugaagauggauuucgaugguacacacugccucucguuucugugauauauuuugcagccucguaaguguuccuguguguguauauaugacauaaauaugaagccaauaaauguaaauuaccaauuguaaacuuuuuccuauugaguaaaucugacaauauguauauuccccaccuucgagucuuugaaacuauagcugugaagauguacuuugagaacgugaaauguauuugcuuguuaaauugggguucagauuuuaaaggagaaacuucccuugguuuaggagcugugucauaaugacugaaauaauucaguuugagaaaguaccgacaauaaaaaauuguugagaauagugagugagcccugauacgaguaguuauauauuuucaguuucauucugagccugccuaauucugugcaguccuugcagcaucuccugcuaguagguaauuaucacuuuuucucuggggaggcagugcugcuuuuggacuauaauguggaaacuauuacuagagagucuagaaguuggggugggauggguguguuuacugagcuuaaagcaaguaaugucaauuugugaagcaagccuaagaauguguguauguguguugaacugagaagaguauaucuuaaauagggcagccaucaucuucaggugauaguugcuguaagaaugauauccuguauuacuguaucuuccuauuuuuucaagaaaagcuggaaaucuggacuugcggguaaaaaucucuggauuauuaaauguuggcaacguauucagauaaaacacuuuaugguucaaauaaaucaugcccaacccacugccugcaccagugugucuguuugauguaaacaguguccaauuaauauuaaaaauauggguuuuaguacuacuagagacucuucuucuagcuuucuauuuguauuauuaaacaggauguacaaacauuucuuuuuuguaguccacaaucaguuccauggcuuaaugaaauaguuuaggauuugucauaccuuguugcugaguuuaaauugaugcugagcauugcaaaucaguguaccuucuuucagauaguucuugccaaggcagaauccaaaauuauugucaaccgugguuuuaacuguggaaacuucuaaugaccuaaacuaaaauguauuucaaauggaaacaaauaauaacauuuuccuuaagcaaaguguugaaauacgaaguuauuuaguaaguuuucugccuuuccaaaugcuggaggaacaguaaaacauugaguaacauacauauugcuuuuaacuaauuguuucaccuuggaaacuguaucuuuguaaacuguauuggcuuuuuuuuuuuuuuaaccagauguaucuuccagaguuauuuauggguacacauuguaauuuuaggacagauuuauuuguaaaugaaguaauguauaagaaagcauuuugggcugggcaugguggcucacgccuguaauccuaacacuuuugggaggccgaggcagguggaucaccugaggucaggaguucgagaccagccugacaaacauggugaaacccugucucuauuaaaaauacaaaaauucaccaggcuugguggcacaugccuguuaauuccagcuacuagggaggcugaggcaggagaaucacuugaaccuaggagguggagagugcagugauccgagaucgccucauugcacuccagccuaggcagcaagagugaaacugucucaaaaaaaaaagaaaagaaaaaaaaaaaagaagcauuucguuaauuguaaagcucaaagcucuauauguaagggauauuguaucuuugaaauguuguuacuuuuaaauuuugaaaauagauuugaucaguagcauuuuuccccauguuuuuccuaaucuuauuugccaguauagugaguaccuuguauggaaugguacuggucuaucagguagcauuuuuauuuuauuuuuauuuuuauuuuuauuuuuuuggagacagagucucgcucugucgcccaggcuggagugcaguggcgcaaucucggcucacugcaagcuccgccucccggguucacgccauucuccugcgucagccuccugagucgcuggggcuacaggugcccgccacaacgccuggcuaauuuuuuguauuuuuaguagagacaggguuucacaguagugucgaucuccugaacucgugauccgcccuccuuggccucccaaagugcugggauuacaggcgugagccacugcgcccggcggcauuuuuugauuguugauguuguuagcgugaauuuuagagguauuugucauugaaauauuguauuuugaagaugcuguuucacagauaccguuuuacuuauagauuuuuugguguuuucugguguguuguuuuuauauuugcaguaaguuuuuucugauccaugcuuuuauuuucuccaaguuuauauauugauuucaaaaugagcauccacggguaugauuuugaaaauguuuucuguacuaaaauauuuucaaaugggaucagugagguaugguauuaagugcauuuguuucaaggccuuuaauuuuuguuugugaaaauuuuacugagcagccaaaugcuauuuaugaguacguuuguuuaauuuuugaacaaaauauuauuugucuuuuuuaaaagccuaauucauuagucaacaugaggaauauucuaauuucaacacuuuucuccuuuuacaauaggauuggauucagcaucaaaauacaucuacucauauugagagcugucgacaguuacgucaacaguaagaauauauuuuuccuuuauuauagauagcauauuuacaaaauaguuaauguucagaugugacuguuaaauaccuuuaguauaauacuuuggagaaaaauauuuuuggaaagcuauugucuuuuaaaaauauuaguuuucuggaaguauauuuaauauuuuuccaaaaugguagaauucaguauauccuuugacacuuuucuaacuuaauucccaguagguaaacuuuuuaugucauuaguucauucuuugcuggcuuaccuuccccaggaucuuuuaucuauaucagagcagguauccuuucuucuccuaucuccaccucuucccauaggacaaguaacugaaaaucagugcaaaccaaacaccaguauuuaauuuuggaccuaaagcucuucucugacuuagaaccaguuuucagaauauaccuuaaguaagggauggacaagcuagaugucuugcuuccuuaaccuuggcucuucaauucuucccccuuuuucuucuuaaagacagggcaccugugaaguuuucccuacuggccauagaggugaaaaagugugauuuuaacacuauguuccuguaucucuuggaguaacaucaaauuaaacucugucuucccuaguaccauuaaacaguuccuagccacuagacugagaguaacguguuauugggcaaauggauuugagauuauuauugagaauccuuuugguuguaagugguuaaaguugcagauuaguugcuggcucaugacuguaaucugagcacuuuggaaggcugagacagguaggcuugcuugagcucaggaguucagccuggccaacacagcaagaucuugucucuaccaaaauaaaaauaaaaaaaucagccaggcaugguaguacacaucuguaguuauaauauuugggaggcugaggugguagcaucacuugagugcaggagauagaagcuucagugagccaugauugugccacugcacucuagccugggcgacagccuguuucaaaaaaaaaaaaaauuuuuuuuuuuuaaguaagaauuuguaagcucacuuaacugggaagcuuaaaugagguuggugguucuauuaauaaguuucaggagcagcuguauuggaugcucaaauaaaaauuggugucagaaauacuucuuucuuagcuguugucuuuugcauuggccuuaugaaaucuuggacacacuucuuucacauagcaaaauggaccccacgguucuggauguaagugaucuguauagcuggcauuucuaggaguuuuuuuguuguuguuuuuguuuuccuuaucccaccccucacucuaugacacagccucgggagguucugagaauauaugccucucccaucugaccuuuuuccuuuaaagcacuucuuucuccauaacucuggcagaaguccuuguuuugacucuuuugguucaauuuugguuaguuguccaucccuaaacacauuauaguggcugugggaauaggguaguccaucucgguuugugucauaugucugcuccggguguugagagugagauaagugucaccuggaucuuuugcacuaagacuggaaauugggguuacuauccuauauagaugcuguaaagacaaacauagguuaucauggggagauaauuuguuaccugaauuagauacgccuuacugccacuguaaggaauacagucgaaaaucgaaaaucucuccuaagcaacauuuucccagagguacccagugggaugucuuaauucuuaugaaggugaauuuuuaguuggaugggggugaguuacuuauuuuagagagucauucaugcuaguaagaggauuauagcuacguuaauuuacuugagcaaacagcauguauauaucuauuaaagccuuuaguguagguaagccuauuauuuuuuucauacauguaggacccugauuuaaagcauuugcuuuccaugccugcuacuuuaauguucuacucuauuuuuuaaccauauccaguguauuuugguucuccacagagaugaauaggggagauauauauaaauacaagcguaccuccuuuuauugcacuucgauuuauuguacuucccauaauuugccuuuuuuacaaauugaaagauugugggaacccugugucaagucuacuggugccauuuuucuuuuuguuuuuuucuuuuugacuuaaacugggagagaauaaauuucuauuuagaguccagaagucugaaaucaugguguuaguugggccaccauucccuuccgaggcucugggggaaaaucuguuccaugcuucucuccuaguuucuagugacuggggacaaucauugacauuccuuggcuuguagccuaucauuccuaucucugcuacugucuucacaccaccuucucuucccuuaaaccucccuaugcccugcuauuagaaagacacuggcuauuggaucuagggcccauuggauaauucaggaugauuucaucucaagaauuuuaguuugauuacaucugcaaagauccuuuuccaaaucggguaacauucacaaguuccagggauuggaacauauauauguauguaucuuuuggggagcaccauucaagaauccauuuuaaucaguuuccccuaauaccaaaucgcucucucgucugggccuugagcagugcuuuugcugccaaaagcaaucaagagcugaagcugaaaaugaacaguguguguauuagcaccuguaugcugguaagaacugcaacuggauauauccuucgaucuggcauccucugggucaguuuccacuuuuuccuauuguggggcuuaaggguucuuucguuacacagguaacugugguuugaaauuuaaaauaacaguaugucuuuccuaauucuccaggcugugucuccuaaccaggccucaugaugccuucacaguuucuuaccuucugcacauuuuucuucaccuggccucacucugaucacaauggcagauccagggccucccucuucccuugucucuacugggucagucaggacucuuuccuaucggugccauuuuucuaacagcaugugcucacuuugugucccugagucacacucauaguauuucaaauuuuugcauuauuacuauaccuguuaauggcaaucugugaucagugaucuuugauuuugacuugcugagggcucaugaucaguauuuuuuagcaauaaaguacuuuuuaauuaauacauguucauuuuuaaaaacaugcuauuguacaguuaauagacuggcauagucuaaacauaacuuuuauuugcacugggaaaccaaaaaacuuaugugacucgcuuagugugauguucuagaacugaaucuacaguaucucugagguaugccuauguaucgauauaugacaggggauuuacuaggggaauuggcuuacacaauuauggaggcggagaagucccacaauaugcugucuguguguugaagacucuggguuucugguaguguggcucaguccaaauucaaaagcuuccaaaccaaggaagcugauagcauaauucucagucugaggcaaaaggcccuauagccccaggagccugcugaugcaaguugcauaagacuuggaguucugauguccaagaacaaggaggagaagggcaucccgcucugagggaaggagggguggagagagggaauuccaccuucuuccaucuauuuguaccaucugggcucccagccuauggcgugaugcccgcccacauugagggcagaucuuccuuacucagcccacugacucacagacuaaucuucacuggaaacacucucacagacaugccaagaaacaaugccucaccaaccaucuaagcaucccucaaucuagucaaguugacacccaaaauuaaccaucacauucagguuguaugcacuugaauaauugcuucauaacuuucucuccacugcaaaauaauuuaauaaauagauuugguuaggugcuugggaucugcauucuuuauucuuuuaagcuguguuauagggauauaccuucuuucuacucauuccuccauugauguauauuuagauuuuucuuuucuuguggcuuauucucucuggcuuuauuggcucuuucuggauuaugauacaagaguaguugaggaaagauaacagugcaucagaauuuuaauauuaaaaauagguaauuaugcuguguuuauugugugcugggcauucuuagugcuuuacauaauugauuuagucuucaaaaccaucuacgagguguuaaguauaaggauuauuccagacuuuaucaaugagagaagugaggcacagagacaauuucccuaccaucaugcagcacauaguuaaauggaacuaguuuagcucaugggccuuuaucaucccuucuacuuuuuuauggcuuaaaaaauuuucagaauaaaauauugaagagaaaaaggaagaaaaacauuuauguguucuucaucuauauucaccauuuguuaauauuugcuuuauuauaucuucauacauuuuuuucugaacuauuugaaaauaaauugcagacauuaugggacaucauuucuaaauucagcauguaucuccgaaguauuaggauguucugcauaaccacaauacaacacauuuaaggaaauuaacaauaauuccacaguuccuucuaauauauaagccaaauucauauuuucccauuucuuuccagaaugccuuuuauaauucuucuuguuugccccauccauacccucaauccaguauucaguuaagauuuaugcauuacagucucuuuuaaucuagaauagccuacucuuuguuucguuuguuuuuuguuuuguuugucuuuuuuuuuuguuugagaaggauguuuuugugguguugauuuuuuccuugaaaugucugggaaacuuguugaaugucccacuuccuauaguuuucuauuuguuuccuuagcauuaaauucacugagaacauuuuuguugcaaaugcuucguuggugauguguauuuauugcaucacauugggacaaagauaauaucaguuaacuagguccuugcucuuaauaguuaauguuauaccaccuuuguugggagcguuauugcuucugaagcacauuuuugacuaguugggcaguauagagguguuuccaaauucugcuugcagaauguauacaugcuuuaucuuucugcucugggcagcagagaugagaacauguguuaccuagugaacaggucugaacuuggugaaccugaaccuaaugaagaucaacaauauuauuuauugcuaucucagcucacugcaaccuccaccuccuggguucaagugauccucccaccucagccuccugaguagcuaggaccacuggugagugccaccacgcucagcuaauuuuuuguauuuuugguagagacaggguugccaaagcuggucucaaacuccugagcucaagcgaucugccuaccucagccucccgaaguguugggauuacaggcaugagccaccaugcuccaccauuauuaccagcucuugaauauuagucuucaagcucuugugaaccauaaacuagagacccccuggaaauuuaauaacuuugauguguuguuaaucaccuucauuuccagcauauacaugugagaaagcuaaggcuuacacauucuaaguaacuggcuuuaaguuucuuagccauuaaaugacagcaccuauagugaaacccaguuuuguuugaugauuaaagauuugcuuugaaucacuguaagacuaggaauuuauccuccugggugguacagagcaaugaaaguuuuaaaaaguguggaaauagaugaaacaaaauuauccauauauugggaauuguugacacuagaugauggguauguuggauuaaaguuaacuuuuuugucuucacaguuuguccucucauaauuaaaagaugcuccagacaauauaucuauucucaaaguaagaagaaugaggcagacgcuuucucagaugucugucagggguuuuguaccuguaucucauugguuagaacuuaccacuggcugucuucuagagauagugggaaagcaaauauuuagcuuuuuuuuugccauuguaauaaaggcaaacaagggaaaagggaauugagaauugcugugggguuagcucauuaacaaugucugaggcaaauagcaaccaagacaaaccacuuuaauaagguucgaccuaacguuauuuuccugcuaggugauuugucagaaguuugcugccuccauuuccuuaccuggcuuucaucuugcugcugaaauuuuauucuuaaauguagugauuuauuuauuuaauauaaucagcauguccagaugccucuuagaguucagauuuucuagaaguugagagugaagauacagccuuuuucuuaggcuucuaugauauuacuguuucuccuacuaguuuuuccgugauugcuucuuaaucuuuuauuauuuuuuuucuuugcuuuacucuaaaguugucgaugugccuaagauucuguccucggcucucuuuuuuccuauaaacuucaucuuguguuagucucacucuuagggcuauaauugcggcuucuacaugccugauuucuaaauaucucagcucucaucuuuuccccuaauuccagauauuccuuuacacuuauucugaaaacauuccuguuaucuucucuuacaaauguucguuaaguucccauuguuuuuuuccuguguguaaccucauuaccugauuuuaaggcucuucguaauuugucucuaccugaaacaacagacagccuguccaaguuucccccuuuauaauuccuuuucaucaugucuaugcuguagccagaccacuuccuggaacaaaacaccgauguuuugccuccaaucuuaguuuacauauugccacugcaugaaaucuaaccugauccauuccuauuaauagaucuuuguaagggcuacuugaaaagcaacccuuucuaugaguucucuccugauuccucucaguggacauaucuuuaugaggacuacuuggggcaaguuaaggggcaccauucauguuguauucugugaguugccauauggaauaugauaggagugguguucccuagaguucuguaaaguagaugaacugucuucucucuuuuaacccuuaaccuaagcucguaucuuguaccucuuaacacuucugugcauaugcuggccgguuuacuuaaaugaaaguuuaggccuuuaaaguauggggaguguguuucccugauacaccuauuagcauaauacuuugauuauuuauugaauuaaacucucaaaauauuuuauuuccaauaaaaguugugaaaaguccuuuugauauauuacagguaaagauuaauugagccuuacagucugauuuuagcuguuaguuaauauuguuuauuuucaaaauagguauccugauuggaauccugagauccucccaucgagaagguaauuuuuaaaaauaguaauauuauuaaaaccugauugucuuuuaaaaguaaacaguuaauuuuaagaaagugauucuuuugaguucuacuucugccauuuaaacaacaggcaaaugcaaaaaccucuaugaaucuuuaacuuauuccagcuuaaaggugacacagccccuccccugaucuacuuucuuuagccuguucugaaaauacuuuauucugacauuauuauuuuauguuuaugacaucuucucuuguaaaugccuugaaugcuaggagugauauuauuaaguucuguauccccuaggggauucuccucagguuauguguguacacacacguacacacacauagagaaaucaaagucauauuuauagauggcauaaucuuucaggaaaaaauuauugaaaacaucuguuuacguaaaucauuuccuaaauucuuuacauaauuuaauacuuuaaaaacauaauuggaauaauguugguacaggaaaaaccagagaaauucauuaucguauucuucuguaaacuagaaaacagacauccaagcaauuggagggcugauaaacuguucugauuguuucuuauuuacguauaaggcugaauuacaucauaacaaacagauuuuuguuuuaaguacauaucuuuuaugagaguuugguauuguuaacagucuguuuuuaacaagguacuucugucauuuauuaucauuuaaauuuacauuaaauugcugaucacuuucuuuuccgccccccugcuuguagaaaugagggcaauagaaaagaaaaugaaacuccacgaagacguucucauucccccaguccuaggcguucuagaagaucaagcucaagucacagauuccgucggucucgaagcccaaugcauuacauguauaggccgagaagucgaaguccaagaauuugccaucguuucauuucuagauacagauccagauccagaucccguucaccauaucgaauuagaaauccauuuagagguaguccaaaaugcuuucgaucaguuagcccugagaggaugucaaggagaucagugagaucaucagguacacugauggccaugaaauagugaauguacuuauuuugacuaaauuuuuaaaugucuuucuuuuuggauuuugagaaauguucuacuuuauuaaauuuuagaguugauaaaugaaaucugacccacaugccacagaguuauucccucugguaacuuggcaaagaaaugugugugaauguauguguccaucaacaucauauuuaaaaaccaaggaugguaaaaaugucuuaguuugcuuuaauaauugauuauagaauuccauggauuaauuuaaaauguuuuugagauuauuuuuuuuaaccugugacuuaauguugauuuuaugacccuuucagaacuagcucacacaugcaugcccacauacacaaacacacaccuucuucuacaaugaaagaaaccauaguuaauaucugagaaguacuuugacacucccacuguuucacuugacuagccugaaaaauucaaaaauaguacuuugcacaggucuuauugugucuaguauagucuaaaaugcugaauucaaauggagauaccuuuaauuauauaaggcauuccuucuuaaaguauggcccaaggaucgauugggguccucaagaucuuuuaagaguucuaugagaucucuuuucuaauuacaugccuccaugaggcuggauuuucuuuauccagaagcagauauaagaauuuagguucuucuuuuaagcucaacauuaaaauguguggaagaagguacuauagugcuacacauuucacuaauuuuguuuugggaauuacaguugguuuuuauaaaaauauuuauguuaauaugggaauuuacuuuuuuugccauuacuuucaguggcaaaaacugcaguuacuuuugcaccaaccuaacauaugaauugauaaauauuuuuacaauuuaauuucuaauaugguaaauaucaguaaauauaacacaaaucuuuguagucuucaauaaguguaaagcaaucucaaaaccaaaaguuugaggaucacugguauaagggaauaaaggaacuucauguaaaagccuucugagugcauaaaaucuagauuuuuguauugucugugugcucccuguuuagcuugagaauagcacuaugugauuaugucaugagauggcuccuaccuuaauuuuuuuccaauugaaauuauauuuauaucuuuuuacuagauagaaaaaaagcauuagaagauguaguacaacgaucugggcaugggacagaauuuaauaaacagaagcaucuugaagcugcugauaagggacauucaccagcacaaaagccuaaaacuagcaguggaacaaaaccaucaguuaaaccuacaagcgcuacaaagagugauucaaaucuaggaggacauucuauucguuguaaaucaaagaaucuugaagaugacacuuugucagaauguaaacaggugucugauaaagcuguuucucuccagcgaaagguaauucuuuaauuaauaauuauuuuuagagauaagguuucacucugucauccucgcuggacugcaguggugcaacaagcauggcucacugcagccucgaucuccugggcucaagugauccuccugccucaucuucccaaguagcuggcaccacaggcgugugccaccaugccuggcuaauuuuuuaauuuuuguagagauggggucuugccauguugcucaggcuggucucgaacuacuagguucaggcaguccuuccacgucagcuucccuaagugcaugagccacuaugccuggcuucguaauucuuuguuagugcaaauaugcguacauuugcuaugacaaacagaaaacaaaguuguugccaggcaugguggcuuaugccugaaucccagcacuuugggaggccaagcgggguggaucgcucgagcuuaagaauuugaggccagccagagcuacgugguggaacucccucucuacaaaaaauauaaaaaugagcuggggguagcggcgggugccaguagucccagcuacuugggaggccuugggaggcucagguggaaggaucacuugagcccgggaggcagagguugcagugagcugaggucacaccacugcacuccagccugaacuacagaaggaagacccugucucaagaaaaaaaaaaaaaugaaguugucuuaacuuuuuuauuccguguuuccaauaacuuugaaauuaugaguuuuguuacaugauuuuaguauggaauauuuuacugguuuuucuugugaguauaauaaaaguccaagguucaaaaucucguagcuuaggaauuccagugguuugguauuugaugugucaaaagaacauuuugaugguuuggcauuuuuggcuagcuucacaagcagaucacugugaugaguuuugcucucuaauugggaaaaugaauaaucaccagcagcauuauugagcuuuuguaaucuuuuuuaguaagguauaagagugagccucuccugagaauugaucauuauucaucuguucuauacuuuuugugguacaguucagaagucaaauacucuguuguacaguguaaaauuuauacuuugguacugauuuauuaguguuauuuugacuguaaccuacugguuacgauacuaagguauuguuuuauuguauguguuuauuaaaucacuauuaauauauuaaaacaucaagagacuaucuucagagaaaauccuaauaggcccaauaucaaauauuuuguauauuuuaauauuaauaagucuucaaguauuuagguauggaaugcauugcucucaacaguauuuaaauacaugaaagacuuucaguaagugcuguucccugccccaaagaacuuacauuuagaaggauaaacuucugauaaucaaccaguaauuaacagaauuuugaagagcauugggaagaaauuuuugaguauagggaaaauuuugaagaggcugaguuagucucauaauaugaaguucuuuucauuuuguuucaagacuucuaggugguggcaguggaacuuuuuuuuuuuuaaguuuucuuauuuaguaaaaaauaagagaaaugggggucucgcuuucucacccaggcuggaguguaguggcacagucauagcucacugcagccucaaguuccugagcucaaguauccuccugccucaggcucccagguagaagacuacagguaugcgccaacacacccagcuggguguuuuaauuuuuuuuuuuuuuuuuuuugaaucagagucucgcucugucacccaggcuggagugcaguggcgugaucuuggcucacacaaccuccgccucccagguucaagugauucuccugccuccugccuuagccuccugagcagcugggauuauaggcgugugccaccacgccuggcuaauuuuuuuuauuuuuagcagagacgggguuucaccguguuggucaggcuggucucgaacaccugaccuugugaucuauccaccuuggucucccaaagugcugggauuacaggcgugagccaccaggccuggccuuuuuuuuuuuuuaaaaauauagagucuuaguauguugcccauccuggucuuaaacuccuggccucaagcgaucuuucugccuuggccucccaaagcagugggauacaggcaugagccaccaugccuggcuguaauuuuuaacguaagcgguaaaguugauacuacaguguauucaaaugguaugcauuauauaugaauuuuuaaaaauauuauaccugucuagagaucauuuccaauuauuagaacagaggggguaagcaaagcuguaauuucagcuuuacuuguuggugggccauguaguuucauagaaaaauucucucuaauggccuuggaacauuccauagaucuuauuugcuauaagaugcuaucaacagaaaagagcaccuguaaaccauuucuggguuaaaaaauauaaauaacauuucuuaccacuuuugcauuuaaaaucuuauuaaaguguuaaaaucgugauuuaaaaaugcguaaaggagguggugaaggaaaaagaaaaauggguaaaaaauauggaaaagacccuuuaguguacuaauauuagugguagaagaaauuauauaggaaauuauuacuguacauuguagcuuaauuugguuuauuuuaaauuuucuuucacuccaaaaauagcuucggaaagaacagucauugcauuaugguucgguucuucuuauaacugaauuaccagaggaugguuguacugaagaagaugugagaaaauuauuucaaccauuugggaaagugaaugauguccuaauuguuccauauagaaaagaggugagucauuuagucuguggcaaaaauucauacaaagugauugcuuuaaugauucuauaaauugcuguuguguuccuuagcugcuuguacugcauauauaauuguucuuugagaguuauauaaaugucuggaugugaauaagcaaggccgcaaaauaauguuuuauauccuuuaaaauaaguguuugcccacuuuuucuguaaagggccagcuaaauauuuuugguuuuauaagccaucuguaggaucucaacuacugugcucuggcauucuaguacaaaaacagcuauaaguaauauguaaaugcgcaagcauggcuguguccaaaaaacuauuuacaaaaauagguaguaugccauaguuugccagucauuacuuuagaacaccaguuagauaauacuaaaacaaauuauuuccuuuguaugguuaaguauuuucuguggguuauauuccuauaacucacaugauaaaguuaagaacugugaacaguucuucacauaagcacaacauaaaauaguuaguuaaggcugggcguguuggcuugugccuguaaucgcagcacuuugggaggcugaggcagguggaucgccugagaucaggaguuugagaccagcccgaccaacauggugaaaccccgugucuacuaagaauacaaaaauuagccagacaucuguaaucccaccuacgugggagguugaggcaggagaaucucuugaacccgggaggcagagguugcagugacuagagauggcgccgcugcacucuagccugggcaacagaguaaggcuccgucucaaaaaaaaaaaaaaaaaaaaguuuugugaguuaaggcugggugugguggcugaagucuguaaucccaguacuuugggaggccaaggcuggaggaucgcuugaggccaggaguucaagaccagccugggcaacauagcaagaccucugucuuaauuuuuuuaaaaaguuugugagucaggacagggaacauagugauaguguugucuuuguugcaagaagccuuuaaaaugucagaccuaccacaagcuggaccauaucuucccuucccuccuguuguucagugagcccugccuucucauuuccucuucuuccaugagccugccuggauuuuuuuuuaucuugguagugguauagaaauuauguaagguuaaauguccauuuaaugugugaaacauccuuaaucaaauuauacuugaccaaaauaaaaacaggcaaaagcaaccaugacuugagguaguuucauaguuugauguuacaaaagaaaggauuaagcccauuuuaaaaugcaggaacuuuuaaagauagauuugugacuaaagauggaauaaauuucauuuuaggcuuaccuagaaauggaauuuaaagaggcaauuacugcaauuaugaaguacauugaaacaacaccucuuacgauaaaaggaaaaagugugaaaauauguguuccaggaaagaaaaaagcacagguaaucuggauuuaggucuuaaauguuuuaucacuguuguuuuaguuuaacuuuuuuguuuaaguauggcacacauauagaaauaggcauagaaacauaaauguuagcucaacacauuauaugugcauuaauucaaguauguugaaauuaaaacuuccucauacauguauggugcuauauacaguauuaaauaacgacgacuaggagaaaauacuugccauauauaacacaaaaauagcaaacaucugugaaucugguaccuaggucacaaaagagaacauuugacaguaucuggaagucccuugcuugcuucuucccaauucuuacacccucccuucuucucacaaguaaacacuaacuugauuucuaaugccauaguugaguuuugccuguuuucaacuuuacauaaacaaaaucguauaguguacauucuuugggccuuuacuuccuuagaaguaucaaguuuuguaacuuuaauuuuucuagaucauuucugugcuucaguucauaugaucguagauaauaucuauagaauuacuuuaaauuacccuuuaaggaugagcuuucuguuaaguaaaaagcuauauguauaucucaccuguaagguuuucuuuguguauguguguguuuuuuaaaauaggguguugagaaaauauuuuuauaucuuaaaaaaaauuauuguauuuuuaauuuuuguggguacauaguagguauauauauuuaugagguacaugagauguuuagaugcaggcaugcaguguguaauaaucacauuauggaaaaugggauaucuguccccuccaacauuuauucuuuguguaucaaauaauccaguuauacucuuauaauuguuuaaaaauguaacauuaaauuauuuuuuacuauagucacucuguugcgcuagcuaauacugggucuuacucauucuguuuuuuuuugguacccauuaauuauccccuccucuacccccuguuacccuucccagccucauaaccauccuucgacuuucugucuccaugaguucaguuguuuuagagcccacaaauugugggauuuuuuagauaccacaaauaagugggaacaugugaucuuugucuuucugugccuggcuuauuucacuuaauauaaugacuuccaguuucauccauguuauuuuaaauaacugaaucucauucauuuuuauggcugaagaguacuccauuguguuauguaccacauuuucuuuaucuauucauguguugauggacacuuaguuugcuuccagaucuuagcuaaugugaacagugcugcaagaaacaugggaguacagauaccucuucaauauacugauuucuuuucuuuuggguauauauacccagcagugggauugcuggauuguaugguugauccuauuuuuaguuucuuaggacccuucaaaauguucuccauagugaucguacuaauuuacguucccaccaacaauauacugaggguucccuuuucuccacauccuggccagcauuuguuuuugccugucuuuuggauaaaagccauuuuaaccgggguaagaugguaucucauuguaguuuugauuugcauuucugugaugaucagugauguugaguaccuuuucgugugccuuuuugccauuuauguguugucuuuugagaaauguuucuucagaucuuuugcccauuuuuuuuuuaucagaguauuaguuuuuuuuuuuccuguaaaguggcuugaguuccuuauauauucugguuauuaaucccuugucagauuuuuuuccuguaaaguggcuugaguuccuuauauauucugguuauuaaucccuugucagauggauaguuugcaauuauuuucucucauuuuguggguugucuguuguuuccuuugcucugcagaagcuuuuuaacuugaaguggucccauuuguucauuuuuguacagcauuugccuguguuugugggguauuacugaagaaauauuugcccagacugauguccuggagagagaguuccuccaguguuuucuuguaguaguuucauaguuagagaucuuagauaaaagucuuuaaucuauuuuuauuugauuuuuguauauggugagagauaggguucagguucauuaaugcauauggauauccaguuuucccagcugguaccucccuagguuacaugccaucccagcccacuagcucuaaucccagccccagcccuaagaguugccuaggaguuguuguccuuguguccuagacuaccuuucagguuuaccuagcacccuggagcacuuuagcccaugguagugagacuugccaagaaauucagauucuuauugccgggauggaugaguccucuuuggcuaggucugguccaaaggcuccuucagugcaugggugcuggcugaguacagcauggcuuugcuguccacugugacagagcagcacugaguucaauguaaaguccccuaguuacugcgcugucccuuccuaaagugcacagacucuguccauguuguggggccagauuagggaggugugcugucagggauuuaaggcugucucugcuacccucgucaaugccucuuucagugauacaaagucaaaaccagguaguaugaaugcucacuugauauuugguucuugugaugaugcuuuucugugugcagauagucguuaaaauuugguguuccugcuggggaugggaugaacaguguaggguucuauucuaccauuuugcuccacccagcuauguguucuaguaauuuaauuuuucuacuagcuguggaauggcuacuuuauagagguucuauaacacacauuucucaauaauuugauuugguagucuaaccauguuagugcauuccucauucuuuguaacuucucuauaguguuucucuguaugaauauaccacagauguauuaccaauuccuuacugauugauauuuagguuguuucuagaaacagaacuuuaguuaacaccuuguguaccuucacaggccaucuuuugacauuuaugauagugguuuuuuaggugauaccuacccaauggaaugguugguuuauaggaugcacaguaauggauaauauaagauugcucacuaaauaacuguuauaauuuacucccugguaauuuaugagaguauuaccaacaacaucuuaauuucuucagcuuuaaaaauucguuauauagaaaaugauaucuaguuuuaauuugcaucuuuuugauuauucauuaacuucaucuuuuuauauaauuguuagcuauaucuauuaacuguuuaagugaguugucuguaucuuuuccuauuuuauuauuguugucuuuuuaaaaauauucauuugaaggugcaugaauauugugcauucuagacacuaauuuugcauuguauguaagaagucuuuucuuacagucuguugcuuguguuaugcauacauauaucaaguuugaauuuuuuuuuuuuuuuuuuuuuuuuuuuggcggagccucucucugucgcccaggcuggagugcaguggcaccaucucgccucacugcaagcuccaccucccggguucacgucauucuccugccucagccuccugaguaccugggacuacaggugcucgccacuaacagagaugggguuucaccauguuagccaggauggucuugaucuccugaccucgugauccguccgccucggccucugaaagugcugggauuacaggcgugagccaccucgcccggccaaguuugauguuuuuauguacucaaauuuauugguauucuauggcuucugcauuuuuuucuuuauuauuuuuaugccugugacacagccucaggagguucugaggacauguuccccucuuuuugagacaaggucucacucuaucacccaggcuggaaugcgguggcacaauuucggcucauugccaccuccgccucccaggcucaaguaauccucccaccucagccuccugaguaccugggacuacaggugcaagccaccgcgcauagcuaaguuuuaauuuauuuuuuguagauaugagguuucacuuuguugcccaaggugaucucacacuccugggcucaggugauucuccugccucggccucccgaaguguugggauuacaggcaugagccacuguuucuggccugcuuuuuuuucuuuugucuuuuuaagaacuugccugugcuagugccuaaaagguuuuauuccuuaaucuauuauuugcagcauaauauaggauuggaaucaguauuauuuccaaaaugggagccaguuagccucaacacuauuuaugccuaauuuauccuuguugauuugaaaagcuucuuuuauguguauaaauucuguauacauagauguguuucauacucuucuguuguggcaauacuaugugguuucuguuacaacaauuacuauagcuuccuaauauuucccugucuuucuuguagaguuauuuuucuuuguuuauucauuuugguuaauguuuuuccucuuuauuuaaauucauuuuguuuaaucuugaacauuuacuccugcacauuaguuuuagaaucaguuuaaguucucuuaaaaaaaacuuacuggaauuuaauuaauacuguguugaauucgugauaguauuuuuacaacacuaagucuuucuaucaaaaaacauaguucguuggcugguggcucuugccuguuauccuagcauuuugagaggcugaggugggcagauaacuugagcucaggaguuugagaccagcguggggcaauacgaugaaacccugucucuacuaaaaauacaaaaauuagcugggugcgguggugcaugcauguagucccagcuacucaggaggaggcugaggcaggaggauugcuugagcccacacgauggagagguagcacugagcugagauagcaccauggcaccccagccugggcaacagagccaggcuuugucuuaaacaaacaaagaacaugguuuguccauuuagauuuccuuuuaugcccuuuagcaaguuuuauuuuuuuuuccauaaaguucuugaacauuuuguggugguuaaauuuauuauuuuacuuauuuuuacauauagcuauuagagaggaucuuuauuuuuuaguucucauauguuuucuaguuaguuacuacuagaguaaccuaucauccuaguuuauaccugcuacaugccauccauuuauucccauuguccugguuuggauaauaaauuaaaucguguggccuuaguuauuaacaauuuuaucauuuaggauuucauucaguuucaacuaauaaaaccucacuaguggauuguuaacaaauaagagguauauuuaucucauaacagaaaucugcauguaggugguccagugcucgugcaacagcuccauaauaucuucaggaaccucgccuugucuuccagcacuacugucuguagaauguaucuuucauccucauuuguaagaugguuucugcaccuucuggcaucuuuucuaucuucgagacauacaggaauaaaaaugcagagcaaaaugaguuuuuguuuucuuuucuggaaagagugaguuccccagcagcauuugccugcauuugauuuaccagaacuaccagacacauggccaucuaguugcagaggcaguuaaggagaaacaaggauuaaauacauaauuuaagaacuuaaacuuuauccuguagagagguauauguuauucaagguuuuugaaccagggcaugacauaauaaaacggagauuagaaagauucauuuggaaaugguuuggagaaugaguuaggcaaaugauuuugaaggcaaagaaagccuagcagauugauuaaaguggagaagagcacugaaguccaauuagaagacuuguuuaaucaauauacucagccuuuugugauaaugguaaugguuuguggguagauuaguaaccuugaaaacagaaaggaauaguggcuuauacuagugacuguccagaaagaccuagcugaucauuaaauuuuuggaauuguugagaaggccaguuuucuuucauucuaaacaguuaacauaguuaaggaacauagguaaggauacauuuaaggaaauagaauguuucaaauagcuuaaaaaauucucuuggccaacuuuuugaugaaguugguaaaguagcaguguaaguccaagagcccaggcauauuuacugucaugauuuucauagcaaugaauagguaaagaaaauacgagcacuagaagcuagaaaacaugccauuuucauggcaaauauuaauguucuucagcuaaauguuguuuggaugaugcuggaacaagaaggcuaacucaugacaccucuguugugacagagcaacaugccuagggauugaguggagggaacucugaacagaauuugaguugugccuucuucauauuggaaguauguggacaauuguuuuuguuguuguuuguuuguuuguuuuguuuuguaaauaagugucugaggcaggaaggggcaaucuuuuuggccuguuaccacuucaaguuuuucuaccagugcaagccaaaaauaagcugaaagaacaaacuaggaagaagaagagcugugcuauagcuuucuugguccaaaucuugauuuuggcauggcaugucaaaaccuagaaaaaacuuacccgcccaacauuugauauuucauguuaggacugccucuaacucuagcuguguuucauguaacaucuucuccauuuugcugcuucuaugaaucuaaauauuacagaaaagguaaaaaaaauccuauaucccuauguuaauauggauuuguacaacucuugucagaaacuagguaacuuagucuuuaauaauaaccuuguaaccuagucuuuaauaauaauaauuuaauaauaaccucgacauccauucuuagcagugauucuuaagucuuuuugagcuacuccuugccccaccguuaccaguaauccgaugaaagcaaacauucuuuuuuucccagggaaagggccauauucucauacuucgaaaguuuucuuuaaaguaucaggagcccagugcaguggcucaugccuguaaucccagcacuuugggaggccgaggcaggaugauugcuugagcccaggaguuugagacuagcccaggcaauauagugagcucuuaucucuucaaaaaauuaaaaaauugaccuagugugguggcacgcacccagcugcuggguagggugcggugggaggaucgcuugagccugggaggcggagguuggcugggugacggagugagacccuaucucaacaaaagggagcugggggaugaucaggagcccuugauguggaaaaaaguaggaucagauuucuaauaaaacgcuuucagccaugacauacuacugcauuucaaccuugugcaaaaaaaacaauuuuuaaaacuucaauucaguguuuucagcaagauucauggggacauuacaauuaaaacuggagcaaguagucaacuaggaauugcauggauaugaaaaauaaugcugggcguuagugaauauuugagcauuacagaaaaucuaaugaauuaacaaggagauaaaagcgaaaauacgcaaucagaauuuggaugagagguuuucauuuuaauucugaaacuauuucuuauuaguuaagcaucuguuaugccucuguugugucaggcauuguaauaucuacagaagaugcaguggugagcaagagaggugugauccuacucuuggugugaaaguuaaaagagugaaaaaugauuagaggaaaggcaugguagauauauuuagaagacacaaucuguacauaaguggaauuccagaaagaggacaucauuuaaauucugaggauuuuaaauuucaugguuaugguggggcaccuuauagugaucuaggcagaaaacaguuuaacuauacaaagaaauagucuagccuuagauugcaaagcaacacauucuuaagaguugggugggaaaaagauuaugauucguuguaauugaguacauucauuucaaguggaauccuaagguguguguuaaggcaguauuuauucucagacaugcauggacuuagaagauauuucacuaauacaucuuuuucuaaaacauuaaaaugaagaucuuaagaaauggagaaguuauuguauaaaauguuggcggugaacaaugaaaccaguuaaacauagacuaaaaucuaaauaaucacauuuuuauaaaauaaauuucaaaaaauaucacuuaaaauuaccagaaagauaauuuucgugugaaauguauaaucaaaaauuggaauguagccaaggaguaaaggcuaaauguuucaacuuauacaucggaacauaguaguuucaaauuucuuuuaaaauugaaaauuaccauuaguagaauagcacuagaacuaauuucuucuaaauaauugaguugaaggaacaugugggauaaaaucccauauagugcaaaaggaaaugacaagagugcccaaaaagaacagaaaguaugaaauugcaugagaacaguuaugaugaaauucagaucaauuaacaaauacuugcugaauguuuaagcaugacuuuaugcacugggaauagaauauugaagaacacaaagucucugguaucacagaguuuuaacuucaagggguagagagagaaagaccacaaauaaguuaaaaaugcauauguauuauguuuguuuucaacaagugcuaugguaaaaaaaaauuaggaaaggggaauagaaguacucuuguuggggaaugaagagcugugcaacuuucaguaaguuaguuggggaagaucucauugaaaaggugauauaugagcaaacauuugaagaagaugagggaacaaaccacguccuggauugagagcauuccagacagaaggaauagcaccugucaaaccuauaccuuuguagcaucuuagaggaguagaaaggaugcuuggggauggagugaagaaguauaggaaggaaguguauugugguuugggaguuagaagguagguagaacauacguuguaaacuuuuagaggccauuguuaaguacuggcuuuuuuuccuugagucuaaugagagguuuugaguuguggaacagcagguucagucuggguuuauguugugaauagagagugagugaauggcaaggacugaagcagagaccauuacgaggcgauuguaguaaucaaagcaaaagguaguaguagauuagaccagggugauagcaguugaacuuuagacauuugagaugucacagugcuaugagaaaccauguuuuugaaaguuacaguaguucccguuuaucugaggcuuggcuuugcaguuucaguggucaguugugguuugaaaauauugaauagaaaauuccagaaauaaacaacauguuuuaaacugugcccuguucugaguuagcaugaugaaauuucaugcaguccaacuccagcccacuggggcugugagucauugcuuugucuagaguauccacauuuuauaugcuaccugcccacuagucacuuaauagcugucuugguuaucagauugaccgucacuguauugcagugcuuguguuuaacccucauuuuacuuaauaauggcccuaaagugcaaguauggugaugcuggcaauuuggauaugccaaagagaaggggaaaaauguuuccuuuaagugaaaaguugaaaguucuggacuuaauaaggagagaaaaaaauuguaugcugaagucgcuaagaucuacaguacaguaagauauuuugacagaccguauucacguaaguuuuauuacacuauauucuuacaacuuauuuuuuuaauuuaaaauauggaaugccuaacgaauaugcgugucauccuugcgcaggggccaugcuaauuaccguaucauuccaauuuuaguauaugugcugcugaagggagcguuuuucuauuuuauuauuguugaucuuuuacuaugucuaauuuauaaauuaaacuuucauguauauacaggaaaaaaaacauaguauauauaggguucagcacgagcacgguuucaaggcauccaccaggggucuuggauaaggagaaacugcuguaguuaaugauaagaaaaugcagaugaguugugaaagaugagauguaaaauuaggcuguguaaucacaaauugaaaaaaaugucuuuauaaauaggaaaagguaauaaucauguguccuuuagaauaggaagauuuuagauuuuuguucuauauuuucuaaauugcuuuauacuaaauuucuuuuguucaaaauauuuuuccuacguagaacaaagaggugaagaaaaagacuuuagagucaaagaaaguaucugcaucuaccuuaaaguaagugacuuuaugauuucauaugugagaaugaaaugugcauaugacuuaagaaauuuuaauuuuuaaaaccgcauuuuaaauauauuuuaucacuauaacuauaguuuaagagggauaucacuccaguugaauuauuuuaaacguuuuuagguuuaaauauuacauuuuuaggauuuuguagaacuuagaauuccuaaguugcugcuaaauuuuuucuccuuuuaaauagaagagaugcagaugcuucaaaagcuguugaaauuguuacuucaacuucugcugguaaguuguuacuuuuaauauucuuucaaaugaguguaucuugucaguuuaguagaaacuuagaugaugaugcuaugaagacacuauugugcuuuaaugaaggagacccaaauuacauucuuuaauuggccccuguauuaagcaggcgguuaauauuuaaugcuguguaauuacagaaucacuucuggaguaaauacaacaaaucugugagauaauguaugugaaauagcuaucguaguuccacaguuaauagcuguuuuuuacauguuuagguuaguuaugcaauaucucccuccaucccuucccgauaaacccacaagacacaaaacauaagaaagguauguuaagaaugcuuaucugguccucuuugauuuuggagguuaauugagagccaaaaagcaagcaaaaaagacuauccagaaauggaugcuaucauacucauguacuaaaagcuauuucuuuauacucaggaaaauacuugaagccaucauuaugaauccaguuaaauaaauuuugcauacaguuuuauaauccggguucuccuuuuucuuaguccauuuaggacuagaaagguggaaaguuuugagacuaguacuagugagaauaaacagcucgauagugaaagacaggaaagaaaagcuaaaauaaggcagagacaaauuuaggaacuuacauugcguuuuguauguucuguuuggggaagguaaaaauauaguguguugguuuuucuaacuggaaugagguaagaauuuaggcacuaaguuuuacuagugaggugaaaauuggauuguggaauaucucauuuccccguaauguuuaguuguauagaguauugaaguauugaagguuagcagagauacuaugaauggcuucuggaaggcaguacauuuugauuaagauuuuaaauuagguaacauuaugugaagagauaaaauguggaggcagaagauuacuucaucuggggggcacacaacaacaaagguaacaaaguucaauuauucuauugaaggccuugaagggucaugcugagaaguuuucaaauuugaccccauuaguagcauuuucagaaugugucauguuaaagaguaauuucugaaagaaguuuuggguaaaaagguuugggguguguguuauagcuauuuuuucucuuuugaaaaaauaauucacagaacacauuuuaugaaauccuucaggaaagaaaccuauuuagcuuuguuuaguccacuguuuccuaagcuuggcaaaaguacacuccauuuuuucuggauaagagcuaguaaaaauugguacagacucugggaaauugcaguagagaauauggagccacucacuaauuguuuaggauucuuauauagauuggauaaauuggagagauguaaaaaucccacugagaaaaaacagcugggcuucacuuugggaugaugaggaccugaugugaaaaagguuaauuuaagugaugugaggagguaaaauuugcauuuuauuauauggaauuuuucaguaagugaguuuaaaaaauuuuuuaaauaauuauaaaauuuccaaguuucaguccugauagguuuuacuaagagugcgaugauauuauugauuacaauuggaaaacucacaguggugccuuugaauuugggguuagguccuuagauuucaacauuaccaaguuucagcugucacgaguaucugcuagagauauucuuuagucagccaaucauauggcauugaaagugagauacuugggaauuuuuuuaaguuuaaggucuaaauuuuggaaagcuaaaauacuuccuugcaauauaaauguagaaagaaaaaggagccuauaaacaggacugagaaagugacaggugagaaaggaaggguacuugauaauuuuuugagauccgcucagauugaagagugacaggaagaguuaauuagagcaguuuuaaggauaaauuugauuauaagcacagggaggaagcaagaguguaauuugaucaugaauggaaacauucgagcucuuacccaguacuaauuaaaaagaaaaauaguaauuacugaguagcuauuauaugcccaugauagggggcacuuuguagaggcuuaggauguaucaguggaccaaauaggcauggcuguccccagacaguuuacauuuuuaacuugaggugacaaauauuaaauauaaaauaaacauuaaauaauaugaguuuuagaaaaugagaaguucugugacacaaagcuaaagcagaaccaggguaaaggugaugcaggauuaguuuguuuuaaaguuagaauuuaguguacaaaauaagguaaaaaugacuuauuaaguagacagaccuacuaacauaaucuguaccagaagagagaaaacaaagaaaagaagccucacauuuguggguaugauauuuaugcuggacacaugggcacauaguauauuuauguuauuuuguuuaaucuuucaaaccguucuuugaguuguaguuaauguuuggcugggugcgauggcuuaugccuacaaucccagcacuuugggaguuugaggcgggugcaucaccugaggucaggaguucaagaccagccuggccaacauggugaaaccccgucucuacuaaaauacaaagauuagcuguguguggugguaguagucccagcuacucaggaggccgaggcacgagagucucuugaaccugggaggcagagguugcagugagccaagaucgugccacugcacuccagccugggugacaagagcgagacuccaccucaaaaaaauauauuguucucauuuucuagaagagauagauucagaaagguuaaaugagucagggccacauggaggaguuagaauuugaacgcaaaacuuuaugauuccaaagcguugcauauacuaaauuaccucccucaagaaugaaaacuucuugauuuucuuggaucacuacuuuucuccagccuuucuaguuuuccuaauaaucuuuuccucuucucaugucaugcuuuucuuccugggugguuuuuuuuuuuuuuuuuuuuucuucuuuuauugagauggaguuucacucuguugccuaguuuggaguacaguggcaugaucuuggcucacugcaacccgugccucccagguucaagugauucugccucagccucccgaguagcugggauuacggguaugcgacacuaugccuggcuaauuuuucuuuuuuuuuuucuuuuucuuuuuuuuuuuuuuuuuuuaguagagaugggguuucaccuuguuggccaggcuggucucaaacuccuaaacuuaagugaugcacccaccucggccucccaaagugcugggauuacaggugugagccaccaugccuggcccucuuccugggugauuucuuuccugucagucuuuaaggacaucucccuuacguacauaaacucuucuauccccuugaguauacucuucucauuuucuuauauuauuuaacaguuaccacuaaucauccgguagaguaguucuuaacccugucuucucuuuucuucuguucaacauaauucagauuuagauaacauccuuccccuuuucagccaaucaguggcggauccauauuaguuuuccacugacucuacuucagcucucaaauucuuuauauguagcuccaucaugccuguaacuccuuuuaauucagaccugucgucucacauuugaacuuuggaagauagccuccugacugguauuuuuuauuccauacucugcuuuauuauacacguuguugcccagaggucucuuuaaagcagaucugaucauucuacuucuagcaaccaguggaauaaaguccaaauucuuuggcuuuccauaaauuauucuuugcccuuugaccccagauuaucuuuugaaccuauuaacagucaacuguguauuauuuuguagucacucagaauaguuuauuuuccauguuacuucauuccuugguucuuuauuuaugcugucuauuugcauggaauugauggcugacuucauuuaacuucaguaagcacuuaauaggucgcaggcaagguacugaagauaaaaagucaguuaagacuucuuuuggggagaguuggaggacagauucugauuuauccuguaaggcucaucucugaugaaacuuccuugaucgaaugauuuuuuucucuuguuauggcuuuucucuuuuuuagaaauaauauguccccuuuucuuuuuaccuuuucaguucccagcugaaaaugacauucuuuuaaaucuaaguauaaaaguaaugaauguuuauugugaaaauuuuaaaauauuucagaaaauguuuaaagaaagugauuuacaccauucagagaucaccucuuguuuauuugcuuaagucaguuauuuucccaauaaaagcccuuugcucaccugugggaacucccacaugugaguuccaccaaaucuuucagaaagcaauaucgauuucagcuauaccauggcauucaggagaagggaaagcuuccuguaaaaggggaaaugagaaaaggugggggaacaggcuaauacaucaaauacugacaaagacacuacacaccuaucagaauggcuaaaauaaaaaauacugauagcaccaaaugcugaugaguauguagagaaacucauacauugugugcaagagcaauugugaaauaguacagccauucuagaaaagaguaugacaguuuaacuuaacaaaacuaaacacaugcuuaccauaugacaucacuuacacucuugggcacucaucccagagaaaugaaaacuuagcucauacaagggccuauacacgaguauuuauggguacuuuguuuauaauugccccaaacuggaaacaacccaaauguucuucaguggaugaauggcuauuuuaaaaaguuuuauauuauaaaauuucauguauaucacauugaaaugaaauuacagagagagaacagauuagugauagucaggguuggugggagggagguggcuauugcuauaaauggguuuuagaagagaucauuaugaaggaaccauucuguaucuuggcuggugguagucacacugaucuacaccuaugauaaaauuucagagcuaaguacacauuacauguaaaaugagugaaaucuggguguugguagauuguaucaauugugucaguuuucugucugugauacuguacuacaguuaugcaaaguguuaaccauuggagggaaacugggugaaggguauauggggucucuccuuuuuucauacaacuccaugugaauuuacaauuaucucaaaagugaaaguuaaauauuuuuuaauugcugacagcuuucauaaaacuauagaauuauauguaggaauauuaauguuaaauuuuaguguaaaauuuuaacauauagugucugcgagcacuuugaauaauggacuaugcacaagagagggucguauuggaaguauaaagaugguucaaaaugaggaaaucuguuaauucaauacuaccauauuaaaaaaagaacauaugauccuuuccauaaauacugaaagggauauuaacuucaacauccauuucuagcauuuaaaaaagaaaucuuagcaugggcaucauagugagacccagucuguaucagaaauuaagaaguuaucugggcauguuggcaugugccagcuacuugcaaggcugaucugggaggauugcuugagcccaggaggucgacgcuucagugaacugugaucgugcuacuguaccccagccuaugcaacagagugagaccuugucucaaaaaaaaaaaaaaaaaaaaaaaaguuucuuaaauuuaugauauguauguguguauauauacuuuuauuuaugcacacacauacauauacaaguacacauauguuaaaagccagcauauguuuaauaaugcauuagaugcauucccauuaagguugggaacuaaacugagaauaugcaucaacaccucuuucaguuaaaauaaauauuuuuuaaaacuaauaaccauuaaccaguacaauguaauucaagaggcauggaaauuggaaaguaggauacaccguuauuugcaaauaugauaguacgaaggaaaaccuaagagaaucaauuauacagugcuauuuaauuauaauuacccaucuuaauucucuaauaugucauguuuaauugcuuuuuaaagaagagcuccuuauguaaucuaauauuaaauaguccauuuauaauaauaaaaaugguagaaguuauaaaaagaaaacuaaaauauuaaaaggcauaaaaugagccuuaaaugaaaaaauggcauucuuggauagaaagcuucacuguuauaagaugccuuuuuuuucuuuuuuucuuuucuucuuuuuuuucuguugcccaggcuggaguucaguuguggaaucucaguucauugcagucuccaccucccagguucaagugcuucuuccaccucauccuccugaguagcugguauuacaggccagagacaccucauccagcuaaaccuuuuuuuucuuuauacacuaaguauaaagaauaauagcaauaaaacauuuuaaauuacauaagcugauucuaaguuuauauauuauaagaaauuaacauagaagaauaggcaggacaguucuuuaaagaaaacaaugaaaacagacuauccacaauaaauauuaaaauauauuacaaaguucgaagauuuagaguaguuucauauaguuacauagacaaaaaguaggacagaagagaguccagagauauuucccaaaacauacaaaacaucaguaaauuuguaugauaauauuucguuuuaguuggaaaaagaucaauuauucauuaaauuagcuacuuuuuuuuuacuuuugauaaaaguaaaagcacuuugcuuggugcgguggcugacgccuguaaucccagcacuuucggaggccaagguggcuggaucacuugaggccaggaguuugagaccagccuggccaacauggugaaaucccaucucuacuaaaaauacaaaaauuagcugggugugguggugcucuccuguagacccagguacucaggaggcugaggcaggagaauugccugaaccugggagguggagguuguaaugagcugagaucaugccacucagccugggcaacagagcaagacucucucaaaaaaaaaaaaguaaaagugcuuauaucaaacugcaguuggaucaaagauuuacuaugauacauaagaugauaacaguauucuuuaaguguggagaauauuuuuuguaaaauuuagguugagaaguccuucccaaucaggaagacauuugacuacauaaaauguauuaaugcauaaguauuuugagugacuuuagaaaauuguuaaccuauguguuaauuuucuuaaggaacucuaauaaaaaauaagaagccucaacccaaaagauaaauuggaaaauaguaugauuaggcagauuauagagaaagaaguagagaugacuuuuaaacauaugaagacggauacaacuacacuuauaauuaaagaaaaaaaaauccuaccaguuuccauuucacauugggaagguugaucauuucaguuaaccauguuagguuuuuguaggagauuggucaggguggugggaaaaguuauaaggagagacgcaaaccuucuuggaaguccugggagguuuugcaaagcuucgggagagaauaaaggcugaaggcagcuaaauucucuuacccugaggcuaagggcaaguaguagguaacaaaggaguguaaaggaauuuaucuagauaaguuuauuuacuuuugccgaccuuugaucauccgaccuuugaucauccgaccuuugaucaucugaccuuugaucaucugaccuuugaucauccgaccuuugaucaucugaccuuugaucauccgcgugcaggacugcucccuacaggcgggggcaacaacuacccacagauuguguuggcuccaggccuuugucauuaaaucuguacuaaauaaauacaagcagcuccagcuuauuggggcugcguucucucuucggcgucucuaaggccgagcaguuuccuagcugcgcucacgcaaaauaccugugucugcguacuuuuuucauccgucgcucggccagagucgguggaucagacucagcagcuggugccccucgugaggaacacugcaagggaucacgacggaacccccgaaaaugaaggcgaagagacugugcagucaguaagucauuggugcccacucgggauauccaaguucaggggaauucucagacuagaguuucaucaugagacaacagcuguccgcacaacagaaacaguauauaaaaguauugaaacaacugcuuaaagcuagcagagccucgguuucacaggcucaguuaaggguccuaaggcaaacuguuguuucccauaauccaugguucccagcagaaggcaugcuggaccuagagcucugggaauaaguggggagaaaucuuaaacaauaccauaaacaagggcaacgggucccaguaacaucuuuaaccuuaugggccuuaguuagggcugcuuuggcccugcuguacacagaagaucccaagaagggaagggagaaggaaccaucaccuaccuuaccgccgccuccucuucccucagcccugccauuacuggguaaagauaccaaagaggaaacagagguuuucccugagcccccucccccaauaaauuggaaaaaagacaagggauacacuacagcugugggacccugucuuaggcaaguggcauuagaaggggagcucuuaaccugcccgguaaugcaagaucagcaagguacucagguauaugaacccauuucuuuugacgcuuauaaagauaagaaaaagcaucagagcaaacggagcugcuaguccauuuaugaaaggauuaauugaagccauagcagacaacuucuguuuggccccaugggacuggucagugcuagcuaaaacaacuuuagagcccagucaguaccuccucuggaagacagaguaugaugaguuguaugaacaacaagccaaccagaaucaauuggccgggcaaaacauaacagcugcuaugcuucaggggagggguuccuaugccaguguccaacaacaauuaaguuuuguucccuaagccuaugcacaagugucuuugugugcuaugagggcuugggacugaauucccgaauuccgaaagcggaaguucaacaaggaucuuuauaaauguucgacaagggccucaggagccauuuuuugaauuuaucaaucgguuaacccaggcaauuaagagacaaauuagucauccccaggccgcugauaaucuuauuguugcaguuggcuuaugaaaaugcuaacgucgacugccaacaagcaaugcaggcagucagaggaaaggcaguuacggccagggaacuuacacgagcacgucaacugguggggacugaaacacacaaagccaaaauauuggccauggcaauaaagucuccugaagugaaaagggagaaaaccccaaauuguuuucuguguggagagccaggucauaagaagaggcagugccccacuaguagagaccaagguaacucagcaaaagaacccccuucuauaugcccccgacguagaaaggggaaacguugggcaaaucagugcaaguccaaauuugauaaagaugccaaccaccuaaguaaucaggugggaaacuucaugaggggccagccccaggcccugcuccaaacuugggcaaugccagcggcuuuccucggucaauuggaaagcccacaguccacucucucagaacagccaccucugggagcgcaggauugggcuuacucugccccaacgaauuagugcuaaaaggagaagacccuaaaaggauugcaacagggaucuggggcccacugccuccagaacagugggauugguccuaggaugaucaagccuauccagcaaaggaauuaaugugcucaccaggguaauugauagugauuaucaagauugagguauuaguuaugauggaguguaaaggucugcauauucuucccccuaaaucuaaaauagcucaguuacuauucuuaccguacuggguccccaaugcccagggaaagaggaagggaaguuuuggaagcacgggagccguaggaguguauuggaaccaguuaaucacugaucagagacccaugauuaccuuaaaaaucggaaauaagaauuuuacuggcuuauaggauacaggggugaauauuucgauuauuaguuaucaaaacuggucagaaacuuggccuugggucacucagaaacaaaaaauugucagcacuggcuaagugcacacagccaagcagagcacacacccccuaacguugugauuuggagggaaaaaacaguuagcaacucuaaacaugacugucccuguuaaccuuuggggacgggaccgauuagcccaaugggggcugcaaaccccuuucuaauaauggccacuguuguuauucuuccccuaccccugacgugguucucucaagauccaauuuggguagcacaguggccuuuaaagggagggaaauaacagugagcccaugaguuaguucagcaauuaaaagccagccauauagaaccaucaagcagcccuuagaauuugcccauuuucaucauucccaaaaggucugggaaauggggacuugcaugacuuacgggcuaucaguggcaguuugcaaccuauggggccccuucaacggggcucccuuccccuguggcaauucuucaagauaggccuauagucgauauugacuuaaaagacugcuuuaauacuauuccccuugcagaacagggcagagaacaauuuacauuuaccauacuagcuaucaguaaugaaagggcagcuugccaauuucauuggaaaguacuuccucaaggaaugcugaacaguccuaccaugugucagcaucauguaaaucaggcuuugcuccccaguagaaaaaaauuuccuaauugcaagauuauucauuuuguagaugauauuuuacuagcagacccaacagagccaauacuuuugaguuuauaugccucugucguuaagauguuaaucauagcaccugaaaaaguacagauguccucaccuuggaaauaucuuagguacauacuaacuuccuggucaguaagaccucaaaagguuaaauuaaauacuagcaacuuacauaccuuaaaugauuaucaaaaauuacugggugauauuaacuggcauccccccaccuugggcauaacuacugauaaauuacagaaccuguuuucuauccuaaaaggcagugcugcccuagacucacccagguauuuaacccccgcagcaaaaagggaaauugaggaaauagaccaaguuauuucucagagacaacuagauagcauagauccacgauauucaguucaguuguuuguuuuuccugcuaaacacuccucuacaggauuaauaggacagauggccacagggcugcgcuuccuagaauguguuuuuugcucacauacugggacuaaaacacuauuuggcuauauccagcuaguuaguaaagucaucuauaugggcugcagacgaugcaaucuguggcuggguuaugacccugaaugucauaagaauuuucuugaguagaaauucgaaguagucuugcuccaucucuagauuuucaauuagcacucuuugauuaugcaggccauauaaaauaugcccuuccugcuggcagacuauuucaguucuuaucucauacuccucuaguuuugccaacaaaaguaguucacucccucauaccuaaagcuuuaacgcuuuuuacugauggcucugguaaaaauggaaaagcggcuauuugguggaaaccacauaauucccucacucaaucuggauuuacuaccgcucagggagcugagguuggagcccuaguacuggcccuagaaaccgaauccguucagcccauuaacauuguuagugacucuguuuguuuguugcaaaaccuugagaccgcccucauuaaguccacucucgagccuacccuguguacaccuuuucuuggacuucagcaauugcugggucaacauacacaguuuuaucacacauauucgagcacacagcucacugccuugcccacuggcuuauggcagugaucaagcagaccugcagcuuaugacgucacugcuugaccaagccacccagucgcuucaguuuuuccaccaaaauuagagaaacuuaacaauagcagcuuacccaaagacuggguaaacaaauuauccugcagugcccagauugccagcucacaggcacaucucuuccuugaacagguguuaaccuuagaggacuagaaccuuauccauuauagcaacagauguuacacacgucccuaaauuuggaauacuaagauauguacauguauccauugauaccaguuccuaccuaauuagcgcacaugcucuuccuggagaguccacacgauacaucauuaaacaucuuuuaacuuuugcguuuaugggguggcccacaaaaauuaaaacugauaauaaucuggccugugccagcucacauauucaacaauuuugucacacauggagcauccaacauuccacaggcaucccguauaacugacaggccauaguagaacgugcccacuccacccuuaaaaauaugcucagaaaacaaaaaggggaaaaugaguaaggacccugcaacacuacuagcacaaguguuauuuacccuuaauuucuaaaauuuaaaugauaaauuucaaucaacuauagaaaagcaccuugcuaaaaccucucaagacauaaaacccgcaguuuuauggaaagauguaaauaguaacguaugguguaguccaaaugaauugcuaacguggggaagaugauaugcuuguguucacaccccccucaggcccucuuuggauuccaguacgaugcaucagaccauaccauggcguggcuaggacccaacacaguaccagaagugaaggaaaugauccugcaggacccgcagcuccagacaacacagcuuccucagacgacacaagccccggacauuaccugggggaugcugaagaagacaacuuacaaggcugagcaaauccugcuccagacacagaaaccauucacuccagauaauuuguuccuugcucugcucucugguguaaguuacaacucacguaggauccuuuuuaugcucucgcuuccccugcaacccguaccggcuacacucuauugggcucaucuguuagauccgccuuucuuacgcccuguuaccugggcaggcacccccuucccagccucuaauaacguuaacugcuuggcuaggagggauugacuuaucccaguaggguccguuauuaauggcacacauuggacuaaggugccagguaacacuacauaucacuccauuaucuucccacuguguguaagguuacuauguaccugccgaaacacaauuauggcuacaaauggcaaaggaauugccuuaacauucuugugccaguagccucaaaccgggcaaggcaaucagugccacuuuccccagcauucuucccugugcuaaagaacaaagccaggaaaguaauggauuccacuuugguugggaggucugucacgggggacaagcccuuagucuccaguuaggcaauuuaacaucuuagacuggagcccccacggucauuuacagggcgaccauacugauguuugcauccauuguggugucaaucuuaguuucauagccauguccguuccccugugauuugggccaaaggggggaugggauaucccagaccccaaguagaguccuugccaccccaagacacuuaauggcaucugggacaucuuagcaccacccuuaacaccuggcaugggacauaacauaauuccaguaacaauuauacuaugaccuuuaugcauaaucacacagaucagugccugauuugcacuacccauccauauguuuuucuuaugggaaccaguauuuccauuacaccucaaaacuccauguuugugaccugagugcaaggacaggcuugcuucaccucauguaucauuaauuacaauauaucuaauuuaaauauuacuaguauuaugguauuaaggagacaaucugaggcauuccuaccagucaguuugauacacgauuggcaagguuccuuugcucuugccaccuuagaacaugcccugucccaggucagacaccaaagauucauaguuaaucuuacagccuuuauagucucagccauagucauccuagcaacugcuaguuuugcuguagcaucuauuacugaaucaguacaaauagcugcuuuuguagauaacuuggccagaaaugugucuaaugaacuucucuuacagcaggguacaaaucaaaagguucuugcacaucugcaagcccucgaggcugccuuggaacauguaggggagugacaagaugcgcuggcauucugacagcaauuaaacugugacugggagcauaagcauaucugugucaccucucuaccauggaaccaaucaauacauaguugggaugaggugaaacaacaccucggggugaccuuacaugauaauuuaacagcagacguaaagcaacuuaaaacuaaaauucuagaaucccuaaacgccauagaucuacauguccaacaaacaguuauauggaaggaugugcaagaacaucucuccuggauagacccucacuccuugauuggaaaaaaauauuacuaauuauacucauguuugucuuauguuauuuacuaauucuaggaugcaaagccggaauacgagcaguaaucgcuacgccugacaaaccugcugcugugcacaucuguacucuucaaucaacaaaaccugaugcaaaaaacaaaagggggagauguaggagaucagucaggguggugggaaaaguuauaaggagagacgcaaaccuucuuggaaguccaggagguuuugcaaagcuucgggagagaauaaaggcugaaggcagcuaaauucucuuacccugacgcuaagggcaagaaguagguaacaaaggaguguaaaggaauuuaucuagacgaguuuuauuuacuuuugcagaccuuugaucauccuauugcgcgcaggacugcucccaaggcggugggggugacaauuaccuacagauuguguuggcuccaggccuuugucauuaaaucuguacugaauaaauacaagcggcuccagcuuaucagggcugcauucucucuuuggugucucuaaggccgaacaguccccuagccgcacucaugcaaaauaccugugucuguguacuuuuuucauccgucgcucagccugagucugcaggucagacuuggcaggauuuugacuugauauauuguguguguuuggaaauggggaauaauuccuaugcuuauguacuguugaugggaauauuaauugguucagccuuucugaaggucagucuaauguuacuuguuaaaauuuaaaucuguaugccuuuugauacaucaaguccauaucuaagaauuugcccccauaguaauuccauggacauacaaagaugaguauagggcuguuucuugcaggguucuuucgaaauuauugcuagguugacuuuuaacuaaauccaagugauguuauuuguaauguaguacuuaaauguuuuucuuguuguuuuagccaaaacuggacaagccaaggcaucuguagccaaaguaaacaaaucuacagguauguuuuuuuaauuaggauucuagacuauuaguuaaaacuuuaauguauuuuaaaaucguauggcaguaguagucuuggauuucacaugacauagucuguauugaaugcaugcuaaucuuugagauuuauaaucaucuagcaauuuugagaaaugauauguacuagauaaugcuucuauaguaauuauugaaauaauuaacuggagaaauuucuuaugaugaguaucacauauuuuccucuuucucuuuuauugaggucucucuucuuccuuacuuuuauauaauaguucaauaaauaugauccuuuguaguuuuugugagcuauagugggauuuuagguaauuauuaaguuuuuucucuuuucccuggcauaauccuuuccaguuuuucucccaguucugcuaaauccugauuaauucagggucaucucuuuaaguggauagaaaucaauguauuaaauuaucuuucaagccaggcaugguggcucacgccuauaaucccaucacuuugggagaccgaagaggguggaucaccugaagucaggaguuaaguccagcuuggccaacgaggugaaauucugucucuacugaaaauacaaaaaaacuagccaggcaccagugaugcacgccuguaaucucagcuacugggaaggcuggggcaggagaaucgcuugaacccgggagguggaaguugcagugagcugagaucuugccacugcacuccagccuaggggacagagugagacucugucucaaauaaauaaacaaacaaauaaucuuucauauaauguuaaaaaggaaaggaaacagccuggaacuggcaaaaaucauuauuaguggcagauccagaauuuucauauaguaguuucauagaagcaguaauuugaguggguuauggguggcuaggaaacuugucuugaagcugcauuuauuuugccaacacuuugauguuacuuugauaccaaguguaugggagucauuggggaugugguagacugggauuaagcugauggccaccccuuuacuugcuggaaauuaaugccagcuauuuuuuauuuuuuccuuaagucccaguacccagauagaagugauuugugauaauaacauagggauagugaaagaaauaucuuaagggcucacugaggcucaguuuacugcaguguggcaaaagucgugaaugacaaguuacgugacaagcuauaaggauuuguauugcucuuuuugagcaaagauuauggacugucuugacuauaaaggguggauuuguaaacuuucaguugauuuuuuuagaugucaaugaaugcuuuuuguaugauuuuuaaaaguaugauuguauucucauaacguuccuguuagguaauuuuggcaaucaccacccuuauguauagggaaauguguacacaaaucuguucgugccccaaagcuucucaauaaaaauuggaauucaauuuagaucuauugauuuuuuaucuugggcuuuuuccucauccauucucgcuaguuguuaugaauccuaauuucgaaguuaaaucuucuguugcucucugaaugguggaaaggguuugggcucucugaugaucuucugcaacacuuucaugaucacaucuuuauaaacaguaucaucuuggaaaauaggccauaguaauagauaauguagguacaaauaauggucagagcaauuuaaauaguacuguacagcuaggaaacuguaggaaugagucaaaacaaucuuuauaugaccugacuaugauauaaguauucuugaaugcuuucuaaucaauuaggagccguggaaguguggguugggaggaucuagguuuaacugcuuuuggaacugcucaaaguaugggauuguuuuuguguccuuggaauuaguaauuuugcuucuaguugauccacacauucagaaauuuauuuaacuugcaugaaugcuauuuuaaguacagguugaguaucccuuauccaaaaugguugggagcagaaguguuuuagauuuuggauuuuuuuucagauuuuggaauauuugcauauauauaaugaaauaucugggggaugggagccaagucuaaacgugaaauucauuuauguuucauauacaccuuauauacauagccugaaggcaauuuuauacaguguuuuaaauaauuuugugcaugaaacaguuuuuuuuaaguacuuacaugggaauuucccucuuguggugucaugucagcagcacucgggguuucagguuuuggaacauuucagauuuuggauuuucaguuuagggauguuugaccuauaccccaguagggagguaaauaucuuauuucagugauuucuuuuuucugaagaaauuaucaucauugcuagauuuagaaaauggccuauguccccaaagaugauagcauuuuauguuuugaauaaaacacagccuauuauucuuacaucuuuuucucugugagguucuuuggagauuguugauacuaguuaaguaaaccaguuuugacugcaucuuuugugauuuagggaaaucagcaaguucuguaaaaucugugguaacgguagcuguuaaagguaauaaagcuucaaucaaaacagguaagacuauuggggaggagagauuuuauuguuuauucuuuauuuauguuuuaaauucguauaauaauuuuuagcaucuaauacuugaagaguuuaguagauauuuccuugauauuuaaaaccugacccauuuuguuggaauuuuaucuuuggcagauaggcagauauauuuuugugcauguaaacaaucacauauauauaaagcuauauaacuguacauuuuugacagcuuuguaaucacagguugcucugucguuucccuccauaaaugguuuaaucuuuguuuccuucgcuuuuuuuagaguugucaauucauauugcccucuccaguuuguacaguuucuuagaugcuuguuacuuuuaaaaaggauguuaggagaauucauuuuuuuucauaaagaaauggaacacuauuuaaaauaaauuuagcaccuugcaacuagagcaaucuuuuuaguaguaccuuuccuaacagacuaauucuaaagaaucuuugcagaaauuacacaguauuauuuuugcgugugugugauuacaauguuggucugccacaugaagguuaaacauguggcucauuugacggcaucaccaaaaaguuguaucuugauuuaaauuugcuuuuaaucuuacugggaaagagguacugaaaauaaauagaaauaaugacuauguggaaaagagcugcuuuuguaauaaagucaaacuaauuuacuaauacauuagugugaaacaugcuaaaugauuuaacaagaccuuuagaauaauggcugacuguacuuuuacaagcaaaaucugguggaaagaagucucuagaagccaaaaagacugggaaugucaaaaacaaagacucuaacaaaccugugacuauaccagguaagcuugaaauguggucauucagugcuuuguuuucuuuucuuuuuuuuaacuuuuuaaguucagggguacaugugcagguuucuuacauagguaaacgugucauggggguuuguuguacagguuauuucaucacccagauauuaagccuaggacccauuaguuauuuuuccugauccucuccuucgucccauccuccaccuuccaauaggccccaguguguuguuucccucuauggguccauuuauuuucuuuagaucaucuuuaagguauauuuugaaauuuugccuaaaaauuaucaaaguggggauugcugucuuuuguuuuucaaagagagauguuuggcuuaugucaggucagccuaaggagacuugaaaugucaaacuagcuuaaguuccuguuuagauucauuaguuuaauuauauuaguguuuuacuagacuauuaaagcagacuauuucaugcagaaaacucugaaauaaagaccaguauugaagucaaagccacugaaaacugugcuaaagaagcuauuucugguaggucaauagaaauuuuauuuuguucuuuacuuauuuuaauuaccaaugccauaccuaagugaaauuaagaguauuacgauucaugucuuuaucucuuaaucugaaauuuugaucucagaaugaaauuuaaauguauuuuuuaaaagccaaugucacuuuuguagucauuuuguacuaauucucuagacuuguuguauuacacguuuucauguagcuacuguuuaaccuauuguggaauaaaguaggaucuugauaaguaugucugcauuguuuuuaauuuuauuuuguauuaagaugcugcuuuggaggccacagagaaugaaccacuuaacaaggucaguuuucauguuuuauuuauuucuuuaaagcucaagacauuuuaacaaaagauauuuuucuuauaaacccagguaaaaaauucaugguauuuggcaugugagaaauuccagucauuugugacuuuuaaaacaugauuuuuagaaaggaaaagagaaaaaaaugugauuuuagcucaaaaacccugaggugcagaguaagucacaaaaaguaggaacagaucaucaacaaauguacauguuuuuugaagauuacuuuucauuugccaaaauggguuuuggguagacaguaguugguuaaauuagaaucaguagaauuuugugaagucuauuuuuuucuuagagguaaaugggagauauguuaaugguuagaauaccaguuguuugcauuuauggggaagcaaguggaguuugcaguuuaaaggacaugaaguucacuuaauauauuguuuucuuauguuuauaucuauuauuauuaauacauuacaaucauuaauuuacauuuuacuggugcagguuuuuagauccuucagguguugagcauaaguuuuugucuaguagauccauucuucaaguaguaacuaaguaguaagucuuauuuuaggaagaguauuuuauagcaccaauuuaguguaaagucacacuaaacugguuuaugaagauuguaacuuccugccuuuuuuucccccuagauaucaaaaauugccaaguugacuauagcacaucaucuuuagaaauuuucccaguaagcaugaaaggaguaauuggcauugaugagagaguuaccuugaagaauaaaauggaucugagagaagggauggcagaaaacaaaagugcuuaauugcauugaggauuggguugugggguaaagauucucaggagcuuuuuuauuauguauugccuaagugauuaucuuauucaggaagauaaaaggauacacacugauuuggagcuuggggauauuaucacaaggcacagggauggcgacaguauaugaaaggaagcaguuguagccaaaaacaaaugaacuuguguuuuaaaacagugggugacagcugcuuggguggcugagacacaagaaucacuugaaccugggagacagagcuugcagugagccgagguuguaccacugcacuccagccugggcaacagagcaagacuaaaaaaaaaaaacagugggugaaaaagaguccagcagaccucgacuagaugacagaugguauaacuacaauuagucuguacucuugaagaguguaaauuugcaagcuuuuuugcuuuucuuuuuaauuugagguucagaccagccucuugaguuuaucagacuuuccucaguauuaaaugcaacaauauacuaauauaacaugauacacaguauaaacuuaaguaaauaugaaacaaagaaauuuuaauaacagguuuuaaaaauuuguuuugaaggaaacagaagaaaugugugugaugcuugucucuaauuugccuaauaaaggauauucuguagaagaaguuuaugacuuagcaaaaccauuuggugguuuaaaggauaucuugauuuuaucaucucauaaaaagguaagaguugauuaauagcuguucauauccucugcaagcaugcaugcuuugaaaaacauuaaauuuacaaaacuaaaaagaaaagguuuaaaagcaguaucucaaaguaaacuuucaagcuaagggauuuuaaaauauaaaacacagauauccuguauuuuaguauuguuguaacgagacauaguuuuaaugauggggacaaauggcuuucuaauaugucaaaguucuacucaaaauuuuaguuuaauaggaaacguuuuauaucuucaauauguuuaauaaauauaucuuuuacuauguuauguuaauauguuuaauaguaggaaauguuuuauaucuuuaauauguuuaauacauaaguauauauaugagaaagaacuuacaccagcagccuuuaucuauuuuggcuuuuuaggaagcuauauuuauaagauucguagaucauucuucuacuuguauuucauacucuuucugcucuuaucagugauacucaaaugggaaguaaccauuuucagacucagacuaaugaugucaucaauacuuaaaacaaucuagguuuaucuuuauguucuaaauuuucuauaagcaucuguuggcuuuguauuuuuaaaacaacacauuaaaauguauguuaauaaucaacuuguagaaaguauguuuaauugagcgagauuucaggaaauaguuuaaaucauggaaaugacaccauuagaauagugggaagaaguguucuuacguuagagaggaguugguagucacuagagaucuuugaaaguagaauaggauauauguuuugaggcacuccgagccaauuugcuuuagaaaaugguagaagagagugaguacaggugaguuauguguaauuucacauuauguuaaaaguagauuauuugaaugaucgcagagcucaguaaauacacuaaaacccauugcauuguguacagugguugaacuuuaaaccuaaguuaugugcccaguuuugaguggaguugaguaaaauuauuaaaauauuuggagacuuaaugaaaauacuuuaaacauuuaugaaauuaaaauuaacauaaaaugaaaauuuaaaaacuaagaguauuuguuuaaaaaagggaacaggauucacaucuacauuaugcuguaacauuaaaacuacaauaaauagauaaacaaccuuaagagauaauucauuucaaauaggcuuacaacuguaagcaaacauacagcuuucuaccucauuaacuaucaaauauauggaagaaguuucaaccucuuuacuuaccaaggugugaaaauuaaaagcaaaauguauggagcuacaguuuuacaccuaugaaaauaacaaaaugaaaaaugacuucacaauuguuacacguuucuuugguuuuuucaugucucauauuucucauauuuuaucaauuuauuuacucaagaaauacuaauauugauuagaaauauaucugcuacaugccagauacugcucuauguacuaaggauacaguuugaauaagauuuuucuuaaugucaguggcuagaaugucucuucuuuuuucucucuuuaguuugccuuaguauaguaaguuuauucauucuuuauuucuugcuuaugguuguaauauucuuagucuuugggccucaauuuucugaggacugcauuuuuuuaucuuuaaaauauuuacuaaguuguucaauccacuugacguuugaaguaguuuguuuauacuugcaagucuguuuuugagaaaaaguaacauaagauuuuucuuguuaccuuaauuucuguuuuaaaaggcauauauagaaauaaauagaaaagcugcugagucuaugguaaaauuuuauaccugcuucccaguauugauggauggaaaucaacucucaauaaguauggcuccugaaaacaugaauauaaaagaugagguaaaucagaccaccauuuuuacuagcucuuacuaaguuuuuaaaucagauuuguuacagucuguuauguuuucuaguuuuccacuuugguucacauuuuucucacagacacugagaaagcuucuuccugucccuccaacaaucacccagucacccaucccacuguuugagaguuacuuucauagugagggaauccuauucuucauguauguugggauggaaaaaagguugcauuuugucuaaagacagguuucucucuuaucuuucugccauuaucugucaucuaaacuagaauucuggaaguuaucuuuaauuuuuuuucucucauuucuuaaauuuaguuccuuguaaaucuuguuuaacucagugagcuuguucccucuuccucaucccauauaccauugcuuuaucucuuaaaaacucuuacugguccagguaugguggcucacgcuggugaucccagcacuuugagaggcugaggugggaggacugugugagcccaggacuucaggacccaagaccagccugggcaacaaagugagaccccaugccuacaaaacuuaaaauaauuagcugggccugaaggcgcacacccguggucccagcuccucaggaugcugagguaggaggaucccuugagccuaggaguuugaggcugcacugagcugugauuuuaccacugaacuucagccugggugacagagggagaccuagucucuaaaacaaacagaccuccuccuggaccuuuuguauauacaaaaguaauugucuuuuguacauacacgcuaccuucaguuuuauaaaacuccuuugaguucucagcuuuuaucucauguacacacccuucagugccucuaugugaccuauaaacauuuacugucaacugcuaagaagcaugagguagaaauauuguaugcaucacaugagguagaaauauuauauccuuucuagaggcagguagaaaugcauguaauguaaaaauaccuuucauuaagaaucacucuaaugugauguaauuggcaagauuguuuuauacacaccaguaguaucaacaagaaaaaaaaaguuuaggauccucagucuuauaaaguccaaguuccuuugccgcacacaaagccuuccauuaguuguccucugccugcuuugauauccuuguucccugauguucuuggccucuucauaauucaguagcaucaaaucugcauuuaugcucugugcuguuuuauuugccugcauuucuguucuuucucaucuccuacuuugcuuaguuaacuuuucuuuuguaauuugaauucucuuccuguugucuaaauuaaaucucuauuccuucugugaauuugaaugucuuuucuaaaugguacuaucuuauuagucuuuuauauucuuaggggaauaagaagaauuaaauuguauggguuagaaugaggcuuguuuaggagagaaagauuuuuggaaagaauguaaaucuugcugcuucuuaauuuuauaaaauacuuuguaaugcauauuuguauagauugucauguuauaaaucuuaacuaaguaaguauuuguaugagaaagagcuuauaccaucaaccuuuaucuauuuuugcuuuuuaggaagcuauauuuauaaccuugguaaaagaaaaugacccagagguaaguuuugcauuuaaaugcuuuuguauacuuauuuaauugauggaaacauuguuuuacuuguuugccuuuuaggaauuaaaaccuuagaacuaauuuuaagauauugaggugauggagaugucagaugggucuucuugguaacaauaaaaaaauaaagguuucuuguaguacuugaugcgaaaaaauuuuucagguacuggagugcauauuaaguggucuaauaggucaauaucuugucugaggauguuuuggguaaacguuauguugauaguagaaauauuauacuucccauuuuaguacgucauuuuacugauuacucguacguaaaauuaagaccucacugucuucccccauguagucauuuucuuacucuugggagagaacaucaucugaccucuguaauaguaaguuaauguuaaucuguuuuaccguuuguugcuucagcugugguuuuuucugugcugucucuuaaaaaacuacaggcaaacauagauacaauuuaugaucgauuuguacaucuugauaauuuaccggaagauggacuucaguguguacuuuguguuggacuucaguuuggaaaaguggaucaccauguauucauaaguaauagaaacaagguaacaaguucccucauaauuuagcuauucauucuguaaagaauguauaauaacccuguauucugacaaucugcaacuucugaucugaagcaccuguaaauauuacucaaccacuucgcagaauuauuauaaaccagaauauuuuauuuuggacugggccgagaaagaagagaugaccucucuuuuuucagaacuccuaguuuuuaaggaaaaauaagacuuacgcaagggggaaagguaauauaguguagacagcauuaucuuacugggaaguuuagaccugaguuccuuuggcucugauuuuaacuaucuuuguggucuuggcuaaguugguuuacacuuacuuguaaaaugaaagggguauuacccaauauuucuuuaagucccuuccagcuaugaaacaccugaguuaggucuauuuguuuguuuauauggaaagagagagauaaaauaauugcuggaugcaguggcucaccccuguaaucccagcacuuugggaggcugaggcgaggggauugcuugagcccaggaguuugagaccagccugggcaacauagugggaugucgucucuacaaaaaguuuaaaaauuagcugggcauggugacgugugccucuggucccagcugccugggaggcugaggcaggaggaugguuugagcccaggaguuggaggcuguagugagcuguguucacgccaccacacuccagccuggguaacauagcgagacccugucucaaaaauaaaguaaucauuccuuacuuucaugauuuggccucuuaaccaaaaauuauucauuuauuuacauuugguaugccuucuguauuuaauauguauuucagcuacauguucauuaaaauuaaauuuuuaucagccauauauuaccuagaaaggcaggguuuuacauaaaaguggacaauauucauaaaaagcacuuaauuaaccaacaacuagauaauuucuuugauaugcuucugauaaauagagcauagaauggaauaugauaaauagugugacauagaauggaagguggggcacagauggcacauaggaauucugaaccuuucuuguaaacauuuuuaauccucuauuuaaaagaauaccuaucauucucuucaguuuugccuuggcuuuacaacauuuuaaggauuguuuucucuuguuuccuuuaaauaaggauuaaccuuaccuuuguagucauauaucugaaaccugaaagaagaauauauuccaaacuuuuaaaacaauuaaaaacauuuuuauuguaguaaaauacacaaauuuuaccguuuguaagacauaaauuuaacauuuuaaucauguuuaaguguuuguucacugauauucagcaccuucacauugugcaaccaucaccaccauccauuugugaacuuuugucuccucaaacugaaguuuucuauccuuuugacaauaacucgccauuaauucagcccuuaucaaccauuauuucuguuuuuauaaauuuaguuaccucauguauguggaauuauauuugcuuuuuugugacuggcucaugucacuuaguauaaugucucuaagguucauccauguugcagcaugugucagauuuuucuucauuuuuaaagcugaguaauaauucuguuuuacgcauguaacacauuuuuauauccacucauccauugauggacaguuggguugcuucucccuuugucuguugugaauaaugcuucugugaacauggguguacaaauacauguuuaaguaucggcuuucauuccuuuuagguguauacuaaaaaguggaauuguuggauuaugugguuauucuaauuccaauuuuuuuaaagaacuauucauaacuuuuuaaucuucuccaaaggcaauucuucaguuagauaguccugaaucugcucagucaauguauagcuuucugaaacaaaauccacaaaauauuggugaccauauguugaccugcucauuaucuccaaagauagacuuaccagagguaagauuuaucuuucuucagcuuuugugauuuuagaaaauacagagaacauaaaggucauucucagguaguagucaaacuguuucuguguuuagagaugauuuuuauaauuuguguugcaaucaguguuccaauuuucauaguuuauaaagcaguauaaauuugucuaaaugagaauaaagaaauuuucaacaauguaacauauaugcauuuuugaauacuuacuguugacauguagguaucuacauuuuuguguauagugacucuuuguauguaacaugauugucuccagaaugcagcuacuuugaauccauuuuggcuuccucuggguagaaagaaguuuguuuuauucuucuuuuuguuucaguuacauuuauuauaaacuguuuuuguguuaagaaauaagauuucacagguucuuggccuacacaguaguacauguaggaaagcuauggauaguccaccuuugaaagcauuaaauucaaacucaaucuauuuucuccuucuauuccauuguaugcugauaucagagguaaguaauaggaccuuauaugugguguccuuguguugucaaucuguuaaaaaucuugcacuaucuaaagaaaaaggcaauuucaucaucuaaaucuaaauuagaguaucuuuaaguaaauguauuaugauagguaccaguuuaagcacaaaugaguggcucauuucacuugauaauuucagaaaaaaauauauaaaaguuuuuagcuauuccucagcagaacaugcauuuuuaaaaaguugucauuuauauuuuucaagcuguuauucaguuguguucaacuaaauucaaaauuaaacacugacuguacagaaauccuuaucccagaaauauagucccaaauucuuagaguuaaaagaaaauuaaagaagugaaaauuuacauaaacuucugccugaauugguacuucacuuccuaagugcuuacccagaaccuuauucguauaguuuaaguuggauaacacauauggcuuauuuguaacaguuuuuaauugacuacuauuuaaaaugaguuaauaaucaacucuauauuaucuucucuucaacacuuacuguuuuuguuagacugaaauguuacuucuuuguguaguaugugugaccuuuauuucaauaucuauaguuagcuuguauacaaagcauguagcacuccauucuaaauacugaaaacuaguagcugcauuuuugguaucaugauuaugaagauauuuacugcagaauuaaguaauaaugagaauggguuuauaaagaaggcaauauguguguccauaaccucuacacucacaggugaguuucuuauauucccagucauuucucaaaauggcgccacauuuucauuuucauaaguagguagauuaugguuuucuuguaugguuuaggguuuguaucuuguugaaagggggaaaaaugacagucuucauguuacugugaucaucuguguaacuuaauuacuauuuguugaauggagucuccuuucagagcuauucuugugacucuuuucuaaauuuagggucauuugcuuugucgaccaauuauauacaccuuugguuuucuuucauuguuuuucugagucaugucuguuuuuucuuggauucugucacgucacaggugguuuuucuguuugcuagaguacauucucaaguauuuuuuuuaccccagaaaguauguggaggcaguacauuuucugaaauucugcauguuugaaacugacuuuauuuugcucuuacguauuucauugauugauugucuagauguaaaauucugugcuuaggcuauuuuuccuuugauuguuuuuagcauccagaauccaguauuauugaggagaagucugauuuagaucaaaacuauuuuguuccucugaaagguuuuaggauuuauauuauuaauucuuuaaacuaguuuguuuuucuguuuguuuguuuuaaagacgaagucuuaacucugucaccugggcuggagugccaugguucaaucauggcccacaugauuuaaaccuuaacuccugggcuuaagcgauccucucacuucagccuccagaguagacuauaggggcaugccaccaugcccggcuaacuuuauuuuauuugauuuuugauuuuuuuuuuguguguguguguguguagauggggucucauuguguugcccaggcuggucucaaacuucuggccugaagugcuccuccacccugggccuuccaaaguguuggaguuacaggugugaaccacugugcuuggcccuaaacuaauauuuaucuaauuccuuuucucuaugcuaacacuauuuuagguauuagaauaccaugaugaacauuguuucaauguccuaguucucaaggauuauauuuuaguggaggagauagacuauaaacagauauaaaagugguaaaaagacugugaauaaauaaauugagauaaaaagagaaugauuaauguggggaauguguaucuuaaaguggucagugauagucccucagcagaagaguuauuugagagaccugauggaagagagcaagcucuaagaaaauuucaaggggagauuuuuaggcagaagaaccagaucaaaggcuuuagggacauacuuggugauuccagaauuucuaaagagaggguugguauugcuaguccagugaguaagguuuuuucuugguuugggacucauuuccugcauccugcuuuuagagcaggaaguuuuucuccccacccaccaccucccccccccuuuuuuuuuuuuuuuuuuuugucgagauggagccuggcucuguuguccaggcuggagugcaguggcgugaccucggcucacugcagccuccaccugccgaguucaagcaauucuccugccucagccuuccgaguagcugggacuacaggcacgcccuaccaugcccacuaauuuuuuuuguauuuuuaguagaaaugggguuucaccaugcuggucaggcuggucucgaacuccugaccucaugaucugccugccucagccuuccaaagugcugggauuacagggauuagccaccaugccuggccccagggaaguuuuucuauuauuauuuuuugauuuauuuccuucaauuuuuaauauucuguuuuucuggaaauaauaccagcacugauuucauagaugcuguauucucuugaauuuuucugaggauguucuuuugaguuuuuuauuuuuuuuauuuauuuuuuauuuuuuauuuuuaauuuuuuuuuuuuuauuauacucuaaguuuuaggguacaugugcacauugugcagguuaguuacauauguauacaugugccaugcuggugcgcugcacccacuaacgugucaucuagcauuagguauaucucccaaugcuaucccuccccccuccccugaccccaccacaguccccagagugugauauuccccuuccuguguccaugugaucucauuguucaauucccaccuaugagugagaauaugcgguguuugguuuuuuguucuugcgauaguuuacugagaaugaugguuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauagugccgcaauaaacauacgugugcaugugucuuuauagcagcaugauuuauaguccuuuggguauauacccaguaaugggauggcugggucaaauguuauuucuaguucuagaucccugaggaaucaccacacugacuuccacaaugguugaacuaguuuacagucccaccaacaguguaaaaguguuccuauuucuccacauccucuccagcaccgguuguuuccugacuuuuuaaugauugccauucuaacuggugugagaugauaucucauagugguuuugauuugcauuucucugauggccagugaugaugagcauuucuucaugugucuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcgaaaauuuucucccauguuguagguugccuguucacucugaugguaguuucuuuugcugugcagaagcucuuuaguuuaauuagaucccauuugucaauuuuggcuuuuguugccauugcuuuugguguuuuggacaugaaguccuugcccacgccuauguccugaaugguaaugccuagguuuucuucuaggguuuuuaugguuuuaggucuaacguuuaaaucuuuaauccauuuugaauugauuuuuguauaagguguaaggaagggauccaguuucagcuuucuacauauggcuagccaguuuucccagcaccauuuauuaaauagggaauccuuuccccauugcuuguuuuucucagguuugucaaagaucagauaguuguagauaugcggcauuauuucugagggcucuguucuguuccauugaucuauaucucuguuuugguaccaauaccaugcuguuuugguuacuguagccuuguaguauaguuugaagucagguagugugaugccuccagcuuuguucuuuuggcuuaggauugccuuggcgaugcgggcucuuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguguccucuuuuauuuccuugagcagugguuuguaguucuccuugaagagguccuucacaucccuuguaaguuggauuccuagguauuuuauucuguuugaagcaauugugaaugggaguucacucaugauuuggcucucuguuugucuguuguugguguauaagaaugcuugugauuuuuguacauugauuuuguauccugagacuuugcugaaguugcuuaucagcuuaaggagauuuugggcugagacgaugggguuuucuagauaaacaaucaugucgucugcaaacagggacaauuugacuuccucuuuuccuaauugaauacccuuuauuuccuucuccugccugauugcccuggccagaacuuccaacacuauguugaauaggagcggugagagagggcaucccugucuugugccaguuuucaaagggaaugcuuccaguuuuugcccauucaguaugauauuggcuguggguuugucauagauagcucuuauuauuuugaaauacgucccaucaauaccuaauuuauugagaguuuuuagcaugaaggguuguugaauuuugucaaaggcuuuuucugcaucuauugagauaaucaugugguuuuugucuuuggcucuguuuauaugcuggauuacauuuauugauuugaguauauugaaccagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuugguugugucucugcccggcuuugguaucagaaugaugcuggccucauaaaaugaguuagggaggauucccucuuuuucuguugauuggaauaguuucagaaggaaugguaccaguuccuccuuguaccucugguagaauucggcugugaauccaucugguccuggacucuuuguuugguaaacuauugauuauugccacaauuucagagccuguuauuggucuauucagagauucaacuucuuccugguuuagucuugggagaguguauguguccaggaauguauccauuucuucuagauuuucuaguuuauuugcguagagguguuuguaguauucucugaugguaguuuguauuucugugggaucgguggugauauccccuuuaucauuuuuuauugugucuauuugauucuucucucuuuuuuucuuuauuagucuugcuagcggucuaucaauuuuguugauccuuucaaaaaaccagcuccuggauucauugauuuuuugaaggguuuuuugugucucuauuuccuucaguucugcucugauuuuaguuauuucuugccuucugccagcuuuugaauguguuugcucuugcuuuucuaguucuuuuaauugugauguuagggugucaauuuuggaucuuuccugcuuucucuuguaggcguuuagugcuauaaauuucccucuacacacugcuuugaaugcgucccagagauucugguauguggugucuuuguucucguugguuucaaagaacaucuuuauuugugccuucauuucguuauguacccaguagucauucaggagcagguuguucaguuuccauguaguugagcgguuuugagugagauucuuaauccugaguucuaguuugauugcacuguggucugagagauaguuuguuauaauuucuguucuuuuacauuugcugaggagagcuuuacuuccaacuauguggucaauuuuggaauaggugugcuguggugcugaaaaaaauguauauucuguugauuugggguggagaguucuguagaugucuauuaggucugcuuggugcagagcugaguucaauuccuggguguccuuguugacuuucugucucguugaucugucuaauguugacagugggguguuaaagucucccauuauuaaugugugggagucuaagucucuuuguaggucacugaggacuugcuuuaugaaucugggugcuccuguauugggugcauaaauauuuaggauaguuagcuccucuuguugaauugaucccuuuaccauuauguaauggccuucuuugucucuuuugaucuuuguugguuuaaagucuguuuuaucagagacuaggauugcaaccccugccuuuuuuuguuuuccauuggcuugguagaucuuccuccauccuuuuauuuugagccuaugugugucucugcacgugagauggguuuccugaauacagcacacugaugggucuugacucuuuauccaacuugccagucugugucuuuuaauugcagaauuuaguccauuuauauuuaaaguuaauauuguuaugugugaauuugauccugucauuaugauguuagcuggugauuuugcucauuaguugaugcaguuucuuccuagucucgauggucuuuacauuuuggcaugauuuugcagcggcugguaccgguuguuccuuuccauguuuagcgcuuccuucaggagcucuuuuagggcaggccugguggugacaaaaucucucagcauuugcuugucuauaaaguauuuuauuucuccuucacuuaugaagcuuaguuuggcuggauaugaaauucuggguugaaaauucuuuucuuuaagaauguugaauauuggcccccacucucuucuggcuuguaggguuucugccgagagauccgcuguuagucugaugggcuuuccuuugaggguaacccgaccuuucucucuggcugcccuuaacauuuuuuccuucauuucaacuuuggugaaucugacaauuaugugucuuggaguugcucuucucgaggaguaucuuuguggcguucucuguauuuccugaaucugaacguuggccugccuugcuagauuggggaaguucuccuggauaauauccugcagaguguuuuccaacuugguuccauucuccacaucacuuucagguacaccaaucagacguagauuuggucuuuucacauagucccauauuucuuggaggcuuugcucauuucuuuuuauucuuuuuucucuaaacuucccuucuugcuucauuucauucauuucaucuuccaucgcugauacccuuucuuccaguugaucgcaucggcuccugaggcuucugcauucuucacguaguucucgagccuugguuuucagcuccaucagcuccuuuaagcacuucucuguauugguuauucuaguuauacauucuucuaaauuuuuuucaaaguuuucaacuucuuugccuuugguuugaauguccucccguagcucagaguaauuugaucgucugaagccuucuucucucagcucgucaaaaucauucuccauccagcuuuguuccguugcuggugaggaacugcguuccuuuggaggaggagaggcgcucugcguuuuagaguuuccaguuuuucuguucuguuuuuuccccaucuuugugguuuuaucuacuuuuggucuuugaugauggugauguacagauggguuuucgguguagauguccuuucugcuuguuaguuuuccuucuaacagacaggacccucagcugcaggucuguuggaauacccugccgugugaggugucagugugccccugcuggggggugccucccaguuaggcugcucgggggucaggggucagggacccacuugaggaggcagucugcccguucucagaucuccagcugcgugcugggagaaccacugcucucuucaaagcugucagacagggacacuuaagucugcagagguuacugugucuuuuuguuugucugugcccugcccccagagguggagccuacagaggcaggcaggccuccuugaguuguggugggcuccacccaguucgagcuucccggcugcuuuguuuaccuaagcaagccugggcaauggcgggcgccccucccccagccucguugccgccuugcaguuugaucucagagugcugugcuagcaaucagcgagauuccgugggcauaggacccucugagccaggugugggauauagucucguggugugccguuucuuaagcuggucugaaaagcgcaauauucgggugggagugacccgauuuuccaggugcguccgucaccccuuucuuugacucggaaagggaacucccugaccccuugcgcuucccaggugaggcaaugccucgcccugcuucggcucgcgcacggugcgcgcacacacugaccugcgcccacugucuggcacucccuagugagaugaacccgguaccucagauggaaaugcagaaaucacccgucuucugcgucgcucacgcugggagcuguagaccggagcuguuccuauucggccaucuuggcuccucccugaguuuuuuaaaaggcacuucaguugucugaaauaucuuuucuuuagcuuacuuuguuuacuuuugugcauuuguuuuuccguuauuccuuuaugaauaaggaaguaaguuggccaauauagguaucugauguagaguuccucugauaccaugcaggguuuuuuuuuuuuucucucuaauaaacuuuucuccuuaauggaaagcugcuaguaaacacucucuguaauugggacuuaaaaaccaucaucuuuaguuuugggcaguaucauuaggauauaagcuagacuuaucaccagauaucccaguaaaggaagucuuuacuguuggacucaaacaccuaugccaggaauccucucuagacacauugaauuuccuuaaaguauuguuuucaguuuuuagucugacaaaaucuuucuagaagacuucuacccagagagugcaugauuucucagaaaaggcuuccuucuaguauguauaagcucugaauggcagauauguuuugccauuuuguucacugaugcaucccaaguacccaggacagugcuugccauauagggacugauuuuuaauuccugcccuuuuuuggggcuacagaguauugcuuucuugggacccacauaucagauaaauauuuaaaauauuuaucagauaucagacaaauauuuaaaaggauuauuguucaauuuuauuuagcauuucuagguauuuugaauaggaaacuuuuuuagucagcugaucucucuuagaagucuuuuaaaauaauuccucaaggaagauguugauauuucacauuuauuguuuagggaaaagauagaauuuccaggcuucuaaaguuaauaaaguuucuuauuuauaucauuauuaaggaaacuuauuuuuucauuaauauaaguuauugugugugaccuaauuuggaggucuuuaauuagaaaaaaauucuagaaccugauaguaauguagacacugaaaacuagcugcuuugauacauuuuuaagguuuuuuuuuuugagcuuaaauuuuuacuaaaaacauugcuuuuauaguuaaauauuucaaauccaguggaauagccucuaauaaaaugcugauuauauuacaggugcaaauugagcaugacccagaauuagaaaaagaaagguauguugcuuuauguuuacuaacacuuuuguauaguauuuaguuucugaauuuuauugcuguauuuuauaguaauggcucacauguagugaaaaguucuuuucugcauauuuauuuuguguacauaugggcuuguuacaguuuucuuuuuggacucagccugaccuaggaguuucguuuguugcuuuuuauuuacucucauuuaaguauuuacugaauauuuagaguaacugcguauauaaacaguuugaauuaaauaaaccacuuuauaaaauguuuuaagacucucgaauaacucaacaucacgaacaguaauuacauuguuuuuguuagauuuuccuauuccaaaauaaacacgguaguaaaauuuuaaccuuuuaacguuacuuaauuucauuguguguuuugauacuuuuuaaaaacaacuggguuggggcgaguaaguauuuguccaaaaaaauuauguauauaguuuugcauuaucagaggaaugaaagcuuguuuuucaaagucuccacaaacuggugacuuacagccuuguuuugaccacguaaaguacacccucuccuuaauaacuuucucauucugauggauauccuccuuaucaccacccuuguuccaccaguugaugacuugccuuucacugcucuucauuguaaaucacugauuuagaauauuucuuuuuccuccuguauacugagucaucaauauuuauuaguccuuguuguaagagcguauauuuguuugaaacagcaguuugaaaguguuuaaauauguaaaguguuuauuuuaucugaugcacugauguuaagaucccugaaaaacagaacgucuuagcggauuuuucuucucaguaauuuuuauaaaaucagauuauuuuaguugacaaagaugaugaguacauuaaaauauaccaguaacauuaagcaauagguuugcucugugugucagcacaggguuauuuaaguuguaugucauaccaggugcauucacauaccuaagaaauaguaccaccagcagugugugaugugaaagcucacaaagggcuuaauaaauaacagugccuauguaguacuauauauauagaccuaaagauuggccacguuaacucuguggcaaaacccauuuuauuucauuuuacaaagauuuuuugaggucugcaugaaaaguuguucuccauagcaauagcaguuggucauuguucuccucucauuguuuagacauagcuuuuaaaauugaauauauuucuuaaauaauuuauagauguauucaaccucauaaaacuaauuuuuaaaauuagcaccaaaaacuucuuaauucccacccccccccgccuuuuuuuuuuuuuuuuuuuuuuuuuuuuuaacauuagagaaaaagaugugggauauguccagaauacuaaacauuuguuuuggagugaacugaugcugagaaaauacuauuuguuguuuuuguuguguuuuuuuuuagagacagggucuugcuauguugcucaggcuggccuugaacuccugggcacaagcuguuuucccaccucagcuuccuguguagcugguacuacaugcacuuguuuuguuuuguuuuaaagcacuugugguugccaauucauuaugaauaugauacuuuuguuuauaacuaaacuauuuaaauacuguuuagaggaaacucguggauacauucauaauuuaauaauucacacuguacucauucuguugauauguaaacagauuuuauuuaucaucugauuaaagccacaaauaagaaugcuaagugaaauuuuucuaauucauuaacauuaggaaguaaacaguuggccucugaaauaaacacuaaucuuuaguauugugaagucccaguuuaagguuucucagaauguuugucuuucaguguuaacguuuguucuaaugcccagcuuuuauuguaugcuuuuucugaaggcugugaaauucugguauuacugggauauuggggcuggagggaggaguggcaaaugagauaucuguaucucaaaugccuuucuggaauccuuuucuguuccauuucccagaauguggcuguuuucauuugaucguuacaaagagugguuguuuaacuuugguguuaaugucauuuauuugacauuucaaacugucuuuucaaacuaacuugaucaauauugaggcuuuuuucccauauuagccagaaagcagauacuaguuuugguaaaugacuucucuaaagaaaacacuaugauuugaaaagacuagcacacaaggacaaauauggaauuaaauaauucuucugaguagaccuguguucucuguuucaaguauggaacugcauaaugguucaguuuguauauaagauaauaacuuuuuuauugaaaaacuugugaaggggaaagucuugcuauauccuugagccaggaaucaaggucuccauuguuauccuagccccauagauguuuuuacuuagcccuaaguuucuaaaguuuuauguaggguuaauaugcaguacaguaaugaggcaggaauuugaauauuuucuucauuauuggaaaugagucuuguaauuuaaagacaaaagcuuguuuugagaaguaauauucauauaccugcuguaacugugaaugucacugcucuuuucugguugugcuuugccacaaauuuuauugugaauuguaaagauuugaaacucuuaaaauuagccauuuauauuuugaaaaaaaggggugugauuauuuuaaaaaaaaaacauuuuagcaugcaaagaauaacuugcacaauggauagaauauauauugauuaagguuuagggucaagagguauuucucuaaucugguagaaaaguuuucuccucaggauguaaucuuuggggcaugagggaagaccaguuugguucaaaugauuuaagacccugaugugguagcacaacuuucuuaaauaugguuaacaucucagcacacagauauacaccaucuuguguuguuaacugaaggguacauggccacccucuaagaagcaggucaaaagggauggcucauccucuccuuccuuaaaaaauaggagaagaaagucaguacuuuuuaauaaucagguauugauaugauaggaucacucucuggugucuuucuccaaucugcugcuucucauuauaugaauauauuugguaaauuuuaauuugcauugauagcauguugggcauuguuuuuggaagcuaagguuuuccuuguucuucaagaaaaccucugauuuguggaauauugauauaaaaauaacuuauucugugucuaccucggugaaaguacuggaauuauaggacuacucacuuuucauauacuuuagauuugggaagaccaugaugaaauaagaugaauuacauauacuuagccauguauuuccuccauuucuucugaauauuacuuacacauuuaaguuaaauauuagaauuauacauuauucucuugaauugggaagguuuauuuuuuaaugcauuucuucuuauagccaaaggcaaauauuuauaagacuguauguucacauaaggugauuauaucagguuuugucacuagcuuuaaauccucaauagaguauauaaagaauacuuuccaaauaauguucuaaguauuaucauuaauaaauaugguucuuggguaauuaaaaaaauauuuuacauccaaaaaaaaaauaaaaaggugauaugauuuagaguauggucuuuuccccccaccaguuucuguuuauguucuuuuuagguaagguucacuuauaaaauuuuaaaucauaaugcauggaucauuaguuuuauuguagaacuguacacauauuuuauuauuucaguuaccacuguugggaauaggaccugauaauauuugaagugucucagauucacauuugaccuuucaaugucagggguuaacuugacagaggagggaaaauauuggcuguaaucacaugagcgcaaaaggaacauaucaacagucauaauuuauauuauuuacguauuuccagcaauacaucuuacccauuuuaugcugauugguuggauuucccagugcuuauuacgaaugcaucaggaagucuuaacaauuggcaucagcaggauucuuuauaaugguugaauucucaucauaguuugauuuuuguuuguguuuuuguuuguguucuuuuuguuuguuuuuaaauacuuuuagcccuggcuugaaaaacaguccaauugaugaaagugaggugcaaacagcaacugauagucccucuguuaaaccuaaugagcuugaagaagaaaguacucccagcauucaaacagaaacuuugguacagcaggaagagccuugugaggaagaagcugaaaaagcaacaugugauucugacuuugcuguugaaacuuuggagcuugaaacucaaggagaggaggucaaagaagaaauuccucuuguagcauccgcuucagucaguauugaacaauucacugaaaaugccgaggagugugcuuuaaaucagcagauguuuaacagugacuuggagaagaaaggggcagaaauuauuaacccuaaaacagcauuguuaccaucugacaguguguuugcagaagaaaggaaccucaaaggaauucuagaagaaucuccaucugaagcagaagauuucauuucuggaauuacacagacuaugguagaagcuguagcugaaguagaaaaaaaugaaacuguuucggaaauauugccaucaacuuguauugugacguuaguaccaggaauucccacuggggaugagaagacaguggacaaaaagaauauuucugaaaaaaaagguaacauggaugaaaaggaggagaaggaauuuaauacuaaggaaaccagaauggaucuucaaauaggaacagagaaggcugaaaagaaugaagguaggauggaugcagaaaagguggaaaagauggcagcaaugaaagaaaagccugcagaaaacacuuuauucaaggcauacccaaauaaaggagugggucaggcuaauaagccugaugaaacuaguaaaacuaguauucuggcuguaucagauguaucuagcaguaaaccaagcaucaaggcuguuauagucucuucuccuaaggcaaaagcuacaguuucaaaaacugaaaaucagaaaaguuuuccaaaaucugugcccagagaucaaauaaaugcugaaaagaaacuuucagccaaggaauuuggucugcuuaaacccacaagugccaggucaggcuuggcagaaagcagcaguaaauucaaaccuacucagagcagucuuaccagaggaggcaguggaaggaucucagcccugcaaggcaagcuuucuaaacuggauuacagagauauaacaaaacaaucucaggaaacagaggcuagaccuuccaucaugaaacgggaugacagcaacaauaaggugaggaggguaggaagaauggcacagugugucuuugaagugauuagcuccgcugcuguagcuauguaguaggagauguaauuuuguuucauacuuucaucuccucacucuaccccggaagcucccauuuccuuuucuuaaaugauuccauuguuuaagccaguagacauucagaguauuaaacucaaguucauaauuuauugacauguuugaaaagcauuauuuggauacaauuuggaaauaacugugguuuaaaaaaaaaaaaaaaaagucugcagugaaucuccuaaggugauuuaccacucugcuucugaaugggaaacuguuuccucucuuaaauugaagcuuccuuuaucaggucacugauugccuaacuagacauugugggacgaaaagaucaguaaaacugaauuuaacuacaacuuguacagacugugccuauacuguuuagugacuguugacuuaguuuuguauacauguuaaauaauuugcauaauugacuguauuuggguaauguuuacuguuuuuuuuuguuuuuuguuuuuuuuuccagaacauuaauaauaugguuguaaauuccguuuuucuguauuucuuauuuacuauuucagacuuuggcugagcaaaacacuaagaauccuaaaagcacuacugguagaaguuccaaaucuaaagagguaaaaaauagaucacagacccuaacccuucuuuuucaucuccauagcacaguucaucuaucuuauaacuugugccugccuuaacaauguuagugacuaagaguuuagagcaagggauaggaaugagauguuuuguuuuuaacuuaucucuaauccuaccauuaauuuacuuuuugaccuugagcuagucuaaacaccuuguguuuucuugaggcggggggagcgggcaaaauguuauauggggacagaaagagaguagaguagggcaauaccuccaaucucauauugacaggaauagguuguagacacagaaaaaaaauuuauauaugugaaagagacugacauuugacuugagucauccucauuuuguuaaaacagguuauccuuuuggcucuaauuuaaccuuaaguggauggucucuaagauuaacuuuacugguaccaaguucuguugucaaacauauuuuauauuugguuguuauuuuagguuuuuaccauucauagaauuuuuuucagucauuuuacuuuucuuaccugguaggggauagauuugggccuauguuguuggggcaaggagaaauguuacuaguuuuaagcagaaauaaggauuauggcuacuaaagcagaaauaaggauuauggcuacuaaagcagaaguaaggauuguggcuacuucaguuugcuuuguuaauuugauaguacaaucgcuuguagauauucucccuagaaauuacaggguacauauucuaaugucguuauuauauauaauagcaguuaaucauuaauaacauacuaaauguauaggagcccugguaggaauuuaucuucuuuacuauugacggcauuuuuaaaaauuacagauacuguuguuuucaaauacaguuauguuagucauugagucuuaguaauaauuuuuucauacaacuuucucaaaauguaaccauuauauuucuuuuauuauuauuauuauuuugcaacgaaaucucacuccugucccccaggcuggagugcaauggcgugaucucggcucacugcaaccucugccucccagguucaaguguuucuccugccucagccucccgaguagcuggguggcaucugccaccacacccagcuaauuuuuguauuuuuaguagagcugggguuucaccauguuggccaggcuggucucgaacuccugaccucaggugaucagccucccaaagugcugggauuacaggcaugagccaccacgcccggccuguauuucuuaaaauauguauucuauauauaauuaguuaauguguaaucaauauauacugauaaauggaacagccuaauuagcuguuuacuuucuaacuauauuugaggugcuuuuagaaguccaguaagucuucuagagcacuuauuagauguuugacauauggaacaguaaauccuuuguacugucugacaaauacuuuaaauguauuuuuaugugucauacuucgaaacucuucauuuaggaaauguaaucuuauugaauuuaaguaaaaguggaauuagguugauacuguuagaauuuuacuuuuggauuauacuuugugaauuauagcuaagucauuuguggggcuuuaaaaaaaacaacucuuaauuuuagccuuuaggaaaacuaauuugcacugaaauucucccaaaugaucugcaugcacauuuauugugacuauuuggaaucuagccaguggucaaaauuuguuuacaauacuaugauuuuuaacuuuccaacaggagccauuauuuccauuuaauuuggaugaauuuguuacuguggaugagguuauagaagaagugaauccuucucaggccaagcagaauccacuaaagggaaaaaggaaagaaacucucaaaaauguuccuuucucugaacuuaacuuaaagaagaaaaaggggaaaacuuccacuccucgugguguugagggagaacuaucuuuugugacauuggaugagauuggggaagaggaagaugcagcugcacaucuagcacaagcucuagucacuguggaugaaguaauugaugaagaagaacuaaauauggaagaaaugguaaaaaauucaaauucacuuuuuacauuagaugaauuaauugaccaagaugauugcauuucccacagugaaccuaaagauguuacuguucugucaguggcugaagaacaagaucuccucaaacaggaacgcuugguaacuguggaugaaauuggagaaguggaagagcuaccuuugaaugagucagcagacauaacuuuugccacuuuaaauacuaaaggaaaugaaggagauacuguaagggauuccauuggcuucauuucuucucaggugcccgaagacccuucuacuuuaguuacuguagaugaaauacaagaugacagcagugauuugcauuuagugacuuuggaugaaguaacugaagaggaugaagacucucuggcggauuuuaacaaccuuaaagaagagcuuaauuuuguuacuguugaugaaguuggagaggaggaagauggagauaaugauuuaaaaguugaguuagcacaaagcaaaaaugaccaucccacagauaaaaaagggaauagaaagaagagagcuguggacacaaaaaagacaaaacuugaauccuugucccaaguggguccaguaaaugagaauguuauggaagaagaucuaaaaaccaugauugaaagacacuuaacagguagauacuuggaagggguagucuuucuguuuuaugaggggauuacauuuaaaauuaauuuuaaaauacauguuguggcauuaccaauaaugucacccaguauugauauuagaggccaacagacaguuaaagucaacaauaaauuuuccaaagaaauguguacaaguuucacaguuuuuuaaaguuuuacagcagaacuugcuccagguuaugcuucaagaaaggaugacaaaaaacagaaaacaaacugaaguagccaaauuagaauuggaaugaaaaugauauauuuguauugugggaaaaagacaacuuuugauaaauagaagaacauuuacaucagauuaccucccaguuuuugcuuagacuuagaauuaagaacuauuuauaaaggaacuauuugauuuuaaaguaauauuguaaugauacagaauaguacggcagcucacuuuccgaacuugagggagauaaacauaauuuccauuaagaaaaucuugaggccaaguauuguggcucacucccguaaucucagcacuuugggaagccgaggugggaggaucgcuugaggccaggagugcgacaccagucugggcagccuagcaagacuccgucucuacaaaaaauuaaaaaaugagccaggcacgguggcaugcgucuguggucccagcugcuuuggagacugaggcuagaggaucgcuugagcccagaaggucgagguuguggugagcaaugguugugccacugcacuccaaccuugguaacagagugagccacuuugucuccaaaaagaagaaaaaaaaccugaaagauuuaacucaacuaagaauaaaauacuaggaaggucccacaggcuuauggaacaaauuagaaaaacauuuauggacauccugggaaaagaaguuagaaaagcauaguuacuuggaaaaugauaacugggaacaaaaggaaaugcuuagauuaaacugauuauuuuaaaauagaauucuucuauuuuauauuagcaguaggcuucccucccaaauuuggguauuuuuugcaaaaauguauaauguugauucagacaguauaauauguuuaauuuaaagcaauuuaaauacuguuacuagagcaauaaauuaggacuuucuuuuuaaagcuaaaacuccaaccaagagaguuagaauugggaaaacucugccaucagaaaaagcuguugugacagaaccagcaaaaggugaagaggccuuccagaugagugaagguaaagcaggauuguuggaaugggaaggaaaguuacacaacacaggagaguaguugaaguuuaaagaucuaucuaagaagaaaaguagaaaaucaguggaauagagcaggggugggaaaagucaacuauaguuauuagauguggguaacauuuugaucuuuguaauguagagagaauggauuauugauauuagaaugugacagauuagaggaaaugauccucgaaagguuuucugaccauguugcagcaucagauagaaauuauuuauuaacuagcuauuauuuguggaccuugcuuuguugaugcuugucagcagccagccaaugaauuaaacaagaagccuuaauagcguuuauaaaauuuaacuugaaacaaauaaggaagggucuagugagagagaauacuuuagucacucagcagauacuugucauauuguauuggguauccuucauaacaauguuaaaaaggguagacaaaagaaaguacauagcucuugcucucaagggguuuauugauucagagagguuaagcaaaaaaucaccuugccaguaugauuuaaauagagcacuguaaggguaucgcuuuuaccauucucuuuguagcacccucauugcccucuuucuuuccuauccuaucuucuuuaaggaaaacuuaccaaguaugauuugguccaaggauuucaggugggcucucagugcugcucccaauauauuagaggucuccuuccuuuacuauuuccuaaccagauguaaaauuagcuuucccccccuucuacaucaccuaacccguuucucauuggauguccuugcuuucguuuuuauuugccagaguaaaucuaggaucucccuugucugccaacuuauauuuuguuuuauacacauaaaauauaaaauuuggccaaguuuuucccauugaaagaaauaucccuuugaccuugaaaucucucuagcuccuaucuuuucuacuugcuuuuagagcaaaacgucuagaaagaaccaccuacuuuuacgucuuaauuucccauggaacugaauguauuuugguuucuuucuccuaccacuuuccugaaaaugauguugaugaaacccccauuagguuguugucaaacgugauuuuuuaaaguguuuucuucuuaaguuagucuuacuugacuuuuccacaugauugguuacuuuugauuaugcccucucuugaaacucuuugccaagucauggucaaguggguauuccuucuuccuugucuauucuuuuccauaaacaaucuuugauaaccaagcuauagguggugguucaguaauuagguucucgcaugauuucaugaggucaccccccgacuucagaauuucuguaugguagggcaaccuuggcaaucagcuugcuuagaacugccucauugcaacugaguaauauaaaaggaugauuuaguuacugcuuacguaacaauauauuucuacuaaugaacaauauguuuugacaaaaggaccuagcuuaagaaaaagucauuuuuccacacaauuguaaacuuaaaucauuuauuuuaaucuauuuuaaauauauaauuuuaauauauguuauauacuauuaagauaaaugugccuuuggaguggcaggaacagauauguuugggaaaguuuauuacccugaugaagaaauaaacaauuauagaaagagauuggaggcaaggaaaccagauuguuuuaaccaucaaguuaagaaaaggaagauaccuuuuucuuauugauuguaggacuugaugaucaguaaagugugaggaauaagaguaaguaaugauuucagaguuccuugccauccccucaggaauacuaaagaguagcccagauguauggagggaacacugaacuugaagucacaaagucuugguucuagccugugucacucacuagcuaugcaaccuugggcauaucuguuuauuaccucuuuugauugugcuuucuccaucucugaagaaauagggauggguuaauaaugauuucacgugccuaucuuacaugagguaaaagcuaaaugaaugauuauauauguaaaaggguuuugucaaguauuaggcaacaguaaggcauuucagcuacugaggguaaucagaauugcuuggaaucagucuucauuuuugucuguccccaagaucauaguaugcagagucugcuaacauugagugcuucuuacguguuacucacuuuggugggcuuuaacauuuauauuaauaauuuuacuuguguuucuaacaggggucuuaggcuaucaguuuaggcuccauuuucuagauuggaagggccucaguauugggccauagaaucaauuucugcugguauccuuuucccuuaaucuccacucucggcucagcuuagcacuuugcauauauaaguucucuugccaguaaugauaggacuuguauuacuucguuaaauucugccuggaacauauauaaauaaaauuugcuguuagcuuuagaccuauauuccuaaauccauuugaauggauuuacccauuuauuccuuacauuaaagaaucuuggagaauauugugcaaagaauggccagaugggauuaacaaagggagguuuucccugagaaagaaaaagguaagaauuauccaauguuaacuuuacaaagucuguaaaucuauucugaauagcuuuuuuuccucgaaaaauuuuaguugaugaggaaucuggauuaaaggauucagaaccagagcgaaaacgcaagaagacugaagacucuucuucaggcaaaucaguggcgucugaugucccugaggguaaaguuaaaaugacauuuuuuucuuacccauaugaaauuuaaaagucggccgggcgcgguggcucaagccuguaaucccagcacuucgggaggccgaggcggguggaucacuaggucaggagauugagaccauccuggcuaacacggugaaaccccgucaguacuaaaagguacaaaaaauuagccggacgugguggcgggcgccuguaguccaagcuacucgggaggcugaggcaggagaauggcgugaacccgggaggcggagcuugcagugagccgagauagcgccacugcacuccagccugggcgacagagugagacuccgucucaaaaaaaaaaaaaaacaaaaacaccauaauaaguauucuauuguuuuaggugaguaauuggguaaccuuggcugcauugucauuuuauaguggaaauuugcauguuuuacacaguggcauuuuugaagacagcuuacugggcuguuuuuaccugagaaggauauuuuuacugcacucuugaaaucugggauguaucuccucuuuuauuccuggugcuuucuuugccacucuggugagaauugaguuauauuugcccaggcagaaagucacuccaguuaagcagaacaugcugcaaaucuuugcuagccgacuuuguucauggucagcuaaggugagcugagggagaccuuauucagccaucauacuccucaaucagacaguugcccaucauucuaccucuucucucucuuuuauuuuaaugggauuccuaagagguuuauuuuuauuauauuuuauuuugagacagggucucauucugucagccaggcuggagugcagugaugugaucucagcuaacugcaacccuuuccucccaggcucaagcaauccucucaccucagccucaugaguagcugggacuacaggcgucuaccaccacaccuggcuaguuuuuguauuuuugguagauacaggguuucaccuuguugcuuaggcuggucucaaaccccugagcucaagcagucuguccgccuuggccucccaaagugcugggauuauaggcuugagccacuucucccagccagagguauauuuuagacuguuagguucuuaucuaaugacuugguauucugaaggauuauugaacaguucuuuguuauccgaagauucuccuugggaaucuauucaacuuggcauuauaccaaagcaguggcauacuggcauucccuagagguucuggaauaguauagaauguguuaacgaaauaaagacuuacguuuucugauuaaaauuacuacuauugaucccuaaauuuauagcaguguguacuguucuuauauuuaaguauauacugugcuuaauauuuuugucguguuuaaauugaugaaggccaguuguggcucacacguguaaucccagcacuuugggagaccaaggcaggcacauccuauaggggaggucaggaguucgagaccagccugggcaacaugauaaaacccaucucuacuaaaaguacaaaaguagccaggcgcgguggcgcacaccuguaauccuagcuauucgggagccugaggcaggagaaucacaugaacccaggaggcagagguugcagugagcugacaucgcgccacugcccuccaaccuggaugacagagugagacuccgucucaaauaaaugaauaaaucgaugaacacaacuggagauuaauuauuguuaauuuucuucuugucucuucuuauccucuagaauuagacuuucuuguaccuaaggcuggauucuucuguccaauuuguucccucuucuacucaggugaaaaagcaaugacaaaucacugcaagaguacacgucauaagcaaaauacugagguaauuuuaaaaauucuuacaaaaucuugagguguuguuauugucuuagaaucaaauuauuuaucuccccaaacguacauuuccccccgcuuuaggagaauguuuaugccaguuuauuccucuuaaguccuguuuucuccuucaguguaccuugccuguaauuucuaguccuuauuccuuuuccuugaacagcaacauuugccagaguagauucugcagaucacuagucucauaugacacuccauuauuaaaguaagaaacugcauguuuugaugcccucuugucauguagacauuagcauauuaaaguuucugaauugucuagccagaaugaauccugguuaacuucaugcaaaccauuuauuaaacugauuuaaucacaaaaccuuuucuaaauuguacacaucuuuaagaaguguuacucuggagaaucaucauuaaccauaauugaaguggugacucuaguuccugcugaauauuugagaguuucguacauccucucuguugaauuuguggcacagacacucaucuaacauuuacugagcuguucuaugcuggaagcuuauuuaaucuccucaugaacuucaugagguagaugcuauuauuccaaucuuaaagaugagaaaauagacuuaaggagguuacguaucuaaacccaaggucacauagcuaguuaguagcagaccuaggauuugaacuccgcucuauuucauucuaggcccaagcucuuauacauugugcuuugcuaccugugugcuuaacuuaguucaucaugucacuuuuccauuuaaaaccuucuaguagcuucauauugcacuuggucuaauauccaaacuucuuauuuugggucuucaaagcccugcaugaucugauuucuuuucuacuucucugaaugcuuucuguguuucagcuuuucuggcucucucuguucuguuuuucauacaugagagacccauugcugccuuugcaccuuuauacugcuguucuuuugccccuucccaguccuacucgcauggccaguucuucauguuuuucgucucaaauaucaguuccccagaaaggucugcuuaagaaagaccuagcuaaguagaacccccaaaaaaguucagccucaauuacguuguugcacugucuuuaaagugcuuaccaccgcccccaaaguauuuuauuuuuuucuuuuauuguuucucuucucccauuagaauguaagcuuuauuguauaaaagauucuaucugucuuguugcccaccgaauccucaggcaccaaguguaauaccuggugugucauaaacaucaaaugacugaugaaugaaaggaagaaaugguuauauaaggcacuguguuuauaauauuuuguaggaucaguuucuuuuaaauuauaaauauacaguagauaaguuugcacacauagcaaaauaacgucuaauaaguauuuuauauugcaaauugcuuuuaacagaaauucauggccaagcaaagaaaggaaaaggagcagaaugaggcugaagaaagaagcucuaggugauugggggaaaggaaagaauucacuagaaauuuguuuaggguccaguugauuuguguauuuuuguuaucauuuaauuuguaauuuucguuucagaagcaaauauucguguuguacaaauuucugauugcccuaaauguagagagacugauggggaaaguaugauggguuugauuuuuauaucaaaucaucaggcauggagaaauaucuuuuagaaguguuaaaauaaauguuccuacuguauauuuaaaauac

SEQ ID NO: 191641 - RNA, 224161 nt, Homo sapiens
aggcgggcggcacugcgccuaagcugggccacaaccgccagucagggcucuccccuuccccucccucccccccuccuccuccuccucugccgcccagagcgagacaccaacauggagcccgaggaucugccauggccgggcgagcuggaggaggaggaggaggaggaggaggaggaggaggaggaagaggaggaggcugcagcggcggcggcggcgaacguggacgacguaguggucguggaggagguggaggaagaggcggggcgggaguuggacuccgacucucacuacgggccccagcaucuggaaaguauagacgacgaggaggacgaggaggccaaggccuggcugcaggcgcaccccggcaggauuuugccuccgcugucgcccccgcagcaccgcuacucggagggcgagcggaccucccuggagaaggugaggcgggccggggagggguguggagccgcggcgaguuggggguggaggcugggccccgagcgcuccgcccgcccgcaggucacgccgccugacggagaaaacgcgcgcagcugaggcuaguaggcggcccagacuccagcccaggugccggccggcugcuccgcgucucccaggcuuuguggcaaagacuucucguuuccucccccucgguggguccugggccuuuugaacucccguagacguucaggggagccugcauuccccgugagaaacgcugagagaggaccacgggugugucgagccuugaaggagggaaaaggcgguguaggaccggagcgagugguugccuggggagcaucuuguuggggagacagugaacagaugagcuugacugaauugcaggacuccccugagggaguaauguggauaauguacaccgcgcgaucacuuagucuggagaggcuccccgcggguuuuccuccccuggaccaucauuuguagcaauaaagggguuccccagccgauaggaggggcuuggaaugcaggaggcuugugaugcggcuccaaacagucugcaaaacuacaaagcacagauaauacacaauggagaaagccgauuucaugguagacccccgaagaucauuuugaaaauaacucuccauuuaauuugcugcccuuaccccccuuuuuuuaacuuacugcuuuucgaggagcaagaccugcccugcucaguacaguagccacuggccacguguggcuuuuuacaucuuaaagagaaaacuauuauaguuuugaguaagaguuaaaaauaaauuaaaugaaaaauuccaugcgucuguucuuaccgguuuucaagugcucagcagccacacuaggcuaguggcuaccauguuggacagagcagauaauggaacaguuccaucaucacagacagugaagguguagaguuuugucacuaaugagcaguaguuguuguuuugucuggugaauauuccaggggguacuuaauucauugaacauguauuauuagaauucaccaugugccacacauugugcugggugcuaaggaaagcuuggugaacccaaacauuuuuggucucugccuuccuuguguucauggucuagacagggaggcagacagauuucagaugaucacauaaagugaaacuaauauaugugcuaauauucuaugaaagcauaaaguaagauaaucuggccuugucagugaaguugggaaagccuucuugaggagguuaugauagagcugauaucugaagacaguuuaagguuaaucaggcaaaggggagggaaagagccgucuagcugagggaaaaacacaugaaaagguacuguugaugagagagagcauggcauuuuccaggacccagaagccaacgugguuugagcacagacugcaaggcuuugugugcuaugccaaggauuuaggggcuuuaucucuggagcuuuggggaguugaagaaaauauuugaaacgaggggauguaugauaaguuagguguuucagaaaggucagguguauagcagaguguggaacagcugugauagcaaggugggauggggagcaguagccauaggucaagggcauaaauuaggagaccauugcagcauugcccggcaaaagaugaugaaaguuuggaauagggaaguguugguggauacagggaaaaguggacugauuugagagauauuuaagaggcaaaaucaucauacuuaauaacggaugggaugugaaaggugaaguagccagguguuagguuauuguuugaaugguugugccaauauuaagauauggccagauuuaugguggaggugguggcugugagugggugguggaauugguugggugagucuuaagauuaugaguuugguuuugaagauugaaggagaaggcugggcuagagauuucaaguuguaagucauuuacauagagaccauaauuaaagccacacuuguugacuaggucuucuaacuuuuauuuuguccugugacuucuugcuugaauaacuauuaauauucaaacuuuaucuugaagccuagaggaggaguuuuuuaaacaaaauuuuaauuuaauuuuagauuuggggguacauaugcacguaauuaacauggauauauugcauaauggugagguuugggcuucuagugaaccucucacccaaauaauauaccuuuguacgugauaguguaacauuguacuugauagguaauuuuucagcccuucucuccuccuucuggagcccccagugucuguuuauuuccaucuuuaugucuguggguacuuauuguacccauuuaucuuuaugccucuguguacccauuguacccacuugucuuaccagugagagcaugugguauuugauuuucuguuucugaauuguuucacuugauaaauagccuccaggcuccauccauguugcugcaaaggacaggauuucauucuguuuauagcugcauaauauuccacaauguauauuaauacauacuacauuuucuuuacccauucaguuguugauggacacuuagguugauuucaugacuuugcuauugugaacggugcugugauaaacauaugagcacagauuuuuuucuuuuuuuuuaauggcgucuagcugguguagaacaccugggcucaagugauacuccgccuuggcuucccaaagugcugggauuacaggugugagccagugugccuggcucagaugucuuuuugaugaaaugauuuaauuuccuuuggagagauacccaguaguaggauugcugggucaaaugguaguucuguuuugaguucuucaagaaaucuccauacugcuuuccauaggaguugaacaauuuacauucccaacaacaguguauacguguucccuuuucuucucauccuugccaacaucuguuuuuugacuuuuuaauaauagccauucugacuggugugagaugguaucucauugugauuuuaauuugcauuucucugaugcuuagugauguugagcauuuuuucauguuuuuuggccgcucguaugucuucuuuugagaagugucuguucagucuuuugcccgcuuuuuagugggguuauuuguuuuuucuuccuguugauuuguuugaguuccuuauagaugcuggauauuaguccuuugucagaugcauaguuugcagauauuuucucccauccuguagguugucuguuuacucuguugguaguuuauuuugcugugcaggagcucuucuaguuuaauuaaguuccauuugucuguuuuuauuuuuguugcauuugcuuuugaggucuuaaucauaaacuuuuuuccuaaguauucuuuaggauuauuauaauuucgggccuuacauuuaaaucuuuaaucuaucuugaguuaaucuuugcauauggugagagauagggacccagaggaggaauuuuuaagcuaacccucuuuuacuacagccaaugugagaaaauuauuuuccuguuuaauaaugaacuaucuuuuuuuucccccgccgagaugaagucuugcucuguugcccaggcuggagugcagugucacgaucuugguucacugcaaccucugccuccuggguucaagcaauucuccugccucagccucccgaguagcugggauuacagguauccaccaccacgccuggcuaauuuuuguaguuuuaguagagaugggguuucaccauguuggccaggcuggucuugaacuccugaccugugaucugccugccucagccucccaaaguguugggauuagaggcaugagccaccgcgcccggccucuaaucgugaacuaucuauggguaauagaaaaucuuacuucugagagcccagaguauuuuuuccuccccacaguuuuuucuuuccccugagaaaaauuagauauuuucuuauuuaccugagagaauauaugauaauauauagaauauauagaugauuuucuguauuaaagguagauuuacaaugauacaaggaguguucagauaauuuuuccuuuaguucacuggcauauugaaacuuacuggcauagguuggaaaguguuuaaggaaaaaaugcuuaguauguuucuugcuagaaauuuaugaacuaugaaauucuuagauguguuguauaacaucuaaugcugcguauuuagaggaugagaucaaauaauaggaaacauuaauuucauccaguuuacucucaaguuaaaugacaaaauuguguuauucaauuuacucucauaucucacuagauaauaagggaguuauagugguguuauauaaggcagugauuaaguuuguaguccuguuacuaaggcugaguuaaacuaugauacuguuuaaauuugaagcaaaauaugaccagucuuauaacuaagucuuuuuaagagggaagugagugauucagagccuuauguuguuuuuaugcugguccuacagaccauucaggcacuucuuguaauuccuuaaccugaauuucugaguugugcuggggaagauaauucaguucucuggguuggcaucacuagaaauucuuggucuccaacuuuuaauugggucaucaacagugcuuggaaaucuuuuuuuuuuuucuuuuuaagauggagucucucgcuuuugucaccaggcuggaguggcaguggcccgaucuuggcuaacugcaaccuccgccucccggguucaagugauucuccugccucagccuccgcaguagcugggacuacagaugcgcgccaccaugcccagcuaauuuuuguauuuuuaguagagaugggguuucaccauguuggccaggauggucuugaucucuugaccucagguuauccacccgccucggccucccaaagugcuggcauuacagaugugaugagccacugcgcccggcccaacaguguuuggaaaucuuuaguuuccucucugucagcuucuuuccccaucuucccucuuaacuucugucucccacccagaguucaacauccccccauaagcagguuacaguuucaaagaagagaacacaggcugaaccucucccguuucugcuccccaucuccaaauuuaucuacagugcacaauuuauuuuuuuaaccuauucauauacguuuuauucuuuuuuuuuuuuuuuuugagacggagucucgcucugucacccaggcuggagugcaguggcgcaaucucggcucacugcaaacucagccucccgaguucaugccauucuccugccucagccucccgaguagcugcgacuacaggcgcccgccaccacgcccggcuauuauuuuguauuuuuaguagagacgggguuucaccguguuagccaggauggucuccaucuccugaccucgugauacacccgccucggccucccaaagugcugggauuacaggcuugagccaccgugccuggccuuguauacguuuuauucuuaauauuaauccuguuuuguguuccuaggguaaaaacuauuuagucguagugugcuuuucucuugaggaacugcuagauuuuauuugcagauauuugauaaugguuuuaaauguuuuucuguuuguuuuuuguuuucuuggccaguauuuaucaaacuugacaucaauauuaugccauuuucauaaaagguacuuggaugauuuuuguuuuucuggaacaguguaaguacaaaggaauuuuucuuucuuguauguuugaaagauaucaccauuuaaacuaucucuguauuccuuucaggguuguagucuauauauguucuccuuucuuggguuaauuuuggugguuuuccuaggaaaucauucuuuucaguaaggguuucuaguuaauuuuaauggagugcuacacaguauucuuuauuuuuucauuugccucugugguuauuuucacuucucauucccaauuuuguguaauuaugcuuuauuuuucuccugauuugacuagguagggguuuauuuaauuuauuuuucauucaaggacacagcucuugauuuaaguuucuguugcuguuuauuuuuuaauuauuaaaaauuauuaauuuuaauaauaaguucaguuuucaucuuuuacuauuuccuuagguuuacuuugauguguguguguguguguguguguguguguguguguguauuuccuuguguugagugcuuaauugacuuacuuaaaaacauuuuaauagcuuuuuugagauaucauucauauacuguacaauucaccuuuaauuuaaagugcacaauucagucauuuucuguauauucauagauaugugccaucaugaucacggucaauuuuagaacauuuuaucacuucuaaaagaaaccccauacacuuuagcugauaucccccgucuuccauuccccauaugcaacuauuaaucuaccuucugucuauagauuuaccuauuuugggcauuucauauaaauggaaugauauguguuuuugugacugggcuucuuucacuuagcuuaaugguuucaggauucaccugugauguggcauguaucaguacuucauuacuuuauauggcugaauaauauuuuauuauauggauaugugauauuuuguauauccauucaucaguugauggacauguuuuuuuuccuccuuuuuggcuauuauguauaaugcuaccguagacauucuuauauaaguguauguguggacauauggauucauuucucuuggauguauaucuaggaguagaauuuuugggacauauggaauucuguuaaccuuuuaaguuucugccagauuguuuuccaaaguggccuuccuauuagcaguguaugagaguuccaguuucuccacauccuuaucagcacuuguuauuaccugacuuuuuuguaguuuugauuugcauuucccuuaugguucaugcaucuauucaugugcuucuuggccauuugugugucuucuuuggagaaauaucuauucaggucaaacuuuugcccauucuuuaauuggguuauuugucuauuuacuauuggauuguaagaauucuuuauauauaugcauauuacauauauaaucccuuaucaaucaagggauugacaagauacagucccuugacaaaugugaggucaugaggaccuacuauguuuucuuugagauuuuauaguauugcuauuacauguaggucuuugauccauuuugaguuaauuuuuguauacgauaugaagaaaggguucaaacuuuauucuuucguaugugacuauccagcacuguuuuuuuuuuuaaauuuuauugauuuguguaaauuuauagaguucaaguauaauuuuguuacauugauauauugcauagcgguaaagucagggcuuuuaguguauccaucacuggaguagccuacguuguacucauuaaguaauuucucuucauccaccccacucucacacuccccacccuuccaagauuccacucucugucauuccauacucugcuuccacauguacuuguuguuuagcucccacuuggaagaauaggcaguuugucuuucugcagcaccauuuguuaaagaggcuguucuuuuccccauugauuggucuuaguacccuuguagaaaaucaguuagccauagauauauggguuuauuucuggauucccaauucuauuucauugaucuauaugcccaccuuauuccaggaaacacuuuuuuuuuuuuuuuucugagauaggugucucuuuguugcccaggcuggagugcaugcaguggugcaaucucggcucacugcaaccuccaccuccugggcucaaguggaccuccuaucucagccuaccaaguagcuggaacuacaggcacaugccaccaugccuggcuaauuuuuguagguuuuguagggauggaaucucaccauguugcccaggcuggucucaaacucuugggcuaaagccaucugcccaccucggccucucaaugugcugggauuacaggcgugagccaccaugccugacuaggagacacucuuuugauuaauauugcuuuauaguaaguuuugaaaugggggaguucuccaacuuugcuuuccuuuuucaagauauuuuagccauucuggagccccuugcaauuccauaugaauuuuagauuagcuugucaguuucugcaaagaagccagcuaguauuuugauagagauugugaugaaucuguagaucaauuugggaguauggucaucuugauauuaaaucaucugguccuuuuuuuuguuguuguugagauggugucuugcccaggcuggagugcaguggugcaaucucagcucacugaaaccucugccuccuggguucaagcaguucuccugccucagccuccaguaacugggauuacagaugcacaccaccaucccugguuuauuuuuguauuuuuaguggagacgggguuucaccauguugaccaggcuggucucgaacuccugacuucaagugauccaccugccuuggccucucaaagugcugggauugcaggcgugagccaccgugccuggccuaaucaucugguucaugaacaugggauauccuuucauuuauaguugugucaauuaaugaugaggauacauucugagaaauguuucauuacaguauuucauuguugugcaaacaucauauaguguacguacacaaaccuagauggcauagccuacuacacaccuaggcuauauagucuaacuguuugcuccuaggcuacaaaccuguacagcauguuacaguacugaauacuguaggcaguuguaacacugugguaaguauuuguguuggauacguuuguguaucuaacacaaauacuuagaaaagguauaguaaaaauaugguauuuuacauauauauguguauauauauauguguauauauauguguauauauauguguauauauauguguguguauauauauauauguguauauauauauauauauauuuuuuuuuuuuuuuuuuuuugagacagagucucgcucugucaccgaggcuggagugcagugacacaaucuccgcccacugcaaccaccgcuucccaggcucaagugauucucaugucagccuccugaguagcugggauuacaggugugugccaccaugccuggcuaauuuuuguauuuuuaguagagaugggguuuugucauguugccuaggcuggucccgaacuccugacucaagugaucugcccaccuuggccucccaaagugcugggauuagaggugugagccaccaugcugggccgguauuauaaucuuauaggaccaccauuauguauguggucuguaguugauggaaauguucugauguggcauacaacuguaauuagaucuucuuuaaauuucaauaauguuuuauaguuuucagaauugcacuuuuuuucuuaaauucuucaaaauacuguuuuuaaugguauugucaguggaauuauuuuucuuaauugaauguuuggguuauucguuguagauguuuaaaaacacuugauuuuuauauauauuaauauuguuucugaaucucuucugaacuuguuuauucauccuaguagauuauuuguggguucucuaugauuuucuuguaaagaucaugucaagggcaaauauauauagcuuuauuuuuucuuuccaaucuggaugccuuuuauguauuuauuuauggcuaauugcccuggcuagaaccuuuaguaaaauauucaauaggagggguaagaguguauaugcuuuuuuauuccugaucuuagggcagggguguccaaucuuuuggcuucucugggcuacauuggaagaauugucuugggccacacauaaaauacacuaacaauagcugaugagcuaaaaaaaauugcaaaaauauaauguuuuaagaagguuuacgaauuuguguugggccacauucaugguccucggcuguggguuggacaaacuugucuuagggagaaagcauccugucuuuuacccccgaguaugauguuaguuguggguuuuuaauagaugcccuuaucauauugaugaaguuucuaucccuaauuucuuaaguguuuuuaauaauaauuuugucaaauuauuaaucgauguauuacauuaauugauauuagguuauuaaaccagccuugugaaaauaacucacuuugucacaguguauaaacauuuuauguguugccugucauagaaauacacacacacacacacacacacacacacacacacacgcuuguauuuuguuuagaguuauuccaucuauauuuguaagauauauuggucuguaguuuucuuuugaugcuuuugucugguuugguaucaggguaauauugaccucauaaagugaauugaaaguauuccuauugguuuuggaagaguuugugaaggacuggcauuaauucuuugaaaguucgauagguuacaucaaaugggucugagcucuuuuuuuuuuuuuuuuuuuuugcaggauggggcauaguauuuuaauuacuaaaucacucuuuuuucuucuuaugggucuauucagauuguccauucuuuuuuuuuuuuuuugagacggagucuugcucugucgcacaggcugggggugcaguggcgcgaucucagcucacugcaagcuccgccucccagguucaugccauucuucugccucagccucccaaguagcugggacuacaggcgccugccaccacgccuggcuaauuuuuuguauuuuuaguagagacgggguuuaaccguguuagacgggauggucucgaucuccugaccucgugauccacccuccucggccucccaaagugcuaggauuacaggcuugagcuaccgcgcccagccugguuaggcucugguaaaauaguuugagggcaaguuuucuaagaagaacaaaauacucugggaauauucaaaaugguuauccccaacccccucccccuaacugggggguagguauuuuucucucaucuuaacugugguaacaugcuagggguuguggagauaaaacuuacagaagcauggaggcccuucauaagacugguuucccugcggcuuuuaauucucaaaguugucgcauugcaccuccagcaauuugucaauuacacuagauuuuucuucccuaguacuaguuaguucccacagugguuucuguucuugggauucugcucugguaaguugugauucucuguguauguaccucuccaauuuuuggaacaauaguuugcccuucaucucaguucucugauggauauaagaagaguuuugauuuuuuaguuuguucagcuuuuuuuuuuuaugauggggaugggagugauuacuuccaagcucuuuauaugcuucaccagaccucuguuuugggguuuuuuuguuuuguuuuguuuuugagaugguguuucgcucuuguugccuaggcuggaaugcaauggcauuaucuuggcucacugcaaccucugccucccggauucaagugauucuccugccucagccuccugaguagcuggguuuacaggcauaugccaccacgcucagcuaauuauuuuucuuguauucaguagagaugggauuucaccauguuaggcuggucucgaucuccugacuucaggugauccaccugccucggccucccagagugcugggauuacaggcgugcgguuuugcuuuuaaacagacuuuaucuuuuagggcaguuuuagguucacagccacauugaaugggcaauacagaguucccaucugugcccugccccucuccauagccucccucacuguuaacauccugaaucagagaugugucuuuugcaaauauuuucuuccagucuauagcuugucuuuuuauucuuuugacaguguuuuucacaaagcagaauaaguuuuuaauuaaauccagcuuaucaauuauuucuuucauagauuauaugccuuuaguauuguauccaaaaagccaucaccaaacccaaggacaucuagauuuucuccuauguuaucuucuaggaguuuuauacuuuugcacuuugcauuuaggucuuuuuauacuuuugcacuuugaauuaauuuuugugugugaaggaugucagaucuguuucuggguucauuguuuugcauguaaauguccaguuguuccagcaccauuuguugagaagacuuucuccauuguauugccuucguuuuuuggucaaaaaaucaauugaauacauuuauaugggucuauuucugggccuucaauucuguuuuauugaucaaugugucuauuucguugauacaugcugucuuuauuacuguagcuuuaugguaagucuugaaguuagguagugucaguccuccaauucggagucuuuugccccuccauauaaacuuuagauugaauucauugauguguauuaaaaauugcugggauuuugauugggauugcguugaucuuaauagaucaaguugggaagaacugacaucuugacaauauugaguauuucaugaaguugaaauaccuucucauuuauuuaguucuuugauuucauucaucgaguuuuauaguuuuccucauauagaucuuacauguauuaaguuagauuuauaccuaaauauuuuauuucuuggguuguuaauguaaaugguauuauuguacuuuuaacuucaaauuccacuugauugcugguauacaggaagugauugacuuuuauauauuaaccuauauucugcaguuuugcuaguuuuacuuauuaauuccaggaaaguuuugucaguucuuuuggauuuucuuuuuuuuugagauggagucuggcacugucacccgggcuggagugcaguggugugaucucagcuuacugcaaccucugccucccggguucaagcgauucuccugccucagccuucugaguagcugggauuacaggcgccugccaccaugccuggcuaauuuuuguuuuuuuuguauuuuuaguagagauggaguuucacuauguuggccaggcuggucucaaacuccugaccuugugaucugcccuucucagccucccaaagugcugggauuacaggcgugagccacugcgccuggccuggauuuucuguauagacagacagucaugucaucugcaaacagaguuuuauuuccuccuucccagacuguguaccuuuuauuuccuuuucuugucuuauugcauuagcuaugaccuccaauacacuguuggacaguggugagaggguguauuaugucgucauuguguugcuaugaagaaacaccugaggcuggguaaguuacaaugaaaagaaguuuaauuggcucaugguucugcagaguaugagaagcuuggugccagcaucugcuucuggugagcuuacaaucaugguggaaggugaagugggggcaggcgucucacauggcgagagcagaagccagagagcaagggaggaggugccacucuuuuaaacaaccaggucuugugugaacuuagagugagcgcucacuuaucacuaagggaaugguguuaaacuaaucaugaaggaucugcccccaugauccagucaccuuguaccagaccccaccuccaacacuggggauuacauuucaauaugagauuugaaagggacagauauccaaaucauaucagagagggaauccuugccuuguucuugaucuuagaggcaaagcuucgaguuucauuagguaugauauuaguuguaggauuuuuuguagauacucuaugucaaguugagaauauuccccucuauuccuauuuuaaugagaauaucgugaagagguugucaaauguuuuuucugcaucuguuauaugaucaugugguuuuucuucuaaagcuugucaacaugauggauuauauuaauuguuuuuuuuuuuuuuuuuuugagacagggucuggcguugucacccaggcuagagugcaguguugccaucuuggcucacugcaaccucugccuccaaggcucaagccguccuccuacuucacccuccugaguaacugggaccacaggcaugugccaccauaccaggcuaauuuuuguauuuuuuuuagagguggcagaggggggucucacuuuguugcccaggcuggucucgaacuccugagcucaagugaucugcucaccuuggccucucaaagugcuggaauuacaggugggagccacuguguccagccuuaacugacuuuugaauguugaaucaaguuugcguacgugggauaaacccacuugucaugauguacaauacuuuuguacauuguuaaauuugauuugcuaauauuuugcugagaauuuuuacauugauauucaugggagauaauggucuguuguuuucuuuuuugguaauauguuugucugguauuggcaguaggguaauacagacuucauagaaugauuaagaaguauucucucugauucugucuucugagagauuuuagagaacugguacaauuuccuccuucaggguuugguagcauuaccagugaaccugucugggucuggugcuuucuguuuuagaaggcuauuaauuuaugauucaguguuucgaauagauauaggccucuucauuuugucuauuuuugugucagauuugacagauuaucuuuuuuaagaaaucguucauuuuaucuaggcuaucaaauuugugggcauagaguuguuuauaguguuccuuuauuauccuuuuaauguccaugagaucuguugugauguccucucuuucuuuuuucuuuuuuuugagacagagucuugcugugucaccgaggcaggagugcaauggcgcagucucccucacugcaaccucugccuccuggguucaagcgauucuugugccucagccaccugaguagcugggauuauaggugugugccacuaugcccggcuaauuuuugcauuuuuaguagauuuaggguuucgccacuuuggccaggcuggucucaaacuccuggccucaagugaucugcccacccuggccuuccaaagugcugggauaacaagagugagcuaccauaccuggccucauuuuugauguucauaauuugcauccuuuaucuuauuuuauuagccuggccagagguuuauugauuuuauugaucuuuucaaaagaaccagcauuuaagcuuuuacugauuuucucucuuuauuugcuauucucaauuucauugauuucugcucuacuuuuuauuuauuuucuucuccucacuuuaaauaugauuuauucuucuuuuucuaguuuccuaaguuggaagcuuugauaauugauuucagauuuuuuuccuaauauauacauucgguguuauaaauuucccaguaagcacuacuuuugcugcaucacaaauuuugauaaguuguauucuuacuuucauuuaguugaaauauuuuuaaauuucuuuugagaguuuuuauuugacccacaugcuauuuagaaauacacuguuuaaccucuuaaguauguugggauuuuccagcuauuuuucuguuauugauuucuaguuuauuuuuuccuuuauuguauauauuuauacaucaugauguuuugauauacauauaccuagugaaaugguugccauagucaagcaaauuaacauauucgugaucucacauaguuacugccuuuuuuuuuuuguggcaagagcuucuaaaauccuuuuagcaagaauccuaaauauaauacaauauuauuaacuauaguacuuauauuuuacguugaauugcuaaacuugcugauccaucauaccugcaacuuugaauccucugaccugcaucuccccauuuccuccccuguuccucacuucuacuucuuuguacuugacuuuaaaaaauagauuucauauguaagugagaucaugcaguauuuuucuaucuuccagguuuauucaugugacaaauggcaggaucaccuuccuuuuuaagguugaauaauauuccucccccuuccccuccucguguguauguguguguguguuaugugugugugugugugagugugaguguaugugugugugucuuguaguuuauucauucaucaauggaugcuguaguuguguucguggcuauugugauaaugcugcagugaacaugggagugcagguaucuguaugagguggugguuucauuuucuuuagguuuuuacccagaaauggaauugcuaggucauacaagaaaaguaguccuuuucuuucuuuucuuucuuucucucucucuuuuuuuuuuuuuuuuuuuuuaagacagaaucucgcucuguugcucaggcuggaguacagcgguguguucucaacucacugcaaccuccgccucccgaguucaagcgauucuugugucucagccuccugaguagcugggguuacaggugugcacuacccugccugguuaauuuuuguauuuuuaauagaggcgggguuucgucauguuggccaagcuggucucaaacuccuaaccucagugauccucccaccguguuuggauuacaggcacgagccaccgcgcccagucguaguucuauuuuuaauuacuuuagaaaacuuuauacuguuuuccgcaauugcugcacugguuuacauugccaccagcaguguacaaggguucucuuuuuuccacacccuugccaacacuuaucucuugaaucuuuuuguuuuuuaaauaauagccauccuaacaagugugagaugauauuucauuuugguuuuaauuugcauuucccugaugauaguaauauugaauaucuuuucauaugcugauuggccauuuuucuuuucuuuuuuucuguuuuggagaaauguuuguucagguccguugcccauucuaaaauuagguuguuuguuuuucuucuacugaguugcacaaguucuuuauauauuguggaaacugacuccuuaucagauauaugguuugcagauauuuucucaucuguaguagacugucuucucauuuuguugauuguuuacuuagaugugaaacucuuuagcuugauuuaguucuauuuauuuauuuuugcuuuuguagccugagcuuuuguugugauauccaaaacaacauugccaagacaagugucaaggaguuuuucccauauauuuucuucuagguuuaugguuuuaagucuucauguugaguucuuuaaucaacuuugaguugauuuuugcuggugguguaagauaaagguccaauuucauucuuuugcaugaggaaauuuaauuuucucagcaccauuauuugaagagaucuucuauucccuauugugucuucuuggugcccuugucaaaaauuagcgaaucauauaugcuuggguuuauuuuucucucucuauucuguuccauugguuuacaugucuacuuuuuaugccaguaccacacuguuuggguuacuauaacuuuguaauauaauuugaaaccaggaagugugcuuccuccaacuuuguuuuugucuuacagaauuacuuuggcucuuuagagucuuuugugguucuauaugaauuuuagauuuuuuuuucuauuuuugugaaaaaugccauuggcauuuucauaaggauuguguugacuuuguauugcuuuggauaguacauacauuuuaacaauauuaauuauuucagucugugaacauggaauaucuuucuauuuauuuguguccuuaauuucuuucauuaguauuguaguuuucaguagacagaucuuuugccuucuugguuacauuuauuucuaagucuuuuuauuuuguuuuuugaugcuaucauaagugggaugguuuucuugauuucuuuuucauauaaguaguuauuuguguacagaagugcaacugauuuucauauauugauuuuguauccugcggcuuuacuggguuuauucuuuuuucuuuuugagacagagucucacucuguugcccaggguggagugcaguggcucgaucccugcucacugcaaccuccaccuccuggguucaagugauucuccugccucagcuucgcaaauagcuaggacuacaggcgcgcugccacaccuggcuaauguuuacauuuuuagcagagaugggguuucaccauugcuggucaggguggucucaaacuccugaccucaagugauccacccgccuuggccucccaaagugcugggauuacaggugugagccacugugccuggccuauucauucuaacagugucgauuuuagucuuuggggguuuucaguauauaggacuuuuuccuuucaauuuauauuucuuuuucuugccuaaucgcuuuaguaggauuuccagugcuauguugaguagaagggugagagcaagcaucuuugucuugcuucugaucuuagaggaaauguuuucaguuuuucaccauugaguaugauaugagcugugggacauacagcuuuuauuauguugagguaguuuucuucuguuuauagucuguugacuuuuuuuuuuuuuaaauaaugaaaggguguugaauuuugugaagugcuauuucgguuucauuugagaugaucaugugguuuuuguccuuccauuaaugugguguauuacauugaucaauuuuuguauguugaaccauccuuguauuccacgaauuccacuuggucaugguguguaauccuuuuaacguacugcugaauucuuauugguaauauuuuguugaggauuuuuacaucaauagucgucggggauacugguuuauagucuucuaaugucuuugucugacuuugguaucaggauaaugcuggccucauagaaugauuuggaauguucccuccugugcaauuuuuugggauuguuucaggaggauugguguuaauucuucuuuaaauguaugguagaauucuccagugaagcuuucuuguccuggaccuuuuuuuuuuuuuuuuuuuuuuuuuuuuuugagacagggucuuacuuugucacccaggcuggagugcaguggugcaaucucagcucacugcaaccucugcccuccaggcucaagcaguccuccuaccucagccucccaaguaacuguuaccacaggcaagcaccaccauguccagcuauuuucguuguauuuuuaguagagacaggaucucaccauguugcccaggcuggucucuaacuccugagcucaagcauuucuccugccuuggccucccaaaguacugggauuacaggugugagccacugcgccuggccaugggcuuuucuuuugugggagguuuuggauuauugauucaauuuccuuguuguuggucuguugagauuuucuuauuuuuucauguuacucagucuugguaggcuguguguuucuaggaauugaucuguuucuucuaggcuguccaauuaguuggaguacaguuguucauaguauucuccuaugauccuuuuuauuucuauggcauugguugucauguccccucuuucauuucugaauuuaguuauuugaggccuuuuuuuuucucagucagucuagcuaaagguuugucaguuuuguuuauauuuucaaauaacuauugguuuucuugauuuuuuuccuacuguuuuucuauucucuuuucuuuaucuuugcucuaaucuuauuuuuuccuucugaucacuuuggguuuaguuucuuuuucuaguucuucaagguguaauguuagauuauugacaugaauuuuuuuuuuuaaauauaggcauuuacgacuguagauuaccuucuuaguccuacuuuugcuacauucaauaagcuuugguauuuugugcuuuaauuuuugucuuaauguauuauuuccuuuguuacuucugucgugacccauugucuuuuuaagaguuuguuguuuaauuucuauaaauuucuugauuuuccacuuuucuuucugcagcuaccuucuaguuucauucuguugugaucagaaaagauaccuaauacuuuguggccaacaugugguguauccuggggaauguuucacgugcacuugagaagaauguauauugugcuguuguuggguggaguguucuguauauguauguuagguccaauuggucuguagugcuguucaggucuuuucuuuccuuauugaucucauucuauccaucauggaaaguugguuauugaagucucucacuguuuuuggagagcucccuucaauuuuaucaauguuugcuuuaaguauuuaggagcuccaaugucugacacauauauaauuauuauaucuuauuugugcauugaccccauaguguucuccuuugucuaugguaucaguuuuguuuaaaaauguauuuucucugauauuaguguugccgcuauugcucucuuuugguuaccauuugcauggaauaucuuuuugaaucuuuuuacuuagagccuguguguguccuuaguuccaaagugucuuuuaaacagcauauaguuggguccuguuuuuuaauccuauggguuuuuuuuuuuuuuuuugguaauuucuuuguccuuucauagcuuguuuuucauuuccuccccuucuuucuuuguguuuagucaauuuuuuugguagggauauauuuugauucucuuauuuccuuuuguguauauucuguagcuauuuucauuguaguuaccaugagaauaucauaaaacuccuuaggaggauaacaaccuguuuaaacuaguaacaacuucacuucaaucacauauaaaaacucuaguccuuuauagcuuugccccccaaccuccaccucccggguucaagugguucuccugucuuagucucccaaguagcugggacuacaggcacaggccaccaugccugacuaauguuuacauuuuuagcagagaugggguuucgccauuguuggccaggcuggucucaaacuccugaccucaagugauccacuugccuugccucccaaagugcuggauuacaggcaugagccaccgcaccuggccaaaguuauuaguacccuguuaacaacauuuuacuggugucacaaguaacauguuuauauauuguuuaaccauuaacauacuuucuuaguuuguuuucucuugcuuauaacaauacuugaaacuggguaguuuauuuuaaaaaguuauggaggcugagaaauccaaggucaagggugagggccugaugagggccuucuugcugauggggacucugcagaauccugagguggugcagggcacauggugaggggguugggcaugcuagcucaggucucucuuccucuucuuauaaagcuaccaguccacucucaugauaagccauuaauccauuaauccaucaagucauuaagccguucagaucugcccucaugauuaauucauucaugagagcccagaucccugaugacccagucaccucugaaagguucuaccucucaguacugccacauugcggauuaaguuuuaacaugaguuuuagaggggacagauacucaaaucauagcauguagauuuauaguuaauuuuuaugcuuuugucuuuuaaauccuauaaaagaauuaagguggaguuacucaccagaauuaaaauaauguuuuuauauuuguccauauauuuaccuuuaccagagaacuuuauauuuuccuauggcuuaaaguuacuaucuagcauccuuuaauuucagcuugaaggacugccauuagcauuucuuccaggugaggucuagugguaaugaacucucucagcuuuugugaauguuuuaauuuucccuuuuacaggugcaugccaucaugcccagcuaauucuuguauuuuuaguagagacgggguuuugcuauguuggccaggcuggucuggaacuccugaccucagguaauccuccugccuuggccucccaaagugcugggauuacaggugugagccacugugcaccuuguaucuuucuuugucuguucgaggaucugagauacuauuuuaaaguccuuuggaaguauaguuuguaaucggauuuuuaguaagaggguuauuuuuuuuuucucuuugugugcauucuucucuaccugcucuuuuugugguuguuucugcuuuguccuuuauggcaucuucuuuagaaggaaaucuuauauuggaagcucuggguucuuauucuucaggguuauugggaaaaaucucaagaaccagucccugaaccaguggguggcuugaccaggucauuuuuguuuuauugccuguaaucuguccauuuguguuccuucagccuuuggcuauggucacaacguuuauugccuucuuucacuaguaggagagcgcugcuccaaccccuuacuucacaaaaugauucugacuuuuguucccacuucuugugcuaugaguugauuucagucccuauuauugggguugauuuuuaacugucucaaccaguaagauuuaaaaauagacaacuugcuuguuucuguuugcugcuuuuaccucuauggguaaaggagguuaaggaacugcugugguuuaugcaaaaguaugcuguguccuaacugaguaaccuuaaggauaauagcuuguauaaugguugugaaaucaaaaugucguauaugugaaagggcuuuauaaacugggaaguauggucuaaauauuaguuuauuuuuguuguauaaucauagugauuguguuauuacucuauuuaagccugcuuuugauuuucagauuguuccauugaccugucauguauggcaacagauaguauaucaaggcaauaguagaacacaaauuucugauacuaauguggucuguuuggaaacaacagcucagcgggguucuggggaugaucagguaugucuucuguaacuggcuaacuuuuuuuuuuugauaagcagcacaagaaauucugauuuagcuaugaagaauggaaaaauaaauuaauauucauuaauauuauguuuucuugucuuuuuuuuuuuuuuuuuuuuuuuuuuaagacagggucucacucugucacccaggcuggagggcaguggcaugaucauagcuuacugcacccuccaacuucuaggaucaagugauccuccugccugagccucuugaguagcugggacuacagacauauaccaucaaacccaccuaauuauuuuuaaaaaauuuuuuauagauggagucucgcuuuguugcccaggcuggucuugagcucuuggccucaaaugauccuucgccuuggccucccaaagugcuaggauuacaggagugagccaccacucuuggccaaauauucuauuuuucuaauagauuguuguaaacuuuauguauauguagaagagcaguucacuuuuuuugaaggcgggucucaggacucuuauuuuuauuuuuaguuuaaaaauuuuuuauagagaugggagucucuguguuuacugggcuggucucucauuccuggccuuaagugauccucuugccucggccuccuaaaacuaugagauuacaggcaugagccacugugccuguccucaggacucuuuauauucuucacaaguauucuuaagagcuuuuguuuauguggauuaucuauauagauauuuagcauacaagaaauuaaaacauuuaaaacuauuuuaaaauuuauuuugaaagaacaaaccuauuacauauuaccauaaauaguauauuuuaaaguaaaaaaugacuguuuuccaaaacaaaaaaauuaguuggaagaauagcauuguuuaaauuccggcuuacuagaacucaguugguauauuauucaggguucuccagagaaacagaaccaauagguuggagauagauacaucuaucuauuuauacacaucuguguguauguguauauauauaucuuuauugauauuuauuauauagaauuggcuuaugugaucaugaagacugagaagucccaagaucugcaagcuggagccccaggagggcugaugguauaguuccaauucaaguccaaaggcuugagaaccaggagcaccagugauguaaguuuugaucugaaucugcagguagaauacccuccagcuggaagaccaucaggcagagagaacacauucucucuugcucagccuuuuguuguauuuaggccuucaagguacuggaucaggccuacccacauuggagaggguaaccugcuuuacuuaguuuccagauucaaauguuaaucucauucauacacaccucacaggccaggaacaguggcuaacgccuguaaucccagcacuuugggaggcugagguggguggaucaccugaggucaggaguucaagaccagccuggccaacauagugaaacacugucucuacuaaaaauacaaaaauuagccaggcgugguggugcacaccuguaauugcagcuacuugggaggcugaggcaagagaaucgcuugaacccaggagguggagguugcagugagcugagguugcgccacugcacuccauccugggcgauggagcaagacuugucucaaaaaaaagcaaaaaaacccaagaaaacaaaacaaaaaauaccacacacauacacacaccucacagacguauccaaaauuguguuuaaccaaguaucuggacacuccaugauccagucauuuugauacauaaauuaccuaucauagcuggauucucagucugcucugcauuucauuuguugggauguauuguuuugguugaaguauaugaagacaaucuugccuuacauagaugaaaaaggaguuagggaaaggaggcugucauucagucccugaaagggugucagugacccucagggauuuuuggacuacacuuugagaaccacuuuucuagaacauaguuauaaacuuugaagaaaugaaacgaucaugagcagauaggaaaaaagcucauguagaguuauuggaggaaaaauguuauuaguguuacuaauaaugguuaaauauuuaagguugauuaauaacuugaguaucagauuucuccuauuaccuucaguuuucuuuaaauugcagugauuaccuguuagaugcaagauauggaggaagggagauacacuaucacugaggcaaaguaguuaagacaaucccugaccauaaaaaacauaguaccuggggccauuaaauggaagaggauuguuuugggucgaauugugcccucccaaauuauauguugcaguccuaauccccaauaccucagaaugugaccuuauuggugauugcagguguaauuauuuaagcucacacuggaguaggguuugcucuuaauccaaucuaacugguguccuuaugaaagaggaaagcaccaugugaggagaaaaacauacaaggagaagauggccgugugaagauggaggcagaaauuggaauuaugcugccacauccagggaaugccuggggcuuccagaagguagaaguagcaaggaaggacccuccccuaggggcuucagagggagcaugacccugccaacaccuugauuucagacuucuggccuccagaacugcgagauaauaaauuucuguuguuuuaagccacuuaguuugugucacuuuguuauagcagcccuaggaaacuaauaccgggucauauuucuaaauaauauucucugagggcauauuuuugguagagcacaguccaaaaauugaugucuuccuuuuuuuccuguuucacacaauacgaaccaugauggacccuaaagcacuucauuucauccuuuacgccuggguucgucagaauagcuggaauauuaugccgcuuucuaguucacuuccuucuuauucuuucgucguucaucuuuguuacugucaucugaguuaccuuuauuuauucauggaaaacuagcucuugcuacauugucuuccucucuuuuauugguuucuuucacuucagcauacauuucccauucagugccugaaguucucauauauuucaucuaaucuccagugaucuuuacuuccguaccuccuuccagucuucuccuaccuguauguaguuacucaucccaugaucacagucuaucuagacuuugucaucaccagcuacuuuacuacaaaugucucguccucucuucccuuccggcuacugcuucggucaauauucugcucccuguuacagugaaauuuucaagaguugucuauacauuuucuguuucuguuuccugauauccuaugcucauuuuuaaaaagucagguuuauuguagguauagguuaaacauaucaaaauuuacucucuuagguguacaguuugucaagugagcuuugacauacguauacagucaugcagucaccaccacauuugagauagacagcacugccuucacaaaaaggaacgucacaaaaaguuccugugugccccuuuguagucagucacuuccccaacuccuagucccuggcaacuacuuauccaauuucuuucucuuuaguuuuaccuuuucagaauaauacgguguguagacuuuugaauuugacuucuuucacuuggcuuagcuuuugagauuuauccauguuguugcauguaucaauaauuuguccacuuuaauuuuuauuacugaguaguauuccauuuguguguagguuuuucgguagacauacugcuucauuucucuuggcaaauaccuaggaauggcuggacgugguggcucacgccuguaaucccagcacuuugggaggccgaaguggguggaucacuugaggucaggaguuugagaccagccuggccaauaugguguaguagaaaccccgucucuacuaaaaauauaaaaauuagccaggugugguggcacaugucuguaaucccagcuacucgggaggcugaggcaggagaaucgcuugaaccugggaggcagagguugcagugagucaggauggcgccagugcacucuggccugggugacagaaugagacucugucucaaaaacaaaaaacaaaaaacaaaacccuaggaauggguuuguugagugauaagguaauuguauguuuaacuuuauaagaaaguaccaaacuguuuuuccaaaguggcuguaccauuuuguaucccaguaguauaugagaguucugauugcccugcauucuuggcagcuguugguaucaucaguuuuuucuuuuuuucuuuuuuuuuuuuaauuuuagacacccuaggagauguauuauuggugucucacugugauuuuaacauucauuucucuaaugacuaaugauauauagcaucuuuuugugugcuuauuugcccuccauguuucuucuucagugagagaucuguuaaaaucucugccugauuuuuuguggcugguuuguuucauuuuuugagcuuugggaguucuucauagcucuagaugcaaguccuuuaucaguuguuucuuuugcagagacagucuguggcauguuuuuguauucuccugucuuugaaaggcagaaguuuuaauuuugaugaaacuuguuuauugauuuuuuuuccuuuuuugguuuauauuucuuguguacuaucugagaaaucuuggccuaauccuaugucacugagauuuuucuucuauguuuucuucuagaccaggguuucucagccuuggcacuauugacauuuuggguugaauaauucuucauagugggggucuguccuguguguccuaaaauguuuaacagcauuccuggccucuucccacuagauaccaguaauagucccccaauuuguaaccauccggaaugcuuucugacauugccaaauguuccaugguugaagggagaggcgugucaaaaucucucccaacugagaaccgcuuuuucagaaguuuuguaguuuuacguuuuacauuuaugucuaagauccauuuugaguugguuuuuguauauggugugaaggaagcauccaagcuguauuuucuuacauaugaauauguaauuguuauucuagcaccauuugcuaucuuuuuuuccaguggauuucaugacaucuuuguaaaaaaauuaauugaccuuguauaugugggucuauuucugcacacuauuccauugauuuacauauguauccucaugccaauauuacacucuuaauaacuguacugucuuaaaaucagguugugugauuuuucccacuuuguuccucuuuuuaaaaauugauuauuucagauucuuggaauuucuauauaaauuuuagaauuagcucgcccaauuuauauuuuaaaagccugcuggaauuuuuuauuaagauuucauugagucuauaaaucaauuugaaaauaauuuugacaucuuaacaauauugaguuuucuaauccauaaacaugacaguucucuuaguuuauuauuucucuuuaaugucuucaucaauguuuugcugucuucagugugccaaucuuacacguuuuguuagacuuacugguauuuuuagaaauuucuauuuccuauuauucauuauaaguguauagaaauauaauugacuuuuuauauugaccuuguguccuauuaccuugcuaaucucacuuacuaguuuuaguagcuuuuuuaaaaaaauauuuccuuuaggacuuuauaugcagaguuauauuaacuaugcuuuguuuuuuacuuuuaaauagauaugucauuucuuuuuuuccguuuuuuuuuuuuuuuguuuuuuuuuugcuuuauuacacuggcuaggaucugccuauucuucuacuugaucuacuuuguguucugaccccaauucuuugaaaggaaguaucaccagcaauauuuauguagcugaauacagugaauacuuuucuguccuccucuuagguacgauaaauagcauuugacacuauuauuaaucauuacauaacuucuuuaaauuauuuccuuucuuggguucuucugguuuuuuuucuacucaucuggcuguucucucucaguauccuuugcugcuuuaucuuccuuuguuaaaccuuagaaucagaauuuguaagcuguggacccaaguaugacucaaaugugguuuucaaaaaccauuuuuuuuggcauaauguuuuaacacuuuugaaauagaauacuuuaaagugaacaugcauaguuagccacaaaucccauuacucuccaauuccagguuggauuacuucauuugucuuacccccauaccccuauacacauuuaguuuucaaccucugcuugaaacgcuggaauguucgcggucucauccagauccaggacuuuaaauacaucuguauacugauaaaucccaaagauguaucucaaacuuuuuuucucccucaaaauuuguuuguauuugucagaaugcuuauauguugucccuccccacaucugucaaaaauauuuagagauuuguuggccuuuuuauauugauuuaaaagguauaacacaaagaauauuugaugauugaaauguaucaagaaaauacauaaugcagaaaguuaaaaaagguugaacagagguuguuuuaaaaauucaguuuauaaugggaaauuauaagaauauguuugcauaggagaggaaugauucaguaaugagagaaaaaugggugaaggaaagugggagaaucacauaggaaggaaaucacugaaaaaaauuugaaugagauaggaaggccuuugagaggcagagugacuuuuuuuuauuuucaagucauaagauagaaaucugguaauggggauuguagaucuggugguugaagacaagggaguuccucucuccugcucuacaauuauugaaggucaucaguugaaaauuaggagcguucaauaguucugaggagggaagguaugaaaucucaacucaccaggaaaauguaguaggauuuccaggcaauauugagugcccuucagguuuagugacaucaauuuaaagaaaagccagucaguuugggagugugauuucuccagcaacgugcugcugauuggauucaugcaaggagacgguuccaucaguguuagcuuuugcugagcaaauaggauaaugggagaaaaacgcaagaaaguuaaggguguuugcaaggcagugauuauaaggauggcucugaacucucagaggggcaaagaaggaaauacagauaagaaaggaauaaagaaaaguauaaaugugauaggauaguugucuccgugaaguuaaaaaauuauugcaguagaggaacuagagaguaagugaucuguggaggucagaggauggacagaaagacuaauggauacaucugucacuauuagagaggagugaacuaugggauacaggcucaaaccauggucagagaggcuaagagaugacucgggaccagugauuuuugcuuuagugagucacaagaugauuggaauucugcuuuaaaaccuuuuguuggcucacuaaccuguccccuauagaaaggagugcccucuaaagaaaaaauguaaaauuaaucauucucauauuccuuuuauuuucaaguaucagaaaggugaaaagcauguuuccaguagcaauuugauguuauagaucugauuaauuuauucaguguagaagggauugagguauuuuggaaugucaaaagucugcuauuccauaaauguagcauuaauauucuagaauauuucucuccacauuuuuuucuuugcauguauuuguauaacugauauuauguaguggauaguggguaucuuuuuucuuaaacuuacuauaugaacauuuuguuaaugaauuuuaaauauuagaaaugucucuucaaagacaaaagucuugcuggaaaauguuugcgaaaauauuuguaaauuguaauacaucuucuuuuuauggauucuguaccacccgggaauuaaaagauaccuauauucucuuagaaacauuugaguugaucaaggaagaagaguccaguaguggaauacuuacaaaauaaugaaaauacauuauaugucuaaaguugcugucaauauaaugccacuuucucauguuuuuauuuaaauaaauaaagcaaauugaaugaauuauuuaaccaaagauuuuacauaaagacucaaaaacuuguaaucccagcacuuugggaggccaagacaggggaaucgcuugagucuaggagguccagaccagccugggcaacauagugagaccccugucucuacaaaaauuuuuaaaaaauuaacugagugccugccaguagucccagcuacucaggauacugaggaugacaggaucacuugagccuggaggcagagguugcagugagcugagauugugccacuguauucuggccugguuaacagagcaaaagccugucucacacacacaaaaaaagaaaaacugcaaauagaggaaacgugguaaagagaaaaacaaguuauaaaauauaauacaguuguuaaauucaagaaauagagaaaaaauagauauauuccuaguaaauagaguugcgaaaaaaaucucaaugaaauagacuuucuacaaaacuaugaguauuucauagagguagacuaggauuacugaggaggaaauugagaaaguuauguuaguaccagcuaucaaaaagauuuuuggaacuaauagauuugcugauaaaucuuuuacauuuuuaaagaaaauugaaguugcuuaaauaaauacagaacaacguuaugaaacaagaaaaugagggcauucuaaaauacugauuaaucuuaguugugaccauauaugugugaaaauguuaaagaauaugcuagcaaacauuuaaacgucugaucuaccacuacuguguaagaaaugugaacauguuucaauauaaagaaauuuugugacuugggaggcugaggugggaggauuaagcgcuuuagcccagaguuugaguccauccugggcaacauagcaagaaccugucuaaaaaaaaaaaaauuauugcuauccuuuaucagguuuaauuggggaaaaugaugcuauaacauaguuugagcuaauuuaguguucauuucuaaucaaauuauuugaaaaugaaaauacuuucauaucaugauagacuauacuuaauuauuaacuaauauuaaauucaaaaggaaaauaccuuuuaaacuugucaccauuaguauuuaauacgacuuuaauucagcauuguuauuuagugugaucuguagauuggugccaguccaugauuugcuuguuacuggucugucaagagguaaguauagaaauugagaggaaguguuuagaaacuuuuauaguaguuggauagaguaauuuuaucuuuuuuuagaccuagaaaucaaacauuugggcuuguguuuuauaucuugggcuuauaguaagacuuuuaauuucauuuuucuaguuauuuuuacugguuuuaaaaauuagcuuauuucucauuaauuuuuguuagcauuuuaguaaagugucaguaugugaugacuuggaaguaggaaaaacugguucuucccuauagguaguuugagaagcaguucucuggaucuugccacuaauuuaagaguaaauauuugaaggagacaaguguaucacauucaugggugauaugauaauguuauauauacugagaagagccagggaucguuuagaaacuaguagagcuaauaaaaauucagucaagugaauucccaagcuaaagcugaagugaaugcuucaguaggucccaugaaucggcccagcccuugcgugcaccaaguuuggccccucuagcaucgccgccacgaagaaaguggcucaacagcuuuggcugaaggcccggcucaacuguguaaaaauuucccaggcagcugcagacuugaaacaauucugucugcagauugcuuaacaugacucucugcugacuggaguaucuucaaguacaaauuccuucauaccccagaaagucuguuccuuuuuguaguaaaaugaaucuuucagagguuucccaagccacuucucaugauacagugaauauucaaaagagagcuacauuugaagccuguacaaaagcuuauccccggaacacaugugccauaauauacaaacuucuacuuuugucaguccuuaauaucuaccucucugaauuuucaugaauuucuauuucacaaggguaauuguuuuauauacacuggcagcggcguacaauacaacuuaguauaaaagguuuuuuuguguuaaaaaaagauguguaguaaugggaagaggucuaaaauguaguuaauauugugagaacaacagcuuuacauuuucuauacuuugaugagaaugucauuaaauaggaagcuauauaauacaugaguggacauuuucaucuaaauauuaauauguaugguaacucaguuaaugacuuagcauguuuuccuuuaacauuuuucuagaaaacagaaucuuggcauugucuuccucaagaaauggacucuucccaaaccuuggauacaucccagacuagguuuaaugugagaacggaagauacugaagugacagacuuccccucucuggaggagggcauauugacgcaaucagaaaaucaaguaaaggaacccaacagagaucucuucuguucuccacugcuagguaaugccuguuuauuuuaacuaguaguaauaccucacauuuguaaguuuugcggggacugcaagucuuguaacuuuccccuuuuugaguuaaggagcucuguagagaccuacucagagggauuagcuuauuucuguuuuguuuguuuguuuguuuuuuacuggcuagcugaucuaauuauauuaagugugcaguugccucucauuuuaucacuucccguugcucacagaaggcagaaaggugauaacugucuacugugugugccuccucagucuugaauuugcagaguuuuugggaugaauaguauacuuugguuaucucagcaauggagacuccaugaucccccacaaaaaacaaaaaacaaauguucauauuuaccuuuuugauuuuuagaauuaauuaaggcauauguuauuauccuuagcuuucaaaccaaaaauugagauaaagagguugaguggcuugucugagguagaucuugcugcuuuccucuguuuaguauggaacugauuuauuagcucuuuauaaaagauaaacuuuaaguacuuuuaaaaucauuaagggauucaauuaugaagaugguuuuauaguuuuguagagaagcaugaauagaacuuaauucagcaaguucuuugccaacauaaacuaaugcuauccaaaucaagguauuagugccaacguuuucuaugauguggauuauuaaagucaauuuuagguccacauuuuaagaaagguugacaaaauuagaguaccuuugugggaggagaggacuaucuuuugauagacaaaagagaagacuuugcuauggucaaauauuugaagggcuguuaugcuaaaaaggaagcaacuuauuuuuuauucauucauguaacaaauaucuaagugccuccuauguguuugaugcuagggguauauagaugaaagcuaccuccucuucugggaaggcaauccaguaaacagaaaauaacaguaccaugggauuuguauuauaaugguguagagcaggagucugcaaacuauagcuuacaggccaagucuugauuuuguacuguccaucugcugagaaugauuuuugcauuuuuaaaggauuguaaaaacaaacaacaguaguauguaugaccaacaaaaccgaaaauauuuaccaucugacccuuuauuaaaaaagguuugcuaacuccuagaguuuaaaauggauacauaacuuaaagggaagcuauuuuucaaauugauguaaaaaagagcuuucuaauagagccauuuaauacuaaaaaaggcuauauaacaacaacaaaaagugagcuucaugucacugcaaaaugucuagcaaaauucuguauuaggauuuuagcacuggggaggagauuguacuucgugaccuaaaauguuuucuaauguaaaguuuuauaacucuggcuucucauuuacuauaguuagggcagaacauuuuaaauuauuggaguagauuccuggaucucauaggcagaggaaauuuuaucauugcuguuuuguuacgcauaaguacuaacauugugauaaauaggcucucgccaauggcaaauguaauugaugauggcuggugccagaaugguuagauaccucaaaaaagagggaugcaagccaguaacagauauccacacuugaggaaacaagaagcaguugaaagcuguaagaaaaaggcauggcaaguaaaauacaccaccuucccaucacacacacacagauaauguuguacacuugagaaucauuaacucuucagcuuuggccugcuccuuuagcaaauacauuugccuauuuaugugauuuaacuguccaacuccacccugagauauucuuaaauauuuaaggagaugcugaaaugcugcuuguaacuuacuuguuacuuacuauuccuuacuuauacuuaaauagcuauuuuagguacugaggauuucuguagguucugaaaccuaguuaggguuaacucuaauuuuuuuugagaaaagacugucagauucuuuaaauacucagccugcaguuaacuggaaauaguaaauuugcuuuacuugcccaaaggucccccuuguagcaucagcucuaguguauuuggggacuuuguuaaaaacucuucaugaguuuuagaggggugaaggacuguuacggagguuuaagacugcuucucugugccaagaccaaagaggaacuguaccaauuguuccuugguggcaaagguuauuguuacauaucaguuuuucauuuuuaauuaauucauucaguaaauaaauaacucucuuuugaguaccuuuuaaguguagcagguacuuugcuaggcacugaggauauagcuauggauaaaguagacacaguugacaauuuagaugggaaguggauagacugaagauuaaaacaagagggugaugaauuauauggaagguaugcaggguauauaagcagugacaguauguguuuugacuaaguaaaggacagaugacaacauggugagcucugugaacucuagauuugcaguaauuucagggggaacaguaaugugagagaggaguccucacuuuguacacaguguugcaggcauucugaaaucaagaaaguauacugauuaaaauaagaaugauuuaagucaacauucaggaaaucacaagaauuuuuuuuucauuaaagcagcaguucaaacuuuuuggguaacaggauucuuuuacacuuuuaaaaauuacugacaacuccaaagagcuuuuguuuauuuggguuauugauauuucccacauuagaaauuaaaacugaaacauuuaaaauguauuuauuaauucauugaaaaaguacauauuuuauaaaaaauaacuuuuccaauacaaaaauguuuagaaguauggccauguuuuacuuaaacaauucuauaaugucugacauaauagaaaacaucaagacucucaugucuguuucuguauucaaucuguugcuguaucauauauucuguagcuucuggaaaaugucacuguaucuuuuugagagaaugggagugaauaaggcauaugauaucuuaauauuauuuugaauaaaauuuugacauuagguacccccuaagagugucuuagggcccaggagcuccugugcuaugcuuugacauaacggguguagucuauauuauguaagaugggaagaaacacucauaauaguuaagagcguuugcuaaaaguugaaaugcuuggguucaaaucucacucuggcauuucagcuacuugaauguggacaaguuacuuaaugcuuuguaaguuuuguaaucauguuuccucaccuauaagauauauauaauaauaccuaucuuucaagguugucaugaggauuaaaugaaauauuguguguuaagcaccuggaccuugucagacucucaauaaaugguagcugcuacugcuguugcuuuuauauuauuauucuaaugcuuguagaauucuccauauggcagcauauguaggugcuuuaaaguauuauauacguaaguaaauaaucaauuuucagcauuacccagcauuuaauauuugaaacuuuacagucauacaagauagcuuugcuucuccugauuugccuuugcugaccuguuugacacaagaccaagaauuugcgccugauucuuuauuucaucaaagugaacuaaguuuugcaccucugagguaggaugauuuauuugcauguaaccuuucucacuucuuguucuauguuuuuacuaauauuagugacuucaggcuaaggugggacuuugagguggggcuuagauacucuuaggacacgcccugaagguaacaaaguccuguacuaagacuugaugcauauuaauuuggcagaguaacguauguguagagaugaaccagaugacaguaguuuauuuaaaaauaauuccuaauauauucaggcauuucaggcauauuuuaauuuagaagacacacuggauuuuccuucuuauaaaccuccccaucugcugcccaucaucucucuccucccucucacccuuauucugcaaaaagcauuuauuucuuguucacuaacuuguuuggcacucucauuuuguucagcuguuauugaaugagacuaguuagcucuccuuaccuuauaggaggugucaauaugaaguaagaagauuuuuaugaacagacauauccaaaugaacagauacuccaaauucauguccuuuagaauagucauaaugggagaaaagucuggaauuuucaaaacauauuuggaauuauucaagaauauguuuucuucuuuuagaauugaaaacccaccuuaaauuaaaaacuauagauguuuagaaaguaaaaaguaaccucuguccuuauacuauauauuuaccugauaucacuuuuaugaaaagugaucuauacacauuagaucaucaacuaaugauuaaguuacuguuguguuuugggaauagaucacuucuuaagugguuucuuucucuuucucuuuuuguuuguuugcuuuuuuuuuucuuuagauggagucuugcucuguugcccaggcuggagugcaguggugccaucauggcucacugugaccucuaacuucugggcucaagcaauccuccugccuuagccuccacagcagcuaguacuacaggcaugugccaccaugcccagccaauuuuuaauuuuucuguagagauagggucuugccguauugccaaggcuugucuugaacuccuggcuuuaggugauccuccugccucagccucccagagugcugggaucauaggugugagccacugugccuggccuugcaugguuucaagagcacaauaaaugaugacuaguaaaaaaguuaacgcagguuaaaugaaaaaucaugguaggcgucauuaugaaaaucacauucugugucuauuguuuuaggagaagucugagauaauaucaggguuauagggugguaguucaccuuuuaguuaaaaagaauuugcuuuacucagucauuagccaucuuagaagagucugaaauuaggagagcuguguuuuucaauacacuuuucaaauaaacuugauuucagugacauauguauuuuuguguuaguacuuaaaaauuaaauguuuuuaauguuauuuauuuauuuauuuuuaacuauauauuuucaggggaauuccugauaagucugaagauacugaauggucuucucgaccaucggaaguuagugaagcuuuauuccaggcuacugcagaaguagcuucagacuuagcaagcagucgcuuuaguguaucucagcacccgcuuauaggcagcacagcuguugggucucagugcccuuuuuuaccuucugaacaagggaauaaugaagagacuauuucgucuguugaugaacugaaaauucccaaagacugugaucguuaugaugaucuuuguucauauaugucauggaagacacgaaaagauacacaguggccugaaaacaauuuagcugauaaagaucaaguuucaguugcaacuucauuugacauaacugaugaaaacauagcuacuaaaagaagugaccauuuugaugcugcucguucauaugggcaguauuggacacaggaagauucaucuaagcaggcagaaacauauuuaaccaguaaguacccugauucuuuuucagauucaucugacacaauugauaaaaauaaaauucccaagggaaguaacaauuuuaguguccccuuuuccuaugugccauggaacaaagagggaacuuugcaccacccagaaacguguguaaucaguaaggacuguuuuuccuuuccaugugaaguugcugcucaucaucaucaucauaaaaugucauauucuuucuuguguuguuuguuggaaagaagaggaaaagggguucccuugacuucugauagucauuauuuugagaauguuuauuuaagggcuccagcugagauugaggugaaacaaaagauggauucuuuggaggguuaugaaagaaaugaagaagguuuacagaaagaaucaucucaauguuuugaacuaacggagacuagaaauaauuuaguaucuucagaagugcaacccagauucuuagaaauacaguauauuaggaauguuauagcuccugauaauucuguaaaaguuucagaagcacauguacucuccaggggacauaauaccucuaaaauggaggcuucugguuggauuguuauauccaacuuggaugagauaucagaacaacuguauuuucaagaggaaagaaaccaaaagggaacuucucuuuuuggugagaaaaauauugaugcugcugaaaauauagccuuugaggcaguuauugccucuauugagccuucuaagaaagagaguacaguaaaugaaauccaagcugacaucaauaaauauuuaacagaugacagccgagagagagccaaaaaauccagaucuuucuccauuaaauuauaaugaugaaaccucuuuauuugauaggcuuaaacauccaugcuaucagucuacuccugggguguuugaaccagcagcuucaaaaccauuguugcauaaaaaggguaauaaugauagcuuccuauacuggcauccaaauuuaaaauuacccccuaaugcucuucagaaaauguucauuaagccacuuuguguuauuccagagcuuaagucaucugcuucuuugagugaaaaaucuuacaaccaggcuguuggucuuggcaaaacacagucagcuuuauuucagugugauauaggcaaugaaccauuucuucccuuugggaagauaaagucuguuccuucucuugaccuugcagagaagguaggaucuucagauguuauuuaucaugugaaaguauuaacuucagaaucuuugguuuuacaagauuuaaagcagccaaccuuugaagaaguugcagauuacucaaacuuuaauuuggguaaggauguuaacuguagaaaugccauuaaagguccaccugcagcuguaggaagcagcuuuucagcaaacuugguggcaugugaugcaaagucacaaggugcuuguaccauugaccagugaugcaucauuaauugcagucgcccaagagacauugcugaaagcugauauaggccaaggugaaaguccuucgugugugggagcugagccuaguuuuacuauacauacaauuaugcaaaaugacuccuauuuuguagagggccugcaggggaagguugagucugacgucauuacucuggauggccuaaaugaaaaugcuguuguaugcagugaaagaguugcugaacuacaaagaaaggugagacacaauaaaaugauaguuguaagaaacguggccuuuuucaguauuguuucaggaaaugguauuguuuguuuuuauuuuacuuuuuacuguuuccuggguacaugaccaaugucauuugacuggugaguacauugagcuagcagcuuuagagaaauuucauggugaucuagagaugcaugacagcucccugcacuggcagccuacuuuacaacuaccaucugagaaggaaagcaauuuugaaaagccuguaaguuuuucuauuugacauuuuuuucugggcggggagggaauguuuuauuugaaaaauuuccaaauuuuauuugaaaauacuuuauuugaaaaauuauauccuucaguaccagcuuguaacuuguaccuguucuucaucugauauccaggaauauguuccauuagagguugguauaaaagaaauguuuauguuucauagacuguaagacuuaguucuguggugucuuggaaaaggcaucccauggggcuccaggccuuucauauugaggcagccuaacucuuccuaguugugccagcaagagucuuuagacaguguuaagauuaggcuuauucaugggaacauccaaaagcuuguacuuugaauguuucccucuggucuucaaugcacaagccuugaaacagucccuggaauauuuaaguauuucuguuuagaagcucuugaaagacuugacuucagaggugucuugaaaauuguaagacccauguuugaccaggaaggauaaugaagugcuuaacguccaaacuggccagugucucuucaaagggaaguaucuccuucccaaaugagcaacauacuaauguauauacaugucucuucccucucucuauuuauaucauuauuaccauuguguguguguguacuagaaacuggcaacucuaggaugucauaaaaauuuuauaucagccuuuuuuuuuuaaauuaaguucuggggcacaugugcagaacgugcagguuuguuacauagguauacaggugucauggugguuugcugcaccuaucaaccugucaucuacauuagguauuucuccuaaugcuaucccuccccuaacccccuaccccgcgacgggcccuggugugugauguuccccucccugugucauucuuuuauagaaggcuuuuauuugcuuggauccuuggaucccuuggcauuaauguuccucuggucccguugaaugaauauccucuuuuguugucugguacuguaagucccaaggugggcccuacuuccuugugauauagccuuauauccuguuauucauuaaauacaguuagauaaaauagugauguacuuaauguuacuucucuuuuccuauguauaagauugguauguuuuuguaaagcucuauuaguuuggguuacaaccacauuuagaccuuuagguucagauuguugguagaaaaugaacaaagauauuaugaugaacuuuuauuuauaauuuauuacauuuauuaaaguuuuuuuaacacagaaucacuagguuuauuuucuucaguauuccaaacuaggcauuuuuuaauuuuaaucugauaacuggggaugaaaaugauaguuaacacuuugugcucaaguacugugcuaagagguuacauguauauaucaauucguuuuuguccucugucaauccuaucaaauagaauuguuagagauuauuaucaucccuauuuugcaauugacacuuagaggauuuaggaacuugcucauaauuauucagcaauugggggaaccaguauuugaaacuaaccauaucuguguacuuaaccaccauaccauaaacuguucccccuccccccaccuuuuaacuauucuuggugaaacuaagguuaagauuuugcauuauuuuggcaagaguagagguuuugaaggagauugccuaaaguugaguucaauaacaaugagaaacaaaguaacaacuuuuaaaguguucuaaauuuuuaauacuacuuuugugacuuacaucaaccuuucauguagauaaaauguauuuuaaaaauaaagauauauagguucaguuaaugugcagagacuagcuuugaccacugcuccaaauuuuaaucuguccuuaaauauagccugaaguauuauucuuucaaucuaaggaagaugcuauuauucccuguauugucuuucaguuguagcucuaucugucuuagucuuagaucuaggaguuauuuaaugucaauaucagaaaagcaaggagccagaugugguaguacuuuuucugcauggcuuagcuugcuuucaggggcuugcuuacuccuugguuuuuccuuaugcuccucaucugugucacagaagagucauucauaguuacuugguucacuuuuauaucuacuccucauaaaugauuauuuggguauccacguauguaugauggagcuuggaacugugaaaagaacauagagauuuugagucaaaauccaguucaguuacuuuguuagccuugugucuugagcaaaugacuucggaggaucacuuuccugaucugcauaaggaaauaggaauaguaauaaccuuauacaucguacuauuaaaugggguaaguuauguagcauuuauauagugccugguuguuaguucucuucacuuugcugaaacuagacuacuagagucucuggugguuuccuacuuucuaucauuauuuuguuuuucuuucuccuuuuucuugguagcagcacauaauuaauaugcuuuuuuuuuuuuuuuuuuuugaggcagaguuuugcucuugucauccaggcuggagugcaauggcacaaucucagcucacugcaaccuccaucuccuggguuuaagcaguuguccugcugcagcgucccaaguagcugggauuacaggugccugccacuaugccuggcuaauuuuuugucuuuuuaguagagacgggguuucaccauguuggacaggcuagucucgaauuccugaccucaggugauccaccugccucagccucccaaagugcugggguuacaggcgugagccaccgugccuggccuaauaugcuauuuuaguaccucuuguuuuggccauuuagcucuaaaaauuauuuaagguuuaagccuuagauuucuuuucucuccccuucauauccccccaccuuuggagaccuaguugccugucucuguguggaugauuaucaccucuguuuuuauacccuaauauuugucuaauuuauuuugcauguuuucuugugaacauugucaucaccccaaauucaacuugcucuauagcaaaauaacucauguuuuuccuaaaauuagacugacuuguagaguuccugaguuuuuaugaaagguauuaguauuuuucugguuucuuggucaucuuucauucuuucuucauuauugauuaaacauugggaagauaaacgaaucuugauuucuguuuucuccugguucuuuccauuuucaauuagcaaugaagaucugcugguuucuuaaauaaauacuucucauauuuuucauuuuacauuuucuuuuguauuaccuacuuuuuuuuuuuuuuuuugagacagagucucccacuguugcccaggcuggaaugcaguggugcggucucagcucacugcaagcuccgccucccggguucacaccauucuccugccucagccuccugaguagcuuggacuacaggugcccgcccccaugcccggcuaauuuuuuguauuuuuaguagagacgggguuucaccguguuagccaggauggucucgaucuccugacuucgugauccgcccgccucggccucccagagugcugggauuacaggcgugaaccaacgugccuggccgguauuaccuacuuuaauaguucuauauuuugaaacuuuaacauaaugaaauuuuuuugacgucaagcuuguaauaaaaauuuuucuuucuguguuugaaagcuguagaagaaaaacugcuguaaacuauaaacacacacugucucucacaagugucuauauauuauauauggucaugccacauaaugauauuucaguuagugacagacugcauauaugaugguagucccauaagauuaaaauacuguauuuuuacuguaccuuuccuauguuuagauacacaaaugccacuguguuacaguugccuacaauauuuagaacaguaacaugcugauagguuuguauccuggaagcaguaggcuagaccauauagccuagguguguaguaggcuacacaguuguagguuuguguaagucacucugugauguuugcacaacaacaaaauugccugacagcacauuucucagaacauacccacaucauuaagugaucuaugacugcauauuauauauaugcauauauauuuauauauauuuauguguauguauauauguguauauauauagccuguacuucagagaaguuuccuguaggagugagguaauugaaaacuaugaacuuugugcuauguggagagcagggcuucuuagcagccuuaucauuuugaguuggauaauucuuuguuauggugggaggcguguuuccugaguauuguaggauguuuugcaucauccaucccuggccucuauucacuagauacuaguaacauccccuccccucacaaguuaugacagcaaaaaauguuuccaggcauugucaaaugucccuugauggguacaaaaucuucacaaguugaaaaguagagaaaccuguaugggcaguagauguagauauagaaauagauauggaauguucauuuccacacuucacauggcuuccuaagaauguucauuacuacacaaugaaaaauugaugaaagaggauagaaaaauucaugcuuauguacauuuuuagacuucauccugagaagaugugacugaaauaaucuuuuuagggaaauaaagacaaucuaaaaaugauauauauuuuuaugugagggugcacugugaauuuggugaaaaguuguacauguuuagguauuaaugucaccaauauugguuucuaauuucuuuucuagcaagaacuugugacuugaugaaacauuaggaacuucuuuuugagcaguuacccuuuacuucacuaccaauuuauaguuuccacuacuuuuguuuuaagaaguuugaggacuuaugcuuguugguaaccgaucacaguuauaguucuuugauacucucauuuuucuucuaaacauuugugaguuucuagaaaauauuccuguuuucuuuuuccuucuuacuguuucuuguccacagugcaccucucuaccuuaaaaagaaauaccugagcuuguccagaauaaucccaugguucaaauucugcgaugaucauaaggagcaaacuucugaguaacagaacacuucuaagcauacuaucuauaauauuuuaucuagacagauuucuaagcccucaggaugauuuagucuucuagaguugacccaauaaaauaugaccuauauaugaauucagaagguuugagauuaugaucuuaaguaacuaguauaacuucuuaguguuccucuuuguaaaaaugaaggauuauuuuuagcagaugagguuugaaauuaauaucuuauuuucuucauuucuucguaggugggucauucuaaucugggcauuaaugagucuuuuucauuuuuauugccuucauuuguuccacauaagccaacaagagagucggaauaucacucuucagaucucagaauguugaggaugucuccugacacugugccaaaggcuccuaaacauuuaaaagcagguacguagaaaaaggagauaguaaauguccuacuuacggauaccuugugaaaaaauaucuuguuaggucuaucuaauuuuguauuuuuuaauaucuauaauaauuauacuucagauuagauguguuuauaaauccugucuuagucucuuuagacugcuauuacaaaaauaucuuaguacuuuaaguauggcuuauaaacaacagaaauuuguuucuugcaguucuagaggcugguuccaagaucaagugcugggagauucagugucuugugagggccuguuugucauagaugacauguuccucugugcccucccaugguggaaggggcagggggucucucuggagucguuuuuuguaaugggcacuaaucccaaacauguggccuguguccucaugaucuaauugcuuuccaaaagccuuaccuccuuaauuucaucaccuuggggauuaggauuucaaccuauacuuuucaggggggacacaaacauucagaccaucacaaguccccugauguuuuauuagaggaaucauuugguuuuucaucgcauucuacauggcaguguuuagaacugaauuauauggaggagucugauguuagaaucuguuuauuccuuugugugacuugaagggaaaaaggaauugauugagcccaagaugacaagaguggaugcagauaaguuuguagagaggaaauugagagaaaucaguuuugagguaaaagcaagauuaucugcugagggaggugaguagugguggaauuagguuagaggcauugaggagagugguuuggugaagacuuacaguuuauguugaagugaauuugagauggagcugaccaagggaaaguaaaaggauuggagggcaguucugagaagucagcucagguuagugauaaugauuuuauaauauugucagccuguauagaaucucugauuuguuuuuccugcuaacacucaggaauggagaugaugaauuacaguauugauccuugguucaggaauacauugaauggguaugguagaaggauagcagucaaagagagaagaguugaucaccuauugguuucagccuacauagggaaagagaagccagaagaguuguuauucuaggagaaaauagaaggaccagagauuucuuuaugaaguugauuagaugaggugggaauaaguuacugagagcacuagaagaauagguaauuuuggucagauugaauaaguagauuuaaaugaggaucaguuugaagggugaugaaauccauuaaauagcccugggauuggaugguagaaauugaauaaaaauuacuggaguaaauaaaauuuugggucagguacagugucuuaugcuuguaaucucaguacuuugggaggcugaggugggaggaucacuuggaagagucuggaaaggauugguauuaauuguuuuugaauagaauuuacugugaaacuaccugggcuguucuuuguaggaaguuuuuaaauugcuaauuucaucucuuuccuugccauaagucuauuuagauuuuauauuuuucaugaaucagcuuuugcaauuugugucuuaaauagaauuuguccauuuagcuaggcuaucuguuuacauauaucuguucauaauauucccauguaaucucuuucauuucaguaagguuaguuacaaugcccucucuuucauuccugauuuuaguaacuuaaguuuucccuucuuuuguucucccuuuggugaaucuaguuaaauuuugucaauuuugcugauuuuuucaaauaaacugguuucuuuauuuuuuucuaaucuuuauuuuucuuuucugauuuuuguuucauuuauuuucauucuagucauuauuuuuccuuccuuccauuugcuuuggguuuaguuugugcuuuuauucuguuuuuuaagguggacaguuagguuauugauuuaagcucuuucuucuucuuauuacaaauauguauacaaauugauaaauuccuaagcacuguguuagcugcauguccuaaguuuugguuuauuauauuuuuguuuuaguucaucuaaacuuauuuucuaguuuacauugugauuuuucuacauuuacccuuugguuauuuaggaauguguuguuuaauuuccuucuguuauuauguuucaucugguucaauuuuuguuggaaaacauacuuuguaugauuucugucuuuaaguuuuauugaggcucguuuuauguuuuagcauguaguuuauucuguagaauguacaguuuguacuugagaagaauguguauucugcuguuguuaggugguguguucuauagaugucuuucagcucuaguggguuuagcuguucaaauuuucuguuuccuuguuggucuucugacuagcuguuuucuccauuuucaaaagaaggguacugaagucuucaacucuuuuuguuuaauugucuauuucuccccuuuuuucucucagauuugcuucacauauuuugacauuaugauguuagauccauauauguuuauaauuguuauauauuccugaugaauugaccuuuuuuuggagacagagucuuguucuguugcccaggcugaaaugcagugcguggcucacugcaaccucuaccuucuggguuccagcgacucucgugccucagccuccugaguagcugggacuauaggcgugugcccaccaugcccaauuaauuagaauugaccuuuuaauuguuauaaauuguuccuccauauuuugaguaacuuuuuguuuuaaagucuguuuugucuuagguuagaauagacacuucagcucuuaugguugcuguuuguaugguuuaucuuuuaaaaucccucuacuuucaaccuauuuguauuaucaaaaaugauguaucugcuguaaagagcauauaguuaaaucuugaguuuuuaauuuuaaaauucuaucuguuuuugccuugugaugugauuauuuaaucuguuugcauuuaaugucauuauugaugugauuggauucacauuuucuggcuuacguuugguuuuucaugugucuuguguccuuuuucuguuccccuuuuauuauugcaugaagugaauauuuucuaguaugacacuuucaguuuaauuuuuaaaaugauuuucuagguaguuuuuuuuaaaguuauauucuuagugauuacucuggggcuuauaauauuuaucuuaucagaauauacuucugauucaauuuauacuaacuuaauucuaguaugguacagaaacuuuacucccguauagcucuauucccucuuuuuuuuuggugcuauuauuguuauacauacuacucacacacguauauaaaugccuuuaaguuuuuguuuuuuuuuuuagucggggacuugcucuguugcccagguuggauugcaguggcaugaucauagcucacucuaaccugagcucaagugauccuccugccucagccuccucuguugugaggcccacagguguguaccacuacacugagcuaauuuuucaaaaaauuuuuuugguagagaugggaucucacuauguuauuagucuugaacuccugggcucaagcaguccucccaccuuggccuccuaaagugcugggauuacacgugugagccaccaugccagccugcuuuauauauuuucaaauugcucuuuaaaucaguuaacagaauacaggaaaugaaguaugucuuuuuguaguuaccgauguaguuauuuuuacuagcacuauuuguuuuguuaugaaaauguuacuacuaucugguguuacuuguuuuucagccuuuggaacuuccuauguuauuucuuguaagauggaucugcaaguucccuguuuuauguaucuggcguguuuuuauuucaucuuuuugaaagauaguuuugcugggcuuggaauucuugguugacagucuuuuucuuuucagcacuuugaauaugucucuucacuaucuucuggccuucauaguuuuggaugagaagucagcuguuaucuuauucauguucucuuguauguaauuuguuuucucuuguugcuuccaagauaugcucuuugucuuucacuuucaguaucuugauuaugauaugucucuaugugaaucucuguguuuauucuacuuugagcucacugaacuugucagauguauaguuaauaucuuuugucuaauuugggaaguuuucagccaucauuucuuugaggauuuuuucugcuucuuucucuuuuuugcccaguuaucaucucuugcaucacaguccacauauaucagcaccccuaaucuugucucacuggucucuaagccuuuguuuguuuuuguuucuucuuucuuugcuucaguuugcauagucucuauucauuuaucuugauguuugcugauuuuuuucuucugucuuguccauaucuacuguugagccucuagugaauuuuucacuucaguuacuguacuuuucagccuuagaauuuccauuuuguuauuuucuaaguucugucuuucauucuguauuugaugugacuuugccaucauaccuaucuuuaauucuuuaagcauccuuuucuucccuuugaauauguuuauaauagcugcuuuuaauuguuacuggcuaagcccaaugugugugcccucugaaagguaaauuugccuauuuuguucccccugugaaggggucacacuuucuuuugcacaucuuacuuuucuguuauuguucuaaacuggacguuuuggauaauaucuuguugcagcucuggauauugaucccuucucugggcugguaacguuugauauuuuuguuguuucguuauuuagugucugguuuggauuaguucuuaauugcucaccaccaagaucuccauuguuuuugucaguguccuuaggcuugagcuuuuuaugcucuguuucaaacaaagucauucuccuuauggagauguguggagcucucuguucuuauggcuugccucugcugggcagaagcuuuguggcacugcucuguaucugggggcagguucauuggucuacuucucuuggaauaacacaccccuucucuaugauugugaugcugaaagggguaguaguuagucccuguucuuggauugccucuccuggaguggacccucacuccaccuacaagugagcuggggguagggaugauuagagcuugguauucucagguugggauaaaucuuccacucuauaaguggggacugggugaagguagguugcuucuuguguuguuucuuuuucacuuauuagcuaacaucaacagccaguguucuuucuuuacagccuuucucccaugacaucccuuccauucugccuuguuacuuuauggaucguaucuacugauguacccaguuguaccauuuuaauuauuugguuaaaaugguacaucucauuucuaccaguaagauccugagcuccucacuuaucucucagaguaguauugugcuguaugggcugacauuaaagauuuaauauuaugcacagucuugacaucugaaacugcgagguccucaaagggccuaaccacaaguuuaccugccagauaugcccucuacucaguggagaggcuuccuacacagccaguucuucuaucaacgagaccaacuguauucuaccugguacucaaccucagauuuccaucccaugcuaaccugugaaauuauucaaacaagccaaucacacccuccuacagaaauaaaaaaaaucacgcucuuuucuugcuacuacaagccugccuccuaugguuccuguuuacucguucuguucccauguacaaucccuguguggcccugcauguccugugucuuccccagcugugaguauaugugacuaauaaacuaccgucagucuccucugugcaguguuguauuuagccaauccagaucuaucaggcagcaaucccucccucaucaauagggugaagaggaggcaaaagaaagaaauauuuguguccauguuugauucauauuguauugaaauggucccuugauauuaguugcccugauuucuuauuuuuuuauuggcaaaccucuggguccuauuuuauaacaagcagaaaguaacugccaagcuucauuucaaauuggcuccaaaguaugagucaagauaauuuacauaucagguaaaguagacacacuuaacauaauuugaauaguuuagauuacaagauaaauuggaaacaaguuuggaucuggauuauugaaaaagaaucggugacaccauuagaaaguaggguagugaauuuaguuuuggacauacugaguuugauuugucgggagaucauuugguuugaagugucuucaaagccaguugaacaaaugggaaauaggaaauacaaauuuggaagaucuuaaauaauuugugauuaaaauuaugccguaagaguaguuaagcuuucugaaggagcauggguagagagaaaagcaaaaugucaaggaugguaccucauggaauacaauagcagaaagaggccaauagaaaauaucaaaaaagacagauauuuuguuuaaauucuuacucugauuuaguucuuaccucuucaguuuccauuccaauuucuuagugccuuuacuauaucacacuggauuuuguugcacgaacauuuaggauugcuuugucuucuugguggauugauccuuuacaauuauguaagaauucucuuugucccucguaauuuucuuuguucugaagauuaucuuauauagccacuccuauagaauaguucuuuucuuucuucuucuuccucuucuuccucuccuccuccuccuuuuuuucuucuuuuuucuucuucuucuuccuccugcuccuccucuuucuuccucuuuuuucuucuuucuucuuucuuuuucuccuccuccuccucuuuuuuuuuuuuuuuaaauaaagauaaagucucacucuguugcccaggcuggagugcagugauaugaucauagcuccacagccuugaauuccugggcucaagcaguccuucugccucacucucugaguagcuaggacuauaaaugcacacuaauaugcccagcuaaucuuuuuuuuuuuguagagacaaggucuugcuauguugccuaggcugguuuucagcuccuggccuuucaaagccugauccucccaucuugacuucacaaagugcugagauuacaggcaugagccaccguacccggccuuuuuaucugucuuuuaguuucaaccuuacuaugucauuauguuugaagugaauuuuuuguagacaucauauaauugggucauuuaaaaaaaauccugucugcuaauaucuguauuuuaguuuguuuguuuauuuauuuugagauggagucuugcucugucaccaggcuggaguacgguggugugaucucggcucacugcaaccuccaccucccagguucaagcgauucuccugccucagccuccugaguagcugggacuauaggugcacaccaccauaccaggcuaauuuuuguauuuuuaguggagacagggugucaccauguuggccaggauggucugcaucucuugaccuugugauccacccgccuuggccucccaaagugcugggauuacagguguaguuuguuuauuuauacaauuuauaccuaaaguuaauauuggucuauuaugccuuaagucugcaauuuuauuauuuauuuucacuuuauuccuguuucucuugucuugccuuacuauggguuucaugaacauacuuuagaauuucacuuuaauuuuuaaaaauuauuuauuuauuuuugagacagagucucgcucugucgcccaggcuggagugcaguggugcuaucucggcucacugcaagcuccgccucccggguucacgccauucuccugccucagccuccuaaguagcugggauuacaggugugugccaucacgccuggcuaauuguuuuauauuuuuaguaaagacgggguuucaccauguuggccaggcuggcuucgaacuccugaccucaagugauccaccugccucagucucccaaagugcucguauuacaggcgugagccaaugcacccggcccuugguguggauuucuuuggguuuuccuguuuggagcugacuuacuuucuuuaaucuguaaguuuaugucucaucaaauuugggauguuuucagacuuuguuucuuugaauuugacucaucuuauuugcaucauuugaucgucuucucccucucucucgcguucgcugucuuucucucucucucucucuugcugucucuuucucucucucggcucacugaaaccucugcuuccgggguucaggcaauucucgugucucagccuccugaguagcuggaaucaugggcgugugcuaccacgcccagcuaauuuuuuguauuuuuaguagagacgggguuucaucauguuggccaggcuggucuugaacuccugaccuuaagugauccacccaccucagccucccaaagugcugggauuauaggcgugagcaaccacagccagccuugauugucuuuucucaguuugugauuuuccugguucuuagugguaaaaaugaauuuugauuauauccuggacauuuuggauauuauguuaggagacuuugauuccuauuuauaaucuucuguuuagcaggcaguugcucuauuuagguuuuccauauaggcucuggccuauuuauguggcugugaucccaaagauaauuuaguuuucaggggaguugcauucuggucuacuucagugguaccauugaggcucccacucagucccuguuggugaugcuuauguggguggaauggucuuccucaaggccugcuggugcugugugggaagggggagaugcuaacccacagaguagagaacauuucccugggccugccccuggaccaacuggugucagugggucacccacuugauucuuguugauggcauucauggggguagaaaaugcuuuucuaggccuccugaugcaucuagguaggaugcugggccccugcgauggagaacauuuccuugaaccuacucucuggguuucucaaugcugguggacuucccauucaauuuuugccagugccacuggggaaggaaagugccuaccugagcugucuuuuaccacaggagaguuaggagaugguggaccuaggucuucuuuuguuacuggcuagaggacagggagaugccaaaccuguugggacucucugccugguuuuugcuggcacuacaguucugguggugcaagccuaccuguugcugcuggguuggaguaggguguggggagaugggacugucugcuaagucugcugggcugcccguuucuugguccauggcccacagacagcaggcuuuucuuggacuucuuucugcccuccuuuguucccuuucuccuucccacuauuccuauuccuauuccuauuucuggucuuaguuccacacugcaggccucuccaggguccagccucagauauaagagaguuaaaaagaaaacuaaggaagucauugccauguuguucuccagucuggagguccuuagcuagucugcguuucacuuucuaccuuucaguuuuuuuuuugucuuuugguuucuagggaaguggagggaaaagcaaauuuauaucauuuugucagggaccagaagacaacuggaguuuugaaaacuugacuuagaugugcuauugucuuugguuguugguagaaauaaucauaugggggaagugagguaaagaucuuucucaggcaauauugaauaaacucagggaucucaagccacagaagauggggacaccuaugccaugaaacuuuccuaacuuuucuaaaaucugcagcccguguccugaacuauuaauaauagcugacauuuauugcuuguucacauugcuaagcauuuuauguauuauuauuauaauguauauuauauaauacagguugagcaucccuaaucugaaaaaccacaauccagaaugguccaaaaucuggaacuuuuugacugcugacaugauauucaaaggaaauacucauuagagcauuuuggauuucagauuuuuggauuagguaugcacaauauguucuuuuaucauauuauuauuaugccauauuguuuuauauuuuuaaucugaccuaugaugaugggcacugcuauuauucuauuugcuaucugagcaaaaugaaacuuagagugacuugcccaaagucccacuuucucuaagaggauuuugauagcuucauuccauauuguucucucuguuucucaaguuuuaaaugccuuuauaaccuuaccauaaacauaucacaccaucaguuuuuccaaauucuuucucagagagggcaccaauuuaauuucuauuauauacuuaacacuaaucuuggcauaugauaaaggcaugaaagagucucgaugauuguuugcuaacugaagaguucaucaguuagugguacaguacuggcugccucagcuuguuuacagcaucagguagugacauaguaggaaacaaugcuuugugcaagaaaggauuuuaacuucuuccuagguaauaucaacacccagggcuucaguuauuuccuaugacugaugaguuccaauuguaggacucuaucuagauauaucucauacuccaaauguuuguaucugacuacuaugaaaugucuucauuuggaugucccauagguaucuuaaugucagaacuuuaaaaauggagccaaucaucucuuuaaaccuacucuuccuucucuauuucuucucagugaaugagugucuacuuauuagccaagcuagaaacuuguauucuucuuucacccucaucccugcccaaucacuuaaucucguugauucuaucagacucccauucucuuuucugaauuacugcauuaguaauggaaaacugaucaucuucucugccacuuauuuucaguauuaagccaaaauagucuguuuacagggcagacuugauaaugucacuuccuaguuuggaguucuugcuuuccauuguuaaccuugggguaaauucuaaacuccuuaguacauaguagaaggucccugcuuaccuucuuagccuuauacuugccucuuuuuucauagugaacuacucucauuucuucaugaugcuagacccucuugucuccuugaucucauagaugcuauuuucucuacuuggaaugcuucccuauuuuuuauaugcccaucuuugccuaauuucugguuuuuauccuuucauucugagcuuugcugucuuucaggaaaauguuucuguuuuucacuguucaccaugacucuuuaagaaagagccagauacuccuuacauauguugcuauaguauccuguaaacagccucccuaaucacugcccuuacacugaauuuaguaauugcuuuuuuuuacuuguuucugucucccacaggacuuuaagcucuuugaggguagagcucgggcuuugcuaauauauauauuuuugcaccuggcugugaaagcuacucaauaaauaucuguugaaugacuuuaugaauugaugaauauuaaaugaauuaacaugccuggguagacugggggagggguagaauaagaugguaggcuuuguauuuuggcagggaucaguucucaagaaaguggaucaaauaaauguaaguaucauauuucauugacuauaugucaguuguaaugaaggccuauggauuagugucuuaucacuauuuuauugaucucugguuaacaugaggcugucucugugacuugaauggccuauaugucuuucuuuauguuuuuugguggguauugggguuuauguucccugccucuaaaccuaauugauuuaucuuuuaguuuuccugccauaauuuuuauugacgcccagucuuuuguuuaaccuuacuaccuuagguuguuauuuguuggauaucuucucccuugaagaugcaaguuacucagggcagggagggaaccugcguguggcucagaguaagggaggacuuuaguuuggggcaggacuuugaaggguucucuuaaagaugaggagccuggaagcaagaucugaaauuacaucuucuccugucccagagggaauuucuuugaguaggggugcaccuaucagggugguuugaugacuggguauuacuaugaccagguuauaacuuucccaggguuauucuguuaggaaauaguguuugggauuugauguuugaguacagaguucaugaacuuuucacaacaccagcaguucauuagcuuuuugaaaccucugcccacuuaggaaugaggaagagucuauaacgcacuuuaccuaacaauuccugcuuucgcauugaaaaagaacuuagugauagcaacaacaaaauuaggaauuaaauuacaggcuauaauguuagcucguguaugugauuuuuguguuauaaaacagugcccuauuaucuuuugaaacuaagcaauuuuauuacauuuaacuugauuuuguauugcaaguuauuuaaauggcauacauuuaucaacaggacaacguuaaugaauuaucaguaugcaggaacuuuggaaggguuauauuuacguccacugugguaauaaggguaucaaaaauccuguuugaacugugauauauuguguuaaguuuaguuaugagagaauauaguuuaagauaaugaauguagagauaaacaucuaugaguuaacugagggauuaacgaaauacaacacaauuauaauuauuuaguuaucaauaauuaauaauuaggaacuuauaaaaaugauauaguaauuaauuagaaagcaagaauaacaacaaugaagacaaagacccauuuaaaauaucacuggugucuuuuuaaaaaaacaugaauuugaguuuacuucucuguacacacaauaggugcuuuugccagacuuuuuaaaaaaaaaucuuuuuuauuuuuaauauuuaugagaacauaguagguguauauauuuaugggguacaugagauauuuugacacaaacauacgauguguaauaaucacaucaagguaaauggaguaucugucaccucaagcauucauuauuucuuuauguugugaaaauuccaguuauacucuuuuaauuuaaaaugcguuauaaauaauuguugacuguagucaccguauuguacuauaucauauucuagagcuuauucauucuaacuacauuuuuguacccauuaaccauccuccucacuaccuucccagccccguuacagacuuauuagugacugaauuagagggcucaaaaugagagcuauaguaauuuauuugugugugcuaguauuaaaacccauaauaauugacuuggaacgauuacuaguaagaggcucuuagucauauguaaaauggaaguauggaauuguaccucauuuugucugugagaaauaaagggcuugcuuauucuucuuaugucagaauauacuuggggaaauaaaaccgugcugucuucgucaccuaggaagccuucuguguuacuaagcaccuuaguauggagaagaguucuugaguaaauuguacccagguuguuagucuuaaugucaucucuaagaggcauacaguucccacccaauauacaacuuugguguaguauagucuuuucuggcagccaucuuccucuucuuggucgaaacuuaccucuucaacucaccccuaguucugaaaaugaaucuccaaagauuauaucaguauguaguaauauuguuaacacucacacuuaguguauucuucuuucccagggcugagagaauaauaaggacucuaaaaacauaccauuuuucaucaugaacuccuuauguacauagacacauuuuauaaaucauaguuaauggauuugugaucaccauucuucugacaguuugacauauauguccuuaacuuuauauagaacugacaagaauucuucuuuaacaucgugcaucuccucccucgcuuuuaacagcuuaaccuauagucguucuuccaguuuucuuuacuaaucuuuuccuuuaccccugagguuaaaaagaccuuaucuuauguaaccuggaucuuucaaggaccugggcuguacaucuuaacuccuuagcuauuuaucucauuuguccccauucauggugucacuaauaauuuguaauggccaaagggauauaaaaacuuugagaaaucaggaaaucauuuagaaaaacaagguuuuguuuuguuaaucuguuuugguuuauuagcuucuugagccuguuuuguuuccucacaaaaacuuuucuuauuuucuuuagacccagcaggcaagaaccucacaaaauuuuguaacucauauuccuucucagguuacaaugcauguuacauuuuuaaauuuuuuacuuuucuugaagaguuaauacuugauacuucuaguucuuuacuuugaaauucacuccucaacccauuucauucuauauucagcuccuuugaagcucgucaguggccauagaaagccagucaguuguaguggaaagagcucagaacuuggauuuagaguuuaaggguuaaaguaccaguuuuugucacuuacccaccuacaauucuagaaaaacuauguaucuuugcacuuaaaauguggucugaggaccaauaacauugggcaucccuggggagcuuguuagaaaugcagaauuucaggucccacccagaccuacugagucagaaucugcaaguuaacaagaucccaacauugagaagcacuguuacauggucaucuuugcaacucgguuucccuauacguaaaaaauagauaauacuugcucuauauaucaaucaucuuaacaccaucugacacaucauauguuuuaccaauuuauugucagccuccuccugcuagaauacaaauuagcucugugagguagggauuauugucuguuuauugcuguauguagaacagugccuggaacauaguaagcauucauguauuuugaaugaacaaugaaugaagggacagcuugucaaauccugucauuucuguugcagucacuuacuuuacacugcuguuuaaaacugcuuucauuuagaauuauuguauuagugcaaauauagaacauuucuauagaaauguuuguuggauugugcaaccuagauuuuuacauucccuucucacucaucuugaaaacuuuaaaacuguaaacaacuugccaugcuauacagaauuaaguuaaaacucuucagaguaaccuuuagaguuuuuucaguuuuauguacuuaaauauauauauauuauacagggugcauuuguugggagaguccuucaaacucacugcacgcauagcaucccucuaggccauauuguacugccccugugggacuugggggcaggaggaacccgugaaaauaagcugaugagccuuugcuguaccagggaucaugaagucuuuugucucugacugaagaccuuaugucuucugccagccugcaagacacaauaacagauuguaaguagggugaaaucaaauccuagacccaauagcauuaucccaucucauugaaaauucucuuaaaaauccaaguuguaagauccauauaauauuucauccacuggauauacuguuguuuauaaccauuacucuguuguugaagauuuaaaauguuuuuacuuuaguuuucuaauuaauaucuuugugugcaaauauuuaucuccuuugauggcuguuuccuuaggauucauuucuagaagcuuuuuaaaggcucaaagcuggcuuuuuuuccagcacauagaauuuuaaaauagaaaauuuuauauacuauuaacaaaucucuuuuucuuuaggagacacuucuaaaggaggcauagcuaaaguuacucaauccaacuugaagucaggcaucacuaccacuccuguugauucagacauuggaucucauuuauccuugucccuugaggaccugucucaguuggcuguaaguucucuagaaacuacuacuggucaacacacugauacucucaaccaaaagacauuagcagauacucaucuaacugaagagacucugaaagucacagcuauuccugaaccagcugaccagaagacugcaacaccaacaguacucucuaguucccacucacauagggggaagcccagcauuuucuaccagcagggcuugccagacagucaucuaacugaagaggcuuugaaaguuucagcugcuccuggacuagcugaccagacaacuggcaugucaacucuaaccucuacuuccuacucacauagagagaagccugguacuuuuuaccaacaagaguuaccagagaguaacuuaaccgaagagccuuuggaaguuucagcugcuccuggcccaguggagcagaagacgggaauaccuacaguauccucuacaucccacucacauguagaggaccuccucuuuuucuaucgacagaccuugccagauggucaucuaacugaucaggcucugaaagucucagcugugucuggaccagcugaccagaagacugggacagcaacaguacucucuacuccccacucacauagagagaagccugguauuuuuuaccaacaagaguucgcagacagucaucaaacugaagagacucuuacuaaaguuucagccacuccuggaccagcugaccagaagacugagauaccagcaguacagucuaguucuuacucacaaagagaaaagccuaguauuuuguacccacaggacuuagcagacagucaucuaccugaagagggucugaaaguuucagcuguugcuggaccagcugaccagaagacuggccuaccaacaguacccucuagugcauacucacacagagagaagcuccuuguuuucuaccaacaggccuugcuggacagccaucuacccgaagaggcucugaaaguuucagcuguuucuggaccagcugacggaaagacugggacaccagcuguaaccucuacuuccucugcguccucuucacuuggagaaaagcccagugcuuucuaucagcagaccuuacccaauagucaucuaacugaagaggcucugaaaguaucaauuguuccuggaccaggugaucagaagacugggauacccucagcaccaucuaguuucuacucacacagagagaagcccauuauuuuuucccagcagacccugccagacuuucuuuucccugaagaagcucugaagguuucagcuguuucuguauuggcugcccagaagacugggacaccaacaguguccucuaauucucacucacauagcgagaaaucuaguguuuucuaccagcaagaguugccagacagugaucuaccuagagaaucucugaaaaugucugcuauuccuggacugacugaccagaagacugucccaacaccaacaguaccuucagguuccuucucacauagagagaagcccaguauuuucuaucaacaggaguggccagauaguuaugcaacugaaaaggcucugaaaguuucaacuggcccuggaccagcugaccagaagacugagauaccagcaguacagucuaguucuuacccacagagggagaagccuaguguuuuguacccacagguguuaucagacagucaucuaccugaagagagucugaaaguuucagccuucccuggaccagcugaccagaugacugacacaccagcaguaccgucuacuuucuacucacaaagagagaagccugguauuuucuaccaacagaccuugccagagagucaucugccuaaagaggcucugaaaauuucaguagcuccuggacuagcagaccagaagacuggcacaccaacuguaaccucaacuuccuacucacaacauagagaaaagcccagcauuuuccaccagcaggccuugccagguacucauauaccugaagaggcucagaaaguuucagcuguuacuggaccagguaaccagaagacuuggauaccaagaguacuuucuaccuucuacucacaaagagagaaaccugguauuuucuaucaacagaccuugccagguagucacauaccugaagaggcacagaaaguuucaccuguucuuggaccagcugaccagaagacugggacaccaacuccaaccucugcuucuuacucacacacagagaagccugguauuuucuaccaacaggucuugccagauaaucauccaacugaagaggcucugaaaauuucaguugccucugaaccaguugaccagacaacuggcacaccagcuguaaccucuacuuccuacucacaauauagagagaagcccagcauuuucuaccaacagucguugccaaguagucaucuaacugaagaggcuaagaauguuucagcgguuccuggaccagcugaccagaagacugugauaccaauuuuacccucuacuuucuacucacacacagagaagccugguguuuucuaccaacaggucuugccacauagucauccaacugaagaggcucugaaaauuucaguugccucugaaccaguugaccagacaacuggcacaccaacuguaaccucuacuucuuacucacaacauacagagaagccgaguauuuucuaccaacagucguugccagguagucaucuaacugaagaggcuaagaacguuucagcgguuccuggaccaggugaccggaagacugggauaccaacuuuacccucuacuuucuacucacacacagagaagccugguaguuucuaccaacaggucuugccacauagucaucuaccugaagaggcuuuggaaguuucaguugcuccuggaccaguugaccagacgauuggcacaccaacuguaaccuccccuuccagcucauuuggagagaagcccauuguuaucuacaaacaggccuuuccagagggucaucuaccugaagagucucugaaaguuucaguugcuccuggaccaguuggccagacaacuggcgcaccaacuauaaccucuccuuccuacucacaacauagagcaaagucuggcaguuucuaccaacuggcauugcuagguagucaaauaccugaagaggcucucagaguuucuucugcuccuggaccagcugaccagacaacuggcauaccaaccauaaccucuacuuccuacucauuuggagagaagccgauuguuaacuacaaacaggccuuuccagauggucaucuaccugaagaggcucugaaaguuuccauuguuucuggaccuacugaaaaaaagacugacauaccagcaggaccuuuagguuccagugcacuuggagagaagcccauuacuuucuaccggcaggcucugcuagacaguccucuaaauaaagagguugugaaaguuucagcugcuccuggaccagcugaccagaagacugagacauuaccaguacauucuacuagcuacucaaauagggggaagccugucauuuucuaccagcagacccuaucagacagucauuuaccugaagaagcucugaaaguuccaccuguuccuggaccagaugcccagaagacugagacaccaucaguauccucuaguuuauacucauauagagagaagcccauugucuucuaccaacaggcccugccagacagugagcuaacucaagaagcucugaaaguuucagcuguuccucaaccagcugaccagaagacuggguuaucuacuguaacuuccucuuucuauucacauacagagaagccuaauauuucuuaccagcaagaguugccagauagucaucuaacugaagaggcucugaaaguuucaaauguuccuggaccagcugaccagaagacugggguaucaacaguaaccucuacuuccuacucacacagagagaagcccauuguuuccuaccagcgagaguugccgcauuuuacugaagcagguuugaaaauuuuaagaguuccuggaccagcugaccagaagacuggaauaaacauccugcccucuaauuccuacccacagagagagcacucugucauuucuuaugagcaggaguugccagaucuuacugaaguaacuuugaaagcaauagggguuccugggccugcugaccagaagacugggauacaaauagcauccucuaguuccuacucaaauagagagaaggccaguauuuuucaucagcaggaguugccagauguuacugaagaagcuuuaaauguuuuuguuguuccuggacaaggugaccggaagacugagauaccaacaguaccuuuaaguuacuacucacguagagagaagcccaguguuaucucucaacaggaguugccagacagucaucucacagaagaggcucugaaaguuucaccuguuucuauaccagcagagcagaagacugggauaccaauaggacugucuaguuccuacucacauucacauaaagagaaacucaagauuucaacugugcauauaccagaugaccagaaaacugaguuuccagcagcuacccuuaguuccuacucacaaauagagaagcccaagauuucaacugugauuggaccaaaugaccagaagacuccaucccagacagcuuuucauaguuccuauucucaaacaguaaagcccaauauuuuauuucaacagcaguugccagauagagaucaaaguaaagguauucuaaagauuucagcugucccugaacuaacugaugugaauacuggaaaaccaguaucucucucuaguucuuauuuucacagagagaaaucgaauauuuucaguccacaggaauugccagguagucauguaacugaagaugugcugaagguuucaacaauuccuggaccagcuggccagaaaacaguauuaccaacagcucuuccuaguuccuuuucacaucgagagaaaccagauauuuucuaucaaaaggauuugccagauagacaucuaacugaagaugcucuaaagaucucaagugcucuugggcaagcugaucaaauuaccggauuacaaacaguucccucugguacuuacucacauggugagaaucacaagcuuguuucagaacauguccaaaggcuaauagauaauuugaauucuucugacuccaguguuagcucaaauaaugugcuuuuaaauucucaggcugaugacagaguuguaauaaauaaaccagaaucugcagguuuuagagauguuggcucugaagaaauccaggaugcagaaaauagugcuaaaacucuuaaggaaauucggacacuuuugauggaggcagaaaauauggcacugaaacgaugcaauuuuccugcuccccuugcccguuucagagauauuagugauauuucauuuauacaaucuaagaaggugguuugcuucaaagaacccucuuccacggguguaucuaauggugauuugcuucacagacagccauucacagaggaaagcccaagcagcaggugcauacagaaggauauuggcacacagacgaauuugaaaugccggagaggcauugaaaauugggaguuuauuaguucaacuacaguuagaaguccucuacaggaagcagagagcaaagucaguauggcauuagaagaaacucuuaggcaauaucaagcagccaaaucuguaaugaggucugaaccugaaggguguaguggaaccauugggaauaaaauuauuaucccuaugaugacugucauaaaaagugauucaaguagugaugccagugauggaaaugguuccugcucgugggacaguaauuuaccagagucuuuggaaucaguuucugauguucuucuaaacuucuuuccauauguuucacccaagacaaguauaacagauagcagggaggaagagggugugucagagagugaggaugguggugguagcaguguagauucacuggcugcacaugugaaaaaccuucugcaaugugaauccucacugaaucaugcuaaagaaauacucagaaaugcagaggaagaggaaagccggguacgagcacaugguaagaagaaaguuucaggcuuauaaacguuauaguuuaauaauguguuuaaaguuagauauuuauguuuugaggaagcuuagccaaugaaaaauacaagcaagaucaagaaaaaaaaugaaguuagauauuuggaguucuaaauguauuuuccaauagaauuguuagaaugacuauauuucuucuaacaauccauaaaaagccuauuuaaccaauaauguaguuaaguuacaguauuaauaguaccagccugaguuuacguucuuguucuuaggagaaguagauucugauguaugacagagaguaaagaggucgcuugggcuccugagcuccuaaagcuaucacguuucucuaauccucccauuauaguauccuuauucugaaggcagaaagagccuccaauuugcugugcucuaaauugcuuuuuguccuaaaacuacauauauuuucucuuucccuuuucuaauagaacucuugguguugaucucagacauuugaaaaaaaaaucaauguauuuuauacuaaaacuuggguuagagguuuaaaagagaauauuuacaaaucucauuaauuucuaauagaauuccauuaaaaacaaaaaucuguaagacaauauggggaauauauuuugggaggcaauuuaaaagcaauuuaggccuaccuagaaaucgucccuugagguuaacuuccuacgcuguucccugcacauuuuuauucuacaaaaaaaccuccaaguuguauuuauuacuuuuaaauaucagcugucauggaauuaugaguaauuguagcaggaacuaaagggagagguaaagaaacucaugauuaaaaggaggauuaagauaaauaugauugauuacccgauuuaaaguggcuuuuuuguagaauuaucuauagagcaugacuuaagaaaaucagacuuugcagugaaaggaucucugucaagaauuucuaauagguugucauaauugagaagaagacauacuaagcauugcaguggguauuaaauugcauauauugaugaucuucuguguugcaauuguugacaaauuaucacuuuugcauuguauuaucucaaguguaugcuuucucuccagccuggaauaugaaguucaauuuagcacaugauuguggauacuccauuucagaauuaaaugaagaugacaggaggaaaguagaagagaucaaggcagaguuauuuggucauggaagaacaacugacuuguccaagguauaaaagaaaucuggaaaugaagaaaguaaauaugaaagaaugggugauggaauuaggaucucuuacuugggcaucaguugaguugcugauaauauuuggcuaaagccuuuuuugguuuuguuuuugagacagucuugcucuguugcccaggcugaagugcagcagugcaaucacaggucacugcagcccugaacucuuagacucaaggaauccucccaccucagccucucagguagcugggaccacauguguguaccgcccugcucggcuaauuuuuaaauuuuuggcagagacagggucucuacguugcccaggcuggucuugaacgcuuggauucaagcgauccucuugccuuggccucccaaaaugcugggauuacaggcaugagccacugugccuaggcaggcaucuuaauuuuucaaaaguuaagauauaaguauuagauucuuacagucuagauauguuguuuuuauugauuccaaauucauauuuugaaaaauuuaucuucuuagaaaaauaagaacugauuugcuuguuuuaucaauuuuuuuuuuaagaacagagaagacuaaaugucacccuuauuuucucuugaaagugguaucuugaaauccagcuauuuucaaauguuuauuuuaaauacuugaguacacagcuauaauagcuuauguauaaauggcuuucauuuuaauaguacauauuuuccuucuauuaacuauuucauauguagaaaagagcauauaugaaucauuuauguaaagaauagcagcaaguaaaaauaauucccauauauuuacuaucgagcuugagaaauagaacauuaccaaauacuguugaaguucuuuguuucuccuuucccagucauaucuuuuuuauuucuuauuuugauauauaaugauuuuccuucucuucaguaugguuuugaacucuaagauggaaucaauaugauacauauucuuuugagaacuagguguuucacacaguguuaggguuuugagcugcuucuauguagaugugcagaguuuucauuuguuccuuauuacuguacaguauuccagugugugauuacaugauaauuuauucuuucuccuguggauaaggcauuuugucugcuauuuugcauaguaauaggguauaauaaugccuaucguagaggguuuugguguggauuaugugagauaaugccuauaaaaugcuuaguagaacgugugaugucuaguuaguacucaguaacuggcagcuauuauuacuauuauuaauccugaaagaauugauauagcuaucaugcaaggauuucauggccugauucauacaaaguuucuuagaaaacuauucuccagugauauaguuuauuuggauuaucucaauuuuggaaaaguuugaaaaguacaaauuagauuggauuuuagguuuuacguauaugcuugugaaaaacaaaauugacaaaauaauaagaauaauaaaaugggcaauugguugucuuagcaccauuuguauauaugcugccaaagugagcacuauccuagcaucauuuguuuaaaauuacauaguuuucucagugaucuguguuucccuauuuuuaaaaauuauuuucuugcguucauauuuccagaucccucagcaagcaaguugccuuccuuuggguagacucugguuugucuguguuuuucuuaaaauaagguguccugaauuagaugaaacacaauuucacuucugaucugaccagcaugaaguauauucaguaauucucuuucugucaauguacugugagaucuuuaauggucacagcauaauugggcauuaaaaaaaaccauguacugcuuucaaaacuuaaagcuguaggaaaaaagcaaagcaaaacaaaccaaacaaaaaccaugaacugcugccaagauuccuauucucauuucuuguaucuauauaauacuuuuuuaaaaaucuucuuauuuuugagacagagucucacuuuauugcccaggcuggacugcaguggcaugaucuuggcucacugcaacuucuacaucccagguucaagugauucuccugccucagccucccggguagcugggauuacagcugugugaguggcgcaugacaccacauccagcugaucuuuguauuuuuaguagagaugggguuucacuauguuggccaggcuggucuugaacuccugaccucaagugauccgccugccucggccucccaaaaugcugggauuacaggccauuacgccucgcccuauguaauacuuuuuaacucuccuguauuucuuuuuauugcuuuuauaucaguguucaagccuauuggaaugauuuuuaaucaaauuugaucauuuauuuuauuaaaauaucccuuucagcuuugugccauuuauauauuugauaaguauuuuuauccaaauuagcaauaaaaauguuuacuaagggcuauggauaaaaagucuaaaacuuuuggcugggcgcgguggcucaugccuguaauccuagcacuuugggaagccaagguggguggaucacuugaggucaggaguucgagaccagccuggccgacguggugaaaccccgucucuacuaaaaauacaaaaauuaccugggugucauggugcaugccuguaauccuagcuacucgggaagcugaggcaggagaauugcuugaaccugggagguggagauuguagugagccgaagauugugccagugcacuccagccuaggcgacagagggagacuuugucucaaaaaaaaaaaaaaaaaaaaggucuaaaacuuuugaauaagauuacucucacaccuauuuugaguacuucacuauacugucauucaaccaucuuguguuucaccaucuuaugauugacuuuuuucagucuauuaacugaguaguugcgaaauaguguuugucuagauaugccuuguccuuagggaacccauauuggccacacuguguacgguuuuggaccuuuuauuuuuuuaacuuaaauauauuaggauuucccuuuaaaacuucucuaaaagcauaauuucacagguauguaauaucccauuguaugaacauaacaauuuauucacuacccuacuguuggacauuuauucauucauuccaaaaauacauauugaaugccugauaugcgccauccucaucuauagccugaggacacaccacugaacaaaauagacaaacauuucuucaucaugagcuuacauuaaggaagaguauaugaauaacaaccaaacaaguaaaauaaaugucagauggugggauaagagccagggagacaaagcagaauggucaacacagaaccugagaaagagguauugaauuaaauaucugaguaaggugagaaaguaaggcaguuaacagugacaagagcauuccagacagaaauagcaugcacacaguugcugagguaaagugugugaaaggaaagggaguguuaaaggaaagggaggaggccaguguguuuggagagugagagugaaagggagaagacuagauuguggaaggcagugguucuugacggguaguaaaugccucccaaagagauauuuuggaaaauuaugugauuuuucuugggucaucacuguaauuggggauuguuucuggaaugcaguagauaggugucagguauguuacuauuucuauaauguacaagacaguuccacacaaugaagaguugucccuugucacauacagcuuuugaaugucccuguagauauuaauguugaugaaaaaccuguuauaaauuacuucaguguuugucauguuuuaaaugauuuuuuuuuuaguauaggguguuucuucuguuuuuucuuucuuucaugacugacauuuuugaagaguacaaccuaguuacuuugcagauuucccucaaauugaauuuaucugguguuuuaucaugauuugauucagauuugauuuuuauguaggaaagccacagaagugaugugcuuuucaugcuugucaggaggcacauuauguugauuugucucaauacuuguaauguuaacucauaccacuuaguuaaggugguaucugcugguuuguguguuuuacauauuaauuaauaaguuaauaaauauuagggagagauucuuugagacuguaaauaucucuaguuuaggaucuaguguuuauacuugccugaauaauuuauuaauaaaauagcuuuaauuugguuauugaaaaaaauuccaucauugcuucaacauuucauuggaguucugugguaaguuaaaagugucccuucuccauuuauuuauuuauaucauuauggacucuuggauuuuucguuuacucaaagggucacaaccuaucacuaucauuguuuauuuugauacucaaauuaucccacacuugcccacuggaaccauuuuaagcugguuccuguguguucuuaugaucccaucauuucaugagcauucacccacuuucugagcuaggaagacacucuaggaauaucuuauauuuucuuuucaccaacccuagagcuguccauuucuccaaggggcgcugguucuuuuuagcagagaguggcauguagaaacuaagaucuguaugcuuggugugcuuauugauacuaugaugcuguugccuuuaugcccuuucagcagacaauguguguguacauaauuacacgcaccccccucuccccuguaggccuguuuccuuaucuauuacuuuuauuauaaaaugagagcugaguuuauacuaguacauccaauuccauuccaguacuacaggguuauucuagccuuuuuuucuuucuuuauuuguaacucacuucccugauaguaagaaacuuggcucccauuauccuccauauauuuacuuguuuaaacucccuuguauguuucucccucagccccacugcucuucaugccugcaacagauugaauuucuuucccagccccaacucuuucaacccacaaguuuuauauguaauauaauuauuauuauaccauuccagauauuuuuaaauuuccauuaugauuucuuucaacaaugaauggugauauauuaggaugauaccuucagugugcugaaagaaaauaaauuauaucuaucuagaauugcaugucagugaaaaucuguuuuaagaaugugguaauauaaaaaugauuuuagacaaaaacaguucauucagcacucauuaaaaaauucggguggagccaagauggccaaauaggaacagcuccggucuacagcucccagugugagcaacgcagaagacuggugauuucugcauuuccaucugagguaccggguucaucucacuagggagugccagacaguggguguaggacagugggugcagcgcaccauucacaagccgaagcagggcgaggcauugccucacucgggaagugcaaggggucagggaguucccuuuccuagucaaagaaaggggugacagacggcaccuggaaaaucgcaucacucccacacuaauacugcgcuuuuccgacgggcuuaaaaaacggcacaccaggagauuauaucccgcacauggcucggaggguccuacgcccacagagucucgcugauugcuagcacagcagucugagaucaaacugcaaggcagcagcgaggcugggggaggggcgccugccauugugcaggcuugauuagguaaacaaagcagccuggaagcucgaacuggguggagcccacuacagcucaaggaggccugccugccucuguaggcuccaccucugggggcagggcauagccaaacaaaaggcagcaguaaccucuguagacuuaaaugucccugucugacagcuuugaagagaguagugguucucccagcacgcagcuggagaugugagaaugggcagacugccuccucaagugggucccugacccccaagcagccuaacugggaggcaccccccaggaggggcagacugacaccucacacgaccggguacuccucugagacaaaacuuccagaggaaugaucaggcagcagcauuugcgguucaccaauauccgcuguucuacagucacugcuguugugcagccaccgcugcugauacccaggcaaacagggucuggaguggaccucuagcaaacucccaacagaccugcagcugaggguccugucuguuagaaggaaaacuaacaaacagaaaggacauccacaccaaaaacccaucuguacgucaccaucaucaaagaccaaagguagauaaaaccacaaagaugcagaaaaaacagagcagaaaaacuggaaacucuaaaaagcagagcgccucuccuccuccaaaggaacgcagcuccucagcagcaacggaacaaagcuggauggacaaugacuuugaagaguugagagaagaaggcuucagaugaucaaacuacuccgagcuacaggaggaaauucaaaccaauggcaaagaaguuaaaaacuuucaaaaaaauuagacgaauggauaccuagaauaaccaaugcagagaaguccuuaaaggagcugauggagcuaaaagcaaaggcgcgagaaccaugugaagaaugcagaagccucaggagcugaugcgaucaacuggaagaaaggguaucagugauggaagaugaaaugaaugaaaugaagcgagaagggaaguuuagagaaaaaagaauaaaaagaaacgaacaaagccuccaagaaauaugggacuaugugaaaagaccaaaucuacgucugauugguguaccugaaagugacagggagaauggaaccaaguuggaaaacacucugcaggauauuauccgggagaacuuccccaaucuagcaaggcaggccaacauucagauucaggaaauacagagaacgccacaaagauacuccucgagaagagcaacuccaagacacauuaauugucagauucaccaaaguugaaaugaaggaaaaaauguuaaggacagccagagagaaaggucggauuacccacaaagggaagcccaucagacuaacagcggaucucucggcagaaacccuauaagccagaagagagugggggccaauauucaacauucuuaaagaaaagaauuuucaacccagaauuucauauccagcgaaacuaagcuucauaagugaaggagaaauaaaauccuuuacagacaagcaaaugcugagagauuuugucaccaccaggccugcccuaaaagagcuccugaaggaagcgcuaaacauggaaaggaacaacugguaccagccacugcaaaaacaugccaaaauguaaagacugucaaggccaggaagaaacugcaucaacuaaugagcaaaauaaccagcuaacaucauaaugacaggaccacauucacacauaacaauauuaacuuuaaauguaaauggacuaaaugcuccaauuaaaaggcaaagacuggcaaauuggauaaagagucaagacccaucagugugcuguauucaggaaacccaucucaugugcagagacacacauaggcucaaaauaaagagauggaggaagaucuaccaagcaaauggaaaacaaaaaaaggcagggguugcaauccuagucucugauaaaacaaacuuuaaaccaacaaagaucaaaagagacaaagaaggccauuacauaaugguaaagggaucaauucaacaagaagaacuaacuaucuuaaauauauaugcacccaauacaggagcacccagauucauaaagcaaguccuuagugaccuacaaagagacuuagacucccacacaauaacaaugggagacuuuaacaccccacugucaacauuagacagaucaacgagacagaaaguuaacaaggauacccagcaauugaauucagcucugcaccaagcagaccuaauagacaucuacagaacucuccaccccaaaucaacagaacauacauuuuucucagcaccacaccgcaccuauuccaaaacugaccacguaguuggaaguaaagcacucucagcaaauagaaaagaaauuauaacaaacuaucucucagaccacagugcaaucaaauuggaacucaggauucagaaucucacucaaaaccgcucaacuaccuggaaacugaauaaccugcuccugaaugacuacuggguacauaacgaaaugaaggcacaaauaaagauguucuuugaaaccaacgagaacaaagacacaacauaccagaaucucugggacacauucaaagcaguguguagagggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaaauuaaugaauccaggagcugguuuuuugaaaggaucaacaaaagaccgcuagcaagacuaauaaagaaaaaaagagagaagaaucaaauagacacaauuaaaaaugauaaaggggauaucaccaccgaucccacagaaauacaaacuaccaucagagaauacuacaaacaccucuaugcaaauaaacuagaaaaucuagaagaaauggacaaauucuuugacacauacacccucccaagacuaaaccaggaagaaguugacucucugaauagaccaauaacaggaucugaaauugaggcaauaaucaauagcuuaccaaccaaaaaaaguccagguccagauggaaucacacugaauucuaccagagguacaaagaggagcugguaccauuccuucugaaacuauuccaaucaauagaaaaagagggaauccucccuaacucauuuuaugaggccagcaucauucugauaccaaagccaggcagagacacaaccaaaaaagagaauuuuagaccaauaucccugaugaacauugaugcaaaaauccucaauaaaauacuggcaaacugaauccagcagcacaucaaaaagcuuauccaccaugaucaagugggcuucaucccugggaugcaaggcugguucaacauaugcaaaucaauaaacguaauccagcauauacacagaaccaaagacaaaaaccacaugauuaucucaauagaugcagaaaaggccuuugacaaaauucaacaacccuucaugcuagaaacucucaauaaaugagguauugaugggauguaucucaaaauaauaagagcuaucuaugacaaacccacagccaauaucauaccgaaugggcaaaaacuggaagcauucccuuugaaaacaggcacaagacaggggugcccucucucaccacuccuauucaacauaguguuggaaguucuggccagggcaguuaggcaggagaaggaaauaaaggguauucaauuaggaaaagaggaacucaaauugucccuguuugcagaugacaugauuguauaucuagaaaaccccguugucucagcccaaaaucuccuuaagcugauaagcaacuucagcaaagucucaggauacaaaaucaauguacaaaaaucacaagcauucuuauacaccaacagcagacaaagagcgagccaaaucaugagugaacucccauucacaguugcuucaaagagaguaaaauaccuaggaauccaacuuacaagggauggaaggacuucuucaaggagaacuacaaaccacugcucaaugaaauaaaagaggauacaaacaaauggaagaacauuccaugcucauggguaggaagaaucaauaucgugaaaauggccauacugcccaagguaauuuauagauucaaugccauccccaucaagcuaccagugguaauuuauagauucaaugccauccccaucaagcuaccggugacuuucuucacagaauuggaagaaacuacuuuaaaguucauauggaaccaaaaaagagccugcaucgccaagucaauccuaagccaaaagaacaaagcuggaggcaucacacuaccugacuucaaacuauacuacaaggcuacaguaaccaaaacagcaugguacugguaccaaaacagagauauagaucaauggaacagaacagagcccucagaaauaaugccacauaucuacaaccaucugaucuuugacaaaccugacaaaaacaagaaauggggaaaggauucccuauuuaauaaauggugcugggaaaacuggcuagccauauguagaaagcugaaacuggaucccuuccuuacaccguauacaaaaauuaauucaagauggauuaaagacuuacauguuaguccgaaaacugugaaaacccuagaagaaaaccuaggcaauaccauucaggacauaggcaugggcaaagacuucaugucuaaaacaccaaaagcaauggcaacaaaagccaaaauugacaaaugggaucuaauuaaacuaaagaguuucugcacagcaaaagaaacuaccaucagagugaagaggaaaccuacaaaaugggagaaaauuuucgcaaccuacucaucugacaaagggcuaauauccagaaucuacaaugaacucaaacaaauuuacaagaaaaaaacaaccccaucaaaaagugggugaaggauaugaacagacacuucucaaaagaagacauuuaugcaggcaaaaaacacaugaaaaaaugcucaucaucacuggacaucagagaaaugcaaaucaaaaccacaaugagauaccaucucacaccaguuagaauggcgaucauuaaaaagucaggaaacaacaggugcuggagaggauguggagaaauaggaacacuuuacacuguuggugggacuauaaacuaguucaaccacuguggaagucagugugucgauuccucagggaucuagaacuggaaauaccauuugacccagccaucccauuucuggguauauacccaaaggauuauaaaucgugcugcuauaaagacacauacacauguacguuuauugcggcacuauucacaauagcaaauacuuggaaccaacccaaauguccaagaaugauagacuggauuaagaaaauguggcacauauacaccauggaauacuaugcagccauaaaaaaugaugaguucauguccuuuguagggacauggaugaaacuggaaaccaucauucucagcaagcuaucucaaggacaaaaaaccaaacaccacauguucucacucauaggugggaauugaacaaugagaacacauggacacaggaaggggaacaucacacucuggggccuguugugggguggggggaggggggaggggggagggauagcauuuggagauauaccuaauguuaaaugacgaguuaaugggugcagcacaccaacauggcacuuguauacauauguaacaaaccugcacauugugcacauguacccuaaaacuuaaaguauaauaauaauaaaauaaaaaaauucuaagugguuaccucagacuaaacggaaauaaucuaauaugggaaauuugugauguaggaaauauuaaagagcaaaagauguguuaaguauguggauaaauaaagcuaaauacuuaaguauaugaaacaaaaauacuaggaccuucaugacugagaugaaauguuauaaacuuaaaauauaugacaacaauaucuuacagguuagaagcugcauaaauggaguuaauuuuuuccaaguuucuuaaguguuugggaaaaagcuguuauuuacuuuagcuugauaacuauauguguuauaauuucuauaauaacccuguccccuacaucauaccuuacuacaaaauuaauuugagauggaucauagacuuuacuuugaaagguaaaauaaaguuucuugaaaaucucuucaugauguuggguuaggcaaagguuucuuaaacaagaacaaaaauacacuucauaaaagaaaggauugcuaaauugcucuucaugaaaguuaagaaugguaaucaaaaggcagcaugaagagugaaaagucaagcuacacaguggaagaggguauuucggauacauauauuugauaaaggacauaaauucagaauauauaaggaagucaugcaaaucaauuauuccuacccaaagacuucacuaggugucucauaaaugaagauauccaaguggacaguaagcauuugaaaacauugucaauaucacugccuguuugguaaugcaaguuaaccauaaugagauacugcuucauaucagaguagcuaaaauuaaaaagaacaaugcuaaauauugguaaaguuaugaagcaacuggaauagucauuuauugcugaugggaagguaaacugguacacaacucuuaaaauaauuuauaguuauuucauaaugguaaacaugccuuaccugggacacuucauuccuacuucuuuuuagguacguacucaagaacuaucaguacauauguucaguagaagacauggucaauaauaauuauagccccaaacugaaaacuacauaaauguauaucaagaguagaauagaugaaucaauuaugcuuuauucauccagugaaauccuguguagccauaaaagauagcaaacuacuacugccucaacaaccuugaaagcugucacacacguuaugguuagcaaaaaagccagacacaaagagucauacugaauaauuccauucauaugaaauucaaaaacuaaucaauggugagaaaagugauaagaaugguuaccucugguggagucaggugugugguauugacugggaagacgcacaagaggucuucucagguauaggaaguuuuuguauaucuggauaugggcagcauuuacauugcugucaucacauauaaaaaauaaacuaccugacuucagauuuguacaccuuauuaaagauuuauuauauauuaauuaaaaggaaacauugaacaagagauacaauugaaaucauagaaaaggaacuuuaagaaggcaaccauuucuaaucauagcaaaaacuuuauaaaaagcaucaaggcauaaaucuaacaagauuuaugagaucuuuuauuggagaauaguaaaauuuauuuugaaaggcuaguagaaguccuaaguacauagagaaauacacuguauuuauuaauaagacucuauauccaccuagcacaaacugcuucaaugaaucaaggcagauguuucuuuaaauuuuuuuuaucaugguaaaauacacaacacaaaauuuaccucaacuguuuuuaaguguacaguuuacugguguuaaguacauucauauuguugugcaaccaccaccaccauccgucuccaagacucuuuucaucuuguaaaacugaaacuuauacccauuaaauaauaacuucucauucugucuucccaucugccccaggcagccaccauuuuccuuuuugucucauaugauuuugauuacucugaguacuuccuauaaauggaauaauacaauauuugucuuuuugugacuggcuuauuucacuuagccucaugugguucauccauguuguagcauauguuauaauuuuguaaagugagucuguuguagacaguauauaguuggaucauucugccaaucucuauugauuaaauuuauuuacuuuuaaaguaauuaacaauaaggaggaaccugcuucuguccuuuuucuauuuguuuucuacaucaagguacaaauuuuauguucagauacaauuccaaaccacgaugaggauuuaucuuaacuguccucuaccccacagaaaugcagaggccaacaaaucacauuuguaggcuccuaaaggaaacucucuuagauugcuugucaaaaacuguugagaucauuuuggccccuuccaugcuaugagaacgagauccacacuguacccaaugauuuacugacuucucucggcagaauacugucucuucuccuucucucuucuguuugguaaugaagagaagaaaaguuugaagucaguacuuuauaucauuuaguauauggaccaauaacucaacaaguuuagaaaaaaaaaccaugaaguaaacuuuacuuauacucuaaaauaaaccaaaccaaacuacgaaaguaguaaggaggaaauuauaaaauaaaaucuaucaguuaaugaacuagaaaacagaaaaaugauagaauugagcauuaaaaucuagauuuggaccuuggaaaaauuccaaaucagcagacaaguucugacuagcuagaagaugagaaggaaaaacauacaaugugguaaaugaaaaggagcaugccagauauaccacuuagaaaauuugaaauaauaggagaauauaauguauaacauauaacucucguuagguauaaaauuuucaugaaaugacugauuuucuuagauaauauaauuaaacagaagcguguaacagauuaaacauuaugagagagaaaaacuuuauugaucaaacauuuggcuuccaagaaaaguaccugaccuagcucaauauuagguaacauuaugaaguauuuccugggcaugauaaugacauugugguuauaugauaggugaauuauuuagggucgaagugucaaaucagugucuuuguggagggauaaagcuuuguggagggauaggggaaaauguucgacaauuguugaaucuaaauagaaggaauucacauguuuauuuuaacauucuaucaacuuuuugguauacucuuaacaaaaagaaaaaaacaaugccugacuuagauguuuauaugggugacucaagcuaucaaguaauggauaacuccugugccauauaaacaguuccaauacacuaacaaaaacuuccuaauuuacuugaggacauuaacaaaaaccucagaagacauaccugaaauuaugaaucuuuugcaucagugugaugucuccacuuuuauuucugauuuuauuuauuugagucuucuaguuuuuucuuagucuagcuaaauguuuguuaacauuguuuuuaccuuuucaaaaacuaacaauuuaguugauuucuuccuguuuuucuauuuuuuauuucugcucuaauuuuuauucuuuccuuuuuucugcuaacuuugggcuuaguuuuguucuuuuuuuucuaguuccuugagauguaaaguugaguugcuuauuugagaucuuucuuccuuuaaaaauaggcaauuaucauuagaaacuucccucuuaguccugauuuugcuucauccuguaaguguucauuuguuguguuuuugucuuuuuuaaaauuuuccuugauuucaucuuugauccacugguuguuuuaagaguguguuguuaauucccacauaauugugauuuucccaguuuuccuucuguuacugauuucuaauuuuagucuauugugcuugggaaaaaaagguugguaucauuucagucuucuuaaauuuguucagacuuguuuuaugacuuaauaugugaucuauccuggagaauguucuaugugcaguugagaagacuguguauucugcaacuguuagguggaauauucaguauauguguguucuguucauuauugaaaaugggguacugacaucuucuacuguauugcuaauugcuauuuuucccuucaguucugucaguguuugcuuuauguauuuagguacucuaauguuggguguauauauguuuauacuugugauaucuuccuaaugaauugacucuuuuaucauaugaccuucuuugucucuugggaugguuuuuuauuuaaagucuauaucgucugauaguguggccacaccugugcucuuuugguugcuaucugcauggaauauauuuuccuauuccuucacuuuuagccuguguguccuuaaaucuaaagugagucucuucuagauaguauauaguuagaucuuauuuuuaaaauuaauucagccacuauauguuuuuugauuagggaguuuacuccauuuacauuaaaguaauuauugauagggaaagacuuacuaguuccauuuuguuaauugguuucuuucuuguaguuguuuugucccuuuuguccucucuugcugucuuccuuugugauuuguugauuuugcuuugauccuuccuuuuuuuuuuuucuuucguguaucuucuauagguauuuucuuugugguuaccaaagucuuaacagaaaacaacuuauagcuacagcgaaagcaauuuaaaaaaauagacaaacaggacugcaucuaauuaaaaagcuuuugcacagcaaagaaaacaguuaagagacugaacugguaaucuauggaauaggagaaaauauuugcaaaccauguaucuaaugagggguuaauauccaaaguauauaaggaacaccugcaacucaacagccaaaaaaaaaaaaaaaaauccccaaaacaaaaaacaaauaaccugguuaaaacauggguaaaggacuugaaugaacauuucuuaagacauacaaauguguaaggugcuguauaugaaaagauauucaauaucgcuaaucaucaggaaaaugcaaaucaaaaccacaaugacugaacacuucauaucuguuaggauggcugauaucaaaacaaaacaaaugguaacaaguguuggagaggauguggagaaauuagaacccuguacacuguagauggucauguaaaaugguguagcugcuguggaaaauaguauggagauuccuuaaaaaauaagaauagaauuaccauaugaucccacuucuggguacauauccaaaggaaaugaaaucagaaucuugaggagaucccauguucacaauagcauuaaucacaguagccaagauauauaaacaagauguauaaacaucuauagaugaauggauaaagaaaaugugguauauacauacaauggaauauuauuccaccuuaaggaaguccugcuguaugugacaacauggaugacccugcaagacauuacacuaugugaaagaauccagucacagaaggacaaauacugaaugauuucacuuauaugaaauaucuaaaaauagucaaauucagaaaacagagaguagaauggugauugccaaggacugggaggaaggggaaauugggaauugauguuagguagguaucacaggcaaagcagauaguucaauauugggaaauuuauaaacaaguuuuuacauuaguagaucuaauggagaaaugauuauuucauuaagcuccaaaaaguauuugggaauaaaaauaaaaucuguaauuaaaaauauuucuuuagaguagaauauuucuuuauaguagaauaauaccucaaauaugauaaagaauauguauuugaaauuugcaaucagcauaaucaaagucaaauacuuuuguuaugcauauaaaacauuugugagaaaagucauauaauaugguggaguagggaacucuagggcucuugcaaaaacaccuaauaagcuuccagaaacuaucagaauuaguuuucguagaacucuggaauuuaguuaacauuaaaaaccaggaaaaguagggagcuguagcgcugcagaaacagaacacuauggcaccuuaaauugcucaccuaccauuccuugugccuagaugaacaaugacuuugaagacagcagcuuauacucauggugcaggcuguuagcacgagaaggauuaguacagaucuugcucucaaaaaauugugaucguuuuaaccugucugaaguaucugaaggaccaguauagagcuuccuuuuguuuuacacagcucagagcuuuccugggacugggguggcuugucugucaucacgugucaaaaguauuuaaaagccagaguaucagcuguagaagccugagucuggggauaaaaauuaggacaaugaauagguagacaaaaagccaggaaggaacgguugaaaaggagauacggggugguauaaggacuuuuaaaugcuuuuuuguaugcugagaaauugagaaugcuacguacaugccuaggauuggacaacuccucagagaaggcuugagaagacccuaagcuuucaccacuagcugaccuucaggcucugccuaacuaaguaggaugugaaggcuaagauauaguuguaaacagccuggcuuaguguugauggaaugccccaacacagagcaaaaaagacugggaguguuuuuuuucuuuccuauuaccuuuuuucuuuccuuggcugcagguguuuaaggaaccugucaaaauaguaguugacccugaagcuaagugagcacagacuucaguuccaugcacaacaaagaauguaagcuuuaugaaauagucacuaaacaacacuuacaacaagcaguaacagcaaacuccagggaagggggagaauccaguauccagaguugucacuuuauaauauucaauauguccaguuuucaacaaauuauaaggcaugcaaagaaguaaaaaagugugacucauucaaaggaaaaaagagaaauuaaugaaacuaucccugaggaagcccaccuuaaauguacucaaugagcugaacaauaccaucagcaaagaacuaagggaaaccaagaaaaggauuucccaccaaaaagaaauaucgacaaagagaaauuauaaaaaggaaacaaauagaaauucugcagcugaaaaguacaguaacaaaaauucuuuagaaggauucaauagcugaguagucugaacaaagaaucagugaacuugaagaaaggucagaugauuuauuuauucgaggagaagaaagagaaaagaauaaagaaaaugaacagggcuaugggacauccccaagcauaccaacauaugcauuaugggauucuuagagggaagagagagagagagagagagagagagaaaggggcgguaauaauauuugaagaaauaaugguugaaaacuucccuaauuuguugaaaaaugaauuucaaauggguuaaacucaaagagacccacaccaugucacauuauagucaaauuguuaaauauuuagcauagauguugguucuauuaguagaaauauacuuuccuuaaugaagucagcuuuaacagauuuuuuuuuuaaaucugguuuugaagucauaaaauacaaaacuaugagcuucuuacaaaguuauuccugccguaaauacugugguaauuuauauauuuaaaaaauugagaauuuuuuuaaaacaaguguuuccaaaagcuuauugauuuuuaaguaaguuuuguaucacaugguaauacguuucuuuuauuuguagaaaguagauuuuuacuuuuuagugcuuguugacucugugugugugugugugugugugugugugugugugugugucuauugguuuacaugacggugaagaacuacuuauuucuuuuuugguuuguuacaugaagucuuugacauuguuuguuuguuugugacagggucuugcucagucaccgaggcuggaguguaguggcuggaucuuagcucacugcaauguccaccucccgagcucaagcuauccuuccaccucagucucucaaagugcugguauuacaggcuuaagccacugcaccuggcugaugugucauuaagcuggaugaugagagaauaauauaaccugauaaaacucauguagaucuuuugagaagagauaauuuuaauugugaaauagcaucuggaaaucaguaaaagacauauuuuagcuaaccaguaauuucauaacaucuuuaucucaguauaauuuacuauaauacauaagguuugcccauuuaaaguguauaguuuauuuauagaauuuuacaauagcauaauuuuagaacuuuguugucauuagccccucucccccaauucccuagcccuaggcaaacaccaguccacuuucucucccaauucuuuuuugccaauucuggacauuuuauauaaacagaauuguaauguaugaucuuuugugacugccuucuuuuacuuagcauaguguuuucaagagucauucauguuauguuguaaugugaaucaguacuucaucccuuuuuauugccaaauuacauuucauuguauagauacuuuguuuacucauuaguugguagacauuuggauuuuccacucuggccauugugaauagugcugcuaugaacauaguguuuauguguuaggguagguguuucauuucucuugguuauauaccuaacaguagaauuacugggacauacaguaacuccauguuuaacauguugaggaacuucuaaacuuuuuucugaaguagcugcacuauuuacauucccaugagcaguauaugaggguuucaguuucuccacguccuuuccaacauuugucauuuucugucuuuuugauuauagccugguuggguguuaagggguauuuauuguguuuuuuaccuauuucuaacaacuaaugguguugaacaucuuuucaugugcuuauuggucauuuaucuuuucugaugaaauaccuauucaaauucuuuacccauuuauaaauuuaucacuguacaaauuuguugaguugcaagcauucuuuuuauauucuggauauuagaccuuuagcagauuuauggacuuaccaauauuuucucccauucuguagacuuuuuuacuuucuugauggugaccuuugauacgcaaaaguuuuaaauucugaugaacucuaacuuaucagacuuuuauucuuugcacuuuuggugacauaucuaagaaaucagugcauaacccagggucacaaagauuuaguguuuucuucugagagauuuaguuuuaguuuuuauauuuagaucugugguucuauuugaggcaauuaaaauuuuuauuuuuuuaauugugauaaaauauacauaaaauuuaucaucuuaaccauuguuaaguauaugguucaguggcguuaaguacauucauauuguuguuuaaccaaucucuauagcuuuuuaaaucuuguaauacugaaacucuauauccauuaaacaacaacuccccauuuuccccuuccccuuaggcccuagcaaccaccauucuacuuucugucucuaugaauuuggcuacucuagguaccuuauaguagcagaaucacacaguauaugucuuuuugccacugguuuauuucauucaguaguauauucuuaaaauucacccauguuguacuauaugucagaauuuccuucuuuuuugagauuauauuauuccauuguauguguaugccacaaacaaaaguuuauccauucaucuguugauagacacuugaguugcuucugccauuuggcuauugugaauagugcugcugugaacaugcuuguuauaauuaucucuucaagguccugcuuucacuucuuuuggguacagacccaaaaguggaauuccuggaucauacagucauucuacuuuuaaguuuuugaggaagcuccguacuguuuuccauaagggcuacacuguuuacauucccaccagcaguauucgaggguacugauuucuccacauccuugccaauacuuguuauuuucuguuuuuuuuuguuuuuuuuuuuccuucuuaauaauggcuauucuaacaggucugaauugaugucucauugugguggugauuuucauuucccuuaugauuaguaauauugagcuucuuuucauuuuugguuggccaguuguauaccuucucuggagaaaugucuauuauuuuugccuaucuuugaaucagguuuuguuguuguuguuccugaguuguaaguguccuuuauauguucuggauauuaaccuugcaucagauacagugagucuuugccucacaucuuuguuaaguucuuggaaacugaccuguaagugaagugacguauagcauagcaaaacaaacugauauaaguuaauugauaaaacaagaguuaaguuccuaugguauucaguacauuguuucacuuaaaggugcaauuucuaaguaccuauugaugauguuaagugaagacuuauuguacaugauuugcaaauauuuucucccauuuucuagguuaccuuuucacucuguugaugguguccuuuggugaacagaaguuuuaaauuuugauuuaguccaauuuaucaacuuuuacuuuuguugccuuucuccuuugagucaguuuuuauguauggcaugcaaauucgucuuugcauauagauauugaguuguuucagcacuguugaaaagacucuucuuucccuguugaauuuucaugaccucuuugcugaaaaucaauuuaccauaaauguuaguguuuauuucuggacugucgguucuaugccauugaucuacaugacuguccuuaugccagcacugugcugucuugauuauuguagcuuuggaguaaguuuugacaucggaaagagugaguccuccaacgauguuugucauuuucaagauuauuuuggcuguucuggguuuaugaucugcuugucaauuacugaaaaaaaaaaggcuaggcuuuuaauaagaguugcauugaaucucuagauuacuaugggaaauauuaccacuugaaucucuagauuaguuuaggaaguauuaaucuuucaguccauaaacaugagccaguuuucuaguuauuuugauuuucuuccauuucauucuauguuuuuuaguauacuagacauauauuuauuuugcuaaauauauucucaaguauuuaauucuuuuucuugcuguuguaaauugaauuuuuuuuaaaaauuuauuuuuggauugugaauugcuaguguauuaaaauacaguugauuuuuguauauugcacuggcauccugcagcuuugcugaacuuauuagucuuaauugguuuguccugguuuccuugggauuuccuguaugaaguucaugucaucugcaaauagauauaguuguacuucuuucuuuccaaucuagaugucuuuaauuucuaaccugguugcccuggcaauauguaacauccaauaugauacugaauagaagagguaagaauggccauacuugucuuguucuugauuguagggagaaagcaucuagcuuuucauuauucgguauuauguuagcgcugagucuuucauagguacucuucaucugguuaaagaaaucccuuccauuccuaguuugcugagaaauuuuaucacaaaaacguauuggguuuuguugaacugaacaguagcuuuuaagagccuguuacauaucuaaugacaugugguugguuuguuguaaaauuacuuggaaaugguuaugugaaaauacugaaauuuacuuggcaaauacuaaagcuacaagaauuuuuaaaauggaaagguuauuaugaaagcuugaaagaugcaaugggaggagguagagcaugaaguguuaaaaaauuuguaagauauaauuguuggaaaggaagaagagaaauauauuuugggaugaguauaaaucuacucaugcauacuuuuaagaggcuggaauagguuuauguuucucaaauucggauauuugcuucccacugauaugucaggagguaucaaggcaauaagaagccacagaauaaaaacaacauuuuuuuugcccaaauaaaauuuuuacaucuauuuuuaucagcuaaugacgaauauuuuuauuuauuuaguaauuuauucguuuauuuauuuauuuauuuauuuauuuauuuuacuuuaaguuccaggauacauaugcagaacgugcagguuuguuacacagguauacaugugccauggugguuugcugcaccuaucaacccaucauuuagguuuuaagcccugcauacguuagguauuuguccuaaugcucucccuccccuugccccugaccccaccgacaggccccggugugugauguuccccucccuguguccauguguucucauuguucaacucccauuuaugagugagaacacgugguguuugguuuucuguuccuguguuaguuugcugagaaugauggcuuccggcuucauccaugucccagcaaaggacauggucuuauucuuuuuuauggcugcauaguauuccaugguauauaugugccacauuuucuuuauccagucuaucauugaugggcaaaaaguggcauuuuuaaaguguuaguuuuguccagugguauuuaauuuuuuuuaagucaacauuuuguuuugaaauaauuguaguuucacaugugauaaauaauauagagauaucacauauacccuucacccaauuuccccaagugguaacaucuugcauaacuguggugauauaucacaaccacaacguugauauugauacagccaagauacugaacauuuacaucacuacaaaggugccucaugauaccuuauaauagcuacuuccacuucucuccugccccaccuuuuacugagcuccuggcaaccacuaauuuguuccuuuguuucuauaacuuuguaauuucaagaaugucauauaaaugauaacauauaguaugcaaccuuauuguauuggccuuuuuuucacucagcauacuuaucuggagauucauccagacuguuuuauguaucaguaguuuuucuuuuuuauugauguauaguauuccaaaguaugaaugcaccacaguuuaaauauucacuauugaaggacaucuugguuguuucccaguuuuuggcuuuaccaguacagcugcuguaaacauucauaugcaaguuuuugugugaauaugucuuuguuucugugggguagaugcccaggauugcaauugcugggucaugugguaguugcauguuuaguuuuuugaaagacaggccacaccuuuuuccagggugguuauaucauuuacauucccaccagcagugugugaguaauccgucuacuccauauccucaccagcauuugauacugucacuauuuuuauucuagucauucuaauagguauguagugguaucuuauuaaguuuuuaauguguauuucccuaaugguuuuugauguugcacauuuuuuaauauuucuguuuccagucucuuucuccuguuaagugaaaugucuguaucuuuugcccauuuucuuuuuuuauuuuuauuuuuauuuauuuauuuuuauuauuauacuuuaaguuuuaggguacaugugcacauugugcagguuaguuacauauguauacaugugccaugcuggugugcugcacccacuaacuugucaucuagcauuagguauaucuccuaaugcuauccguccccacuccccccaccccaccacaguccccagagugugauauucuccuuccuguguccaugugaucucauuguucaauucccaccuaugagugagaauaugcgguguuugcuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuauaauucuuggacauuuggauugguuccaagucuuugcuauugugaauaaugccgcaauaaacauacgugugcaugugucuuuauagcagcaugauuuauaguccuuuggguauauacccaguaaugggauggcugggucaaaugguauuucuaguucuagaucccugaggaaucgccacauugacuuccacaaugguugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauguccagugaugaugagcauuuuuucauguguuuuuugucugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcgaaaauuuucucccauuuuguagguuuccuguucacucugaugguaguuucuuuugcugugcagaagcucuuuaguuuaauuagaucccauuugucaauuuugucuuuuguugccauugcuuuugguguuuuagacaugaaguccuugcccacaccuauguccugaaugguaaugccuagguuuucuucuaggguuuuuaugguuuucagucuaacauguaagucuuuaauccaucuugaauuaauuuuuguauacgguguaaggaagggauccaguuucagcuuucuacauauggcuagccaguuuucccagcaccauuuauuaaacagggaauccuuuccccauugcuuguuuuucucagguuugucaaagaucagauaguuguagauaugcugcauuauuucugagggcucuguucuguuccauugaucuauaucucuguuuugguaccaguaccaugcuguuuugguuacuguagccuuguaguauaguuugaagucagguagcgugaugccuccagguuuguucuuuuggcuuaggauugacuuggcgaugcaggcucuuuuuugguuccauaugaacuuuaaaguaguuuuuuccaauucugugaagaaaggcauugguagcuugauggggauggcauugaaucuguaaguuaccuugggccguauggccauuuucacgauauugauucuuccuacccaugagcauggaauguucuuccauuuguuuguauccucuuuuauuuccuugaguagugguuuguaguucuccuugaagagguccuucacaucccuuguaaguuggauuccuagguauuuuauucucuuugaagcaauugugaaugggaguucacucaugauuuggcucucuguuugucuguuguugguguauaaggaugcuugugauuuuuguacauugauuuuguauccugagacuuugcugaaguugcuuaucagcuuaaggagauuuugggcugagacagugggguuuucuagauauacaaucaugucaucugcaaacagggacaauuugacuuccucuuuuccuaauugaauagcuuuuauuuccuucuccugccuaauugcccuggccagaacuuccaacaccauguugaauaggaguggugagagagggcaucccugucuugugccgguuuucaaagggaaugcuuccaguuuuugggcauucaguaugauauuggcuguggguuugucauagauaacucuuauuauuuugaaauacgucccaucaauaccuaaucuauugagaguuuuuagcaugaaguguuguugaauuuugucaaaggcuuuuucugcaucuauugagaaaaucaugugguuuuugucuuuggcucuguuuauaugcuggauuacauuuauugauuugcauauauugaaccagccuugcaucccagggaugaagcccacuugaucaugguggauaagcuuuucggugugcugcuggauucaguuugccaguauuuuauugaggauuuuugcaucaauguucaucaaggauauuggucuaaaauucucuuuuuuuguugugucucugccuggcuuugguaucagaaugaugcuggccucauaaaaagaguuagggaggauucccucuuuuuccauugauuggaauaguuucagaaggaaugguaccaguuccuucuuguaccucugguagaauucggcuguuaauccaucugguccuggacucuuuuugguugguaagcuauugauuauugccacaauuucagauccuguuauuggucuauucagagauucaacuucuuccugguuuagucuugggagaguguaugugucgaggaauuuauccauuucuucuagauuuucuaguuuauuugcauagagguguuuguaguauucucugaugguaguuuguauuucugugggaucgguggugauauccccuuuaucauuuuuaauugugucuauuugauucuucucucuuuuuuucuuuauuagucuugcuagcagucuuuuguugauccuuucaaaaaaccagcuccuggauucauuaauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugugucccagagauucugguauguugugucuuuguucucguugguuucaaagaacaucuuuauuugugccuucauuucguuauguacccaguagucauucaggagcagguuguucaguuuccauguaguugagcgguuuugagugagauucuuaaucuugaguucuaguuugauugcacuguggucugagagauaguuuguuauaauuucuguucuuuuacauuuguugaggagagcuuuaguuccaaguauguggucaauuuuggaauaggugugguguggugcugaaaaaaauguauauucuguugauuugggguggagaguucuguagaugucuauuagguccacuuggugcagagcugaguucaguuccuggguauccuuguugacuuucugucucguugaucugucuaauguugacagugggguguuaaagucucccaugauuaaugugugggagucuaagucucuuuguaggucacucaggacuugcuuuaugaaucugggugcuccuguauugggugcauauauauuuaggauaguuagcucuucuuguugaauugaucccuuuaccauuauguaauggccuucuuugucucuuuugaucuuuguugguuuaaagucuguuuuaucagagacuaggauugcaaccccugccuuuuuuuguuuuccauuugcuugguagaucuuccuccauccuuuuauuuugagccuaugugugucucugcaugugagauggguuuccugaauacagcacacugaugggucuugacucuuuauccaauuugccagucuuugccuuuuaauuggagcauuuaguccauuuauauuuaaaguuaauauuguuaugugugaauuugauccugucauuaugauguuagcugguuauuuugcucauuaguugaugcaguuucuuccuagucuugauggucuuuacauuuuggcaugauuuugcagcggcugguacugguuguuccuuuccauguuuagugcuuccuucaggagcucuuuuagggcaggccuaguggugacaaaaucucucagcauuugcuugucuguaaaggauuuuauuucuccuucacuuaugaagcuuaguuuggcuggauaugaaauucuggguugaaaauucuuuucuuuaagaauguugaauauuggcccccacucucuucuggcuuauaggguuucugccgagagauccgcuguuagucugaugggcuucccuuuguggguaauccgaccuuucucucuggcuguccuuaacauuuuuuccuucauuucaacuuuggugaaucugacaauuaaugugucuuggaguugcucuucucgaggaguaucuuuguggcguucucuguauuuccugaaucugaauguuggccugccuugcuagauuggggaaguucuccuggauaauauccugcagaguguuuuccaacuugguuccauucuccccaucacuuucagguacaccaaucagacguagauuuguucuuuucacauagucccauauuucuuggaggcuuugcucauuucuuuuuauucuuuuuucucuaaacuucccuucucgcuucauuucauucauuucuucuuccaucgcugauacccuuucuuccaguugauggcaucggcucuugaggcuucugcauucuucacauaguucucgagccuuguuuuucagcuccaucagcuccuuuaagcacuucucuguauugguuauucuaguuacacauucuucuaaauuuuuuucaaaguuuucaacuucuuugccuuugguuugaauguccucccguagcucagaguaauuugaucgucugaagccuucuucucucagcucgucaaagucauucuccauccagcuuuguuccauugcuggugaggaacuguguuccuuuggaggaggagaggugcucugcuuuuuagaguuuccaguuuuucugcucuguuuuuuccccaucuuugugguuuuaucuacuuuuggucuuugaugauggugauguacagauggguuuuugguguggauguccuuucuauuuguuaauuuuccuucuaacagacaggacccuccgcugcaggucuguuggaauacccugccgugugaggugucagugugccccugcugggaggugccucccuguuaggcugcucaggggucaggggucagggacccacuugaggaggcagucugcccguucucagaucuccagcugugugcugggagaaccacugcucucuucaaagcugucagacagggacauuuaagucugcagagguuacugcugcuuuuuguuugucugugcccuuccuccagagauguagccuacagaggcaggcaggccuccuugagcuguggugggcuccacccaguucgagcuuccaggcugcuuuguuuaccuaagcaagccugggcaauggcgggcgccccucccccagccucgcugccaccuugcaguuugaucucagacugcugugcuagcaaucagcgagacuccgugggccuaggacgcucggagccaggugcgggguauaaucucguggugcgccguuuuuuaagccgguuggaaaagcgcaguauucgggugggagugacccgauuuuccaggugcguccgucaccccuuucuuugacuaggaaagggaacucccugaccccuugcgcuucccaagugaggcaaugccuugcccugcuucgucucgcacacggugcgcgcacccacugaccugcgcccacugucuggcacucccuaguuagaugaacccaguaccucagauggaagugcagaaaucaccgucuucugcguggcucacgcugggagcuguagaccggagcuguuccuauucggccaucuuggcuccugucccucuuuugcccauuuuuuaauuggauugucuuuuuuuucccuuuuuacuguugugaauuguauauauauguuaguauauauguuagauguaaggcuagcagauacaagaccuuuguuggauaugagguuugcaaauauuuucuuguaaccuguagcugggagagagaggggcauuuuguuuugcuggauagucuagguaggcuucgcuagacuuucacugacgccgcaaggaagggauagcacuuuaucagccagcagagaugaaaguaaguccuggguuccucacuuggccuuugcugguguuggugugagugggucuaguuuuuucugugaugguuggcuggaguagaaugguuauuauuuaaaaguucucucuuuugcuaggcuucaccucuacuggguuuuuagcuagugagaaaagcucuuguuaggguuuuuugucuguguccauuguuccuggguagcugacuucuucagcuccaagucuguauaugcaagagaaaaagaaaacccagugauugcaccacagcauaauuccucaggucccuagaucucuagcuaaucuacguucuucucuacaucuuucagauucuucuuacauuuguuuuauauauauuuuccagugggcugaauuauacuuagcaggagaaauagggaaaaguacaucuggccaggcgcaguggcucaugccuguaaucccagcacuuuggggaggcugaggcaggaggaucccuugaauccaggaguuggagaccagccugggcaacaaagugagacccagucucuacaaaaauaaaaauaagaaaauuagcccgguguaguggcaugugccuguugucccagcuauccaggaggcugagguggcaggaucgccugagccugggaggucguggcuucagugauagugccacagcauuccagccugggugacacagcaagacccugucuuaaacaaagaagaagagaaaagaaagaaaaaugucacaggauccucagggugucaguuugcaagcuggaaaccacuguggccagcagcaccuucugccugaguauuguucacacugcugggcacauucuccgcacuuggccuggcaggcugugcuuggcucgcacuacuaugcuaugucuuacaccugccaagcaugagccagguguggaguggugaggggugugugggcaagcaaguguggggucuagccacuguacacagccaggcaugcugacggcugugguagggcaggcagcuccagugcuggcacuggugcuggcgccacgcaaggcugcagcuggaccagauguacugugcguggcuucugcugugggcacccacaucugggugagggaaauguggugguggcaacuggaagcuuggaagacaccaggaaccacaaaaccccaaagagggugucauaguccuggcucagggacccccuaggucugggcuucccgaaaggccacagcuugucucuucuucuuguucccugcaacauggcaggcggggagggggcauguuucagcccuguuuguguuacagcucuuuuagucccaccauuugguggauccugagcucuuguccugcauccaugaagaaugagguauguggacaacuggagggugagcaagauggagaggaguuucaucgaguggcagaacaguuuucaggagacccaaaguggguagcuccuuucugcaggcaggucauccugaugacuguccaucugucaguggagaggagaaccuagaguggguagcuccuaccugcaugcaggucaucccauaaucugcaucuuucagcagagaagagacccggaguggcuagcuccuaucugcaggcaggucauuccauugucucuccaagucuggcugaguccaggguuuuuaugggcuucaaaggggaggagaugcaugccaauugguccaugggcaggcccggaaaaagcacuauaaguucuccuuucugcgaaacuggcagcccuucaacccaucccuggcuuaaagguggagcuucacuggugaccugccccuuucugcccaggagccugucugccaucucugccaucuacgguacccauggcacacccaggcuguuuaugucagggggcgccugcaggcccacucugagcugcccucagcccucccugccccugcaaccucccuccugugcuugugggugcccagugucuggaggggcggcagggggcuggugugacagugcugucccaagugugcgcacaccuggcugggucgcaacagugccuggacuuggccucaacuuugcuguguaauuggagcgggaaccaggaguggggagaggccuggcagugggagcaggcacuucugagccugcaggggcagggggaguucccagauccccgaaagugcaguggugccugggucuacagcugugacugggcagcugcagcugugcccaggagggugggguuccugccccuccaacucagaagggaguggggcuucugccuguuccuggcucccaccaccucaguacagcgaguagcccuagcuguuccuuccccacugcagcuggcaucauugcagcagccacuccagaugggaugccgcugccaucaaaaauauaucuacuccaucaccuggggagaugcagcauaauuuaaaauauuuuuaucugaaaucagauguugcuauaucaucaaauagaaugccaaguuauaaugacuguauagguaaaauacagaaaucucaaagaaauguuauauuuaugguagcuuugaguacugauccuaugcgccaggaaacaaggucuugguuuuuuccccccauuguuagggguaaaauauuaggauguaggucaagcuucuguaauagccaaacauagaguggcucaaauaagauagaauuuuauuuuuucacgucauuguucauguuaggaaagugagcucuguuccuugaugucauccagggacccaagcuggcuggacaacuaagcugucuuacacaugacuuccaagguuguuccaugcauuaccauuuucaggaggcaagaaaaauagugaugauagugguggugauauugggggaacaugcaggucaagaacuugauuuuaaggacaggaagcagaaguuguacuugaugccuucauucauaucccauuggugucagucuaguaaugugguuacaacuagcugcagaagaaacaggaaaugucucccacuugguggcuauguggccagcaaaaauuugaguaaggcauuucuauuauuaaaagaaaggugagaauacuuacugguggacaauaguaaucuuugcuguuuacuuuaguggaaauuuuuuagaagaacucucugaguggucuuaaucauugugagccauuuuauucuguaguuaacugucuuuuuugcuugcugugcucuuuguccuguuauauuauaaaagaaugacaugaccuucauggucuaaucuuagcguggguauaaaacugauuuguauaaaacugauuuguuuauaacuacuuggacuacuucaaauaagaaccuguuuguuuguaucuucuaggguuuacagaguccacggggaaugggaugcaagccagaagcuguauguagucacauuauuauugagagccaugaaaagggauguuuccggacucuaacuucugaacauccacaacuagauagacacccuugugcuuucagaucugcuggacccucagaaaugaccagaggacggcagaacccaucaucaugcagagccaagcaugucaaccuuucugcauccuuagaccagaacaacucccauuucaaaguuuggaauuccuugcaguuaaaaagucauuccccauuucagaacuuuauaccugaugaauucaaaaucagcaaaggucuucgaaugccauucgaugaaaagauggacccuuggcugucagaauuaguagaaccugcuuuugugccaccuaaagaaguggauuuucauucuucaucacaaaugccguccccagaacccaugaaaaaguuuacuaccuccaucacuuuuucaucucaccgacauucuaaaugcauuuccaauuccucuguuguuaagguugguguuacugaagguagccaguguacuggagcaucuguggggguauuuaauucucauuucacugaagaacaaaauccucccagagaucuuaaacagaaaaccucuuccccuucaucauuuaaaaugcauaguaauucacaagauaaagaagugacuauuuuagcagaagguagaaggcaaagccaaaaauuaccuguugauuuugagcguucuuuucaagaagaaaaacccuuagaaagaucagauuuuacaggcagucauucugagcccaguaccagggcaaauuguagcaauuucaaggaaauucagauuucugauaaccauacccuuauuagcaugggcagaccaaguuccacccuaggaguaaacagaucgaguuccagacuaggaguaaaagagaagaauguaacuauaacuccagaucuuccuucuugcauuuuucuugaacaacgagagcucuuugaacaaagcaaagccccacgugcagaugaccaugugaggaaacaccauucucccucuccucaacaucaggauuauguagcuccagaccuuccuucuugcauuuuucuugaacaacgagaacucuuugaacagugcaaagccccauauguagaucaucaaaugagagaaaaccauucuccccuuccucaaggucaggauucuauagcuucagaccuuccgucucccauuucucuugaacaaugccaaagcaaagcgccagguguagaugaccaaaugaauaaacaccauuuuccccuuccucaaggucaggauuguguaguggaaaagaauaaucaacauaagccuaaaucacacauuucuaauauaaauguugaagccaaguucaauacuguggucucccagucagccccaaaucacuguacauuagcagcaucugcaucuacuccuccuucaaauagaaaagcacuuucuuguguucauauaacucuuugucccaagacuucuuccaaguuggauaguggaacuuuagaugaaagauuccauucauuggaugcugcuucuaaagcgaggaugaauagugaguuuaacuuugacuuacauacuguaucuucgagaucacuggaaccaaccuccaaauuauugaccaguaaaccuguagcacaggaucaagaaucuuuagguuuucuaggaccuaaaucuucacuggauuuccaagucguacagccuucucuuccagacaguaacacuauuacucaggacuugaaaaccauaccuucucagaauagccagauaguaaccuccaggcaaauacaagugaacauuucagauuucgaaggacauuccaauccagaggggaccccaguauuugcagaucggugagucucauugugauaacaagcaagcuggauggacuuuguaauaaaggguuucaaauacuuaaguagauaucgguucuugggggaaaggccgugugauuucucugaguggagguugugucuggcuaauuacuagaagucuuucaaggaauaaauguguuaaguaagagagaacaugugacaguaaugcauuuauauuucagagggcuuuuggcaagacuugacaucaaguguuuuuaaaaauugaaugaccuugaaaagaaucuuugaucauccaaugauacaauuacgaauuuauuuacuguguuggacauaugcugaagaucuccuuuggagguugcacacacauacaugggugcuuggucacucucucucccgcucucccucucucucucucuucuccagcucucugguuccauuucaugacuucccucaaauauuuaguauuuacaaagaaaguggcuuuacaguggaaaauccuggcagauaccaguuuagucaaaugaugaagauuagcaucgccaguaaaacaucugucaacauaaugugcucccugauaugaugccccaccucauagaguauuguaggaaaggaaacccaauucagggauaaguucguuagauuuauauuauucagcccaauuuuagcacauugccauuaauucaguuuuacuuaaugagccucuuaugauauggugaagcagaacuaccuguauguuuaguauuuuaccuuauaguugaagaggcaucguaccacaguggagagcgcuaggcuuggaaaggaggaagaaagaaauguuuauucauaaucuacaugugguaguagucauggcaauaaggaacuuagauaugcuauccuacuuaguucucaucaugauccuaugaagcaggugaugauaucucuauuuuccuacugggaaaucuuuugugccaaaagauguuguuugugggcaagagaaagagcauucaaaugcauucuguuuaaucagaguaaggauuuguuccucuacacaguacucuguccuagaauuugaacccuaauuccaacacuuccaaccaugaugcuggacaacugauuuaauauccuuggcacucauauguagaaggaaaggguuggaaugcugaaaagucccuuauagcucuaaaaguuagggauugagauaauagauuggggcaaaaaaacaaggucaaucucugauuucaauguuaaaaauaguagagugccauagagaucaguaaugauaccuuuaaaauuuuuuucuuugagacagagucucgcucugucacccaggccagaguacagugaugugaucuugguucacugaaaccuccgcccccuggguucccgucccgccucagccaccugaauagcugggaccacaggcgugcaccaccaugccuggcuaauuuuuguauuuuuaguagagacgagguuuugccauguuggcaaggcuggucaguauugauacuuaaaaaaaaaaaaaaaaguuuagaaauuaaaacauugacaauuucauauacaauuuuuaaacucuucaaagguuaaaugcuaagguauuguacugaauaccuuaaaaaugagauaaagcuaugaaugagaagaaaguaauagaugauuauauauaugaacuaacaauaaugccauuuguucaggguguacguuuguaguggaugcuuauauuauacuuaguguaauaaucagaaauagauauuauuaccucaguuguggauuuaaaaaaccugagacuuagagaaaauauuuugcccaagaucacauggccauugagcauuggagguggcauuugaaccuagguuuaucaaacuccacaguccauaaauaaggcaaacuacacacacacacacacacacacacacacacagaugcauaaaacauauauauauaaguaaauauauauauaauaccuuauaaaauauuuauaaagggcugggugcgguggcucacaccuguaaucccagcacuuugggaggccaaggugggcggaucaccugagguugagaauuugagaccagcaugaucaacauggagaagccccaucucuacuaaaaauacaaaauuagcugggcaugguggcacaugcuuguaaucccagcuacucaggaggcuaaggcaggagaaucgcuugaaccugggaggcggaggcugcagugagccaagauugcaccacugcacuccagccuggcaacaaagcgagacucugccucaaaaaaaaaauuuauaaaguauguauguauaaaauauuuauaaaguauauguguauaaaauauauucaaacuuuuucauuuugagauaauuuuagacuuaggaguugcagaaauagcacagagaguuucuguauuaucuauugcuguguaucauguuacccugaaauauagcaacuuaauaaacgugaaaauuuauguaggucagaaaucuaaauguagcuuauuuggguacuucuggcuuagguugucucagaacguugcaaacaagguauuggcugcaaauguggucucaucacagggcuugccugagaggauaugcuuccagccucacucacauggccauggcuuuggccagagacaugggcuuuuugauucuauaaggcacucauaauaugacaccuaagcuucccuuagugaggcagugagagggcaagagagggugcccaaaacaaaagccacagucuuuuuguaaccuacccuuggaugugucaucucgucaccucugccacauucucuucaguagaaaugagucacugucuaaagcucucacccaaggguugggaauuccacaagguccugaauaccaggagguagaugucauugggggauauguuagagguuguccauguaaccuuuacugaagcuuccauuuauguuaacaucuuaccguaacaucauaaccauaaaauauuuaucaaaauaagaaauuauuauugguguaaaacuauauagucuaacauugauuucaccagguuuuuccacaaaugaaccuuuuuuguuucagauccaacccaggauuccgucuugcauuuuaguugucaugucuuagacuccuccaaucuaugacaguuucccagucuuuuuuugucuuucaugaccuugacgcuuugaagagugcuaaucaguuauuuugaagaagcuucuucaauuuagcauuguuugaugguucaagguuagauuaggguuaugcauucucaacacgucacaacagagagcacauuauguugauauacauuacuggugauguuaaccuugaucacuuggcuaaagugguaucugcuaggauucuccacuguaagguuauuguuuuuccuuuggagauacuaaacauuugagggagauuuuguuagacuauacaaauaaccuguuucugcuuaaacuuugacuacuaauuuuagcauucaugaguggaucuuggcuguagcaguuauuacucugguguuuuaauuuuuuuaugucugucaucucuuuuacauuuguuaauuggaauucuucuguaaggagaauuguucuucccucauuuauuccgcccuagguuauuuauuuacauuacuguagacucauuaguguuuauuucauuauuuggauuauaauccaaugcuaccauuacuguuuuguugcucaaguucucuuuuuagcucuuuagagcacuuuuagguuggcuccuguacccugccccagagcuggaaucaacuguuucauuaaaaaucccucuuuuuauuguuguuguuguuguuguuuucuuucuuuuugagccggagucuugcucugucacccaggcuggagugcaguggcgugaucuuggcucacugcaaccuccaccucccggguucaagcaauucaccugccucagccuccagaguagcugggauuacaggucugcaccaccaaacccagcuaauuuucuguauuuuuaguagagacaggguuucaccauguuggccaggcuggucuugaacuccugaccucaggugaucugcccaccucggccucccaaaaugcugugauuacagacgugagccaccaugcccagccaaaaaacccucuuauuuuugaagggaggaaggaguacaguauuuagaaagcaagauguaaggaccuggcaugcucauugcuggugggauguugcugugucuagccuuucucagugaauaaagcuaagaaauauagguagauuuguaaauuuauguguauacucauaucuguaucuuuuaacguguguguguguuuuaaaucauguguccauauugauaccucugacucuaguacagauccacaagguugauucuagccuuuccccuuucuuuauuuguaacuucugucucuaauagcgauaaaacuggcucucauuaucuguaauauauuuacccuaauauauaaauaguuucagaauucauagccccuacccacaugaaaaacaaauucugcaucuagaguacaguguuuaucugcaguuucgaaguuaucauuaaaauaucuagacaaaaaugcuguuugcuaaaguuucuuaagucagcaucucccuuccccauauucuucaguaugaguacgugauucauuuauaauauagauucauuagucacauucugcauuccaucuuugccucauauccugguucaccuuugaaaauuuccguacuuauaaauuucacuuucugugcuuuacaauucuauccauugcuacaguuucauaugagcaguuccaucaauccccaaauuccccuaugccguuccuuuggagacagucuuuccucugaucccucaccccuggcagucccuggucuguauucuuccuuagaguuuugccuuucuagagugucacacaaauggaaucauaaaauauguaacagccuuuugggucugaauuuuuuacuuugcaaaaugcauuugacacauccaucuuguguggaucaguagugcuuuuuuauugcuuuauuaaaugcaguaauauuuuauuguaauugaguuuguuuauccauucacucacugaaggauauuugaguuguuucuaguuugggaccauuaaaauuagaacugcuguaaacauuuauauacagguuuuuguuucucuacaguaaauacuaagaaagaggauuccugaguuauaugguacagguguauauuuaacuuuguaagaauuauucagagcuaaacuaauacugguuuuucagagugucuguaucauuuugcauuccugcuagcaaugggugagcauucuaguuacuccacauccucaccgauguguaaauugucaauauauuuuagccauuuuuauaguuguacagugguaucucaacauaguuuuaauuugcauguccuuccuuaauggcuaauuauuaugaacaccguuucaagagcuuauuugccauccucuucggugaagugcuuuuuaaauaggguuguuugcuuucuuauuggugaguuuugagaguucuuaauauauucuggauacgagucuuuucuggauauguuauuugcaaauaucucuucacaguaugcgacuugucuucuuauccucuuaaaaaaggcuuucaaaaaacaaagguguuuccuuuugaucaaguccaauuaauugauuuuuaaauggaucgugugauuggguuggcaauacuuuccuuucagcacuuaaaaaauaugcuccuuccuucuggauuccaugguuucuggcaaaaaauucauagucauuugagucauuguuuucuauguaagaacaauguguuauuuuucucugauuauuuuaauuuuuuuccagcacauugauuaugcuucuagauauggguuucuucuuuuuuuuaauuuuuaaauuuucauuucaguaguuuuugggauaaagguuguuuugguuacauggauaaguucuuuaguggugauuucugagauuuuagugcacccaucacccgaguaguaugcacaccauacccaauauguaguuuuuuuaagcccauagguuuacaggcauaccucagauauauugcagguucaguuccagaccacugcaauaaagccggucaccuaaauuuuuuggcuucccagugcauguacaaguuauguuaacacuauacuguacucuaugaaguguauaauagcguuaugucuaaaaaaauguaccuaccuuaauuuaaaaauugucguugguugaugggcacuuagguuuuuaugaguuacuucacuuagaauaauggccuccagcuccaucaaaguuacugcaaaagacauuauuucauuccuuuuuauggcugaguaguauuccgugguguauauauaccacauuuucuuuaucuacucauugguugaugggcauuuagguuuuuaugucuuugcaguugcaaauugugcugcuguacaagugugugcacgugucuuuuuaaugucuucuuuuucuagguauagauuucuuugguacaucuuguuugggguuugcugaguuuuuuuaagccuauagguuuacaggcauaccucagauauauugcagguucaguuccagaccacugcaauaaagccgaucacaugaauuuuuugguuucccagugauaauacaagugauguuuacacuauacuguacucuauuaaguguauaauagugucaugucuaaaaaaaguacauaccuuaauuuaaaaauucuuuauuguuuaaaaaugcuaacaauuauuugaaccuucagugaguuacuuuuugcugguggcagucuuaccuugauguugguggcugcuaacugcucuggguggugauugcuaaagauugagguggcuguagaaauuucuuuuuuuuuuucuuuuuaauuuucauugguacauaguagguguauauguuuauggguacaugagauguuugauacaagcaugcagugugaaauaaggacauugugaagaaugggguacaucccuucaagcauuuuuauccauugaguugcaaacaaugcaauuacacuaaguuauuuuaaaauguacagucauuauuuacuauagucacccuuuuguguuacauaguaggucuuauucauucuuucuauuuugugugugugugugugugugcccauuaaccauccccaucucuccccaaaccccucacuaccuuucucagccucugguaaccauccuucuacucucuauguccaugaguucaauuguuuggauuuuuagauuccacaaauaagugacaacaugcaguguuugucuuuuuaugccugguuuauuucauuuaacguaaugaucucuaguuccauccauauuguuguaaaugacuggaucucaucauuuucuaugucugaauaguacuccacuguguauauguaccacauuuucuuacccaucuauugauggacacauaggcugcuuccgaaucuuagcuuaccacaaacacugcugcaacaaacaugggauugcauugaaacuguagauugcuuuugaguaacaaaaucagucuuccauauacugauuuccuuucuuuuggguauauacucagcagugggauugcuggaucauauuguagcucaguuuuuaguuuuuuuaaggaaccuccaaacuauucuccuuagcaauugcacuaauuuacauuccaagcaauaguauacaaggguucccuuuucuccacgucuucaccagcauuuguuauugccugucuuuuccauauaagccauuuuaacuggggugagaugauaucucauuguaguuuuuaguuuuaguguuuugauuggauuauuagauuuuuuccuauggaauuguuugagcucuuuauguauucugguuauuaaucccuugugagauggguaguuugcagauauucucuuccauucuguagguugucuucuucacuuuauugauuguacccuuugcuguaaagaagcuuuuuaauuugaugugaucccauuuguccauuuucgcuuugguuaccugugcuugugggguauugcucaagaaauuuuugcccagaccaauauccuaaagauuuucccucauguuuuucuguaguaguuucaugauuugaggucuuagguuuaaguuuuuaauccauuuugauuugauuuuuguauauggcgaaagauauagaguucuagcuucauucuucugcauguaaguauccaguuuucauuuauuucugcuguuuuauaguuuuugucagggaauucugauaucucuuuuauccuagccuuggugucuguucccaugugauuuaguuuuuauauuugucucuucaaaaucucauauugaaauuugauccccagcauuagaggugggaccuaaagagagauguuuggguuaugggggcagaucccucaugaauggcucagugaccucccugugguaaugagugaguucuggcucguaguucacccaagagcugguuguuuaaaaaagaaugacuccccuccuccccaccuuccacuucuuuucucuucccgugugaugugggcucuccccuuacacuucugcugugauuggaagcuuccugaguuccucaccagaagcagaugcuggucccaugcuucuuacacagccugcagaacugugagccaaacaaaccuuuuuacuugguaaauuacccagccucaaguauuccuuaauagcagugcaaacagacuaagacaccauuugagcugagauuuuucugguucuaaauaugaugaauaauuuuggauuguauuucauaaugacguguuaugaaaugacaagucuuguuuaaaugccauagagaauguugauguuuuuguuuuagcagacaaugacccaacuaguuucagguuaaaaauuccagccagccuucuguagguuguuguuccaaguccauucaguuuucaaagauuuugcagugcuguucacaucuguugucugugugugugccuaguggcccuuuucuagguacuuuuaucccuuuucuauguacuuucugugacuacauugugucagggcugaguggcacaggacagaaggagaaaaagccaaccaggaguggucacucuugagaccacauuuccuuugguguaaguugaagguuucccuucuucagaacuuuaggcuccugccagccucuguuacugcuuguaccauugccaccaugagauuacugggaugcuaugacuaauauacagagauaaggaaaaaggggauuccacacucuauauagaguguugggagacccuucuuucauuccugaagccugaacuagaaggcuucgcugugaagucuuucucucuaugcuaauauccacuuuuagguuucaggcuauauugaguucaggccaaggaaugacagaggaaacaaaaaugauggcaaacucauuaccauuuugaugauauuucagauuuuaugaucuucaaucugccugcuucuguuauuuuccacagucuuccaauagcugcuccauguagucuaucuagguuuuauagcucaucucaucuaggauuagauacgcuaaccuggaacuggaaccacuucuacuguuuuuuguucccauuaacugcauaugugaguuucaguuauuccacauccuugccaacacuggguauuaacaguuauuuuuaauuucacucauucuaaaugugaguaugaaacaguaugguauuguaauuuuaauuuguauuuccaugaugacuaaugaugcugagcaucuuuucugugucucuugcccauuugcaugauuuuauuuaugaaguaucuguucacuuuuauccauuggauuauuugucucaguauuauaggaauuuuuauaauauauuccagauacaaauccucuguguauugugaauauuuucucauagucuguggugugauuuuuguuuucuuaauggugucucuggggaacagaaagcuuuaauuuugaugaauuccacuuugguaauuuuuuuuuaaugauuaguacuuuuuuguguccugauuaagaaauguugccuaaucaaguguuguaaaaguuuucuccuguauuuucauguagaaauguuauggucuuaacuuugugaucaagucugugaucuguuuccaaauucuccuuugugguguaaguuaugcaguugaggaucauuuucuuuccuaggaauauucuagcaccacuuuucaaaaaugauuauuuccuuauugaaguuaguuggaaccuuggucaaaauuaguuggccuuauauguguaaguuuuagaguuucuacucuguuucuuuguucuuuuuauuuaucuuuacaccaguaccacaaugucuugauuacuguagcuuuauaguaagucuugaaaucagguuauguccuccaaccuuguuuuuguuuucaaaauuauuuuugcuauuucaaguccuuugcauuuucauacaaauuuuagaauaagcauacugggauuuuuuuggggauuguauggaaucuguagaucaauuuuguagauugacauuugaauuuucagucuuccuaugcaugaacauggugagauuuuucuuccccacuuauuuaagucaucuuuaaugucccccggugacauauuguaauuuucguuguguagauuuuacacaucuacuaaauauauuccuaaguaguuaauauacuaugguauauggcauuuuaaaauuuaaguuuucucauuguucauugcuuauauauagaaauacuguugucaugccaauuuguaggucccaacaaguuaauuuuaauuuuaauuuauuauucuuugggucagagcuuucaugccuacugugggauguuuuagggcaaugagugcuguagagaauuuauacaaggcaaaaguuccagugguugacauauaucuauuuguucucuguuuuauguucaguaacuccucuaagauuucaagaguuucuucuuuaaauuuacugggauccucagguauaaagucuauucuucauacauaaucauuucaccagagaacagagcaguuuuacuccuuccuuugcaguucucaugccuuuuauuucuuuuucuugcuuaaugcacuggcuagaacauugaauaugauaccaaaacaaguaguaaaagcagacaucuugcccuguucccuauuccuggagggcaggagaguagaguaguguuuugucauuaaguuuaauauuaccuguagauuuuuaaugggugccuuuuaucagcuugaggauguuuucuaagugaguuuuaucaugaauggguguuuaauuuuucagauguuuuuccugaucuauggauaugaucauacauguuuucuccuuuuuucuacugauguagugaauuacauugguccaguugaucaacuguauuguugaaauugucaucuuuacugaauuuuuaucugcuuguuuaaucagcauuugaaaacagcauacaucuccaguuauguuuguguguuuucuguuucuccuuuagaucuucuuuggaguauuuuguggggaggggaacaauaacaaaguuauagaaaagguaaauauggcacaaggaacuucucuuucuccuuaguuauuugggaauacguuguugaccugcugcacaaucacuuucguguaauauagucucauuuccuauaaaaggacauucuccuauaggaccacaauaaaaccaugagaauuaggaaauucauacuagugcauuacagacauuauuuagauuucuccaguucucccaguaaugucuuuuuuuuuauuuuuauuuuuuuauaacacuuuaaguuuuaggguacaugugcacaaugugcagguuaguuacauguguauacaugugccaugcuggugugcugcacccauuaacucgucauuuagcauuagguauaucuccuaaugcuaucccuccccccuuccccgaccccacaacaguccccagagugugauguuccccuuccuguguccauguguucucauuguucaauucccaccuaugagugagaauaugcaguguuugguuuuuuguucuugcuauaguuuacugagaaugaugauuuccaauuuuauccaugucccuacaaaggacaugaacucaucauuuuuuauggcugcauaguauuccaugguguauauguggcacauuuucuuaauccagucuaucguuguuggacauuuggguugguuccaagucuuugcuguugugaauagugccgcaauaaacauacgugugcaugugucuuuauaguagaaugauuuauaauccuuuggguauauagccaguaaugggauggcugggucaaaugguauuucuaguucuagaucccugaggaaucgccacacugacuuccacaaugguugaacuaguuuacagucccaccaacaguguaaaaguguuccuauuuuuccauguccucuuuaucacuuuaaaacucaauaaaguuguggcuguuaggugccuuuaucauuuuaaaacucaauaagguuguggcuguuagguaccuuuucaucccacaguaggcaugaaagcucuuaggcaccuuaauaccccaaacaagauacucuuuucccuuuuguaauuaaguguuuuauggaagguauguuuaaauuauguaaacaucuuauucaucagcaaacuuacuuauuaauuuguaucuguacagaaucuuccuuauuuuauucagugaguuaugaucaauuucuaccuuuuuucuuuuuaacuuguuauuugaaaauacauauagacucacaagaaaaauaugugacucacaagagguuacaaaaauagccaagggagguccccacucagcuuccccauugauaauguccuuacauaacuauaaugcauuaucaaaaccaguaaauugauauuggcacaauacagucaaguggacuacagacgcuaaucagauuucacaaguuuuugcaugcacucaguuauucuaaugcauauauguguaauucuguaaaauuuaaacacauguauagcuuuauguaaccgccaucauaaucaagauacagaagugcucugucacugugaaggaauucccuugugccuucccuuuucuagucacacccuguucccucaagccagccuucuuuaaccccugaaagccagugaucuguuuuucuacuguauaauuuugucauuuugagaaguuauauagauggaauccaacauguuacauagauggaacauaacauguaaacuuugagauguguucuucuuacucagcauacucaccuggagauccauucaacuuguguguaucaguaguuaauuucuuuguauuggucagcauuccauuauuuggaauuuauacaguauguuuauccauucaccuguugaaggacauuguuuccaaugcuuauuacuaauaaagcuguuaugaacauucauguacuuuuuuuuuuauacuuuaaguuuuggaauacaugugcugaauguucagguuuguuacauagguauacaugugccauggugguuugcugcacccaucaacucgucaucuacauuacguauuucuccuaauguuaucucuccccuugcuuccuaccccacaacaggccccagugugugauguuccccucccugugcccauauauucucaacucccacuuaugagugagaacauggaguguuugguuuucuauuccuguguuaguuugcugagaaugaugguuuccagcuucauccaugucccuccaaaggacaugaacucauucuuuuuuauggcugcauaguauuccaugguauauaugugccacauuuucuuuauccagucuaauauugauagggauuuggguugguucuaagucuuuguuauugugaauaaugcugcaguaaacauacaugugcaugugucuuuauaguagaaugauuuauaaucguugggguauauacccaguaaugggauugcuggucaaaugguauucuaguucuaaauccuugaggaaucaccacacugucuuccacaaugguugaacuaauuuacacuuccaccaacagcauaaaagcauucuuguuucuccacauccucuccagcaucuguuguuucccaacuuuuuaaugauugccauucuaacuggugugagaugguaucucagugugguuuugauuugcauuucucuaaugaccagugaugaugagcuuuuuuucauguuuguuggcugcauaaaugucuucuuuugaaaagugucuguuuauauccuucgcccacuuuuugaugggguuguuuguuuuuuucuuguacauuuguuuaaguuccuuguuuucauucuuaaguaaauuaaguuuccuugauuuuuguucuuuugcauuugcugaggaguguuuuacuuccaguuauguggaucucagcccuuuuucagauggauagacugcaaaauuuucuaccauucuggagguugccuguuuacucuaaugauaguuucuuuugcugugcagaagcucuuuaguuuaauuagaucuaauuugucaaguuuggcuuuuguugccauugcuuuugguguuuuagucaugaaaccuuugcccaugccuauguccugaaugguauugccuagguuuuuuuguaggguuuuuaugguuuuaggucuuacauuuaagucuuuaauccaucuugaguuaauuuuuguauaagguguaaggaagggauccaguuucacuuuucugcauauggcuagucaguuuucccagcacuauuuauuaaauagggaauccuuucuccauugcuuuugucagguuugucaaagaucagaugguuguagaugugugguguuauuucugaagccccugcucuguuccauuggucuauguaucuguuuugguaccaguaccaugcuguuuugguucccguagccuuguaguauaguuugaagucagguagcaugaugccuccagcuuuguucuuuuugcuuaggauuguuguggcuauacgggcucuuuuuugguuccauaugaacuuuaaaguaguuuuuucuaauucugugaagaaagucaaugguagcuugaugaggauagcauugaaucuauaaauuacuuuggacaguauggccauuucacaauauugauucuuccuauccaugagcauggaauguuuuuccauuuguuuguguccucucuuauuuccuugagcagugguuuguaggucuccuugaagacauccuucacauccauugaauguuguauuccuagguauuuuauucucuuuguagcaauugugaaugggaguuugcucgugauuuggcucucuauuauugguguauaagaaugcuugugauuuuugcacauugauuuuguauccugagacuuugcugaaguugccuaucagcuuaaggaguuuuugggcugagaugaugggguucucuaaauauacaaucgugucaucugcaaacagagauaauuugacuuccucucuuccuauuugaauacccuuuauuucuuucccuugcccgauugcccuggccagaacuuccaauacuguguugaauagcaguggugagaggccauccuugcauugugucgguuuucaaagggaauguuuccagcuuuugcccauucaguaugauauuggcuguggguuugucacaaauagcucuuauuuuuuugagacauguuccaucaauaccuaguuuauugaguguuuuuagcaugaagggguguugaauuuuaucgaaggccuuuucugcaucuauugagauaaucaugugguuuuuuguuauugguucuguuuaugugauggauuacauuuauugauuuguguauguugaaccagccuuacaucccagggaugaagcugacuugaucuugguggauaagcuuuugaaugugcugcuggauuagguuugccaguauuuuauugaggauuuuugcaucgauguuuaucagguauauuggccugaaauuuucuuuuuuguugugucucugccagguuuugguaucaugaugaugcuggccucauaaaaugaguuagggaggagucccucuuuuucuauuguuuggaauaguuucagaaggaaugguaccagcuccucuuuguaccucugguagaauucggcugugaauccaucugguccugggcuuuucuugguugguaggcuauuauugccucaauuucagaacuugucauuggacuguucagggauuugacuucuuccugguuuagucuugggaggguguaugugucgaggaauuuauccauuucuucuagauuuucuaguuuauuugcguagagguguuugcaguauucucugaugguaguuuguauuucugugggaucaguggugaucugcccuuuaucauuuuuuauugugucuauuugauucuucucucuuuucuucuuuauuagucuggcuaguggucuaucuauuuuguuaaucuuuucgaaaaaccagcuccugaauucguugauuuuuuuggaaggguuuuucgugucucuauuuccuucaguucugcucugaucuuagcuauuucuugucuucugcuagcuuuugaauuuguuugcccucgcuucucuaguucuuuuaauugugauguuagggugucgauuuuagaucuuuccugcuuucuccugugggcauuuagugcuauaaauuucccucuacacacugcuuuaaaugugucccagagauucugguauguugugccuuuguucucauugguuucacagaauuuauuucuugcugccuugauuucguuauuuagccaguagucauucaggagcagguuauuuaguuuccauguaguugugcgguuuugaguuuucuuuucucuuuucuuuucucuuuucuuuuccuuuccuuucccuuucccuuuccuuuccuuuccuuuccuuucuuuucuuuucuuuccacccugcccuccuuucuucuucuucuuuuuuuuuuuuuuuuuccgagucucacucuguugcccaggcuggagugcaguggcgcgaucucggcuuacugcaagcucugccuccuggguucacgccauucuccugccucugccucccaaguagcugggacuacaggugccugccaccacgccuggcuaauuucuuuuuguauuuuuaguagagacaggguuucacuguguuagucaggauggucucgaucuccugaccuugugauccacccgccucggccucccaaaaugcugggguuacagaugugagccaccgcacccggcugagugaguuucuuaauccugaguucuaauuugauugcacuguagucugagggacuguuuguuaugauuuucauucuucugcauuuucugaggaguguuuuacuuccaauuauguggucaauuuuagaauaagugcuauguaguacugaggagaauguauauucuguugauuugggguguagaguucuguagaugucuauuaggucugcuugguccagaccugaguucaauuccugaauauccuugagcugaguucaaguccugaauauccuuguuaauuuucugucucguugauuugucuaauauugacaauggggcuuuaaagucucccacuauuaccgugugggagucuaagucucuuuguaggucgcuaagaacuugcuuuaugaaucugggugcucuuguauugggugcauauauauuuaggauaguuagcucuucuuguugcauugauccguuuaccauuauguaaugcucuucuuugucuuuuuugaucuuuguugguuuaaagucuguuuuaucagagacuaggauuucaaccccuguuuuuuuuuguuguuuuguuguuguuguuauuuuuugcuuuccauuugcuugguagaucucccuccaucccuuuauuuugagccuaugugugucuuugcacaugagaugcgucuccugaauacagcacaccaaugggucuugacucuuuauccaguuugccagucugugcauuuuaauuggggcauuuagcucauuuacauuuaagguuacuauuguuaggugugaauuugauccugucauuaugaugcuagcugguuauuuugcccauuaguugauguaguuucuucauaguguugauggucuuuacauuuuauuauuauuauuauuauuuuugcagugacugguacugguuuuuccuugccauauuuagugcuuccuucaggaggucuuguaaggcaggccugguggugacaaaaucccucagcauuuaccugucuguaaaggauuuuauuucuccuucacuuaugaugcuuaguuuggcgggauaugaaauucuggguugaaaauucuuuucuuuaagaauguugaauguuggcccccacucucuucuggcuuguaggguuucugccaagagaucugcuguuagucugaugggcuucccuuuauggguaaccugaccuuugucucuggcugcccuuaauauuuuuuccuucauuucaaccuuggugaaucugacgauuauguguuuugggguugcucuucuugaggaguaucuuugugguguucucuguauuucuugaauuugaauguuggucagucuugcuagguuggggaaguucuccuggauaauauccugcagaguguuuuccaacuugguuccauucucccugucacuuucagguacaccaaucaaacguacguuuagucuuuucacauagucccauauuucuugucuucacacuuuauuucaugaaguugaucuucagucucugauauccuuucuuccacuuggucgauucagcuauugauacuuauguaugcuucucgaauuucucaugcuguguuuuucagcuccagcaggucauuuauguucaucucuaaacugguuauucuaguuagcaauuccucuaaccuuuuaucaauguucuuagcuuccuugcauuggguuagaacauguuccuuuagcucggagaaguuuguuauuacccaccuucugaagccuacuucugucaauuugucaaacuuauucuccauccaguuuuguugcuggugagaguugugauccuuuggaggagaagaggcauucugguuuuggaauuuucagccuuuuugcacugguuuuuccucaucuuuguggauuuaucuaccuuuggucuuugcuguuggugaacuucagauggaguuuuugcguggucguucuuuuuguugauguugaugcuuuugcuuucuguuuguuaguuuuccuucuaacagucaggccccucugcugcaggucugcuggaguuuacuggggguccacuccagacccuguuugccuggguaucaccaaugaaggcugcagaacagcaaaguuugcugccuucuccuaccucugaaguuuugucccagaggggcacccgccagaugccagccagggcucuccugugugaggugucugucgaccccugcugguaggugucuccccaccaggaggcacgggggucagggacccacuuguggaggcauucugucccuuagcagggcucgagggcuguccugggagaucugcugcucuauucagagcuggcaggcaggaacguuuaagucugcugaagcugugcccacagcugccccuucccccaggugcucugucccagggagaugggaguuuuaucuauaagccccugacuggggcugcugccuuucuuucagagaugcccugcccagagaggaggaaucuagagaggcagucugggcuucacccaguuggaaauucccagcggcuuuguuuacacugugaggggaaaacugccuacucaagccucaguaaugguggaugccccuccucucacaaagcuugaauauccuaggucgacuucaggcugcucugcuggcagucagaauuucaggccagucgaucuuagcuugcuggacuccuugggggugggauccacugagcuagaccacuugccuuccuggcuucagcccccuuuccagaggagugaacgguucugucuugcuggcauuccaggcgccacuggaguaugaaaagaaaacuccugcaacuaucucggugucugcccaaauggccgcucaguuuugugcuugaaaccagggcccuggugguauaggcacccaagggaaucuccuggucuguggguuucgaagacugugggaaaagccuaguaucugggcuggaacaguccucauggcuucccuugguuaggggagggaguuccccaacccguugugcuucccgaaugaggcgacacccccacccugcugcugcucacccucugugggcugcacccacugucuaaccagucucaaugagaugaacuggguaccuuagucggaaaugcagaaaucaccugccuucugcguuggucuugcugggagcugcagacuggagcuguucuauuuggccaucuugcccgggaaucccucauguacuuguuauuacaugaccauaaguuuuuuauuucucuaugacagugggucucaacuaggagugauuuuaccucucagggaacaugggaaaugucugaagacauuuuugauuguaaugacuaggaaagaaaugcuacuggugucuaguaaauaaaacauagaggugcuguggaauauccuagaaugcacaagacaguccuccacaacaaagaauuguuucaaaaugucagugcugagguugagaaacugcacuaggauuaagacccaggagugugauuauugaguuguacguaaguauauguuuaauuuuauaggaaacugccagaguguuuuccagagugguuauaacauuuugcauuuccaauaacaaugugugagagaucaaguuccuccacauccucaucagcauuuauacugucaguauuuuuuauauuuuuauuuuuuugagauggagucucacucugucacccaggcuggagugcaguagcaugaucucagcucaguagcaggaucucagcucacugcaaccucugccucccggguucaagcgauucuccugccucagccucccgaguagcugggacuacaggugcguaccaccacgccuagcuaauuuuuauauuuuuaguagagaugggguuucaccauauuggugaggcuggucuugaacuccugaccuugugaucugcccaccuuggccucccaaagugcugggauuacaggcguaagcuaccacgccuguccacugucagauuuuuuuuuuuuuuaauuuagccuuccugauugguauauagggguuaucucauuauugcuuuaauuugcauuucucuacuacugacaaugaacauuuuuaauaugcccauuuacuaucuauauguuuucuauuaaaauuguuuugcucauuuucuaauugcauuuuuuuuacuguugaauuuagagaaucuuuauauauucuggauacaaauucuuuauuagauuucagacuugcaaauuuuuacauuguacaaaaccaaguuuucuuauucuauuuauuguuacuauuguaauuuguuuugaugcucaaaauacagauuugguggccgguggcagccccuucaagcuggcucuauauccuuuuuguauguccccgucaucuuuugaucaugucuuugcuuucuggcacaagauauuucaggcucaucuuauacuuuucuuucuccagcucuggaaucaacuacuucuccaagaagccuguucuuccaguggaaugugcuauuuagagguuaggauuuaaacacuaggcauauguguugcucccagcccuacacuuauuuacauuaauauuuauuucucuaucuguauauauuaaaaaccauauguucaucucauuuuuuacuuuuuucuuuguuuuuguaacuuucauaucuaauagugaguaaccucacuuccagugugcuuuauauaacgaauucucucauuucuugccaaccucuccccagcaaggaugacccuaacgcuccacuuggauucaaacacuuuauugucugucuccuuggguggaugcucuuuucacccugcuugggcuuuggcauuccaugcuagaccacuccucaacauguauagcaccccucccuacuuggucucugacuucccugugucagaaugcucaucacccucaacguauggacacucuccccaccccacguagguucugacuccccaugcugaacuacccccucacauggauuucuuccucaugcugcauaggcucaugacaccucacauuggucucccucuacuuggaugcccucaucuuguuuaggauuugacucaagaugucaggcuacgccauuuagacagccuccucacucagguucugacauucaaggucagacugacuccugucacccugcuugaguagugacucaccacacugcccuuacccuguaugacacccuucucauccugcaggaaaucugacuucccagccuaggcuaucucucuguguagguauuuuccuucucuacugcagcucugccacuccauguaaggccaccccaguguggagacaccuaccucauucugcuugggcucuaacuccacaugucugguggaccucccucuucauggaagcccuccauauccugauuuggugcuuuuauugcacacuaagccacacgucugcagagacugucuucuugcccugcuugaauucuaauacucugugcuaggacacuucuuuacaugggcaccuuccuuacccuaaugagauucugauaccuugcucuggcccguugucacuccauuugcuacagauucccgccuuguucugccuaccuaaugguuuuaagauuguauuguuugggaugggaaagauaaaagaaagggagaauagaaacacaggagaggggaaagagaauaggaagcuuauuuuuuguuacuuugugauuaauauaucuuuucucuccuuuuacuuucaaccuaucugugaccucacaguaaagugcaucacuugucaaugucauaugguugaauguuauucauuuuuaaucuugucuguuaaucuuuaucuuauaacugagauauuuaguucauuuacauuuaauauaauuauugagcuaguugauuuugcuauccucuauuauuuuagauuaauuaauuauuuuuauuccaugcuauuuucucuauuggcuucuuuuacuuuuuuuucuuuuagugguuauucuagagauuauaauauacuuccuugacuguauaguuuaccuuaaauuaguacuuuuuucgcuuuaugagcagcaaaguaucuuaggacaguugaacucuauuuacucacuccuccuauuugugcuuuuguugucauauauuucuguucuacauguucugaaucccacaggacauuauuauuguugcuuugaacaaacaacauucuuuuccauauauauguauauaagaaauauaaagcaacguaaaauauguauauauacacaagaguguauguauguauauguacauguauauauuuacauacacacauccuuuaaguguucugcauucuuucuagcaguucuguacuauguuggaucauuuuccuucagccuaaaaaauuuccuuuaguauuuccugaagucuucuggggauuaucuuaguuuuuauuuguuugguuuaagaaauguauuucaguugguuauagaauuguagguuuuuauuucagcacuuuaaagagcuacuaucuuuguugaaaggccaagugucguucuuauuuuugcaccuuugauuuucagcaguuuggcuuugaugccccaagaguugguuuuucuuaguauuacuuuguguucacugagcuucuuaacucaguagauuaagucuucuaccuguuuuggaaaauucuuacccauuaacucauaaauauuguuucugcacucuucccucuucuccuaggaguaagauuacacauguauuggauuauaugacugugccccgugagucucuuaugcugucauccguucguucuuuuuauguuuggcaguuuucuguagacuuuuugaauuuacaaauuauuuuuacacagugucuauuugcuucuacuacaguugaaucagauuuuagauaauguauuuuuauucugaaauauucauuucuuuuuuuaauagauuguaguuuucuguugagauuuuccauauuuuaucuauuucccuuuaucuuuugcucucaauauauuaauaaccauuuugaagucuuuuugugcuaacuaguagcuaaauccccuguaaaucaguuuuucuugucuauuuuuuccucucaauuuuugaucauuuuuuccugcuucauauguuacauaauguuuuguguguuggauauuguaaauaagaggauaauagagauugaggguauuugcaucuagagggacuagaaaaacaagagcaagccaaccccaaagcuaacagaagaaaauaaauaacgaaaauuagagcugaacuguaugaaauugagaugcgaaaauccauacaaaagauuaacuaaaccaaaaguugauucuuccaaagaauaaacaagauugacagaccacuaacuaaauuguuaaagaaaaaagaagacaaaauaaguacaaucagaaaugacaaaggugacauuaucacugacuccacagaaauacacacacacacacacacacacacacacacacacacaaacucagagacuauuaugaacaccuauucacacacaaacuaggaaaccuagaagaaauggauaaauuccuggaaauauacaaucucccaagauugagccaggaagaaauggaaaucaugaacagaccaauaaugaguucugaaauugagucaguaauaaaaaacuucuucacgacaaaagaaaccgucagcauaguaaaugaacaacguacagaaugggacaaaauauuugcaaacugugcauccaacaaaggucuaauauccagaaucuguaaggaacuuaagcaguucaacaagcaaagaacaacccuauuuaaaaaaugggcaaaggacaugaacagacgcuucucaaaagaagacauacuugcagccaacaaauauaugaaaaaauguuccacauuacuaaucauucaagaagugcaaaugaaaaccacaaugagauaccaucucauguuagucagaaugucuauuaauaaaaaguaaaaaaaauaacagguguuggugagguugcagaagaaagggaaggcuuguacacuguuggugggaacauaacauaguucagccacuggggaaaacuguggagauuccuuaaagagcuuaaaacagaacuaccauucaacucagcagucccauuacuggguauauacccaaaacaaaauaaaucauucuacugaaaaaacacauauaaucaauaucauauuauugcuauucacaauagcaaagacauggaauacaaaaaacaauuuuugcuuuaagccugacagaucuuugguuuuucaacaacuaaauauuguaagaacucaguugaggcuuucagguguuugaacucagcucuuuagacucuuugcccucacaacuuuagaauaugguaaauguuguaaggggaacaacagucaugcauuucuugcaguuaaacuuucucaagggaaauucauuucauuaguacucuugcaaauaauuuuacuguuuuucugacucagccccuuuauugggguuggcccuucugacuuuugacugagagucuagugagucuuuaauuccuuaccuuuaaaaguucucucccucaagcauuaguuauuaagcccccugccuuaagcagguacaacauuuggcaaauguuuuaaggaggagagcugauguguguuugucccaggccucuccaucuagugggacuugguuucuuauagugccaugaguaugaaugagauuucagucuauuacucugacucagcccccagccucccauaccaccaaaaaaagggaaauugaccuuuuuuuucuuuucucauaauuguccuuuucaauuagugaaugguagacauacgguagagacucaaaaguucuacuuuugugauauauucuagauauuacucuaauacaauaugacauuauucucuuuucuugaaacuuuauuuucaagugauuuuuugaaaguuuuagucuuuuuuuuuuuuuuuuucuuauagagacaagguguugcucuguuacccaggcucuggaguacaguggugcagucacggcucacugcugccucgaacucuuggucucaagcaguccuccugccucagccuccucaguugcugggacuauaggcgcaugccacugugccuauuuuuuuuauguuuuguagagacgaucuugcugcauugcccagggugaccucuaacuccuuggcucaagugauccuccugccucagccucccaaagaacugggaucacagaugugaggcacugugccaggccuuauuuucaaguaauuuuagaguuacaaaaaagaaacacguauaguagaguuccuuauaccacucuucuagcuucuccuguuguuaacaucuuuuuuuuucauuuuauuuuuauuuuuauuuuuuugaagacagaguuuugcucuuguugcccaaguuggagugcaauggcgcaaucucgguucauugcaaccccugcccgcuggguucaagugauucuccugccucagccuccugaguagcugggauuacaggcaugcaccaccacgccuggcuaauuuuuguauuauuaguagagaugggguuucaccauguuggccaggcuggucucgaacuuuugaccucaggugauccacccaccucagccucccaaaauacugggauuacaggcgugagccaccacgccugaccuauuuuuuauuuuuaaacuuuuagguucaggggguacauguuccaauuuguucuauagguaaacuugugucauggggguuuguuuuacagauuaugucaucacccagguacuaagcgugguacccaguaguuuuuuuuuuuuuucuguuugucuccccugucccuccacccucaaguaggccccagugucuguuguuccccucuuuguguccaugaguucucaucauuuagcucccacuuauaaaugugaggaugcaguauuugguuuucuguuccugcauuaguuugcuaaggauaaugaccuccagcuccauccauguucugcaaaagacaugaucuuguucuuuuauauggcugcauaguauucuaugguguaaguguaccacauuuucuuuauccagucugucauuuauggggcauuuagguugauucaugucuuuguuauugugaauaguacuauaaugaacauuugugugcacgugucuuuaugguagaaugacauauauuucuuuggguauguacacagcaauggauugcugagucaaauggugcaucugguuuuagcucuaugaggaauugccacacugcuuucuacaaugguugaacuaauuuacacucccacaaacaguguauaaccacucccuuuucucugcaaccuugacagcaucuguuauauuuugacuuuuuuauaacagccauucugauugaugugaaaugguaucucauugugguuuugauuugcauuuauguaaucagugauauugagcuuuuuucauaugcgugguggcugcauauauaucuucuuuuaaaaagugucugucauguccuuugcccacuaaguuccuuguaaaugcuggauacuagaccuuuaucagaugcauaguuugcaaauauuuucuuccauucuauagguugucuguuugcucuguugauaauuuuucuuuugcugugcagaagcucuuauguuuaauuagaucccacuugucaguuuuugcuuucguugcaauugcuuuuggugucuucgucgugaaauugccuguuucugugucuggaaugguauugucuagguugcauaugugguauccacaucaucacuggugauguuaacugaucacuuggauaaggcagugcuugcuaggugucuccaagauggaaauaaguuacuauuucuuccuucuuauacucuguuuuuugaaauccagucacuuaguucagugcauacacaaaggaggaggggaagguuaagcuuaaccuucuuuggugggagguauucacaucuguuaucuggacuucuucuuaaagcaaaauuugcuucuucuuuccaauuauuuauguguucaauuauuuacuugcuccacucuguuuuaauauuaauucccuaugaucucaagauauaacugcaaccuugaaaacuccuaguucucccagaacuccuugacagaaugcucuguuucuuguuuaucuuuguacacuguguguauuuagcacaguccccuaauuuaugguggacaucuaguaauuuaaaaaaauguauuuucaauucagcugaaaaauagcauuuccucaacuaaauuauauaauuuaacauucuaaauuaaaaguagguuuuaagauaaaaguaaacaugugugauaacauuguaucaaacaaaauaaaggguacugcugaaauuuuaccuuaauaacguuugacauugauguguccacaauauauuccuauagcuacuuaaauauuccuugaaaccacuuuuggaaagagauuucagucucuaauggccaaggauauaaucugcuguauucuuucucuuuuuuggucagauuaccagagaagaugaagaccccacuuucugcuuucucugaaaaauugucaucugaugcagucacucagauaacaacagaaaguccagaaaagacccuauuuucaucugagauuuuuauuaaugcugaagaucguggacaugaaauuauagagccugguaaccagaagcuacgcaaagcuccugucaaguuugccucaucaucuucaguccaacagguuacuuuuucucgcggcacagaugguaagagaaugugauugcauuuuagauuguuagaccagcucuuuuguguaguuaucuuagaaauuugugguugugucuuucuagucagaaaaccuaauuuuaauuuaagaauuaggguccauaugauuauaucugucuuuuauuugcauagcugucaacagaauaugauuuauuauauuuuaucuuaauuucaagcacaguuaacauguagaacucaugcuguuuguguuaaaacuuaguuuugucucaucauauuugcaauaaaaaugcaaguaguucauaacaacuugaaaguaauugaggucugcuuuuaaaauggcggauaaauuaucuuguauuacaguaacaguaauguuauuacuauauagugcguauauagggagaguauguauauacuaaauacuauaacaaauagaugcauaaacaugugauagugcaaacacaauagcaguuuaucucuuacuuauaaagcaaucaccagagacccagguugucuucuugcucuguuuucuuuaaaauauauaacccaagguuauguuggauuuaccuucauggucaacaggaaggaacaaaaagcauugaggagcacauauaggagauguuuacaggucaggucuggaaguaacccaaaucacuuuccacuggccaggaauguaguuuagcuguguuuuccaaaaugaagaagaaauggauuuuggugaauagguagcagucucuaccauaaggugaacauuuagaguguuuuauaugcuauaguuucagugauauuuugauaguacuuuuaccauguaacauuuagaauuagaccaaauuguaaauuauuuucuuuuuuugaguaaguagcaggaaaauuaacaauuaaguuuccauucuuccccaaaugaagauggagacuuuacuaauuuuuaaaauauuuacuauuuuggacaagucuacucaaaguacaucuuaaguuucucuacuuauacaaaaaacuuguccaccuacacacguagauggaauauaccuaaauguaaagaaaauuguuuaguucagcauuuaaauugcauugaauuuaaguaagugcauuuauauacuaagaugguuauaauucuugaacauuuuucuugugaaauuaaagcauaccaaaaauauauauauaguuuaauaaauuaucacgaagaacaccuuuauguguugguuaccuguuguuacagugguacaguauaacaaacaaccuaaaaaaucucuaugguuuauaacagcagacauuuguuuuucuuacucacaggcuuaugggucaauuggacuuuggcugggcuggcuguaagcugcagaaaugguuugggucuguuccagauacuucuuucugagacucaggcuaaugggucaauagcuauccuagagugugguguucucauggugguggcagaaacacaagagaggaaacagcuauaaaagcagugcgcgguggcucacgccuguaaucccagcacuuugggaggccaaggugggcagaucacgaggucaggagaucgagaccguccuggcuaacacaaugaaaccccgucucuacuaaaaauacaaaaaaaaaaaaaaaaaaaaauagccggacacuguggcgggugccuguagucccagcuacuugggaggcugaggcaggaggauggcaugaacccaggaggcggagcuugcagugagccgagaucgugccacugcacuccagccugggcgacacagcgagacuccguuuccaaaaacaaaaaaaaagcauauuuuaaacuucuacugucaucaaacggaucaauuuauagaggccaugauuuaugguucauauaaacuuuuuaucaaagaaucgauauuauuugguuuaguaauaaguguuauuuucaacacugugggucaaaaguaaaauuuuaugagguguuuuuuuuuguuuguuuguuuuuuguacaaaacauuuuaagguacaaaaaaucguauguuaacuacaugacugcuuacccauuagucugaauuaacaaguuccucuaccccucuccagugcuuuuuuccuuucccggaagcagccauuauuugcuauguauucacuucuuccccuagacaggcaguccaguguaaccuuaagacuacugcauccaaacaaaguucuugagaacuucaaaaaauucuuuauuugucucagguccaucgccaugugauagucauuucugcucuggguccauuguaauuuuguccaaucguugcuguuaauuuucuccaaccugugaacugcauggcauauucagccauugcuaucaagcuuaauauauaccgauggagaaagaaaauuaauaaaucaguauucuaacaauaacuacgggaacgaccaaauagaauuggaggcuacagcuuuuuucuuuuucuuuuuccuuuuuuccugauagagugguacaaauauuccuaaguugucucagacuaagguugagguccuuuuuuuuuuuuuuuuuuuuugagauggagucucacucuaucuccagguuggagugcaguggugcaaucuuggcucacugcaaccugcaucuuccggguucaaggauucuccugccucagccucccaaguagcugggacuacaggcgcgcaccaccacgcccaacuaauuuuuguauuuuuaguagagauggaguuucaccauguuggccaggaugaucucgaucucuugaccuugugauccgcccaccuuggccucccaaaguguugggauuacaggcgugagccacugcgccuggccaaggucauuuuuuauuaauuucuugacuggacuuucuuuagaggucacuuugccaugcccagugauagaaauuaaugccucuagguguuaaucauacuccuuuuaaaaaguaaccuuauuucuuguggauaauucaggucuaucauagauuuagucagcacucuguaagcugcucuauguuuugcuuuagugauauaaaaaauguuaaguagcuagguggcuccugucccugguagaauugucccuuucuuauuucuaagaucuuccaucuaacaacacucauagucacaaagguugaaagcaaaaacuucuuaaaaagcuuguuuguucccaaaugcaugcauucuaucugguacucgguauaggcaaguaccaucuaugguucagagcauaucccaaaucccauaagaaagcauuguagacucagaaagugguguuccccagcuuaugccauaacacuuuucaguaaauagcuugcucacuuuauuuauuuauuuauuuuuuagguuuagcauaguuaugguccauaaggcauggauaaggacaguaaaucccuuuaggcaucaaccuuuugucucauuuccuucauuuggaagugaguuucuuccuuagaagcaggcuacuaacaauguggaauucauugccaaaaugucaucagaaugauagaguugccaaagauggugacacaguucuaaguaauauaaagauuauuguuucuggccaggcgugguggcucacaccuauaaucccagcacuuugggaggccgaggaggguggaucaccugaggucaggaguuugagaccagccuggccaacauagugaaaccucaucuguacuaaaaauacaaaaauuagccgggcaugauggcacaugccuguaaucccagcuacucgggaggcugaggcaggagaauugcuugaacccggaagguggagguugcaguaagcagagaucgugccagugcacuccagccugggcgacagagugagacuccuucccccuuccccaccaaaaaaaaaaaaagauuauuguuuccagaggagagcucauucuacuccaggacuaucagaaucagucuagaggauuuuggguuuuauuaacuagagaugagcaacuaggaguccaucuagaaaugguuacaggauauaagagaaaaccguggucuauaagaauaaagauaaacggaaggagcuggaggcauucggccaugagaaaugguagcuacauugaaaauucauaaucauaugagcaauacaacccuaugaaaugcucagaaauaaccuaaacaaaaauuuuaaaugaccuaaugcaggaaacacuaauccuuuuuguaaagauagaaaauaauaauuuacuaaauuaaaagguaugauucuagaauggaaggcugaauauuguaaagguaucauuuauucccacauaaauuuauacucuaaaguaauucugcacaaaguucuaauggaacuguucuuuugaacuguguaauuuaucuuuaugaauuuauuuuuauuuuuaauuugucuggguauauaguagacauagauauuuaugagguacaugagcuauuuugauauaggcauacaguguauaauaaucccaucaagguaaaugggauauccaucaccucaagcauuuauccauucuuuguguuaacaauccaguuacauuauuuugguuauuuuauuuuuuaaguauuuauuuuuuuugagauggagucuugcucugucacccaggcuggaguacaguggcaugaucucagcucacugcaaccucugccuccuugguucaagcaauucugccucagccuccugaguagcugggauuacaggcacccgccaccacgccuggcuaauuuuuguauuuuuaguagagaaaggguuucaccauguuggccaggcuggucucgaacuccugaucucaagugaucugccugcauuggccucccaaagugcuggauuacagaugugagccaccaugccuagcugucuuuugguuauuuuaaaauguacagugaauuauugacuguagacccuguugugcuaucaaauacuauaucuuacugauuauaucugacuauauuuuuauacccauuaacaauccucacuucccccacacugcucacuacccuucccagucucugguagccaucuuucucucucauguguguccaugaauucaguuguuuuaauuuuuagaucccacaaauaagugagaacaugugaaguuucuguuccuaugccuggcuuauuucacuuuauauaauaaccuccaguuucauccauguugcugcaaaugacaggaucucauuauuuuuuuuggcuaaauaguauuccauugugcauguacugccuuuguguauauguacuacauuguguauauguaauagauuaauuuauccauuaaucuauugauggacacuuagguugcuucuaaauuuuggcuauggcgaacaguguugcaauaaacauggggugcagauuuaucgcugacauacugacuuacuuuauuuugguuauauaccuagcagugggauugcuggaucauauguuagcucuaauuguaguuuuuugaggaaucuacaaacuaacuguucucuauaguguuguacuaauuuacauucccagcaacaguguacaagaguucccuuuucuccacauucuugccaacauuuguuguuguauaucuuuugaauaaaaccauuuuaacuggggugagaugguaucucauuguaguuuugcuuugcauuucucugaugaucacugauguugagcaccuuuucauaagccuguuugccauuuauaugucuucuuuugagaaauguuuguucagaucuuuugcccguuuuuaaauuggauuauuagauuuuuuuuuuccuauagaguuguuucaguucuuuauacauuauggcuacuaaucccuugucagauggauaguuugcaaauguuuccuccuauucggugguuugucucuucaguguuguuuccuuugcugugugaaaucuuuuuaacuugaugugaucacauuuguccauuuuugcuuugguugccuguauaugugggauauuacucaagaaaucuuugccaauauuuaauguccuagagaguuuucucaguguuuucuuccuguaguuucauagcuugaggucuuagauuuaagucuuuaauccauuuugauuugauuucuguauaugaugaaagauagagguuuagcuuuauucuucugcauguagauaaccagcuuucccagcaccauuuguugaagagaccgucuuuuucccaguguauguucuuggcaccuuuguugaaaaugaguucacuguagguguguggauuuguuucuggguucucugguucuguuucauugguuuaugugccuguuuuuaagccaguaccaugauguuuugguuauuauaguauuguaguauaauuugaaguuagguauugugauuccuccaguuucguucuuuaugcuuaagauagcuuugucuauucugggucuuuugugguuccauauaaauuuuaggauuuuuucuauuucugugaagaaugucauuaguauuuugauagggauugccuugaauacagauucaguggaauaccccacugcuuuagguaguauggacauuuuaacaauauugauucuucuaauucaugaacauggaauauuuuuccauuuuuuuguuguccucuucaauuaucuucaucaguguuuuauaguuuccuuuauagagaucuuucacuucuuugguuaauugcuagguauuugauuuuauguguggcuauuguaaaugggauuauuuuuaaauuuccuuuucacauuguucacuguugacauauagaaaugugaacugauuuuuguauguucauuuuuguauucugcaacuuuacugaauuuauugauuguggaggcucuagguuuuuacaaauauaagauuguaucauuugcaaacaaggauaauuugacuucuuccuuuccaaucuggaucuccuuucuaucuuucucuugucugauugcucgagcuaggacuuccagugcuauguugaauaacgguuuugaaaguaggcauucuugucauguuccacaucuuagaggaaaggcuuucaguuucuuccccauucaguaugauacuagcugugggucugucauauauggcuuuuauuauguugagguauguguucucuauaccuaguuuuuucaggguuuuuaucacgaagagauguugaauuuuaagaaauguuuuuucaucgucaauugaaaugaucaugugguuuuuguccuccauuuuguugaugaggcaucacauugauugauuagcauauguuaaaccauccuugcaucccugggaugaauacuucuuggucaugaugaaugaucuuuuuaauguguuguugaauuugguuugcuaguauuuuguugaggauuuuugcaucaauauucaugagggagauuggccuguaguuuucuuuucuuuuuucucuuuuuuuuuuuuggaugugucuuugguuuacuggucuuguagaaggaguuuggauguauucucuccucuuccauuucuuggaauaguuugaguaggauuaguauuaguucuucuuuaacuauuugguacaauucggcaguuaagccauugaguccucagcuuuucuuugcugggagacuuuuuauuacaacuuuuaccuuguugcuuguuauuggucucuuucaauuuuggauuucuuccugguugauagguuguauguuucuaggaauuuguccauuuuuuucuagcuuuuucaauuuauugguguaaaguugcucauaguagugucucaucauccuuuaaauuucugugcuauagguuguaaugucucccuucuuaaucucugauuuuauuuacaugagucuucuauuuuucuuagucuggcuaaagguuugucgauuuuguuuaucuuuucaacaaacaaacuuuuuguuucauuuugcgauguuuuucucauaucaauuuuauguauuuuugcucugaucuuuauuucuuuuuuucugcuaauuauggauuucauuugcucuuuucuaguucauuagcauacguuguuagguuguuuauuugaaguuuuucuauguuuuuuuaauguaggugcuuauaccuauaaacuuuccucuuaguacugguuuugcuguaucccguagguuuugguauguuguguuuccauuaucauuugucucaagaaauuuguaaauuucuuucuugauuucuuccuugacccacuggucauucagaaacauuauuucauuuccaugcauuuguauaguuuccaaaguuccuuucauuauugauuucuaguuuuauuucauugugaucagagaaaugacuugauauaauuacaauuauuuuugaauuuuugaacacuuguuuuguggccuaaaauaugaccuguccuugagaaugauccaugugcugagaacaauguguauucugcagccguuggaugaaauguucuguaaauaucuauuagguccauucaauguaucuucguugauuuuucugucuggaugaucuguccaauacugaaagcgggguguugaaguuuacagcuguuauuguauuagguucuaucucucucuuuagcuguaagaauacuugcuuuauauaucuggguacuccaccguuggguccauauauauuuacaguuguuauauccucuugcugaauugaccucuuuaucauuauauaaugaccuuugucuguuuuuauaauuuuugucuuaaagucuauuuugucugauaugaguauagcuguucuuccucucuuuugguuucuauuugcgugggauaucuuuuuccauccuguuauuuuuagucuauucauggucuuuauagguuaauuguguuucuuguaggaaauagaugguugggucuuguuuuuuuuugcauucauucaaccacuguaugucuuuggauaggaggauuuagucuacugcuuuuuauuuuuuauuuuagauuugcccuuuugaggcuauuuucuagauccuguaggcaugcuuuauucuuuuuuauuccuuuuuuucuuuugucuucucugacuguauuuucaaauagccugucuucaaacucacuguguuuaaucaauuuugcuguuaagagagucugaugcauucuuuagugugucagguguauuuuucuacuccaguauuucugcuucuuuuuaauuauuucagucuuuuuguuaaauuugucuuauaggauucugaguucuuucucugugucaucuugaauuucuuugaguuuccucaaagcaguuuuuuuuuuuuuuuuuuuuuugagauggacucuugcucugucgcugaggauggaguacaguggugcagucucagcucacugcagccucugccgccuggguucaagcaauucuccugccucacccucccgaguagcuggaacuacaggggugcgccaccacacccagcuaauuuuuguauuuuuaguagagacgggguuucaccauguuggccaagcuggucuugaacucccgaccucaggugaucugcccaccucggccucccaaaguguuggaauuacaggcgugagccacugcacccagccaaaacagauauuuuugaauucuuugucugaaagguuccacaucucuguuucuccaggauugguuuuuagugucauauuuaguucauuuggugaggucauguuuucauagauggucuagaagcuuguggauauuuguuggugucugagcauugaagaauuagguauuuauuguagucuucacagucugacuuuguuuauacccauccuucuugggagugcuuucaaggaauucaaagggaguuggguguuaugaucugaguuuuuggucacuguagccauaucuccauuagggggcacuucaagccuaguaacacuguggcucuugcagacuuguagagguaccaccguggagguuguauuaguccauuuucaaacuccuagaaguaugcuaccugagacugguuaauuuauaaagaaagggaguucaauugacucaguucugcauggcuggggaggccucaggaaacuuacaaucauggcagaaggugaagggaaagcaaggcacgucuuacaugggggcaggagagagugagaucucagggauaacugccacguuaaaaccaucaagaucucaugagaacucccucacuaucacaacaacagcaugagagaaacugcccccaugauccaaucaccucccaccaggucccucccucaacauguggggauuacaauuugagaugagauuuggcuagggacacagagccaaaccauauuauuccacuccuggccccucccaaauuucauguccuuuucacauuuaaaaaccaaucaugccuucccaauagucccccagaaucaacucauucuagcauuaacccaaaaguccaaguccaaagucucaugugagacaaggcagguaggucccuucugccugugagccuguaaaauaaaaaacaaguuaguuaguuccaagauacaguggggguacaggcauuggauaaauguucccauuccaaacgggagaagcuggcuaaaacaaagggauuacaggccccaugcaaguugaaaaccuggcugggcagucauuaaaucuuaaagcuccaaaauuuccuuugacuccaugucauacauccagggcaugcugaugcaagggguuggcucccacagccuugggcagcuccaccccugagguuuugcagggcacagcucccacagcuacugucaugagcugguguuuaguaccuguggcuuuuccaggugcacagugcaagcuguugguggaucuaccauucugaggucuagaggaugguggcccucuucucacagcuccacuaggcagugcccaaguagggacuauuagugggggcuccaacucacauuaccagucugcauuucccuaguagaaguucuccaugagugcucugccccugcagcagacuucuuccuggacaucuaggcauucauauauccucugaaaucuagguggaggcucccaaaguucaacucuugucuucugugcaucuguaggcccaacaccacgugaaacugucaaagcuuggggcuugcacccucugaagcaauguccugagcuguccuuuuagccacagguggagcuggagcagcugggacacagggcaccaagucccaaggcuguacagagcagcugggcccuaggcggggcccacaaaaccauuuuucccuccuaggccuccaggccugugauggaagggacucccguuaagaucucugacaugcccuggagacauuuuccccauugucuuggcuauuaacauuuggcuccucguuacuuaugcaaauuucugcagccagcuugaauuccuugaauggguuuuucuuuucuacugcauagucaggcugcaaauuuuucaaauuuuuaugcccugcuucccuuuuaaacauaaguuccaauuucaaacccucucuuugugaauguacauaacugaaugcuuucagaauaagccagguaaccucuugaaugcuuugcuguuuagaaauuucuccugccagauacccuaaaucaucucuuucaaguucagaucuccagggcaggggaaaauugcugccagucucuuugcuaaugcauagcaaaagugaccuuuaugccaguucccaacaaguuucucaucuccaucugagacuaccucaaccuggacuucauuguccauaucacugucagcauuuuuggucaaaaccuuucaguaagccucuagaauguuccagacuuucccacaucuuccugucuuccucuaagcccuccagccuguuccaaucucugccuguuacccaguucccaaguugcuuccacauguucagguuaucuuuauagcagugccccacuucuggcaccaauucuuuguauucauuuucacacugcuuuaaagauacuaccugagacugguaauuuauaaguaaaagagguuuaauugacuaacaguuccacaugguuggggaggccucaggaaacuuacaaucauggcggaaggugaaggggaagcaagacacaucuuacguggcagcaggagaaagagagcucaggggaaacugccacuucuaaaccaucaagaucuccugagaacucccucacuaucgugagaacaaggugggaaccacacucauaaucuaaucaccucccaccaggucucugccucaacauauggggauuacaauuugagaugacauuugguuggguacucagagccaaaccauaucagaaguuucugauaagauccagaagaauucucuggauuaccagguagagacucuuguucuuuuccuuuacuuucucccaaagaaauggagucugucucugugcugagcugcuuggagcugcugugacacaagcaccccuguggccaccaccagugggacuguucuagguuagaccugaagccagcacacacugguucucgccugaggucuacaggaaccacuugcuggauacugccuauguuuguucaaggcccuggggcucuacaaucagcagguggcaaagccagggagucuugugugcuuuccuucaggguggcgauuucccccuggcccuaggcagguccagaauugcugucugggagccaugaccugaagucagaaaccuuagugcuuuauucugcuguggcugaacuggcauccaugccacaagacaaaaaguucuuauucuuuccucuuuuccacaaacagaggagucacuccccauggccaccacugccccaggcuuguggugacugcuggcugccuaccacugauauucauucaaggcccaagggcucuuucgucaccuugggugaaugcuucuaggccuggaacucucacuucagggcaauggccucccuucuggcccagggcagguccagaaaugccauccauaagccaacaccuggaaucaggaacuccuggagcuuacuuuguacucuaccccucuguggcugagcuggcacuuaagcugcaaaacaaaguccuauuuaaucuucccucuccuuuucucaagcaaagggagucucuccucauagccaccauagcugggaaaugugcugggucacaccugaagccagcacaucucugagucucacccaggugaguacugccuggcuaccacugcucacuauucaggacccaaguacucuuuagucagcaggugaugaauccugccaggacuggguccuucccugcaaggcagcaaguuccuuucuggcccaggguaugucuagaaauguccaggaacuaggucauggaauggaggccucaggacucugccuggcaucucuaucauucuguggcugagcuaguauccagguugcaagagaaaggucuguuuaaucuuccgucuuccgaagugaaaggaaggacccucuccuggagcaagcugugcugucuagguuuggguauggaguggugcaagugcuucccuuggccauuuuggcuggugucuuacuagguugcauacgcccaagucagcuggcucugauuccagcacaucaccaagacuuuccugggaauuguguuucuuauugcuuuaggcuaugguauaugcuauuuuaucacagaaacccuaaauuacagguaaguagucuagagcagauagcugaguugcauaucugguggcuguggcauccuuccaucucuggaagugugacuuccauuucugggucuagaguaacugcuacagcuaucaugaucugcaguaucuaggaaguggggggcuuuaaugggauaccuuuacuggaaugccuggaaguuucacacauucuugcacucuucccaugggcugaacaaaguuacccauauguucacacauggcuguaagggagauuggaaguguauauagauguauagguguaaggagguagggaaguuggacacgaggucauauuugacaguuucuaccaaucaugaaagaaaaacuaguauauagaaaaaaaauguccauaauaguaagaugagggcauauuuuuaaaaugagauuccauuuaccucuauuagcaauuaaucauuucuuaaugacuauacacgugcuguuggaggaagaguaaauugucgcagacauauuaauaagcaauuuagcagucaguacuuuuuugaaaacuucaugaaugguguaauuuuucacuuuguaaaaagaauuuaccuuggaugggugaugggggagaauaaguauaaacaggaaaaucuuuauucacagaauucuuuauaauugaacauuuuaacacaaccugcauuuucaacauuaggcuaagaguugacuauauuuaaucugguauaaccauaaaaaugugaagaauaggaaguaaaaugaauauuuuuauuauaaauaauagaaaagcugaauuucaaauuaugcauacuauaugcagacaacuuuguaaacaaauaaaaaacaggaaaagauggguaaguuauacauuaaaauguuaacaauaauuauccuugagugguaggaccuuguaauuuuuacguuuauauauuuucuuaauauugaaaauucauacucuugcaguggaaacuauguuuugaagcccugucacauagaugagaauuagacuuauuuucuaugacucuggaagcagaauaagaccaguauaagggcuuaauuaugaccagguuaggguucgauguaagauaacauguuuuuuaguuagagucaucuauauauggaauggauugcuaaaaagucaucucaaugaaacauaucccuaccauccuacuuaaacuguuuccccugcauuuaaaccccaauuucuccuguauucuuaauuaccuucagcauuucuauauuuucccuguaucacuuauaauguauuaaaaugcuagauaauuuacucauuuaguauguuaauuauuuacuguauauuuuccuccucuagaauucucauucuucuugaaggcagagauacauuucucuuuguuuacucauaaauuccaaaagucaugaacacugccugaaacauagaaggcauuccauauuuguucaaugaauuaacaaauguuuuucauauuaauuguucugauuuuuaccuccuuaggccagccuuuauuauugccauauaagccuucugguaguaccaagauguauuauguuccacaauuaagacaaauuccuccaucuccggauuccaaaucagauaccaccguugaaagcucccauucagguauuaugcagaaauuauucgaaguuuuauuguuugauauuuuauuuguguauuggcuaguugauucuggagugacaaaaguccagugcucuuuaauuuuucagugaaauauggaacuuuucauaccuugaucucugguucagauaggugaguuauuugaucagauauauacacauaagcauuuauaaauauuugaugaaggaaauuguauggaucauuauuuggguuagugggcuccaucuagggcaaaguuucuaagcuuucuugguucacaguacccuuaguuguuucacugauuuauuuucuccgcuuuauauauaauaagcaauuauuuuuuucaaauagcaacuaaggaauuagaacauaaauacuaauuguuuuccucugacaacuaauuuaacaaauuuguuauuuauuuuugguuuugguuuuugaaaaaaaaauuuguucauaaauaacaaugaugacuuacuaaugacauauguguagcuguuggacacugugcaacuucccaaaccaugagaugagauuggacccucuuauuuucugccuuuuauuacagcagcugccaaaaauccagcuuuugccaaggcacaacagcauugaaaagaacauagcacuaucugauguugacacuuugaccuugagcuaguaguuuaucacuguccuuucccuagaauuuuaaacuauccugcagcaucccugugaauccacuacagaggaggugcagaguuaggaaaugaauaauaccccauggaggcacuagauaaauauuuccuauggagauuuuaaguuaagggugcagaguuagugugguguaggguuuugauuggugggacaguauuuugaguugucgacgggauaugacuugauucacuuuagacaaauuguuuuuuccaugauugucuauaaaugucauuauauauauagaaauuacaaagaaaggagaaguugccccuggucuuaggcagacauuuuuguuacuuugauaugaaagagaaccaaacuagcuucugauaguaacugcacuaaagccucugauacaaccucgccugauuucccacaaugauggcauugaaaaaaaagaaccacaaaaauacucaccacaaguuaagauuguuaaguuuauagccauaaaugaagaaauguuuacuccuugcaaggcuaugguuuuaaaaacacuguuaauggcuaccagaaagaaaacaagcucacuuaauugauuguagguaggaaaaucuucugucccacuuacucauaguucagaagacagaaugucuguaaacaguagaaaccuggucagaugugccaguacuuucugaggccuccaguguccugcuaucgauauacgucacuaacacuuccaucugguuggagagauuaacuuagagaaagacugaacaguguaggugaugggagaagaaaaugacucaggacuggcacacuguauccugauaaauauaguuucuguaauaaaguacuguaugcaucaguacgacaaaaagagaucuaguugccauacacacuugagauuguuuuuucauguuuucaucuauucugagagugaggaaguugggaauagaaaauaauccuuucuuagaccaguagaccuacacuggaugaaagccuagaaauuguucuaauuccuagccguuaucuaugaauauguuguacaucuauagcuaugagaggagccaauuagaguuuggggccaagagcaagacauacaucauuguuagcaaauauuugggccaaauaacuguucuucaguugagaaucaguaaauaauagaacugaugcaaacaacgacggcaaaaaacuggggcaaaggaaacagccauccaaagaaagagauaaaugucugcaaauaaaccagucuuaauagcaacccagggaguauuuauucaagaaaaauggccaaaucccacuaagcacaguaagcguuagcauuuuaacuugcccuagucccauucccaguaccucagcucagugauagccuucagaaauauagcuuucuuuuccaagaccagaggaugcaaaauggagcugggccucuuuuaaaaguuccuucccaaagaauuguuaauauuugaccuaucuagugguuccgugaagauuccacacaaaaggcuuaucuuuacuugaccugacugggagccauccagugcuaaaggccucuggugaaggggagggaaagauguuuaucaaaaacauuuacagacaaguauuuuaauaucauaauggcugagguguggacuagcaguugagguaaacaguaaacuaacuggaaagcuuaaaaguaacacccgaggauaagauguugauagauucuuugaaaggcgcugacauauuccuaagacucugggagaccccauguaugcguaggccuguguaugcucaggaaagacccaaggcgcuaggucuuaucucuggcugaccuugaggaucuguacaagaagaaaagggaaggcuaagguaaaguugacagcugccuaggucaguguugaagguacaucccaacauauguguggagccauuugaugaaggccgggagauuuauugguucuaggcauuuaaggaaaucccuguucaggcauuagcugaccauuaagcuaauugaguaguaacuucaguggccauauauaaaaagaauauagacuuuacagaauuaauucagagaaguuauuaaaacaacauaaagcaacaacaccaaacccugagauggaaguagaaucugguuuccagaguuggcgcauuguauuacuuaaauguccaggccgggugcgguggcucaugccuguaaugccagcacuuugggaggccaagaugggaggauugccugagcccuggaguuugagaucagccugggcaauguaguaagacccugucucuacaaaaaauuaaaaaucagccaagcaugauggccuacgcuuguagucccagcuacucggaaggcugaggcaugaguaucacuugaacccucgaguuuaaggcugcagugaacuaugauugcgccacugcaguccacucugggcaacagagugagaccaugucucaaagaacaaaaaaacaaaaaaacaaaggcaacaaaagaaaaauauauaugggagacuuuaucaaaauucaaaacuuuuguacacaaaacccagucaaaagaaugaaaaggugacucacagcauaggagaaaauauuugcaaaucauuuaucuguugagagauuaauaccuaaaauauguaaggaacccuuacaacucaacaacaauaacccaaacaaucugauucauaaaugggcacagaaucugauggacauuucuccaaggaagacgugcaaauagccaauaaacaccugaaaaucuucucuauaucauuaaucaugagggaaauaccaaacaaaaccauaguaagauaccacuucacacccauuacaaucacuguuauuuuaaaaaauaagcggagagagccaagauggccgaauaggaagagcuccagucugcagcucccagugugagcgaugcagaaaacgaaugauuucugcauuuccaacugagguacuggguucaucucacuagggauuguaggacagugggugcaggacagugggugcagcacaccgagcgugagccgaagcagggcaaggcaucgccucacccgggaagcgcaaggggucauggaauucccuuugcuagccaaggaaaggagugacagaaggcaccuggaaaaucgggucacucccacccuaauacugcgcuuuuccaacgggcuuaaaaaauggcacaccaggagauuauaucccgcaccuggcucggaggauccuacgcccacggagccucgcucauugcuagcacagcagucugagaucaaacugcaaggcggcagcgaggcugggggaugggcgcccuccauugccgaggcuugaguagguaaacaaagcggccgggaagcucgaacuggguggagcccaccauaccucaaggaugccugccugccucuguagacuccaccucugggggcagggcauagccaaacaaaaggcagcagaaaccucugcagacuuaaaugucccugucugacagcuuugaagagaguagugguucucccagcacacagcuggagaucugagaacggacagauuaccuccucaagugggacccugaccccugaguagccuaacugggaggcaccccccaggaggggcagacugacacuucacacggccggguacuucucugagacaaaacuuucagaggaacgaucaggcggcaacauuugcuguucaccaauauucgcuguucugcagccucugcugcugauacccaggcaaauagggucuggaguggaccuccagcaaacuccaacagaccugcagcugaggguccugacuguuacuaacaaacagaaaggacauccacaccaaaaccccaucuguacgucaccaucaucaaagaccaaagguagauaaaaccacagagauggggaaaaaacagagcagaaaaacugaaaauucuaaaaaucggagcgccucuccuccuccaaaggaacguagcuccucaccagcaauggaacaaagcuggauggagaaugacuuugacgaguugagagaagaaggcuucagaugaucaaacuacuccgagcuaaaggaggaaguucgaacccauggcaaagaaguuaaaaaccuugaaaaaagauuagacgaauggcuaacuagaauaaccaaugcagagaaguccuuaaaggaccugauaaagcugaaaaccauggcaagagaacuacguggcgaauguacaagccucaguagccgauuugaucaacuggcagaaaggguaucagugauggaagaucagaugaaugaaaucaagcgagaagagaaguuuagagaaaaaagaauaaaaagaaacaaagccuccaagaaauaugagacuauaugaaacaaccaaaucuacgucugauugguguacuugaaagugacggggagaauggaaccaaguuggaaaauacucugcaggauauuauccaggagaacuuccccaaucuagcaaggcaggccaacauucacauucaggaaauacagagaaugccacaaagaugcuccucgagaagagcaacuccaagacacauaauugucagauucaccaaaguugaaaugaaggagaaaauguuaagggcagccagagagaaaggucggguuacccacaaagggaagcccaucagacuaacaacugaucucucagcagaaacuccaauccagaagagagugggggccaguauucaacauucuuaaagaaaagaauuuucaacccagaauuucauauccagccaaacuaagcuucauaagugaaggagaaauaaaauccuuuacagacaagcaaaugcugagagauuuugucaccacuaggccugcccuaaaagagcuccugaaggaagcacgaaacauggaaaggaacaacugguaccagccacugcaaaaacaugccaaauuguaaagaccauugaggcuaggaagaaacuucaucaaucaacuaacgagcaaaauaaccagcuaacaucacgaugacaggaucaaauucacacauaacaauauuaaucuuaaauguaaauggacuaaaugccccaauuaaaagacacagacuggcaaauuggauaaagagucaagacccauccgugugcuguauucaggaaacccaucucaugugcagagucacacauaggcucaaaauaaagggauagaggaagaucuaccaagcaaauggaaaacaaaaaaaggcagggguugcaauccuaguuucugauaaaacagacuuuaaaccaacaaagaucaaaagaggcagagaaggccauuacauaaugguaaagggaucaauucaacaagaagagcuaacuauccuaaauaugugugcacccaauacaggagcacccagauugauaaagcaaguccuuagagaccuacaaagagacuuagacucccacacaauaaugugaggacuuuaacuccccacugucaacauuagacagaucaaugagacagaaaguuaacaaggcuauccaggaauugaacucagcucugcaugaagcagaccuaacagacaucuacagaacucuccaccccaaaucaacagaauauacagucuucucaguaccauaccacaccuauuccaaaagugaccacauaguuggaaguaaagcacuccucagcaaauguaaaagaacagaaauuauaacaaacugucucucagaccacagugcaaucaaacuagaacucaggauuaagaaacucacucagaaccgcucgacuacauggaaacugaacaaccugccccugaaugacuacuggguacauaacgaaaugaaggcagaaauaaagauguucuuugaaaccagugagaacaaagauacaacauaccacaaucucuggaacacauucaaagcaguguguagagggaaauuuauagcacuaaaugcccacaagagaaagcaggaaagaucgaaaauugacagccuaacaucacaauuaaaagaacuagagaagcaagagcaaacacauucaaaagcuagcagaaggcaagaaauaacuaagagcagaacugaaggaaauagagucacaaaauacccuucaaaaaaucauugaauccaggagcugguuuuuugaaaagaucaacaaaauugauagacugcuggccagacuaauaaagaagaaaagagagaagaaucaaauagacgcaauaaaaaaugauaaaggggauaucaccaccgaucccacagaaauacaaacuaccaucagagaauacuacaaacaccucuaugcgaauaaacuagaaaaucuagaagaaauggauaaauuccucaacacauauaccuucccaagacuaaaccaggaagaaguugaaucucugaauagaccaguaacaggcucugaaauugaggcaauaaucgauagcuuaccaaccaaaaaaaguccaggaccagauggauucacagccgaauuguaccagagguacaaggaggagcugguaccauuccuucugaaacuauuccaaucaauagaaaaagagggaauccucccuaacucauuuuaugaggccagcaucauccugauaccaaagccuggcagagacacaaccaaaaaacagaauuuuagaccaauaucccugauaaacauugaugcaaaaauccucaauaaaauacuggaaaaccgaauccagcagcacaucaaaaagcuuacucaccaugaugaagugggcuucaucccugggaugcaaggcugguucaacauucguaaaucacuaaauguaauccagcauauaaacggaaccaaagacaaaaaccacaugauuaucucaauagaugcagaaaaggccuuugacaaaauucaacaacccuucaugcuaaaaacucucaauaaaugagguauugaugggacauaucucaaaauaauaagagcuaucuaugacaaacccacagccaauaucauuacugaaugggaaaaaacuggaagcauugaaaacuggcacaagacagggaugcccucucucaccacuccuauucaacacaguguuggaaguucuggccagggcaaucaggcaggggaaggaaauaaaggguauucaauuaggaaaagaggaacucaaauugucccuguuugcagaugacaugauuguauaucuagaaaaccccauugucucagcccaaaaucuccuuaagcugauaagcaacuucagcaaagucacaggauacaaaaucaguguagaaaaaucacaagcauuccuauacaccaauagcagacaaaccgagagccaaaucaugagugaacucccauucacaauugcuucaaagagaauaaaauaccuaggaauccaacuuacaagggaugugaaggaccucuucaaggagaacuacaaaccacuacucaaugaaauaaaagaggauacaaacaaauggaagaacauuccaugcucauggguaggaagaaucaauauugugaaaauggccauacugcccaagguaauuuauagauucagugccauccccaucaagcuaccaaugacuuucuucacagaauuggaaaaaacgacuuuuaaaguucauauggaacaaaaaaagagccugcaucgccacgucaauccuaagacaaaaggacaaagcuggaggcaugacgcuaccugacuucaaacuauacuacaaggcuacaguaaccaaaacagcaugguacugguaccaaaacagagauauagaccaacggaacagaacagagcccucagaaauaaugccgcauaucuacagcuaucugaucuuugacaaaccugagaaaaacaagcaauggggaaaggauucccuauuuaauaaauggugcugggaaagcugccuagccauauguagaaagcugaaaguggaucccuuccuuauaccuuauacaaaaauuaauucaagauggauuaaagacuuacauguuagaccuaaaaccauaaaaacccuagaagaaaaccuaggcaauaccauucaggacacaggcauggucaaggacuucaugucuaaaacaccaaaagcaauggcaacaaaagccaaaauugacaaaugggaucuaauuaaacuaaagagcuucugcacaguaaaagaaacuaccaucagaaugaacaggcaaccuacagaaugggagaaaaauuuugcuaucuacccaucugauaaagggcuaauauccagaaucuacaaugaacuccaacaaauauacaagaaagaaacaaacaaccccaucaacaagugggcgaaggauaugaacagacacuucucaaaagaagacauuuaugcagccaacagacaugaaaaaaugcucaucaucacuggccgucagagaaaugcaaaucaaaaccacaaugagauaccaucuuacaccaguuagaauggcgaucauuaaaaagucaggaaacaauaggugcuggagaggagguggagaaauaagaacacuuuuacacuguuggugggacuguaaacuaguucaaccauuguugaagucaguguggcgauuccucagggaucuagaacuagaaauaccauuugacccagccauuccauuaacuggguauauacccaaaggauuauaaaucaugcugcuauaaagacacaugcacagguauguuuauugcggcacuauucacaauaacaaagauuuggaaccaacccaaauguccaagaaugauagacuggauuaauuaaauguggcacauauacaccauggaauacuaugcagccauaaaaaaugaugaguucauguccuuuguagggacauggaugaagcuggaaaccaucauucucagcaaacuauugcaaagacaaaaaaccaaacacugcauguugucacucauaggugggaauugaacaaugagaacacauggacacaggaagggaacaucacacacuggggccuguuguggggugggggaagcggggagggauagcauuaggagauauaccuaauguuaaaugacgaguuaaugggugcagcacaccaacauggcacauguauacauauguaacaaaccugcacguugucacauguacccuaaaacuuaaaguauaguaaaaaaauaaauaaauaaaaaagcaaagaauggaaaauuaucaguguugucagggacauggagaaauuggaaccauugcuuauugcuggugggaauguaaaaugguauagccauuacggaaaacauuguggcuauuccucaaaaaauuaaacauagaauuauaguaugauccaguaauuccacuuuuaaauauauaccccaacaaagugaaaguaggaucuucaagagcuauuuguacacccauguucauaacagcauuauucacaguggccaagagguggaaacaacccaaugucuauugaucuaugaauggauaacaaaaugugacauauauguguaauggaguauuauucagccuuaaagaggaaugaaauucugguacaugcuacaacauggaugaacucugaagacauuaggccaacugaaauaagccagucugcuuauaugagguaccuagaaaagucagauucauggagacacaaaguagaauuguguuuacuaggggcuggggcuagggggagugggaaguuacuauuuaauggguacagaguuuaagucugggaagaugaguagguucuggagauagaugguagugaugguuacauaacagugugaauauacuuaaugccacugaaguguacacuuaaaaaugauuaauuuuuugugguuuuuuuuuuuuuuuuugaaacagagucuugcuuuguuacccaggcuggaguacaguggcacaaucucagcucacugcagccuccgccucccagauucaagcaguucuccugccuuagccuccugaguagcugggauuauaggcacccaccaccacgcccagcuaauuuuuguauuuuuagcagagaugggguuucaccauguuggccaggcuggucucaaacuccugaccucaagugaucuuccugccucagccucccaaagugcugggacuauaggcgugagccaccgcacguggucaugguuacauuuuauguauauuuuaccacaguuaaaaaaacuuaagaaguuaccaaaaaucuuaauugaauuuuaaaaguagaugucuauguuccaaaucaggguugaguauacgaaauuagcaaaguaacagaacgagaaauacaggaaacuuuaagauagcauaaacaguuaaaucagaugaguggaauucggugagaugucuuuagcugugauaaauaauuuuagcauauguugauauugucucaugcauguauuuaacuuaagcaaguucaaauaaauauacuuaacaaaagaggagagaaagaauuuuaaaagugcagguguuuugugcaugcacucuacccuuuaugaacauaugacuacggaagaauauguaaugaaagaugggaaacuucauucucaaaauuaauuguaguccucguuugccuuuuguaguguaggcaucuuaucuugcuuauuuggguaugauucuagaguuugaagaaaugucuuuuugguacaauaucagauacuucaucaggugcucagauucaggugcagugcuauguuacaagcuuggaggaaaaaguggacccucauggguuucuugagcagacacgaugucaauuucaacauaugccuuccuaagguaccuucaagggugauuuugacccucuauagcaagguuuucaccucacaugcugacuuuaaacccugaauuccauuuaaaauguaucucuacuuuagugaaaaaauaguaaugagacuguauaugguaugaucccuguaaauguucacuuaguaggauauauaaccaagguuuaguuggguuuucuuuuauuguuuccuucauacuuuccugaauuuucuacaaugaucagguuguuuuguuuguuuguuuguuuuuaaugaugggaagcugucagcucacguucauuuguuuauucaaacaauagguauuaaagauguuacuguguuccacgcagauacacugugguagguguuacaauuucaguauugcucaaaauaaacuauaauggaguuuauguucacguugguugacagauauuaaacaaauaaaccauaaauaaguacguaauuacaagugauaaaugcuaagaaaauaagaagaguuccaagauaaacaaguagacccaguuuuguuuuacgaacuuaugaagaucuuuuccaggaagaaacuuuugagcugaacucuagaggaugggaaugaauuagguaggcagagaguggagugugagaauguuccggcgagagggaagaagauggggaaagccccugaagcagaaaagagcuugaugcauuugacaaauggaaagaaggcagcguggguugaaauuccaacaaauuuaaagaucugauugguuuuuguagugauucaugaaucaggcaacaucccauucuauaauauggaaagggugcacugggcaugggagagaguugguucugguaagguagccagaccaggaacaaggaaacacaauacagacaguccccaauuuacagugguuccguugaacuauuuuuugacuuuaugaugguauggaaaugauacacauuuaguagaaaccguacuucaguacaguauuuaauaaacuauaugaacuauuugauacuguauuauaaaauagacuucauguuagaugauucugcccaccuguaggcuauuguaaauguucugauuauguuuaaaguaggcugggcuagguuaugaugcuugguagguuaggggcauuaaauacauuuuugacuaacaguauuuucaaccuaugauggacuuaccaggacauaacuacauuguaagugguggaucaucuguaauaccaaaaaaagcauauugauuaacaucagguuacuuaccugguaaagauuaaagcagagauaaguuccuuuuuacgccagcucagggugacuggccccuuuuucaguuaguugcugugaaucucuuguuuuuagaaaaaacugguccauuuuggaacuuuccuucuuucuuaaaguuucaguuggauuguauggcauuuaguacaagugacuacauuuugguuuggucucuuggggcuuagugcaggagcucagucuaaaacaauggacucccauaaauuuuauuuaacaggguagagcauagugauggguagauaugguuaaagauagguggguucaagaucaugcaggaucuuaucaacuguauuaaaguguucggauuuuauucuaguacuacugcaauuaugguuugauuuauacuuguaaaguuuauucuugccacuauauggagaaaugguuuauagaugggaaggcggagagccauggcggggcggguuagagugcaaguagagacaccaguuaguuagaaggcuguugcuuuagacaguaccagagaugguagcaugaguaucacaguguuaucuauagagauagggagaaauggacagucagcauccuuuuagaaauaguuucuccuagauuuggugauaggaguauggagagugagggagaagagcgugaaaaaaaugucuggcgugagcaacuaggugaauagaggugccauuuacugagguggagauugaggaaaaagcagauuuggggaagaugaucaaaaugucugcuuuggacauguuaaaaaugagauuccuauuauacauccacauagagauguugggucuacaauugaauguaggcagaguuaauuuacacauguuaagguaauagugccacauauaagguggcauuauucacauuauaaauauauacuuuuaugaaaacauacagaugggcaugaauauuccagaucuuuaguuagaguucuggagcaauaauguuaacucuugugcugccccaaacauaaaucuauacucgcacauacuauagcuaugcacagguacaggaaaauaaguauauguacauucacugacacgcacacauguguggcugcacucucucagcugccucucaccuccucugagguugauucucuugcuuauucacccacugcucucagggauguaauuguuccucaccugacucugaacuugaaagggucaucucucuuggagaacgaggggugguggugcagacugugcgugcacaugcugcugcugguguguacucccugggagaauuugugaaaagaaugaccaccauuuacaguuguuuguguuguacuacaauauauaguaacuuaaacauuuugauuugaagaagacacaucuuuucuaauuuccauaaaagugcuguaagagcuagccgugucccugaaugcuggagucggaugcucagaagaaagguacucuugggcaaugguacauuauuuguuggucaucagcauauaccuugguggucgauaaguuuaccuaggaagagaagagaggccaguuccgacuccuuaaggaacuccaccauugagagauuugguagaagaaaauauaaaaaauaaguuuccggagagguaagaggcaaauaagagaaagugauguuacagaaguugagaagaacccaauauaaucuauuuggcccagaaggcuugguguuuuccuugcagucuguccugcaaaacucuucagggcuuacugugcacuguacuaaugauacagguacuuacccagcucuuauugccauauacauacuaggagcucaggaaauagaggaucuuagaaaaaucaucucauaggagauuaguauaagccuuuauauguccagaaauguucuuuugccuguuagauguggcauggauuauagauuaauuuauuuuaucaaggaaugugggaauauugaaauauauuuuaaaagaaaauuaaauacuuucaaaucuuuuacuuaucaucugucauuuuccauucaguguuuugucuuuuguauugucagauuaaucuucuggaaacauagcuaaauauauuauuauuuuguugaaaaaucuuccguuauguugcauuuuauauacaauaaaguuuauacucuucagcuugggaucccaugcacuggugaauuuugucccaaacaacuauuuuuuaauaucuucuaccacuguccuuaauguauucugcaauccaaccugaccauaaaguguccacuauuuuuaaauacuucuuuucuuugcuuaugcuauaacuucugccuaaaaugccuuucuuccuuccucucuauaucaaaaaacuacuuuuuuuccaagauacaauccauuuucuccuuccuccaaaaccaucaugagcuggaaauauucucucuccugaacugauucuccauuuuacaucuucuuuuauaucauuugcaucucugccuuguauuauuagaauuuauuuuacauggcuuacaacuucaguuugacugacguuuccuucugauuauccuacccauuguaguguaguguuuuuuuguuuguucguuuguuuguuuguuuguuuuuuaagaccaagucucacucugccacucaagcugcagugcgguggcaacaucucugcucacugcaaccucugccucccagguucaagcgauucuccugccucagccucccaaguagcugggauuacacgcaccugccaccacgccuggcuaauuuuuguauuuuuaguagaaaugggguuucaccaucuuggccaggcuggucuugaacuccugaccucaggcaauccgccugccuccaccuuccaaagugcugggauuacaggcaugagccaucgugccuggccuguagugcuuuuuucauagaauuggucuaagaggcaaauuuuuaaaaagucuuucucaaucucaugucgcuauuuguguuuuguauuacuuccccguuuuucuguaggauccaaugaugccauugcuccagacuucccagcucaggugcuaggcacaagagaugaugaccucucagccacuguuaacauuaaacauaaagaaggaaucuacaguaagaggguagugacuaaggcauccuugccagugggagaaaaacccuugcagaaugaaaaugcagguaacuggauuggcuuuguauacuuuguagcuuuuucuccccuuuucauccuaaaugagauuacuauccaaucuuuauccuuuuuuucuguuuuguuauacaagcuuuucuccuugcuguuauauugagcauauacaagaaggcaaaauuucauaaaauccuuuaauaauaaaggaagcauaagcuucagagauuuuugaaaauuauaaacuucauuuucacaacggauaauaaaauaugauacaacuuuugaaaugaaauaauacccaaucaaguauguuuuagauacuaagauccacagaaaaucuugauuaaaugccacauuaguuuaucucugucagauauuacaaaguaaugucuuauaggcuggauucuguagggagauauguagcugacaugauuuuuuuuuuuuaauuuuuuuaaagacagggucucacucugucacccaggcuggagugcagugaugcaauuauagcucacugcaguguugaacuccuggacuccagugauccucccaccucagccuucugacuagcuggggccagaggcacacaccacuaugccuggcuaauaauuuuuuuauagugaugggggguuuuuuguagugaugggggucucgcuauguugccugggcuggucuugaauuccuggccucaagcugucuaccagccucagacucucaaagugcugagauuacaggcaugaaccaccgcauccagcccccauguuguuuuaaaauuuuuaaaauuuuccaccaacauucaaaacuaagauuuuugauuuuccuugaaaaaucagaaaaucugacugcccuuuggcucgcauucauucauggugguaaucagcugcagcugagccauggcugucccccugcaggcaggacauccauucucuuguuugcuuccaucuccacagcucugagacccagucugcuucauucauccaccuuaucugucugcugaucacuguggguauuugaguuucaaucuuuuuuuuuuuuuuuuuuuuuuuuuuuugaguuggaguugcgaucuuguugcccaggguggagugcgauggcgcgaucuuggcacacugcaaccuucaccucccggguucaagcgauucuccugccucagccucgaguagcuggguuuacaggcacccgccuccacacccagcuaauuuuuuguauuuuuaguagaggugggguuucaccauguuggccaggcuggucuugaacuccagaccucagaugaucugccugccucggccucccaaagugcugggauuacaggcaugagccaccgugucuggcccccacuguuuuauaaaagcuuuuuuucuucugcaccccugccauuauacuuuuguagcugauagaugauaauauuuauuaaaugaaaacuccaguagccacugaaaauucuguguguauaauugccuguguuuguuacauuuauacuuuuuuauuccuguguauaacuauuagcuaaauaggugcuacugaucccagggcaguuuuuaaauguaggguggcucuauguucuaguuuuggcauaguguuaaugacuuugugugauagcaucagugccuuugugagaaaaauaaaugagaucugcaugguuuuuuuuauuuuauuuuauuauuguuauacuuuaaguuuuaggguacaugugcacaaugugcagguuaguuacauauguauacaugugccaugcuggugugcugcacccauuaacucgucauuuagcauuagguauaucuccuaaagcuaucccuccauuuuuuuagauaauuucguucuacuucaaaacacagugaagucuuuuuauaaaucccuuuugaaauaagagaagcauaucuaccagcuaacauugagacugccaaguaaauaaaaagaaauaauuuuacaaaauauaguucauaaaugaaaacucuucugcaccagggaauccguuacguguuuuccacuauccauaugcuaguggcaguuugguugaaacagauaagccuaagaucccagugucagauacuucaggugaguguagauguggaaaaauuggcaggaaagaagugaacucugucagaagucugcacaaagaacucaccagcuuuaccucacucccaggcuucauuugguaaggaugauacauuugaaauaaagucaggcucaguuaucugaggaccucuacaaucucccaucuguuggucuacuuacagacuuugcauccuaaggaaaagcccuccuccuggcuuaguccuuaguagccauuucaccuugagagaagccuagccucagaaccucuugccuuagagaauuaaagaagaauagaggagagaaugccugccugggaaacugaacaaugaccuauguaauagcuaaaugagcucauaaaauaucauaucauaaguaaaauucucaguggaagggguggaauauaaaagugagaaaaucucuucaaaaauagaacauaaagagaagggaaaagauuuuuuaaaauucaagauuguccccaaaguuucaacauucaaagcagguauucuguaaagacaauagagaaggcaaaaaagaaagaaccaaaggacuaguauaggaauaaauuucagaacugaaagaugugaguuuucauacuaaaagggacuaccauguacauaaaaauacacaccgaggcacaugaccuugacauuuuaaaacugauuugaaaagagauucuaacagcuuccaaaaagaaaacauacauuccauauaaagaaauggaaaugagacuggcaucagacuucucaaaagugauaaacagaguuagaaaccaaaggaguaauaccuuagaauucugagagaaaauuauuucacuaaaacaagggaguuuauuuaaguuacaaaagaaggaaagaaagaaaacauggugggauugaggaaauggagggggccaacacaggaaaugggaaacgaauucucacuguggcggugguacacaaggccuagaacccauucaguuugaagccugcaaggaaaaagucgaauuuguaggauaccuuaugugauugacuauacuuagaggagguuuucaguucuauuugcagcuaugaggaugaaguagggauuggcacauagaaacucagaaaaugcaaaaacaaagcgguuauuaacucuucaggaaagcagaaguuuguaauagaaaauaaauguaauuacaguauacuagcuggcuuagcugugaauaauaauuauauaaacaaucauauguaaauacuaaauauaaacuuaauugaauauugauuuaaucacucagaccauuauuuaugugacauauaaacacugaauguuaauauagggcuaaaacuuuucagaagauaggaugaaaggauauauauggguaggaggguuuuauaaugagauaaauccauagaucuuaguauauaguauaagaauaaaucccagaacugaaagaugugagauuguaauugaucuuagaaggaaaucaauagauaauuucuggaacauaaaaugauaugguaguauaaagcauguuauuaggaaauaaggauauugauccuagaauaaauggcuaaagaaguugaaaaugguagccuuuagaaauuggggaucuguaguggauaggagagggaacugcugacuuuucuuguaagccucgugaaacuauuugacuuuuaaaacauauacauuguuauuuuuauuaaaucagaauuuauauuguccuucaccucaaaaaaguaagaagaaaaaaauacauuuggcaaauacugacuaaagaaaagcuaguguugauauggacaaaauauaauuccaggacaaaaaaaaaaaaauuaaagguagauacaagaguuuaucucauaguaauaaaagggucaaauauaccaggaaagauaaaauugugagcuuauauguauauucucaaauauauucaggaaaaauuacaggaauguguagguaaauucaacaguacauuucagaaaugugaaagaccaggaaauagagaaaguagggcugagcgugguggcucauaccugaaaucccagcaguuuggggggccaaggcggguggaucacgaggucaggagaucgagaccauccuggcuaacacggugaaaccccgucucuacuaaaaauacaaaaaaaaaaaaaauuagccgggcgugguggcgggcgccuguagucccagcuacucaggaggcugauguaggagaauggcaugaaccugggaggcggagcuugcagugagccaagaucacgccacugcacuccagccugucguauuuaaaaucagguguuacccucagcaugggggagauggaaggaagaaugaggggagcguguaaguuucuagccagauuuuauuuccuaaccuggguaagguuauauacacuugcuuuuuguaauucacugaacucuuuaugugcacguuuucccccauauuuuccacuguacaauuaaaaagauauuuuaaaaagcaauaugguacuuagaaaugaaucuaaaagggucuguaagauaaacaauacgguacuuaggaaugaaucuuaaagggcauguaaaacuauuuuaagagaaaauuauaaaacuacauugaaauauauuaagaccuaaauaguuggaaaauuacacaauuguaauaauaaagaugucacuaaauuaauuucuaaauuaaaugcauugcuacucagaauuccaguaggauuuuucguggaacuugacaggcugauucuaaaauauuuauggaaaaucaaaaaacguauauuuaaagaauaagauaagggaucuugccauaccagacaucaagacuuauuacauguguagcuuauuuaagacaucauuuacaaaggaauaaacagaaagaaaaaugaaacagaauggugacccagaaacauauccaugaauguggaaaccuaacauacacagagauggcauaacaaucuguggagaaaggaugaagaggaacuauucaauagaguuugaaccaaugaauauauaucuggaaaaaauaaaaucagauaaaucacugccacacacuaaacagaaauguauaguauaccaggcauauuaaaaguaaaugggauaacuaaguuuuuagaauuuagauggucuguccuuaugaccaugugauaauaaaagauuucuuaaucaggacacgcaaagcaccuacccuaaagggaaaauauaauaaauaugccauuauuaaacugaaaaacuuuuugccuaaacgauaucaaacaauuaaaagacaugaaacagccugggagaagauauuuauaaugcacaccaccugcaaagacauuucacaggaauguucauugcagugcuuuucaaaauaggaaauagccuuaaguugaucaacagagguguauucguauauauuaauacaguagaauaauacauaacguucagaaucaaagacauauauuaauugacuaacucucaaaaucauaauauugagugaaaaagucauggugcguaaagguacagacaguauuguacccuucguauaagguuuaaagaaacuugcaaaacaaugcuguacacuguugguuaauauaugcaaugugguaaagaauuacaaaacauccuugauauugauaaacuguaaauuugguguaaaggcugcuacugagaagugagaauggcaucauugggaacacuuuacacaagaaacauuauauuuguaauauuuuauuucuuaagcucuaugguaaauacuuggguguucauuuuguugccuauauuuuugguaugccugaaauauuuuauuaacauuaaaacauuuuuuaaugaucuaaaaauuucagaagacauuuagagaaaagagauuaggaggauugaaguaauaagaaguaagaaaaaugugugaauuuaaaagagguagcaagaguuaacugguucuuugcauuuuuagcaaucucuauugccuuucugauuucuuuguugaaaaauauacuuacagauaaaaaaaucaaaaaugaucaaaaaaguagaaaagagaaauaguauuagacaaguuuaaaaggcuauaacugcaugaaauuuuuaaaaaauuguaugagaaugcuguauuuaaaaucuagaugauaaaagugcuuuucuuggauuauaugaaauauaaaaauugacuccauaagugguaaaaacuuugaauaggccaaagaacuugaaagcauuguucacaucuuuuuuccuuugaaaaaacauaccugaucuuuccuuuuuuuuuuuguuuuuuuuuuuacuguugcaucaaaccaucaaggaacagauuuuuuuuagaauguuuuuauuuuauuuuauuuuuuugagacagagucucacugucgccccggcuggagugcaguggcacagucucagcucacugcagccuccaccuccuggguucaagugauucuccugcaucagccuccugaguagcugggacuacaggcgugcaccacgacgccugcuaguuuuuguauuuauaguagaguugggguuucaccguguuggccaggcuggucucgaacuccugaccccaagugauccacccgccucagccucccaaagugcugggauuacaggugugagccaccccgcccggcuuuagaauguuauuuuauuuaaacuguuguuguacacaguaaaguaugaaaaauuuuucaauucaugucacaguuuuuacacagguggagccuaagagguacuuuuuuccuaauauguaaauggguuugggguuuuguuuguaauugugggggaggauuacuugucuguuguguuuauuaucuuuccuuuucugaaaucaaaugaugucguuauuccagaugccucaguucaagugcuaaucacuggggaugagaaccucucagacaaaaaacagcaagagauucacaguacaagggcagugacugaggcugcccaggcuaaagaaaaagaaucuuugcagaaagauacugcagguagcuaaacuggauugucugcguauuauuuucuucuggucuucuaaaaugagacuauucccuuaagaacagaaacagaaauauauucucuauuuucuucuugcugucuucagcucucuucuaucucauguauauaugaaauaguuaagguauguuuagcuauauuuuuuauauacuuuggcagguaaaauuaacauauuuaaaguucuuugugauauuucuggaggguuuugaauauaguaaacaaauuaaucuaauuuccagaaauucauuuaauggacuuuuuaccuccgcugauaaaaucucucaauucugugagacacggacccucuaauaccauuuuuguacauaauccuuuauuuaggaauucagcuuguuuacuuccuaccuaucaguuacuuuacuucaaagggauuaugcugauuuaaauaacccuaauaguguauuuacguuaggauuaguuuugacucagagaggaaaacaaaagcaaaauaacauaggcuugaagaagacagaaaacucuuucucuuuuuuguaaaacuccagagguaagcauccagaguugaccugguacuccagaguaucggaacaaagcuguugcucucuuguuacucuaacauuuuuggccuucauucuuaagcuguagccaucagcccauauugcaaccagcaggaagaaaggaaaggaaaaagcacauuccuuccuuuaaggauacuucugagaagcuauauauaccauuccuuuugcauucuauuggccagacuuagacacauggucacauguaccagggaagcugggaaauugaguuguuauucuaauaacaaugugcccagcuaaaguuaggguucuguuuagaggaaaaggaaaguggauauuagaggacagauaguauugauaguuucugccacaauuguaaacuaaaacauuuuagaacaugauuagcugcuucucuucuuuagguauugcuuguuuaaaaagguuagauuguauucugggcaacacuucugaauuuuaccccauuuuacuauuacuaaaugaauguuccaaaaacaguuuugaucauguuaaucuccuaaucaaaaacuuuaguguuucauugccuguaaggauaaaaucuaaacucuuuuagcacugucuucuagaacuguagaguccacucucaaacaacuuucuaacacuaguucucaccucuuuuccuuauaaauucuauaaucaaaugcuauauacuugcucuguuucuuagaugcuaaguuacuuuccugacaccauucuuguguuauguagucaccuuuuuuuuccaucuuaauguguaucccaucuuagcucucuucuaaugccaaaaucaguugucuagaguucuaugguacucccaccugcaauuaguuuuucuuucuuugaauaccgcuaccucuuuuucugacuguuucuuacaguauaucuguuuacguaugugauuuuuugccccaauuuucaauuauuuucuaaacgcauuucugagucaucuuuuuucuucaauaucaguaacaaagccuuucacauaauacguacuugagagacauuuaaaaaucuuuuaugucaaguuccugucuguauaguguguuaauuucccuuucguagauuccagugcugcugcugcugcagagcacucagcucaaguaggagacccagaaaugaagaacuugccagacacuaaagccauuacacagaaagaggagauccauaggaagaagacaguucccgaggaagccuggccaaacaauaaagaaucccuacagaucaauauugaagguaaugggauuggguuguguaugagugugugugucuuuguguguaugugagggucaguguuaguguuuccauuucauucugaugagaauauagccucaugauuaaacaaaaauuccuuuucuuuuuuuaaaacuuucuuguguaaaguacuuugaugcuacuauuagguuacuauauauauauauagauuuccaaaaaguaauuguuacuuuuuggaaaagauauuagcaacuuagaaacaggauuauaaauaaauaccuaaggcugauaguuuuagaagugaaguaucuugucucaguccccagagacaaccuuaaaggccuuccagaagacuauagcaaagauagugagaccaucaauacaaacuuuuaaaaaauuacaauaaaaucacauuuauuuuuguuuguccaugggucucuuuuucugacauaaaagcguauagaacacaagacauuacuaccuagccaucaagcuuuaccucuuagaggaagauggaacagccuacauaaggagagaaaagagucaaggagcuaaacuacccauacuggauuuuggaaauagucuggguucaacugcuuacaucaagaauauacaaaauaaaugauuuuuugacaauagccaagacuacacaauggggaaaggauagucucuucaacaaaugguguugggaaaacuagauauccacauuuaaaagaauaaagguggaccuuuucuuuacaccacauacaaaaguuaacucaaaaaggguuagugacauacauguaagaccuuaaaaccauaaaacucccagaagaaaacauaaggggaacacuucaggacauugaacuuggcagugauuucucagaugugacaccaaaaacacagacaacaaaagcaaaaauagaccaaugaaacuacaucaaacuugaaaacuucugcaugacaaaguagacaagagugugaauaggcauucuacagaaugagagaagauauuugcaaaucauggaucugauaagggauuaguauucagaauauauaaagaacuuaugcaacucaauagcaagaaaaacccaaacaacuuauuuuuaaaaacacguaacuuauuuuaaaaugagcaaaggacuugaauagacaauagaagauauacaaaugccauaucaagcauauaaaaagaugcccaaucucucuaaucauaagagagaugcaaaucaaaaccacaaugagauaucacucacaccuguuaggaugaccacuaucaaaagaaaaaauagcaaauguucgugaggaugcaaggaaauugaaacccuuguucaccauuggugggaauguaaaaugauguagcuauuauggaaaauauuauggagguuccucagaauaauaaaaaagaauuaguauaugaucccgcaaucccacugccacugcugggcauauaaccuaaagaauucaaaacaggacuucaaaaagcuaccuguauacucauguuuauugcagcguuauuuauaaucaagagguggaagcaacccacauguccaucaacagaugaauguauuaagaaaaugggaauuauuugucaauaaagaaagcauguuacauacauauuuguauugugcagccuuaagaaagaaggaaauccuaucacauacuacaagguaggugaaccucaagaacauuauacuaaguaaaauaaaucagucacaaaaagauaaauaccauaugguuucucgcaaauguugagggauuuaggaggaugagagagaccuuggguuuaaacaggagagucuuuuauugagugcacucaggcccagcagacucacguccaaaggcugggcccagaacaaagacagcacuugacuuuuauacacacuucacaaaaggggaugggcuagcuugaagcaagcuuacaguggcgugaaagcgggaauacagaagcaggacaaagacaguuaaucaaauuguaacagguucauaacucaggauugcacauaaccguugcuaugcaacccagauguccauuaucuagguuugucuaggcacgggcuuaucccauaaccuucacuauggugcccaggcagcuguaguucaggccuacucaggcuucucaugaccuucauuguacuucuuagauaaaacagaauacuugaagucacuaguuacagagaacaggaaucuauaaacucauuccauaaaacaaaggaaaauuuguuuuuucuucucccuguguugaaggagugcugggagagucuccagagcacauuacauaauauuaucaagacuuuuccugggucugggcugugccuguugcugccucugggacaagucagccuaaugcaggaaaacuuauuucucuuucuuuuuaauuuuauuuuucuuuaauuucccaccucaguaugaaauaucuaaaguagcugaaaucauagaaacagaaaguagaauagugauugcccaggcuugugagaggguggacagagaauuaguguuuaguagguguaggguuucaguguuacaagaugaaagaguuagagauuguugcacaacaaugugaauauacuuaacacuacugaacuguacacuuaaaaauggcuaaggugguuaauuuaaugucauacuauuugucacacacaaaaauaauacauaagaugaagaaauauaacauugcaacuuugcagggguuagugugggagacauagcuugcaaaagaaagauggaaauauaaucuguaaaagcauacucuagaagauaagaaaaauuuuucuaaauguuuuacacucugaauaauuuuagaagacaugaaguauaugaaauaaaaauugauagaauaaugaaaugaaaagggagauuuaggggauagaacaaaaugaaaugaaaaaaaaguaccaauuagaagaaagagaugaaagcaauuaaaaaaaaaugauggaauuugaaggcugacagugaaaauccaacacaaugauaucuguuguugccucuaaagaagauaauagaaaaauaaagauauaaggaagaauggaacuuacaauuguauguauguauguauguauguauguauguauguauuuuuagacauggagucucauucuguugcccaggcuggagugcaguggugugaucauagcuaacuguagccucaaacuccugggcucaagugaucuucccaccucagccuguagaguagcugggacuguaggcacaugcuaccacaccuggcuugaaccuguaauuuaaaaggacguaccaaguccuaggaaaauuuuguauauaguguucaauacugagauguauguuugcgauaguacugaacuuuaaagaaaaagaaugaaucaugcaggccuccauacagaaaaaaacaaguagaaaaugcuaaaagacagggggacaggcagaggacagggagguuaaaggagguauaaaugagcaaacuucaccuuuaaaguuguaaaaucaaaaaauacauguguaaguaauuauaggguugaaaauuauaggccagacgcgguggcucaugccuguaauuccagcacuuugggaggcugagguggguggaucaccugaggucaggaguuugagaccagccugaccaacauggaggauccccauaucuauuaaaaauacaaaauuagccgggcaugguggugcaugccuguaaucccagcuacucagaaggcugaggcaggagaagcgcuugauuccgggagacagagguugcagugagcugagaucaugccauugcacuccaaccugggcaacaagagugaaacuccaucucaaaaaaaaagaaaauuauaaaauuuaccccuaaaagaguuaaaauuaaacuauaaaacauccaaaauauuuagaaaaacagguuagcuuggagguaaagggagggaaaaagaaaacaguaaauuuguaacaaaaacaaaaaauugccauaaaaugaaagacagcaaagcaugcaagucuauauauaaguaaacuaaauucaccuauauuaaaaaaaaaaaaacuucuuggauuauauuaaaaaacaaacccaguuccaugcuauauaacaaacauaucaaaaguaaaauuacugagaaagguggaaagcaaaaagaaaacuuagagauguaucaaaaagaaauuuggggacauuaauauagaugagguuaaauucaccaaaaguuuugcaggaauugaagagguauauuuuuauacugauuugcaauccacaaugaggauauuuugcauaaaucuuuaaacaucaaauaacuuagcauaaaaaauucauaaaacgaaaaccaggagcucaaucaauaaggaaauuuauguugccuuaaaaaagaaugaaggagggcagggugcgguggcucacgccuguaauuccaacacuuugggaggcugaggcgggcggauuaagaggucaggagaucaagaccauucuggcuaacaugguggaaccccgucucuacuaaaaauacaaaaaaauuagccgggcgugguggcaggcgccuguagucccagcuacucaggaggcugaggcaggagaauggcaugaaccugggcggcagagcuugcagugagccgagaucacgccacugcacuccagccugggugacagagcgagacuccaucucaaaaaaaaaaaaaaaaaauaaaaauaaaaaaugaagguauggaauuauaugaaaacaacucuuaggauggauugugaggcaaaaggugcuuaacagggggauuggacgguggaauuugcuuguagggagaaaaaaaauaaaacagacaacccuaggaaaucuucaaagagaaauggacaaauacaaaauaauacuggggagcuugaacacacauaauuagcuuaugacagaucguggagaugaaaauuuuuuuuguaagugaaguuuaaaaacaccugggaauaauacaaguaaugagguugaugugggguguguguggcugugugugugugucugugugugugcaugcaugcauaagccuauauggguuaaacuuaaaaaaaaaacccuuuccaaaagaccauagaaaauuuuuucauacagcuuuauucagauauaauuuacccauuuaaaauauguaaggcugggcacaguggcucaugucuauaaucccagcacuuugggaagcuaggguggguggaucacuugagaucaggaguucaagaccagcauggucaacauggcgaaaccccgucucuacugaaaauacaaaauauagccgggcauggcggugcaugccgauaaucccagcuauucaggaggcugaggcaggagaaucacuugaaccugggaggcagaggcgacagugagccaagaucgcgccacugcacuucaguccaaacgacagagcaagacuccgucucaaaaaaaaaaaaaaaaaaaaaaucaaacauguaauucaaugauuuuuacuguauucacagauaagugcaaucaaccaucaccauaaucaauuuuagaauauuuucuucacuucaaaaaagaaacccugagacuuaagcaaauacugauccacuuuuugucucaguagauuucccuauucuggacuuucauacaaaugggaccauuaaguuggggacauaacaugaaacuuagggcccgcccauaaugaaaaauguuaaaggaaauucccauguaaaguaggccuccagugggcuacacucuuacuauaagaauaaaagauaaacacguccauguagaaggggacaguaagaaaacugccuguuuuaaccuugauaaugaguuuggggaaagaagacaaaauuuauccucagaauuuauaaccacaaacuaguguucacacagauuuacagucauuaauuuuguacugguauaauuuauuagugcaguaaacuacagguguguucugaaaaaucucaagccgagaauuuaacaauggcaguagguugguauugcagacucacaugccuuucggaugcaaaugcacaucucucugaagaaacuucaacccagaccuaaaauacccuaaauucccuaaaauaccaagcucauagucaaggcacuauuaguagaaacaguaucaacaacaagaaacagaaaugagacccacaauuacaaauguccaggauuccuuggcaaaaugccugauucucagacugggacaggagauauauuagaugagccugaacccuuuuguggugccagaaaguaaagaaaaaaaaaugcacagggauggggaauaugucaauggaacacagggaccaaguaaaaaacuucccaguggcuaaagcugggacaguuucuguaguauagcaauaguauuagaucauaaccaaaguauaaaauaaauaccuaugagucuguacugauaaaaguaaaugauuuaauaaauaaauggggggaaaugacaaaucugugcagaauucuaaauaauguauguagauauuccaccaucagggagguggaacauaacucccacucuuaacuaauggguugcacauaguaacuuaacuuccuuccaaagaguguauuuuuauaggaagggggaaaaagaauaacuauauagugaagaauucuggcaaacacuggcucagccgggucaucaagaucaucaucaauagugguaagucauguugauaguauguacccuuaauauguaaugagaaauauauuuuaacuuugaaaucuucuucccaaaaacccauaaccccagucuaaugagaaaaacaugagacaaacucaaaugaaggacauuuauacuugaccaguacuucucaaaacugucagagucaugaaaaacaagggaugccuaagaaauucucacagaccuaagagaagccuaaggagacaugauaauuaaauguaauguggugucuuggauagaauccuggaacagaaaaagaacaguauguacaaaacaaggcaacacaaaguauggccuuugguuaauaauaauguaacuuuauugauugauucaugguaauauauuguauuaauguaagguguuaauaggggaaacuggguaugggguauagguaaucaucuguacuguugucaccguuuuucuguaaauccaaauuauucuaaaauuaaaaguuuauuuuaaaaaauuaaugcauucugacauuaaaacagguggauagauaaaugauaaauaagaaauuucaucuucuuaaagaaaacacuuuacagcuucucuuuggcauaaccaauuugcuggcguuacugcucuugcacuuuggggccauuacuaacuacaguuaggguuacuugaacacaggcacugcaguaucaugacagucacccugauaacccagacagcuaugaagugccuaaggggcagguaguguaaauguacggacaugcuggauaaagggaggauucacauccuagggugggauggagcaggaugacaagagauuucaucauacuacucacaacgacgugcaauuuaaaaaucaugaauuguuucuggaauuuuccauuaaauauuuuuggaccaugguugacuauggguaaaugaaaccuuagaaagcaaaaccacagauaagggggacuacuguauucacaccuaaugugugggguuuccccucacguuaagcaguucugacacugacaaccuguacuuagcacaguccccacagguuauggguucagucccacaagacugcccaccacuucagauaccaauugcauggcuuggccuccuauacuucugaccaacuagcuccaaauuggggugguggggagaaucccaugacccccuccucagguuugguaauuugcucgaauggcucagaaaacuuagggaacauuuucuuacauuuccugauuuuuuaugaaggauauuucaaaggauacgcacgaacaaccaaaugaagagauacaugggcaagguauagggaaggugcacagagcuuccauguccucucugggccugccauccucccagcuucuccuguguucaccagaugugaagcucuucaaacucugucuguuaggguuuuuauggaggugccauuacauaggcaauauugauuaaaucauuggccauuggugauuggcucaaccugcagucccuguccccuccccagagaucagggguuggggcuggaaguuccagcccucuaaacauaugguuguucccuugguaaacaggccccccauccuaaggggcuuuccaaaauucaccucauuaauguaaacucaagugcaaucagaagugacuuguuuugaauaacagacccuccuugaaccuuuaucacucgcucuugaacuguuucaagaaccaaguacaaaaaccaaaugucauaauaaaagaugccccuauugcuguuaucccguuuuccuaaauggaaauuacaagaguuuuaguaguucuggccaggagcuaggguuaaggcaaaauauguauuuauuauaucacaguauuacaauuuacaggguauuuaaaugaauuauacagugauaauaguaaaaggaugcuacugggacaagagacugauacaucagugaaaauacuuaaauacagugggcacuuacucuaugauaaaggugccauuucagauccauuuguaaaaagauggauuacucaacaaauaaugccaagaugcuuugcuagccauuuagaguaucgugagaauuuuaaguuguagcccuacuuuacuccugucaccaaaaugcaaguauaaaagauccaaguauaaaaaagagaucauaaaaguucugguuuucugacuuuucuaauaaauuugagcagaagaaggcuuucaaggucugacaaaaucuuggagucauaaagccaaagauuugauaaauguauauauuaaaauuaaagugucuucaugguagaaaauaucauaaugcaaaaucaauuuauaaaugaauaaugggaaaacaauuuuaaaaaauugagaaacugagaaaaggggcuaauuuucuuacuaugcaaagagcuuuuuacaaaucaaugacagccuaaaaggaaaacaaaggaccugaacaaaaagcuuauaguaaaagaaaugcaaauggccauuaaagauaugaagaaauacuuaacugucuuaauaaagaauguacuaagccacaaauuuuguuuuaccugucacaauagcacagaugaaaagauuugauuauccuuaguauuguugaguacauggggaaacauucauguacucuuauaagacuauuauuagaagugcaaauuuguugcaacauuuuugaaaguguggaacaauuggaugauaucuaacuaauguugaaauaaauauucccuuuucacccagacuuccauuuaagggaauaacagauacacagauaaaguuguaccuagaaaaauaaaaugaagcuacacauaaacgcacaaacaaauguucacugcagcaugcuuuggaagaauaaacuauuggaaacaaccuaaauauuuaguuaaauuuugguaaaguaaaucaguuuaauauaaaauguuuguagaugcacaaaaucuugcuuugaacaaguaguuuuacucuacuuggcaggaauuuuucuauaagaaaacuuguuuaauauugguuaucaccagaaaguggaacuaggagguucagagauaaccgggagaacuuuacuguucauauuaaauuugucugcauuauuugaauauuuugcauguuuaauuuuuaaaagucugcaguucuagguaugaaagaaauauuuaaaaauaaaugaaaagcaguaaaugauauuuucauguacuuuuauauauucggggagaauuuugcaaauguuaugaguaaaauuaauuccauuaucagaaguaaauaacuacuucaacuuauuugaccuuuacucuuaacaaagugccaugagaugauggugauuaucaaauccuguuguuuuauaaagcccuuuauacuuaaggaauucagcuugcuugcugcugcuucugcuucuuuuuuuuuuuuuuuuuuuuuuuuuuuuuuuuuuuuugagaugaagucucgcucugucgcccaggcuggagugcaguggcacggucuugacucacugcaaccuccaccuuuuggauuuaagcaguucuccuuccucagccaccacaguagcugggauugcacgugugcaccaccgcaccuggcuaauuuuuguauuuuuaguagagaugggguuucaccauguuggccaggcuggucuugaacuccugaccucaaguaagccacccccauuggccuuccaaagugcugggauuacaggccugagccaccgugcccagccuucagcuugcuuauuuucuacuauccuuucuguauuuuacuucauucccaggcugggaggacuauguucauugaaaauacugauauuagggaauaaacauuuuagagcaauguuaucuauuuccuuauuguuuuacuuacugcuuuaaugaauucuagauaggccuucaaauuuuugcuuuauucuguugccaagguauccuuccugaaauacagccauaauuauguuacucgccuguucaaaaugguauacuggcucuucauuucuuuuaagaauaaaauuuaaaguccuuggccuaguguuccaggcccuguagaauuuggccccaaauaaccuuugcuaccuuacuuuccucugcuuuauaaaugaaauaagccauacauacugaauauuugcacucucccuuauugccucaguucuuuccuacuuuuaugcuuuugcucaugcuauuugaugaagcaggggaaaggccagcacaacuauaguauaguuaucaggaagagugguacaaaaugaggaagaaaaguuauguauacuuguacuucuuguuaaggaguuugggcuuuguucuuaguguaagagaaggucauugaaaauugcuaaauagaaaaugacaaguccagcuuacauuuuaaaaagacuacuuugaccacuauuugacaaauagauuggaaagguacaagaagggacaggagaccuauuagagacuugcaguauugugacaggaaauagaaauagaugugugauuguuuggugaaggauuaaugacaggaacaggaagaggagggaguuggaacuaucaagaauaacucccagauuuuggcuugggcaguaggaugaugugccauucacagagauguggaagacuagggaagguacaguugucaaggaggcuagaauagagcucaguuagauggcugugacauccaaguggauauaucauguauauaguuggaacucaagaaaaaucguagcuugaaaugcaaauuugaaaauaaguaacagcauggaaaugguacuaaaagccacagggagagaugagauuaccuagaaagagaauauagacugagaacauuuccuggaaauuggccauacauugaggucauugaucauauuagcaagagcacuuuuaguccagaaguauggcuguacucugcaguaauuugaagagggaauugggguagggagagagguaaaggagaggaaaauagguuccucuuuagaagcuuggcuaugaagaggagcagagaagugggccaguaccuggaggaagaugugaggauuuucuaaacauacauacuaaaugauguuuucaagccaauggaaaugacccugaaagauagaagagagauaugauagggaaaggaagcaaggucuggaagggaagaugaguuggguuccagagcagcauuggaggaacuugccuuuaaaagaaugggagaggugguguugucucuguauccagaaagguuaugggagcagguggauuggcauagguggcagcugccucaggacauccacagaaagugaucccucagcccagaauguucuucuuccuguuuguuuguuuagcucucauuuuuacuucacaucucauccuccucagagaauucuucucuagcuaccauuucccaguaaaauuucucuuauaucagcuuguuuuuguucuuuguagccccuaauuuagaauuauauauuuguuugcauuuguucagugcagaagcugcaaucucaagaaccuguagaaucuaaaugaaaucucccaauuuuuaaauguugcuagauaauucuaaaauuguauagucuacauacuuuagguauaaaugcaggcccugugugucccacucuacucuggggaaguccguagggauuccuagaguauuucaugaaaacucugcuugccaguaaucuauagugugggugaaaaggaucccaucauugcauguguguaucuuuguuucugcccaugauguagaacucuaaaacaguguuuugaugucauaucagagauuagaauuaggguuuaugauugugucuuagcucauuccugcugcuguaacaaaauucugcagaucuaagaucaaggcaccagcagauugggugucuggugagagcccagucucugcuuccaaaauggugucuuguugcuuuguccucacgugguggaaggcagggaaaggccaaacaggagccuucaggccaaagggcacuaaucccauucaugaagguggagccuucaugaccuaaucaccuccuaccuaauacuauuauauuggggauuauguuucaacaugaaucuuagagggacgcaaacauucaaaccauagaaaauuguaagauauuacaucuaaaaaugucaaaaaaugaagauagaaagugguaaauuuuauguguuuuuuaccacaauaaaaaaaaauuuggaaaaaaagucaagaugguccacagaaaaggaauuucaaagggcucuaaaacauguaaaaaggguuuuuuaaaaaauuuauccauuuaauuacugacuaugagaaugaagugucagguuucuuagcugaauaugggguuaccaauaucugucagguuuaauagcaggauuaauuaaaaaaaaaacagaugcagagcauaugucauaacacccuacacagaacaggugguaaauacauauagcaguugcuuuuaugaucuggagaacugaagugccuuccuccaggucacguagccggucaguggcagagcccaggccaaaauucaugucucuuaaacuuuuacuguaccagcgaggcuacuaagaacaaggcaucagucuuuugugcaggcagugaauuuucugauaccuuauauaaacuauucuuuccuuuagucuuuguucuguaucuaaagaauugugaauaguauuucuaaacagaaugcuaauuuuuuaaguucuuucaaaaucuuuuuuucuccuuuucagaguccgaaugucauucagaauuugaaaauacuacccguucugucuucaggucagcaaaguuuuacauucaucaucccguacaccuaccaagugaucaagauauuugccaugaaucuuugggaaagaguguuuucaugagacauucuuggaaagauuucuuucagcaucauccagacaaacauagagaacacaugugucuuccucuuccuuaucaaaacauggacaagacuaagacagauuauaccagaauaaagagccucagcaucaaugugaauuugggaaacaaagaagugauggauacuacuaaaagucaaguuagagauuauccaaaacauaauggacaaauuagugauccacaaagggaucagaaggucaccccagagcaaacaacucagcacacugugaguuugaaugaacuguggaacaaguaucgggagcgacagaggcaacagagacagccugaguugggugacaggaaagaacuguccuugguggaccgacuugaucguuuggcuaaaauucuucagaauccaaucacacauucucuccaggucucagaaaguacacaugaugauagcagaggggaacgaagugugaaggaauggagugguagacaacagcagagaaauaagcuucagaaaaagaagcgguuuaaaagccuagagaaaagccauaaaaauacaggcgagcuuaaaaaaagcaaggugcuuucucaucaucgagcugggaggucuaaucaaauuaaaauugaacagauuaaauuugauaaauauauucugaguaaacagccagguuuuaauuauauaagcaacacuucuucggauugucggcccucagaggagagugagcugcucacagauacuaccaccaacauccuuuccggcaccacuucuacugucgaaucagauauauugacccaaacagauagagagguggcucugcacgaaaggaguagcucuguuuccacuauugacacugcccggcugauucaagcuuuuggccaugaaagaguaugcuugucacccagacgaauuaaauuauauagcagcaucaccaaccaacagaggagauaccuugagaagcggagcaaacacagcaagaaagugcugaauacaggucauccccuagugacuucugagcacaccagaaggagacacauccagguacauggcuacagauuccaucuggcaaugugacugcccucuucauggacuuuuuaguuaagcuuugcacacaggugaaaaaaacaagccauuugcccuuuccucucuauaccauuucuuaccaacuggaaaagagugagaaaguguaguacagugcuauugugaguugucauuauuuucaucaacauucauuuacgaauuaccuuuugaaugaagggcuuugcugcuagauccuucacagucugcaaaguuuaccccugaaaugggggagcuuugagguuagaaugaucucuauccugaacaauauugcuggguuuauguuuauuuggguuuuuuuuuuuuaauucauuccucucugucuuucaggaaauauauuugagguucuuuuaaacacacacacacagacaaacacauaaauaauacaggguuuuuuuuuuuguaauugaagaauggaguugauuugaaaaauugaagcuggggugagcuacaauaugauuuuuuaaaaaugaguaaauaaggaauugugaauaauggaaagacaagucaaagccaggaggaagauaaauaagccuuguggauguggucgcuagaaaagagcuacaaauuuggcuuuauguuuucuagcacuuaguguugcuagaauuuugugaucaauaacauucacuuuuuaauauaaaaagagaacaaaauuuuuagaaacauuacagauuucugauaagagaccuaaaauaaauuucucucaucugucuucuuaaagaaggcaccacagugcaacaaagaguauccuccuauaaggccauuaucacauuccuuaguuuaggguguuaauaagggagaucucaaggggucaauaaauguaggccauugcuuuaacccaagaggaaaauuucaaguaucacuagacaugcucuccaaagaaggaugcuugcaaaaugguucaguggaguauggaacgaaaaauauuugaauuuauauucauuuuccccaacuuuuuaaaauuuauauuuuuguguauauuuuaugaguacaguagugacauaacauauaaauaaauaucuauuuugacaacuugugcuaaaaaaauuuuugucagauuacaugaucaaaagaaauuggagaccacuggucuagagaaagggaggcaugagauguucagacaauuuauuauaaauauuauuucuccucauugagcuuuuggcaguguuuacauauauaaauaauagaguaugcuuuuuuucuaaaguaagugaagaauugggaaugguacagaguaaggcuuuuguuccauaggggagauagauaaauggauccaggagaggguuuguguguguguaguaaaauacacaugacauaaaguuuacaguuuugaucauuuucaaguauacaauucuguggcauugaguauauucacaguguuuuacaaccaucaccacuaucuauuuccagaaauuuuuaauuaacccaguggaaacccuguacccauuaagcagugacucucuguucccucuucucaccagcccccggcaaccaguaaucuauuuucugucucugaggauuuuccuauucugguuguuucauauaaauggaaucauuuaauauaugaccuugguaucaggcuucucucucuuagacacaguguuuugaauauucauccaugacauaacauguaucaauacuucguugcuuuuuauagcugaguauuauuccguugcauguauauaccacauuuuguuuauccauucauuuauugauuuggguuguuuccacuuuuugguuauugugaauagaauugauauagaacguuuguguacaccugucugcaauucuuuuggguauauaucuaggaauggaaaugcugggccauaugguaauucuguggauuagcuuauugaggaacugccagacuauuccauaguaccugcacuauuuugcauucccaucagcaguguauaaggguuccuccaacccuccuccuuuuuuccacagcgacugcuuuaguuuauauucgcaccagcaguucacaaggguuucaauuuuauugcauccuugccaacacuuauuuuccauuuuuuaauauauaaacuaaccauccuguugggugugaguuaguaucauugugguuuugauuugcauuucccuagugauuauucauguugcacaucuuuuuaugugcuuauuuaaccauuuguauaucuucuuuugaaaaaugucuuuucaagucauuuggccauuuuaaaucuggcuguuugauuuuuugguuuuugaguuguugggauuuucuauauauucuggauauugaucucuuguuagauacaugaucugcaaauauuuucucccauuuuguagguugccucuuucacagucacucugcugaccgugucuucugacauauagaaguuuuaaauuuugauguaguccaauuuagcuauuuuuuuuuuguuuuuugugcuuuuggugucauaucuuagaaauauuugccaaauccagugucgugaaaguuuucuucuuaagaguuuaauaauuuuagcuuuuacuuuuaggucuuugauccauuuugaguuaauuuuuguguaugguguaagauaaggguccaccuucauucuucugcaugugaauaucccguuuucucaacaucguuuguugaaaagacuuuuuuuccccauugaauguucuuggcacucuugccaaaaaucguuuagccauauacgugaggguuuuuaucugggcucucuauucuguuagucuauauaucucucuuuaugccacuacugcacuguuuugauuuacuguguauuuaaaaugaguuuugaaagcagguagugugaaaccuguaacuuaguucuuuuuucaaaauuauuuuggcuguuugguuucccuugagauuucaugaauuuuaguaaauauuuuauuguuuuuaauacuaccauaugugcaauuucuuucuuaauuucauuuuuggauuauucauugcuaauguauagguacauaaauaauuuuuacauacugaucuuguaucuugcagcuuugcugaauuuauuaacucuuuuuuuguguggauuuuuaaggaucucuaggauuucauguugaggaaguucccuucuuuuucuauuuugaugaguguuuuugucaucaaagcauuuugguguuugccaaauucuucagcaucuauugagauuacuaguuuuuucuuuuucuuuuucuuuuuuuuuuuuugagacagaguuucacucuuguugcccaggcuggagugcaaugacgugaucucagcucacugcaaccucugccuccuggguucaaccaauucuccugcuucagccucccgaguagcugggauuacaggugccugacaccaugcccagcuauuuuuuuggauuuuuaguagagacaggguuucaccauguuggccaggcuggucuugaaccccugaccucaggugauccaccccccucagucuccccaaagugcugggauuacaggcaugagccauugugccuggccuguuuuuuucuuuuauucuguuaauaugguguauauuuauugauaaucauauuuugaaccaacuuuacauuccugagauaaauaccacuugaucauaaaauucuguucauaugcugcuggauucaguuuauuagaauuugaagaggacuuuuuacaucuauauucacaaggaauauuugucuauaguuucuuugugauaucuuuacugccuuuauaucaggguacuacuggccuuauagaaugagaaaguuuucccaccucuugguuuuugauaaugaguuugagaaggauuaauguuaaugauugacguuaauucuuuaaauguugguagaauucaccaguaaagccaucuggcccuguguuuuucuuuggggaaauuuuuuuucauuacugauucaaugucuuuuaagucuauuuagauuuuguuucuucuugagucaguuucuguaguuuguguuucuagaaauuuguuuaucuuuuuuuuuaaagucuguuucauuuaucuccauugaaucuacauuauucugcuugcuuuggauuuaguauguuuuuuuuucuucucauuucuuaugauucaaaguuagguuauucauuugggauuauucuuuaauguaggcauuuguagcuauaaaugucucuuuaagccuugcuuuuguagauaaguucugccuucauugcuugccauaaguuuugguauguuugucuucuuuuucauucaaaauguuugcugauuucuucuuugaccauugacuguuuaggacaguguuguuuaauuucuacuugugaauuccccaccuuucuuuguuauugauuucugguuuuacuccauugugaucagagaauauauuuuguauuauuucaauccuucauuuaugaccuugcauaugaucuguccuugagaauuuuaugugcauuuaagacgaauguguauucuguugcuguuuggaguguucucuauuguguuaggucuagcugguuuauaauguuguucaaguccucuauuuccuuaucagucuuuuguccaguuuuucuauggcuaucagaaguggauuauugaagucuccagcuauuacuguggaacuaucuauuucuccauugaaaucugucaguuuuuugcuucauauauuuuagggcucuguugucaguuguguguauguucauaauuguuauauccucuucauggauugauccuuuuaucaguacaaaauccucuuuuugucucuuguaacaauuuuuaauguaaagucuguuuugucugauauuaggguaacuaccccagcucucuuuuggguaacuauuugcauggaauaccuuuuuuauccuuuuaauuucuaacucuuugugucuuuggauguaaaguaagucucuuuuagacauaacauagauggucauuuuuuauaagcuauucugcccucucugccuuuuaauuggcgaguauaauccauuuacauuuaauuucauaagaaaggacuuacuuuccccgugcuguuugcuuucuuuaugucauaucuuuuuuguuuuucauuucuacugccuucuuuguaucuaauugauuuuuuguaguguaccaguuuuauucccuuuucauuuuuuuuuuaacauuucauaguuauuuucuuacggguuacauugaggauuacaauuaauaucuuaaacauguaacagccugauaugaaauaaaaccaacuuagcuucaauaauauacaaacacuguuguuaauacaucucuauucuuccccuuaacuuuaauaauacacaaaaacuguggguagacaucuccaucccuuccucuuuaauuguuauagucacagauuacaucuucauuuuguccccacuaaaauagauuuauaauuauuuuaugcauucguuuuuuaaaucagauaagggaaaagggaagaguuacaaaccagaaguauaauagggacuuuauuuuuaccuauguaauugucuuacccuuauuucuuaugccuuauuucuauguauaugccuuaagccuuauuucuauguauacuucaagguauugucaaauguccuuucauuucaccuuggaguacucucuuuaucauuccuuauagggaaggucuacuuguaacaaauuuacuuuuguuuaucugggaaugucuuuaauuucuccuuuauucuuuuuuuauuuauuuuuuuuuuugagacggagucguccugggcuguagugcaauggcacaaucuaagcucacugcaaccuccaccucccggguuccagcaguucuccugccucgaccucccaaguagcugagauuacaggugccugccaccaugccuggguaauuuuuguguuuuuaguagagaugggguuucaccauguuggccaggcuggucuuaaacucacgaccucaggugauccaccugccuugaccucccaaagugcugggauuacaggcaugagccacuguaccuggccuucuuuuuuuuuucuuuuuaagauggagucucacucugucgcccaggcuggaguacaguggcgugaucuuggcucacugcaaccuccaccucccggguucaagugauucuucugccucagccuccugaguagcugggauuacaggugcacaccaccacacccagcuaauuuuuguauuuuaguagagacgugguuucaccguguuggccaggcuggucuugaacuccugaccucaggugagccacccaccucggccucccaaagucuccuuuauucuuaaaguuuugcuggagguagauuucuugucuuacacuuuuuaucuuucaucauuucaaauaugucauuucacugccuauugucuuccaugguuucuggugagaaauuagcaauuaauuuuaccgaggaucccuucugugcucgcccuuauucuuacugcuuucaagauucucugucuuuggcuuugacauuuucauuauaacaugucucaguguggcucucuuucaguuuauccuacuaagaguucauugagcuacuucgauguuuagauuaauguuuuccccuuaucaaguuggaggaguuuccaaccauuauuucuccaaauauuccuucugccccuuucuuucucucuucuuuugggauuccuaauaugcaucuguugguaaguuugaugguauccuacaagucucuuaagcucuguucauuuuucuucauucuguuuucuuucauuuucuauuuuuuuagaguaggguuucacacuaucccagacuggaguacagugauguaaucauagcucacugcggcgucgaacucugggcucaagaaaucuuucugccucagcuuuccgaguagcugggacuacaaggcaugcaccaccacacucaucucauucuguuuucuuucugucccucagaguacguaauuucauuucaccuaucuucaccuaucuucaaguucacugaucuuucaucugugugaucaaaucugguauuggacugcucuagugaauuuuucauuuuagcucuuguacuuuucagcuucauauuuucuauuugauuccucuuugucuucauugauauucucuuuguugagacauuguucucauuuccuuuaguucuuuauccaugguuuccuuuagcucuuugagcacauuuaaaacaguugauuuaaagcuuuugccuaguaagucuacuguguguucuuccuaagggacaauuucuauuuauuucucuccucuaacccaugaaugggccauacuuucuuguuucuuuucaugccucauaauguuauguuaaaauuuugacauuuugaauauuaugaugugauaacucuggacaucagauuuuccuccccuucucuaggguuuguaguuacugcuuguuguaaguuaaaguuguugguuuauuuagugacuuuucuaaauuauguuuguaacgacuguacucuuuguuguugugugauauuucuguuccuuuagcuuaguagcuggcuacuuguuugauagagauuuucuuaaaugccuggggccgaaaaaagcaaaagaaaaaagaaaauuccccaagucuuugcagauuuucugcauucggacacuccuucaaugcuuagccaggccauucacaacucucugccuuagccuugcuuccuacuuguacugagccuaaaggucaaccaguggugaaagugucuggucuucucaggucuuuucugaacaugcaucuugcucugugcaugcacuuucuaguuucccugguauacaugggaaauuuuccaagcccuuaugccccaaagauucucaguuuuucuuuccugcuuuuaguaugucuauuguuucccuugaacuguuaauuuuugcuccaggcaguagugccuuguucauuugguuuucaguauuuucaaggaacauucuuccccuauaaaacuacuuuuucacucuaagagaguuauguuaggugaaacuaaggcaggucccuugugucaguccacggcuaauacucagacaugucaaaacaaacacaauuccuugggaacaagguacuacuccgugcugucuuugggagcagguaccuacaucaggaccaagggcugccgucuuuaagaccaccaugcuggguaaggggauagcagaaggcuaaguuaaaaugcuacaaaguucuucuaccuugugcugauggccuuucuccugguuuagcaaacacuugguuacuauaaaccuuugacuaucuuccaaaguucagauaagguuggcuuugacaguuuuccguauuuuuugguguuucuagagaaggcacuuucucccuuggaggucucuacucuaccauuuuugcuugucguucccagguggaguugugugucccucugaccaucaaaauaacuagagugacaucaauuauuuuuucuuuuuuuuuuuuuugagacguagucucuauugcccagccuggagugcaguggcacaaucucagcucacugcaaccucugccuccuggguucaagcgauucuucugccucagccuaccgaguagcugggacuacaggugugcaccaccaugcuuggcuaauuuuuguauuuuaguagagacaggguuucaccacguuggucaggauggucuugaucuccugaccucgugaucuguccgccuuggccucccaaaaugcugggauuacaggcgugagccacugugcccagccuguguuacauuuuuaauaucuuugccuuugauuuuacuucauccaguacaguuuuuuuuaaauuugcauuugcacuauugcucuuugcccauccuuuuagccuuuugagucacuuuacucaaguguuaguaacaucugaauuuaacuuuuuucccacccaaucugaaggucucucuuuugaaacaaauuuauuccauuuaaguuuacuguuguaaauguuugguuuaaauuuuauuauuuuggcuuuuuuucauucugauguauuuauuaaauaaagguguguucaacuaaauuucauuucaaaguaaggagaggggugaauuucuugugcgugguaaaaaacacauaccaaaaaauucccuucuuaacuguucuuaaguguacaagucaauaauguuaaauguauucacacuauguugaaaccaaucuccagaacuuuuucauauugcaaaccugaaacucuauacccauugaacaacaacugcccuuguccccgucccccagcuccugguaaccacuauucugcuuccuguuuaugaaugauuaccuuagauaccucauaugaguguaaucaugcagauuugucuuuuugugacugacuuguuucacuuagcauaagaucuuaaagauucauccauauaauccauguagcauguuauaggauuuccucccuuuuuaauucuguaugauauucuacuguuuacauauaccacauuuuguuuuucuguuauucauugauggacauuuggguuguuuccaccuuuuagcuaugguaaauagugcugcugugaacauggguauguaacugucuuuuugagaccuugcuuucaauucuuugggauacauacccagaagaaggauugccagaucauauauaguaguucuauuuuuaacuuuuugaggagccucaacacuguuuucccuagugguugugccauuuugcaaugccaccaacaauguacaaggguucuaauuucuuuacauccuuaccaacacuuguuuuuuuuuuuuauaguagccauccucaugggugugagguaauacuguuuugauuugcauugcucuuaugcuuagugauacugagcauuuuuuuauaugcuuuuuggccauuuguaugucaucuuuagagaaaugucuauucaaguccacuuuuacuuuuuuuuuuuuuuagagguggggucucacuguuuuguccauccuggucucgagcuccugggcucaagcagucuuuccccauugaccuccgaaagugcugggauuauaggcaugagccaccauaccuggccugcccaucuuuuaguuagguauuugauuuuuguuguuguuguugcgacugcuuuauauuuucuguauguuaaccccuucucagauacaugauuuguaaauauuuucucccauucaauagguugucuuucacucuguugauuguguccccugauguacaaguuuuuaaguuuagugugguccuguuugucuauuuuugcuuucguugccugugauuuugguguaauauucaaaaaauuauugccacauugaaugucaugaagcuuuuucuguaagaguuauauggguuuaggucuuacauuuaggucuuuaacccauuuugaguuaauuuuuguacaugguauaagauaaggguccaauuucauucuuuugcauguggauauccaguuauccaagcaucauuugaaagcuauccuuuucccacugaguggucuuggcacccucgucaaaaaucauuugaacauauaugcgagaguuuauuucugggcauguuuucuuauuucauuggucugcuuguuugucuuuauacuaauaucacacuauuuugauuacuguuccucugguaauauguuuucaaaucaggaagugugaauacuccaacauuguucuugucuuucaaaguuguuuuggcuauucaggauuucuuaucauuuuuaaugauuucuugcuauuuccaaucuuuuuuguugauugcuauguaaugcauguuucuucgaguugguuuuuugauaacuuagcaacuauguaaucuaauuaacuaauaugcuucaaccacuuucucaaucugucagugucagauaugaaacuaucuauuggcucuauuauaugaaaaauuaagaaacugauuuuacuucuucccaccuaucccccacauaauuuuccccaacuaaccaauagugguuauauuuugugaauuuugucucagcucauuuauaguaguaguauuacuauauugacuagcuucuguuucaagaauuagaacauuuuacuuacauuuuauaagaucaugaguuauuuuacauuaguuguauuuaaauauagggucaguauuuaccaggagucuuuucacauaccuauuuaugaguuuguuaauuucaaucuguuguuugacuagacuguuaaauguucaggagugaucaucuuuuauguucuugcaaauuugagacuauuaccuuuauguaccagaacaacaacugaguuggauauaaaaguuuugauuaacaguucuuaauucaaaacuguuaauuuugcuccucuuuucuggauuaccaguauuuaauguuucauaugcuugcuugcuuuguuucuuucuuuauuauuuccauaguuuggagggaacaggugguuuuugguuacauggauaaguuguuuacuggugauuucugagauuuuggugcacccaucaccugagcaguauacacugcaccuaauguguagucuuuuauuccucaccccgcucccacccuuccccccuaaguucccaaauccauuauaucauccuuauuccuuuguauccucauaacuuagcuccccguuauaaaugagaacauacaauauuugauuuuccauuccugaguuaccucacuuagaagaauggucuccaacuccacauugcugcaaaugccauuauuuuauuccuuuuuauggcugaguaguauuccaugguguauauguaccacauuuucuuuaucuacacauugguugauaggcauuuaggcugcuuccauguuuuugcaauugcgaaucaugcugcuauaaacaugcaugugcaaguaucuuuuucauauaaugacauauuuuccucugggaagauacccaguagugggacugcuggaucaaaugguaguucuacuuuuaguucuuuaagggaucuccauacuguuuugcauaaugguuauacuaguuuacauucccaccagcaguguaaaaauauucccuuuucaccacguccacaccaacaucuauuuuuauuuuuuauuuuuuuauuuauggccauucuugcaggaguaaugugguaucucauugugguuuuaauuugcauuucccuuacaauuaaugaugaugagcuuuuuuuuuuuuuuuuuuugagacagagucucacucuguugcccaggcuagagugcaguggcauggucuuggcucacugcaaccucugcuucccagguucaagagauucuucugccucagccucccaaguagcugggauuacaggcaggugccaccacgucuggcuaauuuuuuuguauuuuuaguagagaugggguuucacugucugagccaggauggucuugaucuccugaccucgugaucugccuaccucagccucccaaagugcugggauuacaggcauaagccaccacgccuggccgaugaugaucauuuuugcauacacuucuuggccuuuuuuuuuuuuuuuccccgagacggagucucgcucuuguugcccuggcuggaguacaauggcacaaucuccacucacugcaaccacugcaucccggguucaagcaguucuucugccucagccucuggaguagccgggauuacaggugccuaccaccacgccuggccaauuuuuuguauuuuuaguauuuaauuuuuuguauuuguauuuuguauuuuaguagugguuucaccauguuggccaggcugaucuugaacuccugaccucaagugauccaccugccucggccucccaagaugcugggauuacagacaugaaccaucgcaccuagcccauuuguauaucuucuuuugagaauugucuauucuuguccuuugcccacuuuuuguugggauuauuuguucuuuucuugauuuguuugaguuccuuguagauucugcauauuaguccguugucggaugcaugguuugcaaauaguuucucccauuuuguggguuguuugcugauuauuucuuuugaugugcagggcccaucuauuuauuuuuguuuuuuguugcauuuacuuuuggguucuuggucgugagcucuuugccuaagucaaugucuacaagaguuuuuccaguguuaucuuacagaauuguuaugguuucaggucuuagauuuaagucuuuaauccaucuugaguuaauuuuuuuguaagggugagagaugaggauccaguuucauucuccuauauguggcuugcuaauuaucccaggaccauuuguugaauaggguguccuuuccuuacuuuauauuuuuguuugcuuugucaaagaucaguuggcuguaaguauuuggcuuuauuucuggguucuguguucuguuccauuggucuuggugccuauuuuuauaccaguaccaugcuguuuuguuaacuauacccuuguaguauaguuugaagucagguaauaaggaggccuccagguuuguucuuuuugcuuagucaugcuucggcugugugugcuguuuuuugguuccauaugaauuuuaggauuguuuuuucuaguucugcaaagaaugaugaugguauuuugauggaaauugcauugaauauguagauugcuuuuggcaauauggucauuuucacaauauuaauucuagccauccaugagcaugggauagguuuccauuuguuugugucaucaaugauuucuuucagcaguguguuucucauuuuccuuguagagaucuuucaccuccuugguuagguauauuccuaagguuuuguguuuuuuuuuguuuguuuguuuauuuguuuguuuugcaguuguuguaaaagggauugaguucuugauuuguuucucagcuuggucuuuguuggugcauagcagugcuacugauuuguguacauugauuuuguauccuguaacuuuacugaauucaugugucagaucuaggaacuuuuugaaugagucuuuaggauuuucuagguauacagucauaucaucggugaacagugacaguuugacuuccuauuuaccugcuugggugcucuuuauuuuuuucucuugucugauugcuuuagcuaggacuucgaguacaguguugaauagcagggaugaaagugggcauucuugucuuguuccaguucucaggggaaauccuuuuaaccuuuuccccauucaguauaauuuugguguggguuugccauagauggcuuuuauuaccuuaagguauguccuuucuaugccgauuuugcugaggguuuuaauuauaaagugaugcugaauuuugccagaugcuuuuucugcaucuuuugagaugaucaugugauuuuuauuuuaaauucuguuuaugugguguaucacauuuauugacuugugcauguuaagccaucccugcaucccugguaugaaacccacuugaccaugguggauuaucuuuuugauaugcuguuggauuugguuagcugguauuuuguugaggacuuuugcaucuguguucaucagggauauuggucuuuugguucuuugaaaagauaaacaaaauugguagaccauuagugagauuaaccaagaaaagaagagagaagauccaaguaaacucaauuagaaacaaaaugggagauauuacaaccaauaccacagaaauacaaaagaucauucaaagcuauuaugaaaaccuuuacauguacaaacuagaaaaucuagaggagaugauuaaauuccuggaaauauacaacccuucuauauuaaaucaggaagaaauaggaacuccgaacagaccaauaacaaguagugagauugaaacaguaauuuaaaaaacugcuaacaaaaaaaaguccaggaccagauggauucacagcugaauucuaucagacauucaaagaagaauugguacaaauccuacugaaacaauuccaaaagauaaagagggaauccuccuuaaaucauuaugugaaaccaguaucacccuaauaccaaaaccaggaagggacauaacaaagaaacuguugacucgcucuuucuguguuucucucugccccgugcugucuccccugcagucucugcaguccaggcccucuucucucucuaugaucucuuugcacucugucuguuucucuguucugucugccucugcucacccacacgugcacuugugccccacaugccccacccucguucucucugguucccacugugucuguugugugucucuauucuucuucugauuacucuuuccucccccacccuuaucucuuuaauguuauugcuauguuugucucugugcuuucucuguguguuuucacucuuuuucuuuccugucucccuucugcaguucuguuucuuggugucugguugucuucuggugggggagaagggauaguuuacuauugucaguacaaaaagugaagaaaaaaggucauucaguaguuuuccuuuaugaagaaaaagcugaagauggugaaugauuucucuguauuuuagaucucuccuuauuuauauuagcucauguuuccagcaggugggcaaauaaacaacacaagcaaacuaccaaacagagagaccuccaugagaaaagaaaaugagagcuuuauguccaacuaaauguuuauuaauguuucauauauuuuuguaaaauggaguucauaucagacuuuacaugccuauauacgaagagaaauuacacucaaaagcagcauccugaaauccaaagcguaaauuuuuuuauacguuuacagagaaagaguuaagauauaaaacuauguauacauauuauaauccaaauauacauaccuauguguauauauauauacguauacauaucaguaucaccggaacaaaauauaugucauacauagaacaaaaaacugaaauuauuauaaaaauaugaauuaugauuuuuucuuuuauauuuuugucuauuuuuuacaagaauuauguucuaauaagaaaccauaaaaguuguuuuuguuuaacaauaauagaauaagguaagccagauugauaaacacaaaaaguuauaagcuuagaaggugaauucccaaauuucucauugacuucuauuuuggguguaaaagaccauuuugagcuucccaaacuagucauaaugaacccuucuagaaguauagugaaauaauaggauuagagaacuaguauacaugguuucugugucaugauaaaguacaguuuucuuuuaacuuccagugccaaggguugaguuaaauguacuccucaguucaugaccccucuuuuuaaaauuuuaucaccauaugccauccucauuucugucuccccauaggaaaccagucuuauguaaauaucuuucagguuacaugaguucuuacaaaauacauauuuuuuaaguaugcaugaacuuucaucauauauaaaagguguaccauuauuuuuguuauguuggcuaaguuuuguauuuucaaagucugccuacauugcuguaaguauauaucuacauugcuguaaguauaucuaaucacauaaugcuccauggagugcaucuacccacuuacgcaugaacacccaggagcacccagguuccugucaguuccccagcaccacagaacauggcagugcugucuuuguccauguccccuuaugcgucugucugaaacugucuuuagcauauauacccagaaguggaauucuuggcuuacaggcucguauacuuaauuuccuacauuaguaccaaauugcuuuccaguucauauuccuaccugcagugcaugaaaauuuccauuucuacuucucugccaauuauuucuaauuuuuaucagaacacuaguaaaacaaguuucuauaccaugggaagauagguguuuuuuuuuuuucuuuuuaaugagaugauacuugucuugaacaucuagaguaucucuuuaauuuccgugggaagagaguuuuucauauaauuuacagugcuuucaaccagaauacauucguuuguucauucauccaaacauaauuauagaauugacaaaagcacagagugacauacuuuaauaagcuuuucucagauuuauauauaugagugagaaaauauauggaaaauuuuuauaacaauauuuaaaaacuugauuuaaauaucugguaaaacuucauugucaaaacacagcauccacauuuguuccaaauacccauggaauauuuacaaaauuaauuguacguuagacaaaauauugaugaauucucaaagcagaaguuuuauaaguaagcccauauucuguaacuguaaugcaguaaaauugaacuuaacaacuauaauuuuuaauuuugcuaaugcuuuaaauugcauuucuauuagguuucagauuugccauuuacauuucuuacuuugagaauuaccuuuguguauccuuugccuguuuuucucugaagguuuuuuuccuauucauuuuuguaaacauauuuggagaccacuguaguugcuguuuuuuuaaauucuguuuuauuacuuuuuuuuuuuuuuuuuuuuuugagaugucucgcucugucacccaggcuggagugcaguggaaagaucucggcucacugcaaccuccaccuugcggguucaagcgauuuuccugccucagccuccugaguaguugggauuacaggugcgcaccaccacgccugacuaauuuuuuuguauuuuuaguagagacgggguuucaccauguuggucaggcuggucugaaacuccugaccuugugaucugcccacagccucccaaagugcuggaauuacaggcgugagccaccgcgcccggccccuuuuuuuucuuuuuuagagauguggucuugcuauguugcccaggcugaucucaaacuccuggccucaaccaaucuucccaccuaagccuucugaguagcugggacuacaggcaugugccacugugccuggcuuccuauugauuuuuaagcuuaauuacauuguguuaauauuggaauaaauaauauuguuauguauuucuuuauuucuguguucaugcuaaaaaagaucuuccaaccucaagauuuguuuuuaaaaaauuauccugcuuuacuuuugauacuuuuugagggauauggaagcuuuaagcuuuaauuuaagcuuaagcuuuuaaucuacauggaauuuauuuuuguguguauagguauaaauuuauuuccaaaugguagcuaguugccaauaaagauuuuuaaauaaaguaaugucaauaaauuaauuuauuagaaaaaucuaauguucuuuuguuaagcuagacuccaaucaguuagaauugguaaauaauuggcaugguucuuuugaaauuuccguucaaaacaacugaaauaacauauggacaccuuauaaaaauugacagaccugaagaggaaauuaauucugacugaaacaugaaggaguuuuauuuauuaaacuugaaguuggaucagaucauccaagugaaaauaucuaacaagcuagauggaucugaccccaugaggauaucaugagugagaugaagauuuuagagucauccauguaaagguggugguaauucuuauaguuauuaaagccaagaggaaacauauuugggagaaugcaaagaauaaauaaauguauagggcuacuuccaggcuguaguuuuucaaagcugauagaaaaaccuuugggaaacaugcugucucgcucuaucacccucuacaaaauuguaugaucauuugucaaccuucugguuuuccugugaguuaauugaguguuuuagcucuugauucauuuucuuucuguccaacccaaagcccuaccauuaucugggaaauuuuauuaucccauuagaguuuuuuuuaccuuaguuguaaugaucauugacuguaauaauuuccacugcauuuuagccauacauucucuuaacuauuguuugaauuuuggauucacucaaaauuauuuguucucugcaaucuuuacuucuucacauaccaaaauaaauuuuucaagaaccuguuaugcaggcacaguacauuguuaauuuucugaggaagauuuuccauaguuuucugaucaaccacacuggcagaaauagauaacuaguucuaauuuccaaaagguaaguaauagauaguuaccaccugaguuucugcuucugcaaccuuuuuucacuaggaauuaaauguaugucacagcauuauuuuuuggacagacacuuggucauugugucaccccuuggugaugaguaaauuuuauugaaaauauacuugcuguuugauugacacaguucuauaaacuuuucacaagaaaagacagucuuuuggugccauagacuauauuucucauuuugacucugacuguuuuaucaaugugugucucugguccuaagccugagugauuauaaaugaauuagcguaaacccaugccucuaaaggaaaagcaucucccagcaggcaccuggcuagcugaaggccagcaguaccaauccuccugccugaagaauagcaguguagggucauaucagaaaacauggcccuuuuccuauguuggauauguuuuucuaagaucaguuuccaccuaacaaguaauuuuuuaauugaaaagcuuuuauuucuaggucugucucaugucuuuaauaaauacgggaaugagucucauuuaguucuuaagcuaaagaguacuacaaaaacccugaaacaucucugagaugguacauuuacuuuccauuguuacucuuguauaagacagcaacaggugaguuugcucucauaguggaaauuaaaacagaagcagccagccagcauauauuuccuuccaagauuguguacaagagaaagccuaacccaugguggcugauaaugccauuuaauauauagucaccuaaaucuuuaugugucagcuccauugcagaggacucagugggcuacuccacacccaagccugagggaugaggagaucauuagagaugcgugggacucucccacggacuaaggaaagugaacuguuuugguuuacugaccgcauauauaaauggauucaggaaaaaaaaaaaaaaaaaguuccaucccaugauggguccucagcacaaauugugggacaugagugcagaugugugcauugugauuauugugaauccguggauggauucaacaucacauggcacgguucugacaguuugugcuuggcccagcuuuagaguagugcuccaucacuccuauagcauccagugcccaccuuuuuuuaggauuguuuguuguuuauuacaugaaggcaacacuguuuaucacuuuccaagguugaucuuuuucugauuucgguaacauaggagaugcagaacuauagaguauaaccuuuuuucuccaaacaagacuucauaguccacauuuuuuucaguuggcauacaauaaauaagugcauuuuaugccuuucuugacauauuuuccaugccguaaacuuuaccuguuuaaaguguacaguuuaaugggucuugauuuagucacagaauugugcaaccaucaccguauucugauuuuagaauauuuuaaacacccuccaaaaaaauccuguaaacauuaacaaucaaucuucauuuccccagccucccaccucugccacagccugcaggcaaccacuaaugacuuucuguuucuauggauuugccuauucuggaccuuucauauaaauggaaucacagucuuucgugacugacuucauucacuuaacauaguauuuucaagguucguacaccucauagcaugugcucauuccuuuuaauggccaaaggacauuccauucuaugaauauaccacauuguaucuauucaucaguucauggacauuuguguuguuucuguuuuuugucuauuaugaacaaaacugcuaugaauauucauguagaaguuuuuuugagggcauauguuuucauuucucuuggguauauaccuaggaguggaauuaaucauaugacaacucuauguuuaaccauuugaggaacugccagacuuuuccaaaaugacugcaccauuuuacauucccaccagcaguaugugaggguuccaauuuuuccacauccuagugaacaguuguuuuugucucugucuuugauugucaucuuccuacugggcuggauaauuauauuggguugagagagaauuuauucuuagacuuuucuauuuuuaaauguuuaccuuuuuauaggcaagcauuacuaaaugaaaaagaauuugaaaugaaaacggaaacauuccaaggcuccucauauaauccaguguaauuguguguuuuuucacacccuguggugcacaccaugacuacuuguguccuuuggaagugcaggauguucacagaaccucagacuuggaagggaccacuggaguccugugaauccuacccacucccaucaacacuucugcugcaucugcaccaaaugacaggccacccucuaauagcuccaccucucacgugcuacuuauggggcagccaguuccauuugccuaaggcuucaguuaucaaaggcuuuaacuuaaauccaauaucuccuugcauuggaauaccuggcucugcucccagagcugcucucugaaggcacaggaaacagaccuagcccucugccucucggacccccaccuccuuuccugauguguuuuuucucaggucuucacuccaugaaccguuccacaugggcugugguaucuacucuccuuucugaguuuggcagcuuuccuggguauaaguuuguugguaucuuguuuuuaaauaugucccucucagcuaagcuuguugugcuucagguagugagagcguauugaccaacacaacuuaccaccuuccauucagugacuggaccaugucuguggccuaacguauguuauuccuuuugaacuccuuaaaucuuuucugccacacccuuccccacaaguuuuuguuuauucucauuucuugaacugguaauacaguacaaccacaugauacaaaauauuugaucaagaguguccuuccuacuccuguuccccagcacccagcccuccuucgcagagguauacaauaaaauuucauccauuuuaaguguacaguuaacuuuuaguaaauuuacagaguuuugcaaucaucaccaaaauccaguuuuagaacauuucugucguuaccaaaaggugcccuuguaccucuuugcagucaauccuuguucccagccccaggcaaccucucaucugccuucugucucuucuggagauuuuauguauauagcaucagauguggucuuuugcaucugccuuuuuuuguuaacaucaugauuucaagguucauccgugcuguaguaugcaucagugguuccuuuuuguugcugaauaguguuccauuuuauggauauaccacauuuugcuuaucuuucaguugauggacauuuggauuguuugauuuuuuuggaugugaaugcugcuauuaauacuucuguaaaaguuuugugugggcauacauuuucauuucuucuggguuuuuacucaggagugaaauugguaggucauaugauagguuuauguuuaacuuuaucagaaauugccuaaguguuuuccagaguggcuguaucauuuuacauucucgccugcaaugugugaggguuucgguuucuccacuuccuugucaacacuugcuauuguccaccuuuuuauuuauagccauucuagugggugugaagugguaucuuauugugaguuuaauuugaauuucccuaaugacugaugauguugaacauuuugugugcuuauuggccacucuuacaucuucuuugaugaagugucuuuuuaaaucuuuuugcccauuuuaaaauuagguuaucuuccuacugaguugaaagagcucucuauauacucugguuacaaguccuuuaucagauguauuuuuuguaaguaacuucucccaggcuguggcuuuugaauugcaaaugguuuuaauacaguaaugaugaagucccauuuaaacuguuugucuuuuauggauuguggauuguacuugggguguuauauucaagaacuguuugccuaaccaaagucauagagauauucuccuauguuuuucauuaaaaguuuauuguuuuaauuauuauguuuaggucugaaauccauuuuuagugcauuuuuuguguacgguguguugucuaacuucaucucuuugcauagggauauuuaauugucccagcaucauuuguucaaaagaguauuauuuucuccaauuaguugcuuuggcccuuuuguugaacacuaauugaucacauauguaaggcuucauuuggaauuuucauucuguuccauugauaugucuguaucuuuuuuuuuuuuuuuuucuuaagacggagucucacucugucaucaaggcgggagugcaguggcacaaucucggcacacugcaaccuuugccuccuggguucaagcgauucuucugcuucagccuuccgaguagcuggaacuacaggugcgugccaccacacccagcuaauuuuuguauuuuuaguagagaccggguuucaccauauuggccaggcuggucucgaacuccugaguuugucaucugccugccuuggccucccaaagugcugggauuacaugcaugagucacugugccuggccaaucuagaucuguccuuauaucaaugccacaaugccuugauugcuguaacuuuauaagauuugaaaucaggaaauauaagcccucuaccucuuuuuuuuuuuuuuuuuucuuuuuuuuuuuucaguaacuuuggcccuugugguccuugccauuucuauauaaaguugagaucauuuuguagauuucuugaaaaaugcuugcuggaauuuugauagagauuguguagaaucaacagauuaauuuggggauuauugccauccuaacaauuuugagacuuccaauccauguauggugagugucucaccauuuauauugacuucugaugucucccagcaauguuuucuaguuuuuaaugugcaaaccuugcacuucuuuuguuaacuuuauuccuaaauauuuuauucuuuuugaugcuauugugagugagauaguuuucuuaauuuuauuuucagguugucacuugcuagaauguagauauacaauugauuuuuuuaucuuauugaucuuauauucugcaaccuggguaaccuugguuauuaguucuaguucuuugaggauuccuuaguauuuucuacaaagaaaaucaugucauuuguaaauaaaaccaguuuuaccucuuccuuucaaucuggauucuuuucuuucagagacauuuuauaaauaaaaaagcaaacaccuacauauacuuuuuuaguaccuaacaugcuuucuuccccuuuuuuauagcugcagagaagguauaauguauuucauaucagucacuucuuuuuuauguucccuuuuuuaaggagaaaauaaaaauauauuuuuuaacaucauuuuagucucuaguuuuauaucaguguuuuauauuuuaccaucuaaaucaucuguuauuucuaaaaugcagauuucguuuccuuuucuagauggggaaacugacacaaagagguuauggcuugccuaaauagagaccgcuaauaaagggaagaccugaaacuggccuagcuguuuggaauccugacacagagcuuuuuuuuuuuuuucccugcaucaaaguugcugccauuccuccugccuaaugagcaggacuuuacaauugccccuacuaaacaugcucugauuuagcccaucauuccuguuauuauuugggauccugacagaggcccucucucugaugaguauuguauguaaauucuccugcuuuccauaucuaagacauuuaugucuaaaaucuuaagaaggaauagccagcaccaaacccagugauugcacacaguaauugcuuaguaaauauuuguugucaaaugcaagauguaccacucaguaaagacaucuguuuugaaauuauauuuggauaagguugguucaaucaguuaugauucuaucaacuuguauuaucauccaacccauauaacuccaucuugcccucaaagaugcuauuaaauguuuuggcauuuuguucaaaucuagguaugguaugcuauguauucuuuugguuagccaguaaagugaccuuauguacuagagaaaacaaggcuaaccuggcagggcaugcucugccugccugacugagccuggcuuaaaucugcucaucuuuuuuuucaccaguuccuugcaaauuaucugauucgugaugcauccuaaauuuuacaugucaucaguguucagcccacuaguuugcaaugccuaccuuuccgaaaaucaaaguauuuccuuucuucaagugucuaacauagaucuuccuccccaaaauucuguuacaaguuucuuugugacucuggaauaugguuuaucuaguucaagggaucagauaugcucaguuuccuauccuuacccuggcuuuaauuuaccuccaccagaccugccuaaguagaaaauucccuaacauuuauucaaaauauagauuaccagaccccuccccuagagauuccaauucauuauucuggguuagccucccucuguccuuauuaacgauggagauauuaacaaugaacaaguuuaagaagcacuauuuuacacuauaguauuuguucagcuauaucuuguuaaucauuuugucauccaccgacauuccaccaucagcugcaaucccugaaauugccuucauugcucuacuugcucugaacguaauuuaaaaggccuuugggacucucuaauacuuuuugcaaugcucuacucaucaggacgucucacgagccuuguaggucuuugguguuugucuuaguauacguguuugagucagcucuuaauuggagagcgcucucuucaguucaucacucuuuuuagcuaucuccaggccucuuuaucucacaugaaaauuaugugcaggugucacuucagaauuucauucugaagaugcaucagacuaauguuuggcuagcauucucuucagaguuuuuccaagcccagugaaaauagccaggcuuuuuuuugucuuaccaccuuauaacagcuuaaguccuauccaccuacaacauucucccuaucacagauacaaggcagcaaguucacaguaucucaagcuuccuccaaaugcaucucaacaguuugaauuggauuagaaagaggacuuguuggcuugcuuauccuguggauaacugugacauugacugcagguaauaauaacaagaucucuuuuauuuuucuagguagcaaaccaugugauuucuucugacucuauuuccucuucugccaguaguuuccugagcucaaacucuacuuuuugcaacaagcagaauguacacauguuaaacaagggcauacaagcagguaauuacuugaaucuaaacuuuuucauugaaauacauugaaauggcucuuaaacauguaagauacucaaccucaaucauaauaaaggacaugaagauaaaacuauauccaacugccaauuuucaucuugucagauuggcauaaauucaaguuugauggcaaguuugugggcaagaguguagggaagcggguucccuuguauauuucagugggaguagaaguugauucacugugaaaggcaauuugaaaguuccuaucaaaauuacuuucacucagcauuuuuacuuuugaaaugucugcuauagauauacuaugaauauguggaauuuaaccuauagauauacuugcauaugugcaaaauaguguacaaaauuaaccacuaaaacauuguuuauagcaggagauuaaagugaauuuagguguuccucaguagcugaaugauuacauaaauuauuguaugucuagauaaugaaugaaauucuacauagaaugaggaagcucucucuguacuaacauggaaagauuuccaaggcauguaauugauuuuaagaaaagguacagaacaguguauagcauacuacaauaugaauuuuuuuuaauaaaagaaagaaaggagggaagagaauugcuuaaaugugcaaaacgaauucucuggaaccauaugggguugugaacagaauaaauggagaccagaagugggaaggaggauuuuuagcuauugccuuucuauaccuuuugguuucauaaaauaaaaauaaauaaacuuucaucuugauuuguuucuuccccucaaauccugucuucugucagccucuuccuuaccugcgugacuaccaaaaggacucuuaaguauuuauugucuuucuaacuugggaucagaguugaaauccuuuacccuuugaacccauauucauucuucuuucccucucauaccuaaaaugaguuacaaauaaaacccuuucuuuuuucuuugcccucuuuuucccuccuacucuccccuguccuucuuucucuuccucucucuucgcaucccuccaucccacacaaagggauuguauuuuugaaacauuaaaaaggguucacguacucacuugaauaaaucugucaacucagccucaagguuacucccagagacaccuaugauccuuccccucagguaacuuggagauugugaacggugccaaaaaacacacucgagauguugggauaacuuucccaacuccaaguuccagcgaggcuaaauuggaagagaacagugaugugacuucuuggucagaagaaaaacgugaagagaaaaugcucuuuaccgguuauccugaggacagaaaguuaaaaaagaacaagaagaauucccaugaaggucaguuucucauuccagaucuuguaguagagaaacuagugaauuucaaguccccugcgaugcugacucuguguuuccaagugacucuaugugguccccaccuacccccagccacaaccuugucagguuuucagaguccagcauggcaguuacacagucaucccugcagcaaaaccagacucaagggcacccuguggccucugacagcugagaccccugagaaccuguauuauaugcauauccuggauaagagcuggguggggcuguaaaaaagugaaaaaucuguguuccuucuaaaaacuguuuccuguaggaguuuccugguuuguuccuguggaaaauguggagucuagaucaaagaaggaaaacgugccuaacacuuguggcccuggcaucuccugguuugaaccaauaaccaagaccagacccuggagggagccacugcgggagcagaacugucaggggcagcaccuggacggucggggcuaccuggcaggcccaggcagagaggcuggcagagaccuacugaggccauuugugagagcaacccuucaggugcagugacguugacuuaacuuuaaugcuacguguagggagaagaagggcaaggcgcagagaagcuggcucugugacuuggugagcugagguguaggccugagacgcucuuuuccagcaccuccgcaguucaccuguuuucacgcacgaggguuggguuucucaucaucugucaaaggcugccuuacuccuaaccauagauggugcaucaccgucgggaucuggggacaaggccgcaggagggaggauuugcaucucugcuuauugggccugugggucccuguguguggagggcccggaggccugacgcuugugcggccucauguguguuccuccauguccguagcuccuguuucugcuccaugucggauuuaaaggaaaccaggucucuucugaugugucccuugggggauaaaggaaauguuauuaaugauguauuugucugaauagaucuuuaaaauagcacugugggaagagcuguauugcacugacauuucaaagaguuguaaucgccauagucuuaguuccuggccuaugcugaaggcaugucuuugaucccugcgguuuccaagcugcagcucucccccauagagagaugucagaggauucuucaacgcuagauacuuucucggcauuugaaucagacuuccccaaaccucuugggcagguggugugucuccaggcauauggagaguagauugcaucauuaaucugaggcugggcauuuucucuuuuuuuuuucuuuuaggaaucgcuucaguuucacagaccugacuucaucucccgcucuggggagcggauaaagcgccugaaguuaauaguccaggagaggaagcugcagagcauguuacagaccgagcgggaugcacuauucaacauugacagggaacggcagggccaccagaaucgcaugugcccgcugcccaagagagguacgcccugcccguucacuuuccugugaguggaauagagaaggcaaggucugcugcucugcugcagagcccugcuaaaggccagcccaggccaguuaccugggcagacagugaccuuuugcuugccaagacucaaaccuucuuagcuagcagaaucuccccaacuuagccgucagcacauucaugauccaaguaagcccaguuacucuaagcccugucacugcaucguaaaccagcucugugucugugagcaaguuaguuccaaaaguauauugauuuuuccugaaaagauggggcugauuccaggcuugccuaccucuuaggaugguaauaauaauaauaauaaacacauaguccuuacaucuugcccaggcacuguucacauuagcgcuuacagcacucucaguagguacuauuaauauaucuacuuuauagugagaaaacugaaucaaagggagauuaaguaccucucccaagaugacauaccuaguaaguaaaagcuaagauuugaacccaggugugcuccucuggagucugcauucuuaacaauuaugauaagcagaucuugauaaaauaaugaaagcugugaaaacuacaaagcacuaccuaauucuuuuauccaacuuuagaaaccggccagauuuuuaauucaaagccuagucuuugcuacagaguguuagguccuuagggccuuaggcugcugucccuguuacccuagucuuacacuggcuugccuuggucauugcuccccacucagucuugccagcucaggguaggggcaccaaguccuagcagcucccucucccagcucuugcaccacacccucuggguuaagucacuguccacugaaaacccuuucuucucuugccuagucuuccuggcuauccagaagaacaagccuaucagcaagaaggaaaugauucagagguccaaacgguaagaccaagaaaacaagaguacguauacaaguguaaaccaggccaccaaguggucgggagcucuggcuugcacccagaauaaauguauuauacucaaguuuaaacauuaugagaaaguugugagagucauuucucacuuauggcacugaaaaaaaaaaaagcacaucaugguaugaaugacucauaugcaaaagaugaaaaacuucucacuaauuugcaugucuuaggcuccucuuuauuagaaaccuaaauguaaauaaagaauauuuuaggccagguacgguggcucaugccuguaaucccagcacuuagggaggccgaggugugcagaucacaugagguuaggaguucgagaccagccuggccaacauggugaaacuccaucucuacucaaaauacaaaaauuagcuggguguggaggcacacgccuguaaucccagcuacucaguaggcugagccgggaggaucucuugaaccugggaggcagagguugcagugagcuuagauggugccacuguacuccagucugggcgacagaacgagacuccaucucaaaaaaauuaaaaaaaaagauuauuuugaaauaaaauuaaauauguauuuagaccacaucuuuuauucuagcaaucccauuucuaggaauugaucccauagggugagaaagaacaguguucuccagaacacaguaaguuaaacuuuuuuaaaagauuaaaauuucgaagcaugugaacacuguuuccauuuguggucuuuaaaaauaaguauuugugccuauguagauguguguacuuuuauaugcauagaauauuucuggaagacagaaaaaacugguaauacugauugccuuuggaaaggauaacaguagauuuuuugacuuuuuauaauuuuugaauuuugugccaugaugaacgaacauuagcuacucguuaauuaauucauuugaguguugaauguggugguacauuucuguaauccuaccuacucaggagucuuaggugagagaaucucuuaagcccaggaauuugagacugcagugagcugugaucacaccauuacgcuccggccuggguaacagacugaaacucuguauucaaaaaauaauaaauacaauuuuuaaaaauuaauucauuucagauauucauauauugaucaugagaaugccagagaauaagguugacuuuuuuaggcauucauuggacacuugcuuuaauaagaauaguuucuuaguuggcauaaugcuucugaaguaaugguacuuuaaaauaauuuaucucaugaacuuuaagcauuccucuugaaaucuuguuuuuacucuaucuagucagcccuuauaggcaauccaaagggaugcuuuggaugcuuuaguccagugguucucagagaguggucuguggaguccuggaaguugcugagacccuuucaggcaauuugcaagcucaaaacuaauuucagaaugacaccaggauguucugugccuuuuuugcuguguuggcuauuugcacugaugaugcaagagaaauggggaggaguaaaaucacuggugucuuaccacuauucaagacaguggcaccaaacuguaguagucuaguaggcauuguauccugcacagccucccgccaggagugugauggaagaacaaggaagcaguguaaauggagguacacgggaagcacuuccuuugcaccgugaaggaugaugacuguuuuaaggaaaagcacuuaugccaugguuugugucgugagcugaaccagcugccuuuuucauggaacaugacuuuuacuugaaagaguaacugacagaaaaccaauuauucugacuuguguuuguagcagacauuuucuugaaaaugaagaagugggucugugacuucaggaaaaugucugacaguaucuguugccaaagaaaaugugaguuuucaagccaacaauagaaaucuagaaaacuuguauucaccuccaugggcuugaugaccucuuaguacuuagaccuuucugacgagauaagcgguggcauuaacaaaugugauguuuuucauguuaucuaaauacauuugucaacauuuggaagaucugcacaacucccuggaccaggauuuuccaaaugauuguugcuuuuuguuacaaaaucagggaauagauagaagauucauucaaauaaugaaagauagacugauggauuuuuauguaacagaauaggaaaaguuuaugacauguuuucagauuccaccuugcaacuaauuuuuaagaagcuaccacuugucagccaggcacaguggcucacgccuauaaucccaacacuuugggaguccaaggugggcagaucacuugaggucaggaguucaagccuggccaacauggugaaagacuucucuacuaaaacuacaaaaauuagcugggcauggugguggguaccuguaaucccagcuacucuggaggcugaggcaggagaauugccugagccugggaggcagagguugcagugagccaagaucgcgccacugcacaccagccugggcaacaagugcgaaacucugucucaaaaaaaaaaaaagaaagaaaagaaacuaucacuuaucaaguuuggguguaguaucaaagaagaucaagaguuaccugaaaagaguauugcaguaacuucucucguuuccaaguacguggaaaaucuauauguaagcuggauuuuuuaauguauacuuuaaccagagcagguugggacagcagacuuaauacagaagcagauacaaguccagcugucuuccauuaaaccagacauuaaagaguuuucuaaaaaauguaaacagugccacucuucucacuaacauuuuuuuguuuucaaaaagucuuuauuucccauuaaaaauacagguuucuuauguuagccugucacaggcuuauuguuauuucaagugaauaaaaaaauaaaguuuugcuuaauuuuuaauuuuaauuuuugauacaguaucaauagauaaaaccuacauugggaucuucagcauuugggagugugaagggggcccuaagucuaaaauauuuuugaaccacugcuucauucuaacucagucacaaaauggaauuaggggaaaucauacaggguuuguuguggggcagcuacuaauacucucaccucagcaagagcagucccugcuguaagggacuaggaagcuugccuacaggaagacagccaggacaucuccuaaaauguaucaaugcuuucgacgagaaauauaugaguggauuuagugcccaucuucuggagagacuuuuuaaacuguuuuuaaacugguacauuuucauuagguugcuucuguucauguuuauuucuuguguggccucuuuucaagggagugaucuguuuccaucugagaaucuucaauaucaucuaguaacucuuaauauuuaggaaacuacaacccagagaggggaaguaacccagcaaguuagggucacagcuggaguuagagccugguguuuggccuucaauuguguccuauuaaggauuugugucucuggagccuguguuacucaucuuuuguuaucaccuaucucuaccaaagauauuuaaagguucccgugagaaggaaagauuucaagaggaaagaacauagcucuuuuauuuggaagcacuuguuccagaguggccuucaggagacaccuucaccuucucuaauguguuucccgcagagcccuccaugaaucuagugauuuuuuuuccagauuauagaaaacuuuaggaaauauagagaaaaguagaaaaaagaaaaugaauaucacuuaucauccuuccaucuaauggaggaugggaauuuuuggugggaggcgugggaauuuugcagagaccugcauaacacacacuuuuuucccucaaauuguuaaucauacugcauauacagguuugugucuugcuuuauuuuauucaacauuauguugugaaccuuuccuaugacacuaaaaauucugaaacuuuuguuugguauacaugaaacauacuuguaacauauacauuccauuauacuucauaaucuauuuaacuguuguuuuguuggaaacguauuuacaaugagagugcauuuaucaaaugcacauuuguguuucucccaacuuaaaaucauugccacccaaccccugcuagaacagaucccauguuuuucacauggccacaagauccucucugcagcccaccucacccucacccccaucuguuucccaccuauuccuuuacgcuccuuuuugggaagccucgaguccauuuuuaccaacacucauuuuccccaccuugagugucuucuguccuucuccccauucccuuucugcucuuauccaucauuauuauuuuuuuauuauuauuauuauuuuugagauggagucucacuuuaucacccagcuguagugcagcaguggcuugaucuuggcucagugcaaccucugccacccagguucaagcgauucuccugccucagccuccugaguagcugagauuacaggcaucugccaccaugcccaccuaauuuuuuuuuuuuuuuuuuggugugugugguuuuaguagagacgggcuuucaccaucuuggccaggcugcucuugaacuccugaccucgugauccacccaccucagccucccaaagugcuggguuuacaggcuucagccacugcacccagcgcuccuaucuauucuuaagacccaacuuaccuauaauuuccucucuggagccuuuccgaaccuccuuccaccagaccaaguuucuucuccucuagaacauuuuauaggugugaccauuuuaguacuuuuccauaauuucacuuguguuuccaaacacaauaguaacgcuguucauuaucuuauauugaaacaguccauuuuugcauguagagcagaaaguagaaguucagcucuccuucauuuaucucacuccuuuccccccuuuaucccacuucuuuccacauguaagcacuauuaggauuuuauuguguuuguauuuaucuccccuuccagauugugagccccgggcuaggguuuucugugcuggaguaucuaacggggcccagggccuuucugagagggaugagcuccuggagagugggagguauagggagggaugaugagaggagaucucaugacucugcacccugguaaccuccccgauuucuguccuuucacuggugccauuucuaaggauuuaugagcagcuuccagaaguacagaaaaagagagaagaagagaagagaaaaucagaauauaagucauaccggcugcgagcccagcuauauaaaaaggucaguggguccucugucuagagugggauggaucagguuuauuggcggaaagagaaauggagaaaacacguugccuguugagugugaagucagaaugaaccgcauuugaggaaugaacuuagaaugcacuggaccaguguugaaauuuggaagaaggcaucuguaauuagacuucaaaucagguuuaacuccccauccauaaugguguaaggcccuuuccaugcauucguuugcagugaaaccaaauuucacacacaggaguucauugacauaucaugguagaaauaccagaauuaucagguuuccauuccagagucccagguggugauuucaugccccucauuggugagucagauaccuuuagaacuguuaaacuggaaaauguguaacugcggcauaagaguuguccacuuggauggucagaggccuccaacuugucaccaugcccugcccauugucccaguagagucagcguugcugcaaguccaagaaccucacggggcaggguugguguuaccaguuaauucucugagaaaccagaccggcuccuaugccugaagggccauauacuucacuguaguuguuuccuucucacccugucagucaccagacugaugugggaugggagcugcuucuggagcaggccccagaacccaggcgggugccucagguggaggccccaggcaccacaccaccugucuggugugucagcaucgcagggccaggccucuccuuaugcuacuguaugugggaacugauggauuaucugugucucuauagaaauaauagauauugauuacagauccucuuuccugaaccuuucgugaaguauuuuuuauaugacgaccauaguuucugaagcagaguaaaaugaacaagauuugaauaggaccacacugauucuccuuggugacauggaugcagggaggagaggcaucugccucugauggcaguaauaucuaacuucuuuccugccuuucuuuucuucuacagagagugaccaaucaacuucuggggagaaaaguucccugggacugacacaaguuuauuuuccucagagccuuggaauucuauuuuaugaaccuagagaagcagaauccuuacuuuugugagucugguugaauaaagcuuauucuuuguccauguguauuuuagaaauaguaacuucuaaagagucuggaacaaaguggugauuaaaauuccuaaugguuugggagcaauacuuucugcauaguggccuuguccaauggccuguguguuacaaugauaugaucauuucucaagaauaagucccuuuuuguauguguuuuuauacuuuuagaaaauaaaaacuuuagauuaacuc

SEQ ID NO: 191642 - RNA, 17960 nt, Homo sapiens
uagguucuaaagaaauuaucuccuaaguagauuuuaauauaaauuuugaacaguuauagaaaauaaagauggccuuugggucaauaacagaacauaacaaaaacacuaaaaauuucuguacauaaacacacgcauaucacaagucuagucagaaagaaauacauagaaaaacaagauagaauuuuaaaaauaauuugcaagggaaguucucaaugcuucaguucuaaaauauugucuucuuuuagaaaaauuuaagacuggaauaacagauuguuuuuccugcaaugcuguaauuacugcaaauuuaucagcaaagagguaaacagcaaugcaauuuuuccuuaagcuugaauacauaagggaacaauaaagaaaccugauuagaccugaacuaauuaaaagucacaccaguaauuuucaggccagcucuggucuccagguagaauuccaggacagguuuguaucacuggguccauucccaacaggcuggauaggagagucuggaguaauuauaaggauaccaccuucuucuauccugggcugcccgacuggcauugggcuucacauuccaagaauaccuccugugugaauaguccucuccagggggaccaggaggagggagauggugucucugguaaacauguggauucucugaaaauuuucuuaaagcaaaacaaaaaguaauaagccauuacuaggauuaauacaauaauuuuuauuuauuuuaaauuuauauuuucauaaaauauuuuaaauuuauaaauuuacaaaauaauauauauucuacuguuuccuaccugugugaccuaagcagauaaaauacuuaauuguuauuucccuaaguucuuuauaaaauggggcuaauaauacuuuucaccuucacgagcuguuaugaagcuaaauuaaaaaaauacauuucaauuaccuacaaugcccuggcacaccguggauucccagaagccuuuccaccuuucccuacagagauaaaugcaugcccauacuauucuaaucaaauacuuucucucccaaagucuggcaggguugacauaagacagaauaagcuaguuaguacugagaacagauaucugcuuccacuuuauaaacgaacauacauaaauuaauuaugaagugugaaaaacuuuaagcaugguauaugcaacaaauuugaaaaauuaggauuuaaauuaacuuguuucaaaagcaagaccagaaaaucucauauaauuauacaaaagaaaauuuggggcugggcgugguggcucgcacuuguaaucccagcacuuugggaggccaaggcgggcggaucaccugaagucgggaguucaagaccagccugacuaacauggagaaaccccaucucuauuaaaaauacaaaguuagccaggugugguggugggagccuguaaucccagcuacuggggaggcugaggcaggagaaucauuugaaaccgggagguggagguugcggugagcugagaucacaccauuacacuccagcccgggcaacaagagcaaaacuccaucuuacaaaaaaaaauaaagaaacuuuggaaauaugagaaaagaaaaaccccccacugcagagcccucaaucccacuuacuauaauucaauuaguuaguauuuccuuuuguucuuuuccccagcaucuuuuucugacuguugaaucacagccuauuaguuucacuuaucauaaaugagcuaacacuuccaauggcuuuauaaaauguuauaguauggauauaauuauuuagcuacauucuccacuguuagaaauauagcagcuacaaguuuuuccacaaccacaaauaaugcugggauuaacacugcaaaacauauacuacuguauccugagcuagcccagcaucugacacauggaagggaguuugagaaaugugcugaaugauuaaguaaauauagcuuuuucuguacuuugaaguauuuccuuaagucucagaaugaaauuacuagguaaaguauuuuuauggcucuugaaauugugcuucaaaaggcuuauaccaauuuucaaugccgcaagugacauguuuuuugaaauguuuguuuacaucuuuuaaaaaugucaauuuuuuuaaaguuucuuuuuucuuuuuuuaauaaaaacaggauuccagcauguugcccaggguggucucaaauuccugggcccaagcaguccucccaccuuggccucccuaagugcugggauuacaggugugagccaaugcaccuggccuaaaaauggcaauguauuuuugaaaguguuuacaacgugcuaaacuguuuaaauucauguuaacugucaauaacaaccacuaugggguauguauuauuaaaauaucuaucugacuaaugggaaaaaugaaauguagauaggcuaaguaucuuauccaagaucacaaagcaggugaguaacaaagccaacaugcaaauccagguccagccugacaaccacuacaauggagugcuuaucaaaaacuguugcuaaacuggcugggcgaggugguucaugccuguaaucccagcacuuugggaggccgaggcaggcagaucaccugaggucaggaguucaagaccagccuggccaacauggugaaacccccaucucuacuaaaauacaaaaguuagcugggcgugguggcagugccuguaaucccagcuacucgggaggcugaagcaggagaacugcuugaaccugggagguggagguugcagugagccaagacugcaccacugcacuccagucugggcgacagggugagacucugucaccaaaaaaaaagcaaacaaaacuguugcuaaauuaauaggcaagaauaauagcuugcuauuugugauaguuaauuuuaggugucaaguugacuggguuaagagauaucuagauagcugguaaaguauuauuucugggagugucugugaggguguguccaaaggauacuggugugugaguggguggacugagugggaggauccacccucaguuugcguagguaccauccaauaggcugggggccuggauacaacaaaaaggcagaggaaaggcaaauuguguucucuccuggagcuggaauaccuuaccuucuucuccuacucuuggacauuagaacuccaggcuucauggccucuggacuugaggacucauaccaguguccuccaacccuuaccagauucccaggccuucagccuuggauugagaguuacuccacuggcuuccgugguucugaggcuuucugaguuggacugaaugcuaccagcuucccugguucuccaguuugcagacagccuacuaugaaacuucucagcuuucacaagugcauaagcugauaccccgaauaaaaaagcuccuccucccauccacccacccauccacccauccaucuauccauccauccauccauccauccauccauccauccuacugguucuaucauucuggagaacucauacuaauguaccacuuuaaccauacugaggucuuccccauuuuccaagugaaaauacuuuugucguuuuaucuguucagauccuuugcuauuucucuauuaggauuuuauuauuuuucuuauaauucauaucaacuccuuaaauaacaaucuuccuuauucuaaaaacuauacuacauuaauguagccuaagaauauaagauccuuuuugauagccacaucaaacucuuggcuuaaguuuaaaaucaaucaaaauuucuaagucccuuuccgaauugccucugaaaagucacauauucccuguccuguaacugauuuuccagugcuaaaugcaaaauacagagcagaauaauaucuccugguucaaacugaacagcaagaauuccuuaucggccaggcgcgguggcucacgccuauaaucccagcacuuugggaggcugaggcggguagaucacagggucaggagaucaagaccauccugucuaacauggugaaaccccaucucuacuaaaaauacaaaaaauuagcugggcaugguggcgggugccuguagucccagcuacucaggaggcugaggcaggagaauugcuugaaccugggagguggagguugcagugagccgagaucgcgccauuguacuccagccuggaugacagagcgagacucugucuccaaaaaaaaaaaaaacgaagaauuccucaucaguaucauaauguguuuucauuaacuauaguauuaauuucuaucucaauucuagaaaagggaaaacagagagagguaccugacugauuguugcaaacuuugggucuggguguggaaaugucgaggagcugagugacccuggaucugauguagauuauaccuagguccuuguuuaacaggcuuauuguggacugguugcaugagaugugcugagucuucaaaaucacuugaccuggguacacuggaauuccaauuccuuaaagagaauauuuuccacacaauauuacugguuuccaaauuuaguagucaauuuagugacuauauuuuggcauaugaaaauaacaauuucuuccuucucccauuccuauuuguuuacaucuccccccaacaaacaaacaagcuaccagaagaaugaacauaugcaacuuaaauuacauaaacagagaucucccugacccacaaaucucacauauauaacauaagacuuacuuucugauaggaccauucugaaggucuucaauguaguuuugucuuucuaagcaauguccccggcaccuauugaauacugaggagaggauaaacuguuagaaauaacuguacaaaaagcagaucuuuccagaaaaagcaaauuaagcugaaauucacuauucaagcuguuauaucucacuacuuccacauacaucuauagacuuuuggcaagacuaucuuauauuggaacaaacgaauuacaaacuucuuuuuuuccaaaauuugauaaauucuucuacauuuccaccuuuaacuuuaauaaaagggaaaaauagugucaacccucauacuuacauucaauugcaucaucuggccucacgccuucuacaucaaucaaauaucuaacaaaacaacauaauuugggucauuuauauacgaaaagaaaaaaaucaaguuuuuucaaaaaagguccaauuucaacuuauagacauagauauaaaaauccuaagaaaauaucagcacaucaaauccagcaguuauuaaagaaugacauaccaugaccacaaaaagacguuuuucaagaaugcaaggaugacccaacuccagaaaaucuauuuauauauuuauuuacauuaauguaauuuaauaaacaaaaggaaagaaaaugcagaaucauuuuuuaucaaaaugcuuuauacacuaaaaauagagacuuccuuaauaugacagaguauuuaucagaaaccaacaaugaacaaaagacaaauugggaaaaauauuaacauuauaucuaaaaaauacuguauaaccaacagaaugggccagaaacuugggagucaccaucacugucagccauuucuuccaaacucucauauucaauucaccaccaacuccugacaacaauauuaccuaaauaucucuauagaguauaucuguaucuuucuaccaaaaugaccaccaugcccugguccaauccaccauuaugccucaguuccuacaaacaccucccaacuugucuccuugcuucuaccucuuucccucugcaguguauucuccacucagcagcaaaaugauagguugaaaauacaaauuugaauguguuccccacacucauccccaacaaaaaaaauucaaugguuuucuauugcucuuaagguagugacuaaaaccuuaaacauagcucugcaugguuucagcuccuauucauauuuccagcuccauuuuaacgccauacuacccccauggcccagucucccuagccaguuccuccaacacaguauauauuuuccuguuaauauggucucugcugauccuuacguucagaauucucuccacaacaucccuaccugguuaacaccuacuuauacuucagauauuugcucagaccuccccacagaaaccucuaguccucuuguugaagucaaauccucccuauucuaugcucucauuguaccaugucacuccccuucucagcacuuguuggaauuguaauuguauaggcauuugugugauucuuuaauaucuacucccucccuagacuguuaggacgcacaaagggcagcuaaagucucuuugcuaacacgcagcacacugcuuacacauaauagaugcucaggagauauuuucugaaugaacaaacauaacucaguacaguguggcaacauccauaaaaagcauaacgacacauacuauuugauuaagaaauucuauuuugagugaaauuaccuccggggcuaugagauaugcauucaaaaauauuuacauagaaauguucacuacuucaauguuuuauaauaucaaaaacuucugacuuuuguguucaucggugugcaaagaacaacgcaggccuuaaaaagaauaaggagucuggccaggcgcgguggcucacuccuguaauaccagcacuuugggaggccgaggcggguggaucacaaggucaggagaucaagaccauccuggcuaacacggugaaaccacaucucuacuaaaaauacaaaaaauuagccgggcgugguggcgggcaccuguagucccagcuacuugggaggcugaggcaggagaacggcgugaaccugggaagcagaacuuggagugagucgagauggugccacugcacuccagccugggugacagagcaagacuccgucucaauaaaaaaaaaaaaaaaaagaauaaggaguccaaguauuuucaaagaaagaugucuaucacauauuaaauuaaaaaacagaaugucuaacuauuauaccauucaauaacauguaugcuuguaucugcauuuuuagagucugaaaagauguguacuaaauuauuaauggugguaaucucuggguggggagcaagacugccuucuacuucauguauuucuauaccaguuccauuuuuuacaaccuuacauuaccauuguaaacagacaaaaacaauuuaaaauggucugccucugggguuggcaacuuaccugcaaaugagguagccaguccuguuuaaaccauggguacaguggacaccaauaaguuuaucuauaaaaagaaaauacaggguuaaguaacugaaguagauacacaaguauauaacauuaucacugcccugaaaaugaauaacucuuaagaggaauuguuuuuucuaggaacauacuauaaagaaucaucuaacagaaagccaaaacucacugcuucugggaaacuuugcauagucccaauuagacucagugauguaaacugcaagccuggucagacacuaacagcuaaaacugcaaugagacaaacccgucuaucuuaaaacagaaugcccaucagcaacugauuuaauuauacaaaaagggagugaaagcaacaacaggcuaagagaagaaugaaauuuguuucugaaucaaacaaauaaaaggccuucacucuugauacugaauauuaaggacaguuuccauaguacucuugaguucccgaagagcuucuauuccuucucuuguucggugcuccacacauaccacaggucuaccugcccugugaaguacucagguaaauagcacuauucacauuuuacaaugaaaaggcaaggcuuggagauguaagucaaagcaggcaaauaguacaagacuagaaucaagucuaagauuuuucccauuacaccacaguauuucuuaguccaucuuuuuaaaaaauuacaugaggaauuaaauaaaaaaaaguguaguuuaucuuugcaaaaucuguguccaugacuagguagugucugguaaagaaggcacucaucagccaggugugguggcucacgccuguaaucccagcacuuuccaaccuggccaacauggcgaaaccacgucucuacuaaaaguacaaaaaauuagcuggguauuguggcgggagccuauaaucccagcuacucaaaaaaaaaaaaaagaaagaaagaaaagaaaaaaagaaggcacucugccgggcaugguggcucacgccuguaaucccagcccuuugggaggcggagguggguggaucaucugaggucaggaguucgagaccagccuggccaauauggugaaaccccaucucuacuaaaaauacaaaaacuagccaggugugguggugggugccuguaaucccagcuacucgggaggcugaggcagcagaauugcuugaacccaggagacggagguugcagugugccaaaauggugccacugcgcuccagcuuuggcgacagagugagacuccaucucaaaaaaaaaaaaaagaaagaaaaaagaaggcacucaucaucgccagccuggauuacuacaacaaacuaaucucccuacuucuaucucaacugauccuccauauggcagauguuaucuuucuaaaacauaagccuggcuggguuguuuuugcuuaaaaaucucaauuuagcauagcaugaagcccaaauuuagcauggcauuuagaauccuucauaaacugguaucaaucugucuuuccaaccgaucuaaguccacaaugauccuaacuaugauuuacaagggcugauaugauccaccucccuucugcccagccccaaccucucugaucccguuucuccugcucuuacccucacucacuccacuccagccacacucggcucuguaacauuccucaaacaugccuagcauagucaugccucagggacuuugcaccugcuguucccucugccuuaggacauuccuccccagacacccaauggcuugguucauuacuuccuuuaagguucugcucaaaugacaucuucauaaagaggccuuccugaucacucaccucuucccucaucccuuuaucauguuuuguuauucuccaaagcacuuaucaccauauauauuccauguauuuauuugcuuauuucucuccccgacuagaauguaaaguauauaagggcaaggacuuuguucuauuuccacuuucuagaaaagugacuucaacauagguuauauaauuauuuguugcaaaugaacauaugaauuccaugccuuuucacauuaucuucuagucacacaagaggcugccucuccauggcuuuaggcccugugccuuuugugccuaauccccaaaacugggcugcccuuuucucauacuggcaaaauucucaucccugcagcucgaauguugucuccugucaggccuuccucaaucucuccucuauauucucacugcacuuaauuuauucuuuuauuaugaugaacugucuuuuuuguucuuuuuuuuuuugagauggagucucgcucugucgcccaggcuggagugcaguggcgcaaucucggcucacugcaaguuccgccucccagguucacgccauuccccugccucagccucccgaguagcugggacuacaggcgcccgccaccaugccuggguuauuuuuuuuuuuuuuuguauuuuuaguagagaugggguuucaccauguuagucaggauggucucgaucuccugaccucaugaucugcccaccucggccuccuaaagugccgggauuacaggcaugagccaucgcgcccggcuuuuuuguucuauaauuaacccacaucuuuuuuuuuuugagacagggucuugcucugucccccaggcuggagugcaguggcgccaucuccgcucacugaaagcuccgccucccggguucacgccauucuccugccucagccccccgaguagcuuggacuacagaugccugccaccacgccuggcuaauuuuuuguauuuuuaguagagaugggguuucaccguguuagccaggauggucucgaucuccugaccucgugauccgcccaccucggccucccaaagugcugggauuacaggcaugagccaccgcgcccagccuaacccacaucuuaaaccacaugcacuacauauuuauuuuccuagauaacugugaacugcuauaacaaaaaacaaagacugcuaucaucucugugucuucaugcucuaacaacaaaucuaaaaggaucucaguguuuacugaaucaauuuauuuucucagucccuacuaguucuagaagcgaguggagaguguaguguccucuuuuuaucagugagccuguuaucugugggaagggauuauagcagagguagccaaaacugauuauaaacaaggucccaagccugcuauggcagugaguacugcaagacuuagacagucagcaccacucaggcagaagaccaacauggaguucagucuauccaacugacuacaaucaguauaacgugaacaacuaagauuuaaaaauguguucucauguauucauaaggaccuccuagcccucacagaacagaugaagugcuauauaaaaauuucacagaaaagagccuggaagcagugaauaggccaucagcuguacccucauaucuuaaaagguaguauuucugugacaacagcuuauacaaaugggaaagccaaaccucucaaguuuuaaaguuaaaguacaggggaagaucugugaacaagguuuaacauaauuaaaagcuaguguccacauuaagugagcgacuagguuacaauuugaaauuuuaucuucaaacccacugauccagucucuaucucucaccuuccauucccuaucuucccaccucugucucuauucuuucuccacuacuccaucacauuuuuuaaaaaggaguauuuacugucagauuuauguaacaaaguguacacuccucaagcuaaauuuggaaagaaggcaaaugaagccucuguccugugggugucaguggcuuuccaaagauaaaagcuucuucagucuuaaaauaugacaaauaucauguucuuucuggcagagagaugccagaaaaaggcaacuggauccuuaagauaaagaagcuguuaaguucuauuuucaaaagaguaagguaaaucuuaaagcaggaacaagaaagcaccagccuuuggcuuaaguucucccaugugaagaauaagagguggugguauccuuccccaucuguacucaaagcggaaaaacagcagaaauaucuuuuuuuuaauuauacuuuaaguuuuaggguacaugugcacaacgugcagguuuguuacauauguauacaugugucuuaaauacauaugacaaaggggcaauuccacuggugcacucuuucuuguuuugcuucuagggguccgucccauucuuaaucuuugcccuuucuugucucuuucacauaacucuaagacucagaguuuuuuaaucuuuucuucuacuucucacuucuuaaccaauauagaagacaaaaauaacauuuuaauuuuauauauuucucauucaaauuaaaaaagaaagaugagccaguucaguucauauuuugcacuaaaacuaauuuaacauuccaaaguuaaauuauuugugaucaacaaaaggaaaaacaucuuacccuauuagcaccaucugacauuuucaucaccuuagcaucauuaaauacaacaggucugagguuggaacuauaaaaaaauaccaaaaauccccaaccccauucauaaugcacaccacaguucagguaagaacaaaaacucaccauuaucuuuauuuucuuucaaaaacccauuaacagcguguuugaauuuaaaaauagucucaucaucaggcacuugauguccaacuguaaaaauuuuuaaguaaggaacaguuucuggcaaauccuauaaagcaaaaccauaaaagauguguauuauuucacuuguagagaaauaauuaaagaguaauuaggggacccagaauauaagccaagagauuauaacaaacuuaauaugccaauaucaguauacacaauucugauaaaagagccauuuuuuccaacacugcuucaaccaggaaguaucacuugauuuucaauaaaacuacauaauagauagucacuagguauacaaaacugaaagcaaauuccaugugaaugaaugcauauuuaacuauaaauuauauaaacaguuccauuuaauauuuuauaauucaagggccagugccuucauaaagcagcuaugauuuaaguagaagaguagagaauagagucagaagaacuuggauuugaauugugagauagagggaauuccaggcacuauugagaaccgauauucuuggggugggagaaaaguagauacagauaaaagacagaagaggcuaagucaaaaucauuuuaaccauccacaaguguauaguucaguggcauuacauucacaguauuguguaaccaucaccacugucuauacccaaaacuuuuucaucauccccgacaaaaagacucugaccacuaaaccauaauucccuuuucuccccaccucauagauccuuuagucugcuuucugucucugugaauuugucuauucuagguacuucauacaaguggaaucauauauuuguccuucugugucugguuuauuucacuaagcauguuuuuaagguucauccauauuguagcacguauuaaaucuauucuuuuuuauggcugaauaauauuccauuuaagacagcaauuaaaaacauguaauuagagaaaucacuugguucucuuuuaaacuuacuacccaucaaagaaggccaagcuucacauuagcacaagaugauuacugaauuacuauaaauuauuuuaggaucagaaggaagaaaguucuuuucauugaaggguuccacuuaccucugguuuauaauagcguugaguauauguuaaaucaauaaucaguccaaguucuucauuuuguucucggauuuuguuaaaaagauccaaaggggaaaagcauucuucuggagcaaguuucuuuucaaaacucugucacagagaaugaaauaagagcaaauaugugcuuaaaauccuguacuacauuaggcauuuauucaaguccugugaugcuaacauacaacgagauucaaaggaaaguuuccauucuccuggaacauagaagguauauuacaacaauccuuucuuccagaguggucagaaagaaaaaaauaagcccacuucuauauauguauuucuguauuuguuucauguuggucuccuaaucagacuguaaucucccagauuuuauucaccacuguaucuccagcuccagguggagugcuuaucauauuuagugcuuauaaauauuucuuuucuuuuuuuuuuuuuuuuuuugaaacaggguguugcucugucauccgucauccaggcuggagugcagugacacaaacauggcucacugcagccuccaccuccugggcucaagcaauacucccaccucaaccucacaaguagcugggacuacaggcaugaaccaccacaccuggccuuuuuuuuuuuuuuuuaaagagauagggucagcugggcgcagugguucacaccuguaaucccagcacuuugggaggccaaggcgggaggaucacaaggucaggagaucgagaccauccuggcuaacacugugaaaccccgucucuacuaaaaauacaaaaaauuagccaggggugguggcaggcgccuguagucccagcuaccgggaggcugaggcaggagaauggcgugaacccgggaggcagagcuugcagugagccgagaucacaccacugcacuccagccugggugacagagugacuccaucucaaaaaaaaaauuuaaaaaaaaaaaaaaaaaaaaaaaagagauagggucuugccgucuugccauguagcccaggcugaucucaaacuccugagcucaagcaacccuccugucucggccucacaaauaaauauuucucacaugucuacauauaugaaggauggcuuucauugcugaauauucuuuuauguauguggcuuauuuuugaacuuuaugcucuguuccuucaaucugucuggcuacucaggugccagcaauguacuuuuuaaaaaauagacuaguuuggcugggugcgguggcucaagccuguaaucccagcacuuugggaggccgaggcaggaggaucacgaggucaggagaucgagaccauccuggcuaacacggugaaaccccaucucuacuaaaaacacaaaaaaauuagccaggcgugguggcaggcgccgguaguuccagcuacucaggaggcagaggcaggagaauggcgugaacccaggaggcagagcuugcagugaaccaagaucacaccacugcacuccagccugggcgacaagcgagacaccaucucaaaaaaaaaaaaaaaaaaauagacuaguuuucagagcaguuuuagguucacagcaaaacugagccaaaaggacagauaguucccacauguacuuugccuuccccaacccacccagacucccccacuauccacauuccauaccagugugguccauuuguuacaaaugaagaaccaacucugacacaucguuaucaccaaagucuagagguuagguaugcgugauucauucuauguuaugcauuguauguacauauuauguuauauauauuuugccacaaaaaaaaugagagaaagaacuaaguucaaguuuugauucuuccuuuucugagccuguuugauuaucuacaaaauuauuuauuagauguaaccaucuauucucugagcuuagugcagaauaagcacucaguaagagauauuaguacuacugcuacuucaucagcacaggauuguugugaaauguguuaauauacgugaagcccuuuuauagguuuugaucaauauauaacauguauccacccuuagaguaucacacagaauaguuucacuucccuaaaaauucccugugucuccaacaccuucuuuuuggagacagggucuugcucuguugcccaggcuggaguacaguggcaugaucauggcucacugcagccuugaccuccuggguucaaucgauccucccacuucagccuccugagcagcugagacuacaagcacacgccaccgcgccugguuaauuuuuguauuuuuuguagagacacgguuucaguguugcccaggcuggucuaaaacuccuggacucaagcgauacacccaccuugccucccaaaguacuggauuacaaacaugauccaacaggccuggccugaaaugacucauuuuuaagcccagacaugcagagaagcugacacagcaguugaaaaaggaaaucugaucuauaagucacaaauuaaguaaauucccaaaacguuucaaguaggcuucuccugauacuaaucugagcuaugcuggggaagucuaauaagaaagacauggaaucuagaaaacaauuauuugucuucaccuucucaucuuuuuuauggcugucaaaagcuuuccccuccuaucccuccuauuccuuuccuaguuuaaacaaaaauacaaucuucagauuuuccccacugaaauccugaccuugaugauccgggggauauuucugauugugaccauggaaggaaaggagucccacuggcauucaguggguaaggguuacaaauucuaaacaacuugccaaauucaggacaguccuacaaaugugucccacauccugaauggcuuuuggauguccuauucaagauuaauauagauaaaaagcuguucauauuuagcuuggccucagaaccuaacuccauuucacaaauaaacacaaaguauuuuuuguacaauacuaauauauauugaauuuuccaggauaauaaucaccuuaucaaccaaaugaagauuauacuuuguuauauuuggaaaucuauuacagaaacuccuaccacuaaagcaauacaacccaccuagaucagucuacauuuguaauucuugaauucauggcgcaggcaacuauuacucuaugucuuuuaauguagucauguccaaacauuuauauauugaaauaaauauuauuuuauuauaaauuacuuuuauuuuauuuuuuauauuauaguuaggguguuaauugguauuuuuguuuaaaauaugaaguagguuguauguaccuaugaacuucauuucaggauaguaaaggggucauuacaaaguauuugcuauaaaaagagaaaauggaaugugauagaguggagagcaguguucugcauggugaacucagaugccugaaagaauacugaauuaacuuuugcuuaccuuuugcaaaggaacuuugaaagcaaugaaacgagucccaggcauccgcuguccaacugggagauagucuuuccaccuauuagauauauuuuuuguuagccaaauuguauguuagccuuguuuccuugcacaaaauaagacuuuuugaaaaugggaaucauagcccgcacaacauguccucucuccucucugcuuugcauuucgccacuccacuuauuaaaccccaccaaguaacgaccuauaccguccuucucuccuguuuccccaucauaaaaacgaacacaagccaacacaacaguacaacucaaauaaggccuauauaaaaccggagauacccagaacuucuguaucccuguuaaacuuggcccaguaccagauacuaaagugccauuaauacaaacauauucacugaaauaauuuaaauucaauuauuucacuucacgcuuuuaguuuucauacgacugaugccauaaaguucaauuaguaggaaacuucaaguucauauuuuaagagaaaaccugcuagaagagggacugugaacuucacuuaauaaugcuaggaacuggccgggcgcgguggcucacgucuguuaaucccggcaauuugggaggcugaggcagguggaucaccugaggucaggaguucgagaccagccugacccacauggugaaaccccaucucuacuaaaaauacaaaaaaaauuagccgggugugguggcgggcgccuguaaucccagcaacuugggcggcugagggaggagaaucgcuugaauccgggaggcggagguugcagugagccgagauuggaccauugcacuccagccuggcggagaagagcaaaaauccaucccaaaaacaaaaacaaaaaaacggauuggaagaaaacaaacaggagauucacuaauuagaaccccacugcaauaagucaggcaagaccuguauuaggguacugacagaaagugacagucaaaagauaguagauaaaaugaagaggauuuauugagguaugagaugguggaggauggucucaaggaguaaaaacaguucaaugcaccuacgugcaaagucucaaaauuaaucauuuguacguauaaaggaguuaucuuucaaaugaggccuguuaggaaguaacaaaguaugcucuuugugauuucuggaaacaauacaaaccaacuuuccaugugagaucucagggcgcuacuacugcuggguuccuaacucaaaccauuacacuuuccgugccaacguaacaaggaauugaggagguuccauuuugggaauuaaggaguguccccaacaguaacagucccaccuuaaagcaauccuuccguauuuuaccuaagagcaauggccagaaccucccuuuuacaagaauauggagaaaucacaggacaucacagacaucgccccuuucagcuacagcggguggcgcagagggucaaagccucaaagcaagcggcggacaagucaagcuugcgauggcaacggcgagaggcagagaccacaaacgaugaagcccagacccagaagccacgagcuggaaaggccacgccaagggaccaagacauacuaccuuucggggaugugguuuccgcccuucuucuuggcugaggagcguccugaaaagucgcgucuccggccccagccacugcggggaugaugccacuggcucaugugggucccaagaagccgcccacccaaugccaagucggccaaaagcgccaguccggcgcccucaaugccaggauaagacccuaaacaggaaaagacucggcagccaccuacgccgcgcuccagcgucucgcuauugcgcaugugccaccgccggucgugauggcguagccacgcuggcuuacu

SEQ ID NO: 191643 - RNA, 12364 nt, Homo sapiens
agacgcaagacgccgggccuacagcgggagcgugaggaaagccgugcguugcguuccaaggcaucugugagcccgcggaguauacaccaugagcaaagcucacccucccgaguugaaaaaguaaguaugugugagagccaaaccgaaguggucaguuauuugcguccugcgagucccuugguucccucuccguuagccgaaugucuugagccgcuucacuucauuucuucuuccgguccgaggucgccgggaucccggccaggcucccgcgcaugagacgugaagcccgcgcagagcucgcgcgucggugugguuacagccggcagccacggcaccuccuuccggccgacuagucuccaggucccgcggucuggccccuggucacccggcgcugucccucguuccuugaagaucuccagugcuaccuuuuguugaacaucucgaauaguaucauguucuagauagacggcuagagggggaaauucucugaaggaacuaaggaggggcuggaagggaaggaaguguuuuuaaaacuacgugaggcaucagaauccgaaagccacuuuagucuuagcaaauguguuuguagguguuugagcuuuuacuuagaaaccucauuccuuuuucuugccuucuuuuacguuaagcuugaaugucauguguuaucuugcucugauguugaaacuauauaagaacauucauuuuucuuuuuuuuuaagaacauuaauuuuuucuagucagagaaggcuaauuuuuugaaguuuuuucuacacacccaguaaagucaaacaacuuuaaguaggagagccuuacuuuagguaggacucaacguaaagcuuugaauuccucaaauacuuuuugaguggacuuaacagguuauguguuuccugacuacguuucuguuuugcuuauacuuccugaugcuggaauucuacauguauuaguuggauugcacaaaggaugcaaaauuuuuacagggaucaguuuuuucuggcguagcaugugguuggcuuuguguauaguuaguucauuuauuaccaggcccauggaagucagacaaaagguaaaguuccuauuuaauaauuuugcggccgggcacaguggcucacgccuguaaucccagcacuuugggaggcugaggcgggaggaucaccugaggucaggaguucgagaccagccuggccaacauggugaaacccccgucucuacuaaaaauacaaaaaauuagccaggcagguggugugcgccuguagucucagcuauuccggagguugaggcaggagaaucgcuugaacccgggaagcggagguugcagugagucaagaucgcgccauugcccuccagccuggguaacaagaccgaaacucuguuucaaaaaauaauaauauuuuugcauuuaaagguccauuuguaucaaagccaucuuuuguaugaaaacuacuucuauguauauuuuaguuaggucuguuaaggaauuaauuauuaaaacauaagcccaacgcgguggcucacgccuguaaucccagcacuuugggaggccgaggcgggcggaucacgaggucaggagauggagaucaucauggcuaaaacggugaaaccccgugucuauaaaaauacaaaaaauuacgugggcuugguggcgggcgcuuguagucccagcuacucgggaggcugaggcaggagaauggcgugaacccgggaggcggagcuugcagugagccgagaucgcgccacugcacuccagccugggcaacagagcgagacuccgucucaaaaaaaaaaaaaaaaauagaaguuacucagaaauuauugugaaaauuacucuuuuuaucugaaaguuauuuuuggugauguaaguauccucuggauucaucagggacuggugaaauggugauuuuuuuuuuuuuaacaaaaagaccauucucuacuuguaaucuaagauuuucuuucugauucauaacauaguuuuugaaaauuucagagaaggaagcuaguuuuaauaccuuucucuuccucguagguuucaugaauugugaaauccggucagaucugccgccaaaaugacuuaaaaauuuuuucuuccucugcuuucucacagauagcaucuucuuuuacaccauuaugcccuccuucugguguagcauaacucagguguucuuaaauggggaguagggaaucuggugcuaccggcuucuagugaguagacaccagggugcugcuaaacauccuacugcuuauucgacugcccccaacaauacaaaauuaacuggucccaaaugucaguaguauagaaguugagauacacuggcuuaacugaauucuuccuuccacuucuuaaaauuugcugccacgguagucuugccagugacugcuuuaauaauuuaucacaguaugcaaaaucgagucuguacuuaacccagcauucaagcaccaaaccuucuagcugcuaauacucagguauuccguucuccagucacacugaacuauuuguguuugcucucacuugcugugugacuuugaaaaauugcuuuagcuuuuccaagccuaguucuccaucuguaaaaacgguggaaaugauagaccauaauugcaaagucguuguaaagauuguauaagaucuuguguguuauauuugauacguuuuauguaucuuauuaaaauauaguuuacuucauauauguguguguguguguguguguguguguguguguguguguguguguuuugagauggaguuucacucuuauugcccaggcuggagugcaguggcgcgaucuuggcucaccgcaaccugugccucccggguucaagcgauucuccugccucagccucccgaguagcugggauuacaagcaugcaccaacacacccgacuaauuuuuuuuuuuuuuuuuuuuuuuuuuuuuuuuuuuuuuaguagagacggguuuucuccauguugaucaggcuggucucgaacucccgaccucaggugauccgcccgccuuggccucccaaagugcugggauuacaagcaugagccaccgcgcccagcccauaaauauauuuuuacuuguaaauguaucuacucccuccuucagucaugcuccuuguuuuauauuuacauuuucccaugauaauccuauacauuaaaauugaauaagugccccacuucguggcccauauacuaaacaucuuuuuuucauuuuuuuauauuuuaaaauuugaaugaaauuuuuaaaauugaaugaaauuuuauguuuucuggccuauauggaagaaauuaaaaacugauuugacugcauggcuuaaucucguauuccacuaaaauggaauuuuuuuuuaauucauaucguuugaaguuucaaaugugcauuuauuauucuaaaauauacuuaaauguugaggacuacccugaacauuuaugcuugaugcuuuaauauuaaauaaaagaacacuacuuauuucaaauauaaaauaccuauugaauuggauaugauuugauuacuguuugcugucuuuacaacuuaguuuuggaaauaaccaaacauaggcaagucuuuguuuuucucuugugacuauaaaauccagucauugaaaauuaggucaaugagaccagaugugguagcucaugccuguguaaucccagcggcacuuugggaggcugagggggaguauauuuuucgaggccaggaauucaggaccagccugggcaacauaaugagacucccaucucuuaaaaaaaaaaaaaaaaagaaagaaauuuaggucaaugaaacaacguaguauugaacaauaagaauguaauucacauuaguauacucuacuuaauguaaauuaauauagucuaaauauguuucauuuuuauugccuuuccucuucccaaauuacuuugcuuccuagaaugucuaauuuagguaacccuuuacgcccccacucuuuuuuuccccugagacaguuucgcucuauugcccaagcuggagugcaguggcgcaaucauggcucacugcagccucaacguggcaggcuccagugauucuccgaccucagccucccaaguagcuggaaccauaggcaugugccaccacccccagcuaauuuuuguauuuuugguagagaugggguuucaccauguugcccaggcuggucucaacuccugagcucaagcaguccacccgccucagcccccuaaagugcugggauuacaggcgugagcuaccucgcccuacucccucacucuuuacagcaauacauuauuuuuacuauuuuagauuucauuauucccauuguauaaauuuuagcaaauuaucuuaacuauaccuauuuacuuguuuaugcuuaaauuuuuuuaauugguuauauaaucuuuacccuuuuccuuuuucagauuuauggacaagaaguuaucauguaaguuuguuguuguuuugggguuuuuuuuaauuauuuaauugcuuuuuacaugugucuuagcaauguuuggagcaacuuuauaaaaauuuaaagcagccaggcgcgauggcucacggcuguaaucccagcacuuugggaggccgaggcaggcggaucgugagaucaggagaucaagaccauccuggcuaacacggugaaaccccgucucuacuaaaaauacaaaaaaaaauuagccgggugcaguggcgggcgccuguagucccaguuacucgggaggcugagucaggagaauggcaugaacccaggaggcggaguuugcagugagccaagauggcgguacugcacuccagccugggcuauagagcuagacuccgucucaaaaaaaaaaaauuuaaagcacacaggaccucuaauucacauccguuaguuaagcagauuacuuaauccuaacuagacaauuuuauuuaccuaauuucugauaauuaauuuaacagcacuucagacuuuaucuuauguaagcccuuccucacuuuggcaaaauuaacaggauuuaucaaccuuuuuucuuuaaacaagcuacaaaggacuuagacaaggaacaguuaucuuguuucuugggaauauguaggaauaacauuuguucaauuuaucuaaaaaucugacccacacaguacuugaaauauauguaggggaaaaaaccaugagcguuagagguaagcagccuucagcuugaaucucacuucugucguacaguagcuguauaaccaugaacccaguuacuuaaaagcucgggcacggugguuuacaccuauaaucccccagcacuuugggaggccaaagcgggaggaucccuugagcccaggaguucgagaccagccugggcaacauagggagcccccaucuuuauaaaaauuuuaaaaaagcucugaaguuuaguucuguccuauaaaguaaggauaauacuacuuuuuaggauucuuauaaauuaaaauguggaaguaaauacaaaaauguuuaacccaguucuugucauacaguaaggauaguggguuucagacaucucaaauacuuguguuuuaucccaccugauuuuuagugaaugcuugguagcuaauggaauguuuuucuaaaacuucuuuuucucuuuuuaauagugaaauuaaaugguggcagacauguccaaggaauauugcggggauuugaucccuuuaugaaccuugugauagaugaauguguggagauggcgacuaguggacaacagaacaauauuggaauggugguaaguaaagauacaagaguucucuuggagauuucauuuuucuuuuggaauguguauuaacuuuccugguuaguaacccccagaaauggcaaauaacaggcaagauuagacuuuccaucuccuuuuuaguugcauacggcaguuacucagcuguaguaauauccugguuaccuguagguaagaucucaacuauacagaaccuaagguccuagcgcuugaaauagcuguuggaaauccuuuuugagcuuuauucugcaauagaggcucauaguugguccuucauuagagcaguaguucugaaaccuuaauguguauaugaauccccagggaaucuucuuaaaaugaagauucuacuucaguagguauggggcagaacuuaacuaagguuuugcauuucuacuaaugccuaaugcagaucugccaguucacagguaacacuuucugauuuuacuuguauacauaguuaaccuggauuuucugguuuaccacacccaaaauuuuaagguagccaagguaaaaguuacaagggauaaucacaaugacaguuauucacaugagagaaaaagcaggaaaaaauaagcacauacugagcccucauaggauuaaacauuccuacauucauugggccguaguuuuagugauugcugaagaagaguuuugauacccagacuuugagucccucuuugucuaacacaggacaacauaccuaauaaagcgguaagcccaaaguucuugaaaaaggugaaccaaaaaggacaacuuacuuuuagcaaauuauuaagcauaaagaccuccaaggagugguaagaguugcuaauuauuagccuugauuuauuaaccuugauuuuuaaguuugagcaguaaaguugaagauagaccuauuuugacaucucugccuguuuaauuuuuuuacauaccauucuuuccaagguuuguguuauuacuuauuucagauacuuuuucauuacuguauuuugaaaagcaaaucaauaguuaugacugaaaaaacaguuuagagucuccagauaccacacuguacccccaaguuucauguaaauugacuugucuuucagguauauucccuugugagcuucuguugaauaaggcugccagcaugauuaguagccaaguccuuuuaaaaacauuuucuagauaccccaagauuuuccucucagcccuuauuuuuacaaauaaauuuucauucuaauagaagguagauuagguuuuuaguuccuugcaaaaaauuugcugaaaaggauucaggaagaacuuggcaccuaauugucaauucugcuuugagaagauuagagaauuauguaacacacugcucauuggaauuuuaucagagaaggaauagagcaucccucuggcaauuuucccccuaaacuuuauggacuuuauuuucuuugcacagaaauugguugaaagcacugccaucccaagucauuuaaguaaugauuaccuacuuaguguguugggcagccuccuguuccaucucugagguuuaugugacacacacgccccccaacccccagccaaagaaaaaaaaaaguuuuuaucagcagacaguaauucuugcugcugagucuucacuuugaaaaagaaauaauaacacaucagacuucuuuaauaaaagacauuuuaaaaggcaagaacagagaugaacuuuuugacuuuucuaaaguuggaagaagggaaacaaauagguuaagguuuuguuauuuuguuagaaguuguuuaacaaaggacaguuggcuucauuauuaccuuguccaagucagugauccauugaggccauugaaauuacuuaauacuguuuuauugcaguuauguguguguuggcugggcacaguagcucacaucuauaaucccagcacuucgagaggcugaagcaggaggaucacuugagcccaggaguuugagaucagccugggcaacauagugagaccucaucucuacaaaaaaauuagaaaauuagccgggcaugguggugugcaccuguagucccagcuacucaggaggcugaggcaggaagucaaagcugcagugagcugagaucacacuacugcacuccaaucuuugugacaaagcgagauccugucucaaaaaggauguguuuguuuucaggagugaguuuguuuuuaaccugucaguuggaucguuaccuaaugauaaaucucaacuaucuucugagacauccccagaguugucaguggcaucgccucuaucuuacuuuuuauuauguuacauaguucaggcacucuugcuaggguuguccuucuguagcaucauugaagcacaaaaaagggagcaguauguaauucuggaccugaugguucaaguuugauuuggagaauuaggccucaaacacaguggcaaaagaggaagagcacuacaauaggccuccuuuauccucagaguagguaccagaaaccacagauaguagugaacccuaugcacaaauuucugugugugugugugugcacgcgcguguguaugacagagucucacugugucaccgaggcuggagugcaaugguguggucucgggucacugcaaccuccgccuccuggguucaagcaguucuccugccucagcuucccgaguagcugggacuacaggcgcacaccaccacgccaagcuaauuuuuguauuuuuaguagagacaggguuucacuauguuggccaggcuggucucaaacuccugaccgcaugagccaccugccuuagccucccaaagugcugggauuacaggcgugagccaccgcgccuggccagcacgaacuucuuuuuacuucuucacaaucucacagauagaagauucguccuuaccauaaaucuuggcagucucaacauaugauucuuuuucuuauuaagucaagaacuuguaccuuuucacuuaaaggaagcacuuuacagcuucucuuuggcauauccauauugccagcaucacugcucuuauacuuucaggcuaguauuaaguuaaaaaaaggguuacuugaacacaaguaacccuuugauaccacaacagucaaucauaaaacugagauaacugauuaaugggcagcauggagaugcuagacaaaggauaauccacauccagggacaguaugagguaucaucacacugcuaagaacagcaugcaguguaaaacuuacggaugucuguugcugggacuaugcauuuaauguuuuuggaccacagauaaggugggacaaaguucaccauuuagccuuauuuucuaaauauuaugugacaagacaaauauguaaauuuagcagggagcuaggcaggaaggcuagcuuuucuugcuuuggucaaugagaugugauguucaauaucuguugccaaaaaaaaaauugagaauuuaaaauucugauaacuggccagguacaguggcucacaccuguaaucccagcacuuugggaggccaaggcaggaggaucacuugagacuaggaguuugagauaagccugggcaacauggugagacccugucucuacagaaaauuuuaaaauuagcccagcuugguggcucaugccucuggucccagcuacuugagaggcugaagugggaggaucacuugagcccaggaggucaaggcugcaguuagcugugauugaaccacugcauuccagcuugggugacagagcaagacccuguuucaaaaaaaauaauaauuaaaaugaaaauaaaauucugauaacuagguaagcauguuucuacuccuggcuuaugcugggcauggugaugugcgccuauagucccagcuacucaggaggcagaggcaggagaaccacuugagccuaggaguucgaggaugcagugugcagugauugugcaugugaauagccacugcacugcagccuggucagcauagcuagucccagucucaaaaaaauggaggggagcucuguuaacuuagaagaagagugucaaucuuuagacucuuucaguucccauugucauuuucagggcacuguguuuacugguuuuuguuguugguuugagauaaggucucacucugucaccgaggccggagugcaguagcauggagcuugguucacuguggucucaaccucccugggcucaguugauccuuccaccucagccucccgaguagcuggaaccacaggugugcaccaccacccucagcuaauuuuuguauuuuuguagagacaggguuuuaccauguugcccaggcuggucucaaacuccugggcucaagcuaucugcccaccugggccucucaaaaugcugagauuauaggcgugagccaccaugcccagccauucuuuuuuaaaucugcucuuuacuaccuuaucauacucauugcugauaauuggcugccagguuccaagacacuuauccuaccaauuguguucccuucuauucugucagcugcaguaaucacaugugaguucuuuuauucauauuuaccagguuauugagcccucugugugccugcuacuauuuuaggcacugggguuuugcaccuaagucccugcccucauaaaauuuacauuuguauggagaacacaauaaaucauagcguauguguaaauaaaacaagcaugauacugugagaaaagaauaaguuacaacuacuuuuacucuagcugccuauaagcauagcuccacuuugaaucuuuuuggaaugccuccauuucuaauaaacaccucaaauuauuacauuaccuuucucuccccuacauuaccuauucuuucccucccguaccccuccauucaccuauccaauucuacuugacugaugggugaucuaucgauuaugaugaucuccagucuauuagggacuuacuguuuuuaguccccuagccuuccaguuucgcuuauuuuucuaccccucuugaauucauuuaccagcugauucaucuauacucugauaaguuugucuguugguuuguuuugguuuugguuuguuguuuuuuuuuuuuuuuuuuuuuuuuuuuugacaaaagacaguuucgcucguugcccaggcuggagugcaguggcgcuaucuuggcuuaccgcaaccuccgccucccggguucaagugauuucuccugccucagccuccugaguagcugggauuacaggcaugugccaccacacccggcuaauuuuuuauuuuuaguagagauggggguuucuccauguuggccaggauggucucgaacucccaaccucaggugauccacccgccuuggccucccaaagugcugggauuauaggcgugagccaccacacccccgauaaauauucuuaucuucauuuauggcuuaucuacuaggucaagcacuguucuccuagggccuuuuuuuuauaacuucucuuucugccucuagguucuguccuauucaaacuucggcguauuuauauaauaucuuguugcagggacacuuaugguugucauucccccaagugaaacucucacuggcucauuguuaguuucugauguccuccaaacacuaagauuggcauuugaagcuuuccaagauugaaugccaacuaucuuuguuuccugauucucuucgugaacuuuuuacugcauucaaauuagauuacuuccuuauccucucauacuuugucuucaucuuaguucugucuagaauuuccuacaaucuccuuuucaaaauucugcccaauuuccaagacccagguaaaaugucauuuucauaaagcaugccuuucacaauuucccauccugguuucuucccuaaaugaucucauaccuccaaacuguaccuaacauacucuacuguacauauuuuacucauuaauuuuuggaucccauagagucagggaugggcauuuaaauuugaguccugcauuuuagaaggugaaauuagggccaggcguaguagcucacgccuguaaucccagcacuuugugaggcugaggcaagcagauuacuugaggucaggaguuugacaccagccuggccaacauggugaaaccccgucucuaccaaaaauauaaaaauuagcugggcguggucagggcuccuguaauccuagcuacuugggaggcugaagcaggauugcuugaaccuggguggcagaggcugcagugagccgagauugcgccacuacacucuagccugggcaacagagugagacugucucaaaaaaaaaggugaaauuagucauuggagacuuggcauuagaaucucauaaagcaaauuguuagccuuaaauccaaaagaugucugucguauaaagggcuuagaguuguuuggugucccuguggcuugaacaaagcuuugcaaaccgacauguaauauuaaaaaaccauuaaugauuuggugaaaauucuuaaaucaucauaguuaugucuguuaccugaguuguucuuuucaaauuuauuuuucucuuucuuagguaauacgaggaaauaguaucaucauguuagaagccuuggaacgaguauaaauaauggcuguucagcagagaaacccauguccucucuccauagggccuguuuuacuaugauguaaaaauuaggucauguacauuuucauauuagacuuuuuguuaaauaaacuuuuguaauagucaaaaaugcuuucucagauguucugaauauagaauaucagcucucauuccaguuuuuucuaacaugaauuuuccugguugacauugauuucaaaggguuuuaugcauuaaagugaaagaaucuuauuaaaugugaa

SEQ ID NO: 191644 - RNA, 23087 nt, Homo sapiens
uaaugauguaguuguuuauuuugaauauaaucaugaaguggggaaaaauuuuaauacaagaguagaaagaggauuccagagaaaaacauuccaguguaucaugguucuuugugagugaguagagagggguagugaggaugcuguccacaauguauucaucuaguuaaugaauuguauggcccacaagcucaaacgagagauacauuacagaugguuguauuauaaaccuaaucuuaagaaaccuuaccaagcaaaugcuuaaagacugauuuuuuugugaucugauaaaaagccugcaaaucgugaaucacuuuuaaacuguacagaauggacuacacaccaguaugguaaaguucuuguaaaacaccaaacacaauggcucauagauauauaccucucucacucuuaaauggcauuuccuaauuauagaaaauguuuacaacaaaagaacaagagggaucaaacuaacaaucaauaaggagaacugaugugaagucccauacacuguuacuccauuuuucagcaacucuuuauaacuccuucauugacuugacuccuuuacaacauacagcugaauuguagaacuaguucuucaagugugguuccuauaguagaacagcagcaucacuggggaacuuaauaaaaugcaucuucuuauaucccauaacaaacuuauugaauaaacaggguggagccuagcgauguuuuaacaagcccuuaagguaacugaugcaugcucaacucagagagccacuggagcagagcuggcuuucauucagccccugcaucauuuuuaccagucucuucuauuaaaaaaaaaggucuggagcaguaagcucugacaguguuuuuucuuccaauaaaacucuuaauacuauaguugcauaaaacuaccuaaugcgcccagaguagcagguucugcuaggauuuuucucccaguaaaaaagcacucaacacuguaguugcauuaaaacuacuugauguccuugguguauugauaaccuguuuugcuuuugccaaagcaauuucagaugcccuacuggaaaauuuauccagaguagguuugauguaauaccagcaacauuuuuaauuuuuuuuuuuuccuuuugagacacagucucacucuugcccaggcuggagugcaguggugcgaucucugcucacugcaaccuccaucuccaggguucaagcgauucucgcgccucagccucccaaguagcugggauuacuggcacacgccaccaugccuggcuaauuuuuguauuuuuaguaaagacaggguuucaccauguuggccaggcuggucucaaacucccgaccucaagagauccaccugccucagccucccaaagugcuggugagccaccauacccagccuaaacugguuuuuguuuuuuuuuucugagacagagucucgcucuguugccaggcuggagugcaguggugcgaucuuggcucacugcaaccuccgccucccgguugaggcaauucuccugccucagccucccaaguagcugagauuacaguagcugggauuacagacaugcgccaccauguccagccaauuuuuguguauucaguagagaugggguuucaccauguuggccaggauggucuugaucuccugaccucgugauccguuugccuuggccucccaaagugcugggauuacaggcgugagccacugcgcccagccuaaauugguauuauaaguaaaaauauaucccauugcaaaacaagucuacaaaugauggaaauuaauuaguauuuaccaacauuuagcauauacauaacaguauuacuuuacaaauugucuucauuaaaaccacaaaaggaaacaaauaugaauaccucaacauaucuguuaagaauaaaacuagaaaaaaacacucuuuugacaaaccaugaguuuaauccccuaccuaucaaauauaucuuggcaguuuuaucagcauauuaacauucacaacugugguagggaagaagucauuuuuacucagaaccaaaguuuacacuauuuugcuaaaguagcuaaugccaugaucugaugaaggacuuugaaguuucuauucaauggaaggauuuuuuuuuuuuaagauggucucuguugcccaggcuggaguacaguggcaugaucaugauucacugcagccuugaccuccaaggcucaagugauccucccaccucagccucccgagcagcugggaccacaggcgcgcauuaccaugccuggccaacuuuuuaaaaauuuuuuguagagaugggguuucaccauguugcccaggcuggucuaggccuuuguaauuuuuuaauaacacuacauguuaaauugguugcauuuacuuuugaacucuuaaucuuuugcuuguucuguucuaccagugucuugacaguuaaucaugaucuuugcacaguagaugcagaacuaguucugaaguuuugcugccuguuaauuaccauuuggaugcuuuaaaacccuacaggugauuccaaugugcagccaagguugagaccacugucuuaagauuucagcaaccaauuucucacccagaaugcuacaguaaaugaaacacuuaacucuuuggacauaugcuggacuugguuaacuuuggugucauuccaaguauucuguucuagugccaacugcucaggaguuauuuaaguugccucugcuguuaggcugucugugcuuauuaucaagauuacuucuaaaguucuuacuaagagaacugagaaaguucuaaaagaaagauccuugcaaaauggaucugcuuugauacagauugggcuucuuaggacuucuaaggcacuaaaacccuuuguaggcauuuucacacccacauuggugauucccaacccugggugcacauuagaaacuuuaaauagcuacaaugcuaagguccuauccucagucuuugaaucugaaucucugguuaugggggggucucaguauuuuuaaaagcuccugaagugaggauuuaauacuagaaugccaguuucuuaauucaguagcccauauuugcuuuucauuuuacuugagauuuuuguuuaacaucuucaaguuacauuacuaagacuucuaaauuucaccccuaaucaaaucaagacagaagaaucaaaagacaacauucugaaagucaaggcuuuaggcaugggcacacguacuucaaaccgguaugaaauuacuaagagucaggcauaagacaccagcucccauaaauuuuaucugacugaagauuauaucuagcuguaaaauucaaaaggacuacuccccaacuaagaugucuuuaaguucucccucagguacucaccuuaaaaugcucuacaauuuugaucaaaauccagcgcgccacucccagaccuacugaaucagaaucuucaagagaggagcuugagaauccauaugguuuaacaaacuccaggugauuauuuuuauuuacuuuugagacggaguuuugcucguguugcucaggcugaagugcaauggugagauuggcucacugcaaccaccaccuccuaacuccaggugauucuuauuaucagacaaguuuaagaaaaacuccuaauggauagugaaagaauacuuaagaaauuuuggagauggcauaagugcaauagcuauaccuucacacuuaauuagaaccguguguuuuccuaugaccagcagggauuacuuuuauuaaacaaugauaauggcaaaauaucugguucaaaaucaucucugcucagauuuuguucuuuuuugccacugauagucauuuggaacuaggaggggaaaaaggagugugucacuucauaguucaguuuuaaguuucucauauaagccauccugaucaaucaugucugugugcccguuccagcggugauaggcaaggagugcagcguugugggcugcaauggcacucaucuccauggcacuugcugcacacucuaugccauugagguaauaaagucgaucauggagaaugauagaggggcauuucuccgggggcuuauagugaggauaugcaagccauggcuucuucacagcauaaucauaggacagaaagagcuuuaaaauuugugcuuuaguaagaguuucuugggaaaagaucuuccaaacauauguuccaucuguugauggcucaggaucuuccuuuucucucacagagggcacaaucccaauacuguuaaugaacaaaucugaauuaucagugguuaaaacuguauuaaggccaaauuuaucuaugggucuagagcuaaagauagauguauucaauucccccuuaacuaaaguugucacuauauguugauaauauugauggaauuccucaauuggaggaucaaaguugagaaaaguaauauucgacauuuuucgauucaacggaguggccaccaagacgaugucauagaagucugaacgagucucaguuccaauuugguagaccacuucauacaucuuuguuggauuuccuagaggaaauaaggaggcauauauuuguuuaguguuucuaacauaccuucuaaaaauaauuguauaccuucuucauaauuucucuauaauucuaaagaauugaagaaguuauaucccuuaagauaguugucccuugcauuuuuauuacauugaggccaauuucuuauucagaaugucaguaaguacaaaauacagaauuuuuacuuuugaagguaagauuaucuuucggccgggcaugguggcucacaccuguaaucucagcacuuugggaggccgagguggguggaucacgaggucaggagaucgagaccauccuggcuaacauggugaaaccccgucucuacuaaaaauacaaaaaauuagccgagcgcgguggcaggcgccuauagucccagcuacucgggacgcugaggcaggcgccuauagucccagcuacucgggacgcugaggcaggagaauggcgugaacccgggaggcggagcuugcagugagccgagauaggccacuacaguccggccugggcaaaagagcgagacuccaucucaaaaaaaaaaaagauuauuuuucaaauccaaggagugaugccacagcacuuaacuacacuggggaauuuuuuuuuuuuuuuuuuuuuuuuagauggagucucacuccgucacccaggcuagagugcaguggugugaucuuggcucacugcaaccucugcccccuggguucaugugauucuccugccucagccucccgaguagcugggauuacaggcaccugccaccacgcccggcuaauuuuuuguauuuuuaguagagacaggguuuaacuauguuggccaggcuagucuugaucuccugaccucaggugauccacccuccuuggccucccaaaguacagggauuacaggcaugagccaccgugccuggcccauuggggaauauuucuauaugguacaauauauacaauuucaaguuucaucauuuuagaacugaguaagagaugacagaagagaaguguuucucccugagcaaucauuuucugcaggggauaucaggaacaauaagaaauucaagcuuaccuguguacuuggucuuuguuuucuccucgauguacauuacugagccagauauaagauugcuuuuggaugccugcagaagcccugagcaaacaaguuuauugccaccuucuacugcccaaaggccagaaucagaacaggacagugacaccgccccugucaauaggaggaaaaauguguuuuaauucugacuuuuuguaagaggcucucuacccacucucccuucccaauuacauguucuacuccaaaugucucuagacauugcuaaauggccccugggagcaaaaucucccccaguuaagaauuacugaacuaaugaaagcuaaagacccucucccccuaaaaaugcacaucuacauacgcacaauuuugcuaacaaugucugagguucacagagaaaaguagccuccaauccacagccuaaagucaggaaccaccauagcaucagguaagccccucugugaacuaauguccaccacuguuucaagcccuggcuuacccacaaaggcauugauguccgugcuuuggccauaauugacccucauaacaggagcaaucauuucauugaggaacuucucagaaaagccggccuuuugcaagguuucaagaaguguucgauuaagcauuccaaggaagucaucuccuccuagagcaugaaguaauuuuucgacacuacugaaggcauagucaugagacugguagcgguagauccuuuggaaaagaagagaaauccauuaaauaccaaacaagauguggggaaggggauguauaaagaagggaaguggcgucauaagaaucaaacugacaucuaggugcaguggcucacgccuauaauccccacacuuugggaggcagaggugggcaggucaccugaggucaggaguucaagaccagccuggccaacauggcaaaaccccagcuuuacuaaaaauacaaaaauuaaccaggcauagugguguaugccuguggucccagcuacuugggaggcugaggcaggaggacugcuugagccccggaauucaaggccgcagugaacugugauaaugccgcugcacuccagccugggccagacagugacagugucucuuaaaaaaaaaaaaagaaaaaaaaaaagaaaagaaacuaaggaagaaagaaagaagaagaaaaaggaaaaauaaaaaguagaaguaaggccaggcgcggugguuucaugccuguaauccuagcucuuuggaaggccaaggcaggcagaucacuaggucaggaguuugagaccagccugaccaacauggugaaaccccgucucuacuaaaaauacaaaaauuagcugggccugguggcgcacgccuguaaucccagcuauucaggaggcugaggcaggagaaucgcuucaacccagaaagcggagguugcagugagccgagaucacaccgcugcacuccagccugggcaacagagcgagacuccaucucaaaaaaaaaaaaaaaaaaaaguagaaguaaaauacuuugucuaaaggccacauggcaaguauaaggcucaaucacaacuugcccacucugcugucaaucacccacacaugcacagucuccacuggagcacaccugacccauucacuggucucuaaauuugcccuacaugcuguauccccaccagugcacaagcucuucccuccaaccugaauacacuucccauuccuaaccauggaacaucuauucuuccuuaacagaacuugaaucccaccuucucugaaaagucuugcucaacuucccaguccacaguuauaucaucuccagaagccucauaaaacuuagcaccaaugccacucauucaacaauuagaugcuuucuauuauuuuuuagaaaacaucacuugaccaaaaagaaaaauaucacccaacacuucucugcauuuuauggauuuaaaacaacauucacauaaauuagugcauucaguaauucaaacacaauuuuucauguugcaaauaguacaaagauggaaaacaggcuuaaguuugggauaaguaauacgggguuuaucucuuauucccuuaaggggcuuauaguuagggauaaguaauaaggcacaugcagagauaaguauaugaaaauaagaaauuaagagccaaggaaagaucccuaucacugaucauggaagggaaacuuucacaucaaguuuuucucucaaaauguacuauauuuuuuuacagaacaagggacaguauuauaaccauuucaguauuaccuacuaaaagcauaguaguaguauaaguguacaaaauguuaaacacauuuuuauuggaaaaacugauucgauaucuaugccaaaacugagaaacuaaauaccuucuaaccauagcauuugggucccagucuuuaggagacuggaaaaaguaggauggaaacacugaauucuucagaaaaauaauagccuggauaucucauauccaaagaagagugaucuuuggcuaauggucaacaugagaaaauaacagucaauuaaauaagcuacuaaugaugcuauaaaaaacauauuccccaacugcuccugccagagcugcaaccucacucaagcaagucucccugggagggggcgggguggcagcggugagaugaaacuauauacacaauauaaacagagagcacucuaauuguuucaugauacaacuaaucguauuagaauaaauacacugcuggguaugguggcucaugccuguaauccuagcacuuugggaggcaaaguggggcagcaucacuugaggucaguaguuugagaccgccuggccaacauggugaaaccccaucucuacuaaaaauacaaaaauuauccaggugugguggugcaugccuguaaucccagcuacucagguggcugaggcaugagaauugcuugacccaggagacagagguugcaguaagucaagaucacaccacugcacuacacccuggaugacagagcaagacuccaucucaaaaaaauaauaauaauaaaugaaaaaacagaauaaauacuacuaaaaaacagcacccaggugaggcagcaugcaccuguagucacagcuacucaagaggcugaggugggaggaucacuuaagcccaggggcacaaggcuguaguacauuaugguugcaccugugaacagccagccaauauacuccagccugggugacagaguaagacaggaggauaccuugaggccaggaguucaagacuagccugggcaacauagcaagacucugucuguacacaaaauguaaaaauuagccaggcgcagugguucaugccuguaaucccagcacuuugggaggcugaggcgggcagaucgcuugaggucaggaguuugagaccagccuggccaacauagcgaaaccccaccucuacuaaaaauacaaaaauuaacugggcaugguggcgcaugccuguaauaccagcuacuugggagguggaggcaggagaaucgcuugaaccugggagguagagguugcagugagccgagaucgugccacugcacucuagccuuggugacagagugaaacucccucucaaaaaaaaaaaaaaaaaaauuaaaaauuagccaggcuccuauauaauagauugaucaugcaccauauccacaggagguuggaaaaaccaugccauuuucuggaauuuaaggguguugcauuauuucaucaaucauuuguugacaaaaaagaaaaacuaaaaaauaaauuuaaaaugugaaccuucagguauugaguaacaccuuuaucuugguauagaacugauacuuuuuuuuuauuuugaaauaucugauaauaauuuggaaugaaguaagguucuguuaaagaaaauauauuugaagacccuuuaaagcagugaaucugaaacaauuuucacacccuuaagugguugauacguaccuauuuuuagguauuuugagguauuuaccauaaacuaaauuuagaaauuuuuuagauucacuugaaguaaacauuacaaacauuggauacggugggguuuucuuuagauuuuacuugagagaaggugaguacaaagcaauuugcaguuguuguaaugacaagauuacugcgcaagugugaauccaaacaguauagcuuuuaaauuuuaaagcauuugguaaauuaucgcugaguuuuuuucuguugccaauagcaaacugcuuuuccauuaauggagaauucacgccuuucaagcauuuuaaauaugacaauauuuauaaauguaugguuuggaggaaucguuuaaauucucuuuccuaauuuucuuucuuuugaagauagauucuuucaacaaguaauuuguaguaaugacuguguugacuucaauuuuggagcgcaguagcuauguuaaagaugaacuauuuggucucauugaagccaacacagaacuugcugcuguguuuuuucuucagugauaaauaaaauacuuacagaaaaaaaaaaaaaaaaaaauuagccaggcauggugaggcaugccuguagucccagcuauucaggaagcugaggcaugaggaucacuucagccccgcugguugaggcugcagugagcugugaucacaccacugcacuccauccagcuugggcaacagagugagaccuugucuuaaaaaaaacaaaaacaaaaacaaaaaaauaauaauuuuuaaaaaaauauaacuggggccaggcacaguggcucacgccuguaaucccagcacuuugggaggccaagacagguggaucaccugaggucaggaguucgagaccagccugaccaacauggagaaacccugucucuacuaaaaauacaaaauuagccgggcguaguggugcaguggcacagugagccaaggugagccgaggagagccaagaucgugccacugcacuccagccugggcaacagagacagacuccaucucaaaagaaaaaaaaaaggagaaaauggucugaaaagaagacuagaaauacaugggguuaggaggguugaauucuaaauaagacuguccaaaaacaagaguggucaggaaaagccucacugagaagaugauauagaccaaagacccgaaggagaugaggaugcaaaccaggcaaacaccugggggaaaauauuuccgguagagguaaaagcaaugcaaaggucacaugacagaagcuugccuggcacauucaagaaacaaugaagccagagcagcugaagcagagugauaugggagaaccgggagugguacagccagaaauguuacuggggagaggaaacuuccagaauggcagaggaaggaccucuggaaaucugcuccuccauaaaagcuaugagaauacugccaaaaaugaucaacauugacucuuucagagcucugcagauaaaccaaagccuuuccaaguccaaggaguauuuauucaagaaaaaugucuggcaggcaugguggcucacaccuguaaucccagcacucugggaagcugagccaggcggaucacuugaggucaggaguucaagaccagccugcccaacauggugaaacaccaucuguaccaaaaauauaaaaaauuagccaggugugguggcacacgccuguaaucccagcuauucaggaggcugaggcaggagaaucgcuugaacccaggagauggagguugcagugagccaagaucgcaccauugcacuccagccugggcgacaagagggagacuccgucgaaagaaagaaagaaagagaaaaagagagagagaaaaaaaaauaaaaaauaaaaccagcacccuuccaacugcaaugugaaacuagcaagcuagaagccacuggagagaacacaacgaguuuguagcucccaaaaagcacuauccucagagaacugucaauauuugaccuaucuggcagcuccgaaaaagcucuauccugaaggcuugucuuuauucgaccugauucaaaguucacucuaugcaacagccccauccugagggcacguguccacgugucaaaaaaaaaaucuguggcaauuguuuaacaucacagaugccggaggcuaugacaucaauagagacuacaagaggcugaccaaaaaaacuuuuuaaaaaaggccgggugcaguggcucacgccuguaaucccagcacauugggaggcacaggcuggaggaucacuugagguuaggaguucgagaccagccuggccaucauggcgaaaacccaucucuacuaaaaacacaaaaaauuagccaggguugguggugcaugccuguagucccaccuacucaggaggcugaggcacaagaauugcuugaacccgggaggcagagguugcagugagccgagauagcgccacugaacuccagccugggcaacagagcgagacucugucucaaaaaaaaaaaaaaaaaaauuagcugggcaugguagugcacaucuguagucccagccacucaaggggccugagguuggagaauugcuugagccugggaggcagagguugcugugaacauacuacacucuagccugggcaacagaguaaaacaucaucugaaaaaaaaaaaaaaacagacacacagauccuugaaacaaauaagaaaacccagaaauaaaccuucaugaauaugaucaaaugaucuugacagaacugaaauacauaguucaacaauaauggagacuucaauaucccauuuucaauaauggacaguuacugaaaaugacaacaguguauuaguucaccaagacugccauaacacaguaccaaagacuggauggcuuaaacaaaaaaaguuuuauuucuuauaguucuguaggccaaaaguccaagaucaagguguggaugcauucgguuucuucugaggccuauuuccuuggcuugcagauggccaccuucuugcuguguccucacauggucuuuguguguuucuucugugucccaauuuuuuuuuuuuuuuuucugagacagaguuucacgcuuguugcccaggcuggagugcaauggcucacugcaaccucugccgcccagguucaagugauucucuugccucagccuuccugaguagcugggauuacaagcaugcaccaccacgcccagcuaauuuuuuguauuuuuaguagagaagggguuucaccauguuggucaggcuggucucgaacucccaaccucaggugaucugcccgccuuggccuccuuucuguguccuaaucuuaaggacacccaucaaauuguuuuagggucuacgcuaaagaccucauuuuaacuuaaucacauauuuaaaggcccuacauacauaugcagucacauucugaguacuggguggcuaguguuucaaccuaugaauuuuggggaaaacaaauuuaaaaguaagggaugagagcacagaauccugucaugucuucucagucacaaaacagauuuuggcuauaaaucucuauuaaugaaauagccacugaagguuucugaguuaguggagugaugugaugagccuuagauuuuaaagaacuacuuuggcugcuaaccugagaacaaaugguagcaauauaacaguaauggcagaugauuuaggaggugucuugguuuuccacugcugcuauaacaaauuaccacaaacuuaguggcuuaaaacaacacaaauuuacggccgggugcaguggcucacaccuguaaucccagcacuuugggaggcugaggcggguggaucacgaggucaggagugcaagaccugccuggccaagauggugaaaccccaucucuacuaaaaauacaaaaauuagccgggcaugguggugggcgccugugaucccaacuacucgggaggcugaggcagagaacugcuugaacccaggaggcggaggcugcagugagccaagauugugccacugcacuccagccugggugacagagcaagacucugucucaaaacaaaaaacagcucucccucucccccucccccucccccucucccucuccacggucucccucugaugccgagccaaggcuggacuguacugcugccaucucgacucacugcaaccucccugccugauucuccugcuucagccugccaagugccugggauugcaggcgcgcgccgccacgccugacugguuuucguauuuuuugguggagacgggguuucaccguguuggccgggcuggucuccaguuccugaccaugagugaucugccagccucggccucccgaggugccaggauugcagacggagugucgcucacucagugcucaauguugcccaggcuggagugcaguggcgugaucucggcucgcuacaaccuccaccucccagccgccugccuugaccucccaaaagugcugagauugcagccucugcccagccgccaccccgucuaggaagugaggagugucuuugccuggccgcccaucgucugggaugugaggaacuccucugcccggccgcccagucugggaagugaggagcgccucuucccggccgucaucccgucuaggaagugaggagcgucucugcccggcugcccaucgucugggauguggggagcgccucugccccgccgccccgucugagaugugaagagcgccucugcccggccgcgacgccgucugggaacugaggagugucucugccccgccgccaucccgucugggaggugaggagccucucugaccagccgcccucucugagaagugaggagccccuccgcccagcagccgcccugucugggaagugaggagccccucugcccagccgccaccccgucugggagguguacccaauagcucauugagaacgggccaugaugacgauggcaguuuugucgaauagaagugggggaaauguggggaaaggaaggagagaucggauuguuacugugucuguguagaaagagguggacauaggagacuccauuuuguucuguaguaagagaaauucuucugccuuggaaugcuguuuaucuaugaccuuacccccaaccccaugcucucugaaacaugugcuguguccacuaaggguuaaauggauuaagggcggugcaagaugugcuuuguuaaacagaugcuugaaggcagcauacucguuaagagucaucaccacucccuaaucucaaguacccagggacacaaacacugcggaaggcggcagggcccucugccuaggaaaaccagagaccuuuguucacauguuuauccgcugaccuucccuccacuauuguccuaugacccugccaaaucccccucuccgaagaacacccaagaaugauuaauaaauacuaacaaaaaaaaaaaaaguuauaaucuuacgguucuguaaauuagaagaccaaagucagucucuccgggcuaaaaucaaggugugcacaaggcugguuccuucuagaagcucugagggaagacugucuuuuccagccucuacaggccaccugcauuccuuggcucguggacgcacaccccuuccuagcaucacuccaaucucuuccuuccaucaucacaucuccuacuaccuacccugauccuccugccucucuaaggacccuugugauuauauugggcccaccuagauaauccagaauaaucuacccauccuuaaccauaucugcaacgucucuuuuaccucaaaagguaacacauucacagguuccaggaauuaagacauggacaucuuguggcagacagcaggggagaggauuauucagccuauaauaggaggcuacucuagcaauccagacaagagacagugguggugacuuggaacaaagugguagcaguaauccuggagagaaguaguggaauacuggauguauuuuaaaggcugaugggauucaagauagaguggguuugggaaaugaaagaacaaaaauugacucaaaauauuugguaggaguaacuggaaggaagaaaggguguuuauaaagccuuucccugugagucuaucagucucagaucaagaaguguuaaggaucuuacaaguccccagaaaugcacuaacuugagagagaagaauaagcuuuaaccuagucuacaagccaagauaucucaacaggaagccaucagcagaccagagauuuaaauuccacaaacaucugaguaaacaucuacuacauucuaguuacugugcguagcauagaacacaagcacacagugugcaccguauaauaagggauguuugaaaagaaagaugaauguugauugaagcauuaaggaaaugcuuugcugaaaaagugagauaagagguuggacuugggaguaaagaauggcauccggcugagcgcgguggcucacgccuguaaucccaacacuuugggaggccaaggugggaggaucacuugagcccaggaguucaagaucagcuugggcaacauggcaacacccugucucuacaaaaauuuaaaaaauuagccaagcaugauggcacaugccuauagucccagcugaggcuggaagaugacuugagaccaggaggucaaagcugcagugagcugugauugcaccaccguacuccagccugggugacggagcaagacuuggucucaaaaaaaaaaaaaaaaaaaaaauuaguuaagaauggcauccaaccagaacaacuacauaaauguaugugcagaaguggaaauuaagcuagcuagugcugaugucaggggcugcaggauuuccacucaaguaccuccaacagcagagaaugaaugaaugcacuguuuucgaguauugccuaccacaagcuugagcccucuuucgagugucaugguuuacuacuguuacauaggucuuucuccaccuuguguauacuuugaucuuggcucaccacaaccuccgcuuccuggguucaagcgauucuacugccucagccucccaaguagcuggcauuagcugcgccuccacacccagcuaauuuuuguauuuuuagcaaggcggaguuucaccauguuggccaggcuggucucgaacuccugaccucaagaucuaucugccuuggccucccaaagugcugggauuacaggcgugugccaccgcgcccggcccguaaauuauuuuuuaaagucaaaaacaguauaaccuauguauccccucacugguucuuuuucccaguucuguaauaccuugaauucacuucaaaagugauuucuuaggccaggugcgguggcucaugccuguaaucgcagcacuuuaggaggccaaggcgggcagaucaauuaaggccaggaguuugagaccagccuagccaacaugguaaaaccccaucucuacuaaaaauaaaaaaauuaucuggguaugguggcacaugccuguaaucccagcuacucaggaggcugaggcaggagaaucgcuuggacucaggaggcagagguugcagugagccgagauugcaccacugcacuccagccugggugacagagugaaacucaucucaaaaaaaaaaaaguaauuucuuaauuucucaaagggcaauucucuacaucucaagcaagccacagauaaaaaaaaaaacaaggcugggaacaggagcucacaaccguaaucccaacacuuugggaggcccaggugaguggaacacucgagcccaggaauucaagaccagccugggcaacauggccaaaccucaucucuacaaaaaaaauacaaaaaauuagccagaucugauggcacgugccuguagucccagcuacacagaggcuaagguaggcagauccccugagcccaggagguccaggcugcagugagccaugaucacaccacugcacuccagccugggugacagagugagaccuguaucaaaaaaaaaaaaaaaaaaaagagggccgggcacaguggcucacgccuauaaucccaacacuuugggaagccgagacaggcagaucacaaggucaggaguuugagaccagccuggcuaacacggugaaaccacaucucuacuaaaaauacaaaaaauuaaccaggcaugguggcaugugccuguagucccagcuacucaggaggcugaggcaggagaaucacuugaaccugggaggcagauguugcaguaagccgagaucccgccacugcacuccagccugggcgacaaaacgagacucuaucucaaaaaaaaaaaagaaaagaaaagaaaaacaauacacacaagcagggcugaugccaucagaacuugaucugccugcugaguaugcagcaccaugccacccaccuucuauaaagugacuggccgucucuacgcaaauucuauauauuuccuugguuguguauugccugucucuccacuagaauauauauucuuugaggacaaggacauguuguagguccuauacucucaacauagaacaaugccuagcaccuaacagguauucaauauugggugaaugaaugaauggcuacuuaaaaacauuaugcacuguagauggacuuaagguacccacgggaaaggcauuuaaggaacugaccuaagaaugauguugagaaagaaagaaaccccaaacuaccaugaguuauagaaaccagagcauauccugcuuagcuuucuuuuuuuuuuuuuuagacagucuggcucugucccccaggcuagaguguaauggcacgaucguggcucacugcaaccucugccucccagguucaagugauucuccugccucaggcucacaaguagcugggauuacaggcaugcaccaccacgccggcuaaauuuuuauauuuuuuguagagacaggguuuuaccauguuggucaggcuggucucaaacuccugaccucaggugauccaccagccucagccucccaaaauucugggauuagaggcauaagccacugugcccagcccugcuuaacucauauuuguccuguucaauaccuggucauaugacauguuuuguuuuguuuuguuuuuccccucaagauggaaucuuguucugucacccaggcuggaguguaaugaugcgauccuggccuccaguaccuaaaacuguaaagcagcauaaaaauuagcaugugcuagccgggcacaguggcucaugccugcaaucccaacacuuugggaggcugaggcaggcggaucacgaggucaggagaucaagaccauccuggcuaacacagugaaaccccgucucuacuaaaaauacaaaaaauuagccaggcacaguggcaggcaccuguaaucccagcuauucgggagucugaggcaggagaaucgcuugaaccagggaggcagagguugcagugagccgagauggugccacugcacuccagcccgggcgacagagcaaaacuccaucucaaaaaaaaaaaaaaaaaaaauuagcacaugccggccaagcucgguagcucacaccuguaaucccagcacuuugggaggccgaggcagguggaucaccugaggucaggaguucgagaccagccuggccaagagggugaaaccccaucucuacuaaaaauacaaaaauuagcugggcgugguggcaggcaucuguaaucccagcuacucgggagccugaggcaggaguaucgcuugaacccaagaggcagagguugcagugagccaauaucgaaccauugcacuccagccuaggcaacaagcgaaacuccaucucaaaaacaaaaaaacaaaaaaacuaaaaaacuagaacaugccaacagcuuuaaaaauacagauuguaccuuucaaaauuagacuggcuauuuuauguuagucuuccugauuaccaaagugauacauauucacacgcauuaaaaaaacuguuuaaauauagaaaagcauaaggacgaaaaagaggcaccugaauucucacuacccaaaacagugcuagaauguaaauucuuggaauauggaacuuuuacucuacuucaggcugcugguucacugaaaacaugucacuauuaaaggccauuuaaguuuucugauccuuucuacaagcucuuguacacauuaucucaauucauauacacaacaccagcacagcauagagauuaagagugaagacucaaaggccagacugccuggguggcaacuccagcuauaccacuuacuaugugggugaacuugccuuuuaaaaccucucuacaccgccaccuucugcaucuguuuaaagaagcuaaaaacaguaccuaccagaguaaguugucauaagaauucaaggcaucuaacaguaucuggcaacacuaaagaagcauuugcaaaauacacuucagaagcaaaaauaaaccaaccuuucaauauccaagcaaauagucugcauaguuucuacaaaacauuuugccuaacaauguuauaaacaggccuugcugugagguagaaaaugcuuacaagaaaucauaauuccuaaaguucaucaaguuuaauuuaaccuaaauuaaaagaucuuagguuaaauggaaggaaaaaaaauuaccucaugaacuugucuaacacguccucuacccacaugugcauacggagggauugaaauccauagcgccaaacuaauuuaaucacguuaauuaugaaccaguugcucuccucaaauaccagagucucuccauuauauauccccaguaggccaccagaggccugaacagcagagagaccugcaaaaacauaaagcacagcuaagucaguggugucuaugcugaucaaaugaaagaacguaaucugagugaauuuggggcuucccucaguucucaggagacacauaaaggagcucuaucuuuggaacagugugaaacacuauacuuucacuacacuguccaaaagcagauuugcuaggcgaugggucagaugaucauguaaauauuaauauaucaaaaguagauauauuuuuaccuggcuauuuuuagacuaaaagucuaaaaaaacuggauagucaaaggaaaaaagccagaguaccaacugaauucaauuuaaaaacaaagaugucagacaugcaucuucguggcauaauuuguucuggguauaccuucgcccucguggaggaaacggaagcagaggcagcaucuacagaggauguggaaggcagcugaggcacuuccauuccugugagaauccuauuuugcaaaacuggauauuucagauaacuggaaggaggccaaaguuacaaaauacucccugccgaaagggccuccagaggccugucagacuuuccccaugaccuauccagcuccucugcugucagggcagcaguugcacaucccaaguucuaggcacgugucugcauccacagcugugugacggaguuuguuuuguugguggugguuuguuuugauagggucucacuuuguugcccaggcuggagugcaguggcaugcaaggcucacugcagcuucuaucucccaggcucaagggauccuccugccucugccucccaagaagcugggacuacagguuugugccaucacaccaggcuaacuuuuuuauuuuuaguaaagacaggaucucacuauguugcccagacugguuucuaacuccugggcucaagugauccucugccucggccucccaaagugcugggauuacaggcaugagccacugacccuggccauggccauaugugagugacuuugagccagacaauucaagucucugggucucauuuacucagcugcaaaaugaucacaaugagaugacuaucuccaaaccuucucugauucuuuaacacaaacccagaauuuuaagaacagacaacagaggccgggcacgguggcucaccccuguaaucccagcacuuuggaaggccaaggcaggcggaucaccugaggucaggaguucaagaccagcuggccaacauggugaaaccccgucacuacugaaaauacaaaaauuagcugggcgugguggcaggcaccuguaaucccagcuacucaggaggcuaaggcaggagaaucgcuugaacccgggaggcagagguugcagugagccaagaucgcaccauugcacuccagccugagcgacaagagcgaaacuccucaaaagaaaaaaaaagacaauggcagccauucccacccccaccccauggcuguaauuccagauaacugaagauacagacaacuagugucccauuacagcagaacugcuccuaacucaggcaguaccaacuaacaagaaagugaggaaaacaguuuuaccaacgucucuguaaggcaauuaacaaggcagaaauuucaguucuccaucugauaaaaauauccggggaugucacacaguaaucuggugagcuccaagaccaaaauuacauacccaggucuuugacaaaacguuucaugugcagauuuaaaggauggaugacagaaccuccugccucguauucuugccccugcaccaucaugguagccaggcggcccccgaccucuucucuuucaaacaggucuaucuucacaucuuucccaaauuucugccgcagguaauaggcugcugaagugccaccaauuccggcuccaauaaucgcuaugagggaaaaaaacagaagauuauauuuuccccuuuuaccagcucugugaguuguuuuguuuuugaaagaccaucaauagcagagguuguuacucaaagcuauuaccaacaauuuggugggggaagagugacaccugcagcgaaggucuaacucccugaaucuggacagacacuguucccagacaaaagcaguagauuaauuaacauauugacauuaacucgauuuuuuuuccagaugcccaaagauucucacaggucuuuauggaggaaccaaggggccugcacacccuuccagaugcccaacucacgggcacauuagagguggaccuuuccagcacgcauuuuuaauaaagugacggccauuuaugccuagcuuuguugugucuagauucaauguagauagguuaaugauaccgaagaacacaacuuuaaaggggggcgggagggagacaggaagcaaagagccaaggcuccugacacuggagcucuugacaguggaaagagaacagauucuuucugcagcuguguuaguccuaggcggagaaacugugcaagccaagggccucugagagcaggccgaccucagcaaagcggagcugggggaaggcgguucagccucccaagggaagcaggcagggucaacuuguuugcacuccucccugugcugugccugcgugagccuguuaaucuggccgggcgccccaggucaagccagaacacuggagucuucacggucaguguucaacgggaagauagagaaaccuaggccuccccggagccccacaccuaagagacaggggcuacagguacgcuaggcgccugccugcccgcccgccccuguccccguccacgcccauuccucaagugggcaccucuccacgccugggaaugcacaguccuauuccgaccagagcugaaagccgcccugaagugugaaugggggaaagcgcgaccugcgcagcuggcucggccugcaccgcuggacugcgucgcggcugugggaucugggcgcacugcgcagcggccgcccggcgcggggcgcgcuccagcaccuucccgcgccgcccccuucucgccuaccgauuuuaucuggcggagcacgcagcucggcgcccucggggcauccgcagcugcacagcaacagccacaaccccagcagcgaggagacgagcuccgcgacgacgcgccccauggccuccacaagcucugcagcuggccucaagagccccgcaguccucccaccgcugcgcggcugcgc

SEQ ID NO: 191645 - RNA, 39204 nt, Homo sapiens
gcuccuaggcucccggcucgccgccaucuuguauugggguuucauuguucccgcugggccgggcgguuuaguguaauugccgccggaggaggaggcggaguaaccucuggucagccgagaaaccccacuauccuguagccauaaccgcuuaaacgauuugggagguagugaagggcagggagcuggaccuggaggcgccgccgcgacagcagcagccauggaggacgagaugcccaagacucugugagucuggggcagcgaugagggaggcgggaugguggucgucccggagggaaggccucggcccugcgccgcucccagccuauuguucuccguggacaccgcgauaucgugguuuuuguuuccuuagcaugcaccuggaugcuuacaaccaagacccaaucugugaggacgaggugaagggagacggggcucaacccucucaauuaaucccuucacuuuagcaacaccauugcaugaccuuugcucucgccacgggcccucuguggucuuagaccuggagaaaagacuuuaauucagaccucuuuuuagaacucgucgaaccuuccuuuuguccuaugcuuucuuuccuuuucccgcuucucccccuuuuugauuaaccucuucuuaucuuuacagccgucucccuuuaauuuuacuuuugauuuccuacugaaauucuuccuuucauuuucuucucggugauaagauuuuuuuuccuccucgagggugcuuguacucauuuucagugcaguaaacuuuauucuugcaguugccaauuggaaaaaagccaagcauuuuucuuuaaccucuggcuuuccuucuguagcacccaccgaccaaaaagccuaaccagacaccccaaggauuuggaaaucucacccagaaggaauauaucaauugaggggaaauggauuuaauauuauuuuuauagucguuuacuacuguugugauugacaugguguugaacgagcgggcuguaaaugcccuaacauauuuacagagaauuuuuagagauagcguuaaauuaccggagcguggauauuuucuuugucguguggcuuccccaacugcguucuuuguuuuucgagguauuaucggaugaguugauccugccuuuguuggcauuucucggaagaagaaaagcucaaugaguucuugacauagcuuuuuguuuuucuuggaugacauagcuuuuuguuuauauucuuggaauacuggcaguuugagagcuccaugcauuaaaaaugcaauuuuagguuucucuuugcagcucucuaauaaaguugcucugaaguacgauguaauuguuuuuuuaccuccaaaauuuuuccacuuuuaaguugcuauuucuugucuauauuggaaaugugguuacacuuguuuucuuaauagauugucaguuaaucuguuaguaaccuugaaauuucuuuucucuauuccugaggcucagaaaguaucuuuucaguaggacguagcaauuagugcaugaccuuuguuuuaggaaagauuguaucuguagaugaauacucccuaaaaaacuacuagccucacgguguugguggaaucucuucccucuugccucuuagcuaugacagucaucagcauuuuggguuaaggcacugcucguguuuuauaauguaaacuuaauauucucaguauuaguuugaaaauguuuaauuuuagaaacugcagaaguaucugaccacuuaacuuuuuaacuuuuuaauuuuguuuuuacuuuuuaauuuuuugagauggagucucacuuugucacccaggcugcaaggcuagagugcagugaugcgauuucggcucacugcaaccuccaccuccuggguuuaaaugauucuccugccucacccucccaaguagcuggcacuacaugcgggcaccaccaugcccggcuaauuuuuguauuuuuaguagagaugggguuucaccaugucggccaagcuggucucgaacuccugaccucaggugauccgcacaccucggccucccagagugcugggauuacaggugugagccacugcgccuggccuguccucaacuuuuaacuauuacauuuauuacuuauuuugccuuguaucccucacuaauacaccccauccaagaaacucuuccucaaaguagucauacuguaaaagucuucucuuguuucuaccucccucaacccaaacucccauuuuucuagucaggcaaaccuugaccaaacaugaggguacuaaucccuaaguuuuccuaauaguguuuuuaauuuuaauguaagauuuuugcuuuaaugacccuggaagucagaggcuuuuaauauauguucuuagcagaguucuuagcacauuaaaaacacagccucucaauauauguucuuagugugguccaugguaaguaaucaauacauuuguuuaagaaacugguauaauuggcugggcacaguggcucacgccuauaauccuaacacuuuggggggcugaggaggguggaucacuugagggcaggaguucaagaccagccuggccaacauggcgaaacccugucucuacuacaaauacaaaaauuaacugagcaugguggcgcaugccuguaaucccagcuacucgggaggcugaggaaggagaaucgcuugaacccgggagguggagguugcagugagccgagguugcgccauugcacuccagccugugcaacaggagggaggcuccaucucaaaaaaaaaaaaaaaaaaaaaaaaaaucugguagaauuucaagcagugaauuaagauuuuacucuuucuugaggauaaaauagagucugaauuuuuaucacccacauaccuaaauggcucacuggaaauuccuucauuugcuacaucugaguguucggcaucuccauguuaaguuagagaauaccaguauuugauuucuugucaccaauacuuuggaaucauauucugagacaaacuucccgaaaguuuauacugcaagauuauuuugaggaguauucaagguacaguuaauaaguucaaacauuuguagugagcauaugggugauguauacuacucuucuccauauauaaauuugaaauuuuccacaguaaaaaaauaaaaauacguguauagugagucugaauuggccuugguuacuuuaaaaauauucaacuugugaacuaaaagcuacacacuagacuagaaaaacauugcugguguuaguugaugaaaguuaauucccucaaauccagacaccuuaauauccuuugugugguuuacucucaaaugcaugaguguucucuuuugagauaacuauacuguuauugugcggcuuucccauuugcuaagaugcagaucuguaaauuauagaccaucuuuaaaagccugcagcuggccaggcaugguggcucacaccuguaaucccagcacuuugggaagccgaggugaguggaucaccugaggucagaaguuugagaccaaccugggcaacauggugaaaccccaucucuacuaaaaauacaaaaauuagcuagguguggugacacaugccaguagccucagcuacucgggacuccggaggcucaggaaggagaaucgcccgggagguggagguugcagugagccgagaucacgccacugcacuccagccuggaugacagagcaagacggagcccaauuaauugcuauauacuaaugagggccuugccuuucuucugcuccaugcucaucuuucauucuuguugucuacuccacucuccaaauaguauuggccuuguaauuuguaugaaauaaaaucucuuguauugagaaucagaccuaucuuuuuuuuuuuuuuuuuuuuuuugagacagagucucgcucugucacccaggcuggaaugcaguggcccaaucuuggcucacugcaagcucugccuuccagguucacgccauucuccugccucagccuccggaguagcugggacugcaggcacccgccaccacgccuggcuaauuuuuuguauuuguaguagagacacaguuucaccguguuagccaggauggucucgaucuccugaccucgcgauccgccugccucagccucccaaagugcugggauuacaggcgacaaucagaccuauuuuaaagauuagauugaaggcaagguuggccaaaaugagauauuuauuagauaauacuuauguuuccaaauaacugcuaguaauuaagaauaugcuagaaacauuacauucacucaguaauauugagagcauacuacauggcuguccgucuucugggaacuggggauaugguaguacauauaauaggccuuuuacgaauuuacauaaguaauuauguuagaugguaauaagugcuauggagaaacauaaugcaggguaugcaugguaaggaggaagggguggauauuuauagagaauaauaaaggaaggucauccuuugauaagugacauuugaggaaaaaagugaaggagaugagggagagccaugcuucuaucugaaggaggagcacccuagaaagagcuagugcaaggggcccuugggggcaggucaugcugguugguuagccugaagagaguaaauguaguagaggaguaggaaaugaggucagaaugauaaauaggaauguuaggggagauagaaaaugccagaucauacggauccuuaugagggcuaucuuaucugaguaggaauggaagcuguaaguggguuucacgcagaguagugguauagccuaucuuaaccuuaaaacuggcaaaagcaaguagccuagucaggaagccaauccagguaucagagaaagcagugccuguaauuguaguuagugcuggugaaagugaugggaaguaguugaauuauggauauguuuugaaaauagagcaacaggaauuaccaguggcuuagauguggcaugugagaaugaugucaacaauaaauggauuuauuuuaaaauguguaauaucaguuaucuaaaauguuauaguuuguugcaaaauauaaguaaaaaugaaaagucuugaggaucgauaucccuuaagaugucuacaggcauaguauugaauacauuuguucaagcugguuuaccuagugaaggaggucccaacuaguaaggcaguuucagccaucucuuguaacagauuauucuuugugauggguauacauuuguuaaauaauaauaagguuaggaugcugauguauaguauauacacaagcacuuacuauucuacacaauuuauuuauuuauuuauuuuaauugagauagggucucauccuguuguccaggcucuggcgcaguggugugaucacagcucacuguagccucgaccucucaggcucaagggaucuucccaccucagccuccugaauagcugggacuauaggcaugugccaccaugucuggcuaauuuuuaaaaauauuuguagagaagcgaucucacuguguugcccaggcuggucuccaacuccugggcucaagcgaucuucccaccuuagccucccaaagugggauuauaggugugagccaccgugccugguguuuacacaguuucuucauuagcaaaagacauaacuaaucuuuucccucuaggguaacuuaagcaaaaugagagaauuuucuagcaaauugcaaauguucagaagucauucugagacaguacauuuaacucuuuaacagauauuuauagagcaauaaauaucacugcaaugauauugcaauguuccaggcaguguucuagacuagcaguccccagccuuuuuggcaccgagaccaguuuuguggaagacaauuuuuccaugggcgggaugguuucaggaugaaacuguuccaccucagagcaucaggcauuagauaaauucucauaaggaacacacaaccuagaucccuugcaugcccaguucacaaaugcugcugaucuuacaggaggcagagcucaagcaguaaugcucccuccccugcugcucaccuccugcuguguggcccaguuccuaacaggccauggacgcauaaugguccauggccuaggggggaguuggggaccccuguucuagaugguagauaccaacuaagaauaaaaaugaaaaccucuuauggaauuuauuauuagguaaaaaacuauucaucguuuuuacucaaauuuucagagaccuuaucaaauucugccuuuuuuuuuuuuuuuuuuuuuuuuuuugagacugagucucugucacucaggcuggacugccguggugagaucucggcucacugcaaccuccacuucccggguucaggugauucucucgcccaccaucacacuuggcuaauuuuuuguguuuuuaguagaggcaaguuucaacauauuggccaggcugaucucgaacuccugagcucaagugaucccccaccucagccucccaaagugcugggauuacaggcgugagccaccgcucccagcuaauccugaaaauuucuuauaggcacaagagucaggugagaguagacacacaagagaugcagagauaguacagaguuuuguuuuuugcgggggaggguuuugcggaagaauggcaugauaaccuucaucuagcaucccuuaauguuaccaucuuauauaaccgugguauaauuaucaaaauuaagaaauuaacacuauaggcuuuauuccaauuuuuccacugauauccuuuuuauauucuaggauccaauucaggaaaauaccacauugcauuucgucaucgucucuuuauucuccuucauucugugagaggucuuucugaccuuaacacuuuuuuuuuuuuuuagagguaaggucucacucuggugcccagacuggaguucaguggcacaaucauuguucacuucagcuucccaaguagcuggaacuacaggugcacaccaccacacccagcuaauuuuuucuuauuuuuuguagagacggugcauaucacuauguugcccuagcuggucucaaacuacuggccucaagugaaucucucaccucggccucccaaagcacuggguuuacaggugugagccaccacacccuaccgacacuuuggaaggguacuguuucuccuguucuccaaaaucaccgugacuucuuuuuucuuaacuuacucuguugguuagaaguaagucaccgaggcuagcucacacucaggaagaggaagauuaaguuacacuuccuggagggagguauauccaaagaauucauagucauguaaaaccacuaguucauuggucaaaacuuuuuuuuuucuuuuuuuaagacagagucucgcucuguugccaggcuggaguacaguggcaugaucucggcucacugcaaccucugccuccuggguucaagcgauucuccugccucggccucccuaguagcugaaacuacaggcacacgccaccaagcccagcuaauuuuuuguauuuuuuaguagagacgggguuucacuauguuggccaggauggucuugaucuccugaccugugauccgccucggucucccaaagugcuaggauuacaggcgugagccaccgcaccugucccaaaaccaauuuuuaauaaauauuuuaguggagguacuuugaggcuauucagauacccuguuuccccuuuuaagguuucaucaacuaaugugagcuuccauggguggaucuuccuuuagaaauuauuacugugguguuuuaauggugauuuucuauuucucucauucuuucuacauuuauuaauucuguaagaaaaaacuauuuuccccucauccgggauccauuuaaacauuauugauuguauuugguugucaguguuuuuuauguccuuuuuuuuuggugggggggcagggagggcagugucuugcucugucacccuggcuggaguacugugguguaauaugagcucacugcaauguccaccucccaaguucaagugauucuugugccuccccuucccagguagcugggauuacaggcaugcgccaccacaccuggcugauuuuuguauuuauuguaguagagaugagguuucaccauguuggccaggcuggucucuaacuccuggucucaagugaacugccuaccucggccucccaaagugcuaggauuucaggcuugagccacugugcccagcuuucuguuucuuuuauuuauuuauaucuuagaaaugaggucuugcuauguucccaggcuggacucaaacuccuggguucaagggauccacccaccucagccucucaaguagcuggggcugcgggcuugugccaccacucccuuuuauucaagaacagucaucuguuguuuuuguuuuaggacaauaauuuuuugaagagacugaguugucuuauaaagugucccacaucuggauucauggaauuguuuuauuugccugauauccuauaaacuuaaaucuaauuuucagcuugguuagauuuagguuagacuuuuuuauguaaauauuucauaggugauacuguguaauucauauuauauauaugcaguaucucauuggucguugcccaucuauaaaauaauugaaaauuuuaucacugggucauagugguaacagccaaagcucucauuuuuaagguaagguuuucccuuugcaauuuauuaaguaaucuaugugauaacuuugacaccuugugacuauuuccacaccaacuguucauguaguaguuuaagcauuaauuaaagauccuugccugaaacaguuauuucauuaggguuuacacauuguuaauuuaauacuaucuuucuacauuuauuaacuagcauucuccuguaaaggagaacuuuucuaaacuagagcuauuagauuacacuauuuagugggaguuccuacuuaauaggauaaaugcuuaauucugucucuuuuucagaauaaagacuugguguaguaauaacucccaauacugguaaauugcuguuggguaaauguugcuguuacuuucucuuuugaguaccauuauuuuaccugaucguuaaaugucauuuguuauuaagacucagcauuucuuccuuugccaucuuaaccuuuuccaaaggcuucguguuaagcacucaauauguguuuguugaaugguagauggaaagaagaaauugauuccacacuuugugagcauguaugaauauuuacuuuucuggggagaaaguccauaccuuguaucaaauuuucugaaggguaccugagagacaaaugagaaacuaccauucuggggagacugcauucccugauuccagaacugauaaaccucuaacucuguaaaaugacuagagguaaucucaucucaaaaucucauuuaaaaacuuauuuauaaacccuuuauuggccgggcgcaguggcucacgccuguaauccaaacacuuugggaggccgaggcaagcagaucacgaggucaggagaucgagaccauccuggcuaacauggugaaaccccaucucuacuaaaaauacaaaaaacuagccgggcgugguggcgggugccuguagucccagcuacucgggaggcugaggcaggagaauggcgugaacucaggaggcggagcuugcagugagccgagaucacgccacugcacuccagccugggcgacagagcaagacuccgucucuaaauaaaugaauaaauaguaaaaccuuuauuuucuuuuuagagauagaguuuugcucugucaccugggauggagugcaguggcauaaucauagcucacugcagccucuuaacuccuggguucaagugaucuucccaccucagcguccgaaguagcugggaccaugccaugggacauagugccaccauguccgcuaauuuuuuaucuuuauuuuuauuuuuuguagagacgggggucucgcuguauugacugggcugaucuugaacuccuuggcuaaagugaucuuuccaccuuggccuccaaaagugcugggauuacagaugugagccacugccccuaaucuaaacccuuuaaaugaagaucaucacagucuuauggucuuguaaugcacgauuuauauuuuuauauugauaaccaacucauaaucugugauguuucuacucccuuucaccccucuucuacugaucaguaauguuaaauggaagguuucucaucccacuguaagcauucaaaacaacugauaauuuaccuauaacuuuucaaaaauguguucauugcauaaccaaagucuaccuaaauugaacaaauaagggaaauaauguuaauuuaaaaauuggggguaccagccuggccaauauggugaaaccccgucucuaccaaaaauauaaaaaaauuagcugggcgugguggcgggcgccuguagccccagcuacguggguggcugaggcaggagaaucacuugaaccugggagguggagguugcaaugagccgagaucgcaccacugcacuccagccugggcgacagagagagacuuuguccacaaaaaaaaaaaaaaaaaaaaaaaaaaacuugggggaacgucaauguucuuaguaguaguaauaccauagaaguagaaauaauugcaaugccuuuuagguuugaugguauacauuuuuuuuuuuaauugagauggagucucgcucuguugcccaagcuggagugcaguggcaccaucucggcucacugcaaguuccgucucccagguucacgccguucuccugccucagccucccgaguagccgggacuacaggcgcccaccaccacgcccagcuaauuuuuuauauuuuuauuagagacgagguuucaucguguuagccaggauggucuugaucuccugaccucgugauccgcccaccucggccucccaaagugcugggauuacaggcaugagccaccgcacccagccuuuuuuuuucuuuuuaaagacagucuugcuccgucacccaggcuggagugcaguggcgugaucggggcucguugcaaccucugccuccuggguucaagcaauucucaugccucagccgucccccaguagcugggauuacaggcaggcgccaccacgcccggcuaauuuuuguguuuuuaguagagaagggguuucacuguguuggccaggcugguaucaaacuccugccucaagugauccucucuccucagccucccaaagugcugggauuacaggugugagccaccucgcccagccauuauuguauaagauauuuuauauaacuaaugaugauucauuugaguguuuuuaaagcuugucuuccuaagguaagccuggaaacguagaaacaagcaaucaguuugcaaaacgaugacuaaaacagacaagcacauacuagcuuccccuucacuagcaagguguaauauauuuucuuuuuugagacauagucucacucuguugcccaggcuggagugcaguggugcaaccucagcuaacccagccucugccuccuggguucaagugauucuccugccucagccucccaaguagcuggguuuacagaugugcaccaccaugccuggcuaauuuuuguguuuuuaguagagacaggguuucaccauguuuaccaggcuggucucaacuccuggccucaggugaucuucccaccuuggcuucccaaagugcugggauuacaggcgugagccaccacaccuagcuaauauauuuucaaauaacauacuuuacaucuguuuucaaagagauuuugaaguguuggcaaacuuuuaaaaguuacucccaaauauuauaguuuaaggcaaagaucugccuauuucucaaguuuaauuuuuaaugaacaacuuuagaaaccgauggagaauaagcaaauuaaaaaugguaaaucaagggcugggcacaaugccucaugccuguaaucuuuaagauuacacuuugggaggccaaggcaggcagaucgcuugaacccaggaguuugagaccagcucagcaacauggugaaacgccuucucuacagaaacuguaaaaaaauuagccagauaugauggcacacgccuguggucccagcuacuugggaggcugaagugggagaaucccuugugcccaggagguggagauuguagugagccaagauugcgccacuacacucuagucugggcaacccagaagaccuugucugaaaaaaaaauaaauugagguaaauugagcuggguguggugguuccucuaguccguuacucaggggaccaaggcaguagguuugcuugaggccaggaguuugagagcagccugagcaauauagccagacuauuucucuuaaaaaaaaaaaccgggugcaguggcucacaccuguaauuucagcacuuugggaggcugaagcaggcgggucaccugaggucaggaguuggagaccagccugaccaacauggagaaaccccgucucuacuaaaaauacaaaauuagcuggguguggucacgcaugccuguaaucccagcuacucggggaggcugaggcaggggaaucacuugaacccuggaggcggagguuguggugagccgagaucgugccauugcacucuauccugggcaacaagagugaaacucugucucaaaaaaaaaaaaagguaaauuguuucucuuuguguuucagauacgucgguaaccuuuccagagaugugacagaagcucuaauucugcaacucuuuagccagauuggaccuuguaaaaacugcaaaaugauuauggauguaaggguauuuuacuuaguuaacuuuauucuuuuuuuuuuuacacauuacuuaaagccauugcuuggaaggaauucuuaguuuaccauggucuaaauauaguauaaauuauuaguuuacuguagucuaaauauagucuuaguuuaccauauucuaaguuaauagggauuuuagugaauuuguaaugaaccuguuuugacagcugaauuuaauuuguuuuauuacaugauggaagaugacaauagaacuaguuauuucuagaucagaugggaacauauauaugggcucuuucaggugcauugaggcaucagaaauguuuauauguggugucaacugguuggcuaauaaauucagcucuuacaauuaaauuggaaaacagguuuaaaaauaauaggcauuugguacagugaaaguauuuuuaacuuuauuuuuaaaggucaucauucaaguuuuucuuguauuuaggcaauuccuauuuaugagacaauguauuaaacacacacacauacacacacacacacacacacacacacacacucauucaucuaauugguguuaacccugaaucauaauagguauaaaaagacauuuagggaacauuuaccccauuucccuggagucuuugucuccugguuggggggaaaagacuuuaaauuuuuuuuugagacggaguuuugcucuuguugcccaggcuggaauacaauggugcgaucucggcucgcugcaaccuccgccucccggguucaagcaauucuucuggcucagccucccaaguagcugggauuacaggcaugcgccacuacaccuggcuaauuuuguauucuuaguagagaugggguuucuccauguuggucaggcugguuuagaacucccgaccucaggugauccaccugucuuggccucccaaaguacugggauuacagguaugagccacuguaccuggccuaaauuuuuuaaugggaaaggcuauguuaaagagaaauccuuuugucccauggucucucuuuucuguaaacuuuucguuuguuuguuuguuuguuuguuugucuugaaagacagggucuugguauagccauugcacccagccugcuauaaacuuucaguuuucuuuucuccagaaaagacaaucauguauguguguauguguaucuguuaccuucuuuccuguuguauuccaguucaacuuuuuuuuacuuaauauuuuuaaaaguaauuauuuagccgggcacaguggcucacaccuguaaucccagcacuuugggaggccgaggcaggcagaucaugaggucaggaguucgagacuagccugaccaacauggcgaaaccccgucucuacuaaaaauaccaaaauuagccggacaugguggcaagcgccuguaaucccagcuacucaggaggcuaaggcaguagaauuguuugaacccaggaggcgaagguugcagugagccgagauugcaccauugcacuccagccugggcgacagagggagacugucucaaaaauauauauuuauccaauuggcuuugauuuguugucuuagaucuuaaaauguugucagaccuuuguucugaugcugcaaaaucaucugcauauuauauagaugaaaucaacaaagaguuauguucuuuuauucuaucacauuuaauaucgguaugccuuuggauaaaggagaaaaaauccauguacccauagagaaagacaggagggaaagauggggaaagaugaagagaaauuuaaaaccagucuuuccuuaaucuagaucuccuuacuuaucccaaugguagcauuuauggaaaauuugcugccugucaguuacuuuaauacauugucauaaaugcucaauagaaacauaaagaagguguuauuuucauuucauguaugaggaaaugaggcaaagcaaggcuguaaacccuaauugauuuauccgaauauaaaucuucucuguugguuugccugcugcuacucucucucuggcuggucauauguuucccuggggaaagaucauuagacaaaacguuaaugauugccuuggcuacagaaaaaaccagguuagccuuugccacuuuuuaucauuuguggauucugaucgcucaaaagcuuagauuuuuauuauucaaaucuaaauuccagucuguucacauucugagacuaauguucacauuuauaaauuuuaugcucccuggacugauaauauguauauaugcuucgauucuuauuuaaaaaguuaguuuuuucugcauauaaauuaaguaaagcauauucuuuuucauuuauuuacucuuaaaugcaagugacuuuuucuuuuuuuuuuuuuagacagagucucacucuguugcccaggcuggagugcaauggcaugaucucagcucacugcaaacucugccucccagguucaagcuauucuccugccucagccuccuaaguagcugggauuacaggcaugcgccaccacaccuggcuaguuuucguauuuucaguagagacaggguuucaccauguuggccagguggucuugaucuccugaugucaugauccgcccaccccagcuucccaaagugcugggauuacaggcgugagccaccacagccagccgcaagugacuuuuucuaacuucauuucaguguugccugucagcauugaucuugguaauagaauucccauuguguuuuauuaguuugaguuauauaacauuuuuauucucuaauuuuuuuagacaaaauauagucccaauauauuaaacuuugucuuggccucguugcuuuaaaauuuuuacaagucauugccagugacucucaaacuauuaauuguugaugugcacagugacugaugccuguaaucccaacacuuugggaggcagaggcuggaggaucacuugagcccaggaauuugagaccagccugggcaacauaacaagaccacaucucuaaaaaaaaauuaauuaacuguacuugaaauaaaauuguauauuccucuauuuuaguagcuuucuagucuuuugaauuaguuuuuuauuuuaacaaaucuguuuaggaggcuauggaaagaauuuuaaaauggccuauaaugucauuugauauuuugcacuguagguguaaaaauuggaauuuuuuucugcuacuugaauuuauaauuaaacauccagguucuauuuaucacauagccucaccuaccuggaacaccagcagaaaagggaaguuuuguuuuuuuuuuugagacagagucucgcugugcgcccagacuggaauccaguggcaccaucuuggcucacugcaacgucccccuccugaguucaagcgaaucuccugccucagccucccgaguagaugggauuacaagcacacgccaccacacccagcugauuuuuguauuuuuaguagagaugagguuucaccauuuuggccaggcuagucucgaacuccugaccucaggugauccaccugccucauccucccagagugcugagauuacaggcaugagcuacugugcccggccaagggaagauaauuuuuuuuuuuuuuuuuuuuuuuuuuuuuuuuuugagacagaguuucacucuuguugcccaggcuggagugcaauggcgcaaucucggcucaccacaaccuucgccuccaggguucaagcgauucuccugccucagccucccgaguagcugggauuacaggcaugcaccaccacgcccggcuaauuuuguauuuuuaguagagacaggguuucaccauguuggucaggcuggucucaaacuccugaccucaggugaucagcccaccuuggccucccaaagugcugggauuacaggugugagccaucaugccuggcugggaagauaauuuuuuuucuuuuuucuuuuuucuuuuuuuuuuuuuuuuugagacagagucucgcucugucgcccaggcuggagugcaguggugcaaucucggcucacugcacacugcaagcuccgucuccuggguucacgccauucuccugccuuagccuccugaguagcugggacuacaggcgcccgccaccaggcccggcuaauuuuuuguauuuuuaguagagacgggguuucaccgugcuagccaggauggugucgaucuccugaccucaugauccgccugccucggccucucgaagugcugggauuacaggcaugagccacugcgccuggcgggaagauaauuuuuuaaaggcuucugagcaagcaaaaaauugaugucagaaaguucacauucuaaaacuuauucuaaaauuuuacuuaccagagaaucucuucaguuuucagagccuauuuaccuauauuuuaaaacagguuuaagaagguuggcuaagauuuucugcuacucagcaagcuaguagcagcaaggagcaauguacauuuguagcaguaaaaaguaacuuauaacagggaggggauagaaaaaucauaaaaagccgaagugagacuucagaacuuaggaguucagucaaacuuaaucuguguagcuugaacaaaugguuauaugaugaugggguauguguagcuauauauccaguuaggauaccuagucauuaauauuaaauuauaguacuauaguauaaccuguugaagaaaauagcuauguauaaaagcagugugauuuuaaguguuugcuuuuuuuuuuuuacuuuuuaauuauuuuagagacaggaucuugcuguguugcccaggcuggauucaaacuccugggcucaagcauuccucccaccucagccuccuaaaguagcugggacuacaggagcuggcuguuuacuuuuuuguuuguuuguuuuugagacggagucuugcucugucgcccaggcuggagugcaguggcgcagucucagcuuacugcaaccuccaccucccggguucaagcaauucuccugccucagccucccgaguaggugggauuacaggagccugccaccaugccugguuaauuuuuguauuuuuuuuuaauagagacaggguuucaccacguuggccaaguuggucucaaacugcugaccucaugauccaccugccuuggccucccaaagugcugggauuacaggugugagccaccucacccagccuacuuuuuuaaaucuaaaauuuacuuguggaauagaccauucauucuccauggccugauaacuuagauguauaaaacuugguuuaagauuuuuuuuuuuacauaauuuuaagguaaugggugaauaaagcuuaaaauuggcuuuuguguuucuucucccacagacagcuggaaaugaucccuauuguuuuguggaguuucaugagcaucgucaugcagcugcagcauuagcugcuaugaauggacggaagauaauggguaagguaagcugucguaauuaaagaaggugacuugcacugaaaaaauuuaaguuauauaugauuuuguuuccuuuuuagaaacauuaaacacuuuuuuuuuuuuuuugagaugaaauuuugcccuuguugcccaaucuggagugcaauggcacagucuuggcucacugcaaccucugccuccuggguucaagugauucuccugccucagccucccuaguagcugggauuacaggaacgcaccaccacacccagcuaauuuuucguauuuuuaguagaaaugagguuucaccauguuagccagacuggucucaaacuccugaccucaggugaucugccugccucggcuucgcaaaguguugggauuauagaugugagccaccgcgccuggcugaaacauuaaacacuuuauagcaaaaggucaguuauugacauauaauauuaaaaagguaggauaaagcuuuuagagggcagaggcuuguguuuauguuaguauuuucuuuucuuuuuuuuuuuuuuugaguugggucuuucucuguugcccaggcuggagugcagcggcgcgaucucagcucacugcaagcucugccuuccggguucaugccauucuccugccucagccucuggaguagcugggacuacaggcgcccgccaccacgccugacuaauuuuuuguauuuuuaguagaaacaggguuucaccguguuggccaggauggucucagucgccugaccucaugauccgaucugcccgucucggccucccaaagugcugcgauuacaggcgugagccaccguccccagguuuuuuuguuuuuuuuuuuugagauggaaucuugcuuugucacccaggcuggagugcaguggcaccaucuuggcucacugcaaccucugccucauggguucaagcaauucuucugcuucagccuccuggguagcugggaugacaggcacccaccaucaugcccagcuaauuuuuguauuuuuguagagacaggguuucacucugauggccaggcuggucuugaacuccugaccucaggugauccgccugucuuggccuccgaaagugcugagauuacagacgucagccagcagccuauguuaguauuuuccaugguggauuguacaugguaaauaacaaaauauuugcugaauuacucaagcuuggaugcuaauggaaaagaaugaaaggaaaaaaaauaauauggguacuuuagguaggaaagguuaauugaaugauaacagacacauaaagauuaggauuugucaacauuauuugccuaaauguaggucagaagauuaaguguugaaacuugaccagagcugguaucuccuucaguguuucaucuuaaacagauaucuuccuauguguuuauagauacaaaugugauuuugggcuuuauuuuugugaaguauaaauguagaaauuuuuuuuuuuuaggaagucaaagugaauugggcaacaaccccuagcagucaaaagaaagauacaagcaguaaguauauuuuaugcucuuugaacauuuguuuuuauuguacccaguaguuuuauuguaaagccuauaaacaucauacauguuugcaguaauguuuugaucguuauccuaagauaugauugaauguguuuguguuaauaaauuuaagaacaaaucuaaucuuugucaucagguaguaccguugucagcacacagcguucacaagguaauuguaucuucuuaaacauaaaaugaaaucucuugaaaggguauucacuaaccaccugaaguuuuuuuguuugauauuugggggaggggggcgggaggagauauuauuucuauuugucucucuagcaauacuuuucucccuucucaguguugaccaaguauaacuuguccgcuacuuuggugcuaguucaagcuuucugacccguuugguagcagcugaugccuuagaacuacuuucaccaacuaaggggcaaaauacccuccuuucuugaggucaccauuugggcuucauacccagaucuuccaaaugcuugaguugcuccucaaauuuuguuucccaaagagcaauccaaaauguuguuuaaggccugucaaauauggguaacuuuucuuuccaaauaugcuuugucaaauugauguauguguccauuuuaaaguguugguccaacaauuuugcauuuuuaaaguguuucuuuuuuugauaauugucuuuuuuaaaaacuucagauauggguugguuauuucucuccaaugcuuuuuuaaugguucugauauaaagugaagggauuacuguuuucauucuguugccuucagucuuaguucacuugcacauggauucacauaaacugaaugguguaaugucugggcaaccaaaacuguuggcuuuugagaaaacugucaaauacuuuaacaucaaacuguugcaaugcaagguauuucuuugauuguucuucacaaaauaugguuaaaccaaguauauaucauguagcuagcuucaguaaauuguguuaacugaggcaaaucuagucuacauaauucacaguaccacuauuuuauuuuaauuuguaaagccuuaauauagugguaaacugaauaaaaguaaauaauuauuauuagaaugguaacuaagucauuaaauuuuuuugcagaacugaaacuuguauguuauuaguuuauuuucuuagaccaguguaauaauugacuguaaauagaaauauaaaugucacuuuacaguuagauguaucacagucguuucaggagaauuuuuccuauauuguuaccuugauucauuguuuaaaauugguaggauuuguauagauauaggauaguguuuuauuuauacuuuaucauaagccauaaucauuuuaagaauacuuuauuggauagauuuuaguacuuuuuaaauucuaaaguucuauuuuucuuuucacuuccccuuccuuccccuuauaagaucauuuccaugucuuuguuggugaucucagcccagaaauuacaacugaagauauaaaagcugcuuuugcaccauuuggaagaauaucguaaguaacagaagauaaauaaaauccuuuuaauuagaaacaauuauauguagacauaacuugaaaauaauucuguugugaauuuuguacauuaauuuuauaacuugaauauaauguauuacauuguuuagagaucauucaagaaguuaacagcaaaagauuguuuucccauugaugaauaaaccuuugguuuucaauuaucuuaaaauccuuuuucaauuagcauagcucuuaagagacaaauuugccauuguacauguuuuacuuucuuauauagguaucaagcuagcuuggugacaaucuuuaguaaaauugugcuguaacuaaggaauuuagaucuguuggguacuucuaugauaccaugcauuuuguguuaauauauuuuaacaaaaagaaaccuuaacaauucaacuuaaaaagcaguuauugaauauuauuuucuagauauuuacacccuuuuaaaaaaacugcuaacaauaauagugccuuaauaauauuuuaugaagcacugccuugcuugcacuuguuauuagucauacauuuuaggcccuuaugaauaaauaccuuacuugagauagcauucaucauagaagaacuuuaaaauuuugaaaagcaugccauauuagaguaagaauaacaaguuguuuacaguacuuucuguagaguaauuagcuuagaaaacuucuucaggguuucugcuugcucuguuauuuuuccaccuagaagaauaguaaaaaggaagugcuagcugugguuugguuugaacagaccaacagcagagaugagaugaggagacuggaaaguaaaugccaguaguauuggugaauuuuaggagcuuucguuugaagaguuaucguuccuugauuaggggaugugaccaaggaauuaccaacuuuaaagguggucacagaauuagggcuuauaaauggacuucuuucagaugacauuuuucuuugugagaccugaucaggaaaauaaguacagcuuucauuucuugauuguccuucuuaauaauaucuuagaguuucaauaauaauuagcuugcuuucgaauaucuggacuuagacagucuuagccuuuggccucucaagggcucuaaaucucuaugcacaauuuuguguuuucauuuugguguggaaaaucuuuguaaauuuuauccuauugucagaguagucauagaaccauaaaaggauaaagaagccugaucuagaucuuugcugcugcuucagagaaucuuuucagagagaaauaaaugaguugaauauuuuucaagacuaacauuuucugaaacuuuaagaagaaaaaauuuucuaacauugugaacagauuaaguagcuauuuuauuaaaugcuuugauuuuaauugagguaguuuuuuugaaaacacgggaauuuuaguuuggaauuaggcaaagauuguuuaacaguuggugaguuuaaguuaagugaccuucagauuuuagcaauuucaugauuuacaaaucguggguuauauuuuuuucucuuaaauauauuucugugucauauuuuuagucuguagauuuucuuauggucccaugauuauugguguauacuuuuuuuuucuugguaagaccuuuaaguuuuaugauuuucaauugagauaauguauaauguuugaguuuuaggcuauauaaggaauuagcuuuccugcauuuaaaggaaucauuuggcagucaguagcauauuuuccugauuuuuuguuguuguuaaaggagauaaguugauaacuguauguugaaggguucucaugauauucucuaaaaagugcaaauaucagugcuugauuuauagauguguaauaaacaguggucuguaaaagcauguaguauaaaaaauaugguauuuucccuuauauacagccuauaaacucuuccuauuccuugaguuuaggguagacuaacaaauuacagcguagaagagagucagcuaccagauuaaaugcaugcguaccauacagauaauuuauuaaguauuuuugcauauugaacauugacuuacauuaauuuucccuuuucaccaccacgucuuugucauuuugacccugaacacuuaauaaaucacucagauugaucuaaaauaugcuuauguauacuuuaauagaaaauuacauugcauggcuuucugacuuggguuuuuguuauaaaagugccuguuuuguucauguguccugagagagcaagcauugugacauaccugacuaacuuaaaagcagauugccugugaagcacaauuugaguccaauuuuuugagguauggaguuuuagcuaucauggcuggguuuuuacucaaucucaaauaauagggcucugguuauuuugcagagugucucugaagaauggacagaauugcccuggcuaacuacaagcuacgguucacaguggauaaauguuggcgugcuuuuuuacuuucugacuuuuuaaaauuuugcuuuuauaucuuguaguuccaaucaauuuuauaugaaugcuauuauaaaauucaguguaaaaucuuuucuugucuagcuuaaaacuugugugugucuaguauuuuucuucaaugauuuaacauuucugaaaaugucaaguucucaaaauuuagacaaaaagggggguauaaauugaucugaaaaaauuaaauaguuuaauuaguuuagggaauauacaacuuuuucauucuuuugguuuccaguuuucuauuuuuuuuuaaugauuagguagaauauagugucaaauaaguuauaaauugcaugguuaaagaaagccauucaucuaauguccugugaacuuuauaagugguuaaguaguucaugugaguagcugcuuucaccaugcuuaauauuuaaaaguuuaaaaaguuuuuugaagagagaggcaauuucuguacaauauaaauauacauauauacuuaaguuauugauuugcaugucuauaaaauuaagccucauuuccuaauacaugauaaauuuuguagaauaaaaggugaauuugcauuaaagguucacuuuaaugaaggugaaacaugagaaugaguugugugugaaauucuuauuugauauccagaggauaguuugcaaaccuaaacuucugauuguuucugauuucagagaugcccgagugguaaaagacauggcaacaggaaagucuaagggauauggcuuugucuccuuuuucaacaaaugggugagcucagugagaagugcauggauaaugcuuaaagaguaaagaauggaaacacuccguuuuaauuacuaaucuuuuuuucgucugcuguuuauuuuacugaugauuaaaauaaacccucacuagaagauuucuucuguuuugucuguuuaacauuuauuggcaccugaggcaugcagaguacugauaagauguuuucagaauguagaaaguaaaguuguuuaaauuaucagccaaagguagauguugaaaaucucauuuauggauuuaauucauuaucucccuaguuuauauucccaugguaguuuaaaaguagcuaauaaaauacugugaggaggccggacgcaguggcucacaccuguaaucccaacacuuugggaggcugaggcggguggaucaccugaggucaggacuuugagaacagccaggucaaccuggugaaacccuguuucuacuaaaaauacaaaaauuauccgggcgugguggcaggcgccuguagucccagcuacucgggaagcugaggcaggaggaucacuugaacccaggaggcacagguugcagugagccgagaucaugccacagcacagccugggcgacagagugagacccugucucaaaaaauaaauaaauaaauaaaaauacugugauggauaggaacuuuuuaaaaaauuaaauauuacccgggcacagugguuuaugccuauaaccucagcacuuugggaggcugagaaguuugagauaaauacuggcaauauagugggacccuaucucuacaaaauauauauauuuuuuauuuuacuuuuuuuuuaauuuuuuuuuuuccgggaauuccgaaaauucagccgagcccaguggcucacaccuguaaucccagcacuuugggaugccaaggugggcggaucacuugaggucaggaguucaagaccaaccuggacaacauggcaaaaccccaucucuacaaaaaauuagccaggcauggcgacacaugccuguagucccagcuacuugcagggcugaggcgggaggaucacuuaaauccaggaggccaaagcugcagugagucaugaucaagccacuguacuccagccugggugacaaagugaggcccugucucaagaaaaaaaaaguugaaaauuguaaaguacauugagaggugaaaacaauacaagcucaaucauguacaugucccaucuaccaaagauuuuuuuuuuccuguaagaugagaaaauaaaaauuaagagaauuuauuugguucucaaaacuuuacuauuaagcauagcauaauguuuuagaaagguagaaaaauaccuucuauaauggauugauagccgugauuaauuugaguuccuuagaggauugauucauagguuuuaggauguuuuagugcaaguuagggaaauaaauuggcgguuugaugggcuaggaacucauuuuucacauuuucgagauuguggacuguaggguucugcuauauaaaaaucacuguugaauguguauuuaguaugaacuagagucaaauagcaaaggaugucucuugauaaccuguguauggccucuggaguuagccagagauguauacaaauucugacaaccauuauaaaacagauguaacuuugaguaaauaauauaauuuuuuuuuugagacggaguuucgcucuguugcccaggcuggagcgcaauggcgcaauuucggcucacugcaaccuccaucuccuggguucaagcaauucuucugccucagccucccaaguagcugggauuacaggugccgccaccaugcacggcuaauuuuuuguauuuuuaguagagacaggauuucacuauguuggccaggcuggucucaaacuccugaccuugugauccaccugccucggccucccagagugcugggauuacaggcgugagccacugcgcccggcaguaaauaauauaaucuucuauaaaaucuucuauaaauuuaaaucuauaaauuucaacuuauguaaaauuugugauacgugcuuggcucuguuacgcagugcuacagcccugauugcaauuacccccagccucucuuccuauguucuacaugcuaggaagaccacaauacugauugagcuuagcuucucugccuaccccaaaauaacugaauguuccuggaaaaaaacugaguucaggugguuuugcuucuaauuuaauggucacacacuuuaggugaguacagaguacugucuuggcaaacauguguuucucaucuuucaaccaccaaacuuacauaaaauucauccaccuucccauucuuccuauuauaguacaggaaagguccuuccugucaaaggcaaaaucacuuaugauuguguccccaucucucuugccuuuucaaggacuuugagccuaugcugccacugcuucauuguuuuuuuuuuguuuguuuguuuuguuuuguuuuuguuuuaacagcagcuuuauugagauauaauucaaguauacaguguggccgggcacaguggcucacaccuguaaucccagcacuuugggagacuaaggcaggcagauuacuugagccuaggaauuugagagcagccugggcaaaauggcaaaaccccuucucuacaaaaaaugagccaggcaugguggcacacaccuguagucccaguuacuugagaggcagaggugggggaaucaccugagcccaggaaguugaggauccagugagcugagauugcaccacugcacuccagccuggacgacagagacccugucucaaaaaaaaaaauuuuuuuuuuaaaguauacaauucagugguuucuagguaauucacagaauugugcaacuauuaccaaaauaaauuuuagaauauuuuuaccaccccaaaaagaagcuacaugacucauuagcagucacuauccuccuuucaugccccuccugccagcccugaacaauugucaaucuacuuucugucucuguagauuucccuguucucaacauuuccuauaaauggaaucauaaugugcuguucuuguuauuacugcuauucugugucaucacucuauuccuucucuacuggaucauucucaucaaccuaggaucucucuuuuuuuuuuggagagagggucucacucugucacucaggcuggagugcaguggugugaucauagcucacugcagccucgaacuccuggccucaauccauccuccugccucagccuccagaguagcugggaccacagguguacaccaccaugcccaccuaauuuuuuuuuaaaaaaaggccaggcaugguggcucacacuuguaaucccagcacuuuggguggccgaggcaagcagaucaugaggucagaaguucgagaccagccugaccaacauggugaaaccccgucucuacuaaaaauagaaaaauuagccaggcaugguggcacacgccuguaaucacggcuacucaggaggcugaggcaggagaaucgcuugaaccugggaggcaaagguugcagugagcugagauuaugccacugcacuccagccugggcaacagagugagacuccgucucaaaaauauauauauauauuuuuuuguaggaacaaucucacuuuguugcccagucuggccucgaacuccuggcuuccaccaguccgcccgccuuggccucccaaaguggugggguuauaggcaugaggcaccguuccuggccaucuaguaucucuuaaucaaaaccacuguuuauccucacaucccuucccuaacuguauccccauuucuuggcuauaauucucaagaguuguuugcauaugcuucuacuuuaucucccauucacaaccaccaacauagauacaucucuguuuuuuuuccacuuuuuugagugaguaguuuuauuuuuuuccugaggagcuguaucaaaguaucauaaacuggauggcuuagagcaacaaaaauuuauuuucucaauguuuuggaggcgugaaauucacaaucaaggugucagcauguccaugcucuuuugaaggcucuguagaagaauccuuuguugcuucuuccaagcuucuggugguugcugguaauucuuggcauucauuggcuuguagcuguauaacuccaaucucugccuucaucuucacaugaccaucuucucucuuuguguauccauauaaucaucaucuuuuuuuuucgagacaggaccucacucugucacccaggcuggagugugguggcacaaucacaacucacugcagccuugaccucccaggcuuaggugaucuuuccaucacaaccuccuaaguagcugggacuacagguguugcaacaccaugcccagcuaauuuuucuauuuuuuguagagacaggauuuugucauguuguccaggcuggucucgaacuccugggcucaugauccaccugccucggccucccaagugcugggauuauaagugugagccaccgugcccagucugaucuuuacuucuuaugaggacuugagucauuggauuuggggcccaccuuaauccaguauaaccucaucuuaauuacuucggcaaagacccuguuuccaaauaaggccauauuucacagauaccaggguauaggacuucauaucguuuugagggacacaauucaacacauaacauuaguuaagcgucucauggaguucggacugguuggggugauaauauuuguuucuuuuuaagaaugugcauuuccugccaggcacaguggcucauuccuguaauaacagaacuuugggaggccaaggcaggaggaggacugcuugagcccaggaguuagaaaccagccugggcaacagcaagacccugucuccauuaaaaaaaaaaaaaaaaaaaagccuggcgaccuagucuguggaccccgaaucccucccauugccuguugcaaccaguaaaggcuguuccuaccauaguaaagaaauuaaaaaaauaaaaaaaacagccaaccuuguuggugcaugcuuauaguccuagcuacuaggaggcugaggugggaguaucacuugagcccaaggaguucaaggcuacaguaagcugugaucaugccuggaugacagaauaagacccuauuuaauuuuuuuuuaaagcauuucguuuucauauuucaagaaaggccuugaauuugccuguuccuucaguaguagauuaagcuuaccuuugaugugugcacacaaaaguuacacuccauuuacuuuuuagucuacucuaagcugguuuuacucucacuuuguaccaaugcuacucuauuuucaaggucaccucuuaaccucuguuuucuuggcucccuggaccauacacuuuuguggcuuucuuccuucaucacuggcuacuccucccuagucaccuuagcuagugauuauuccuuuacccauuuuucaaguuuugcuguuuuucagggcucuguccuaggcucuuucucuagucugcaugaauuuuguaucuucagucuacuucucugcguuccacauuuauuaacaaauggucuucauuuauaugucucacaggcaucucaaaguuuuuucuuaauggagcuuuuuguuucuuccucagaccuguuccccuuuucuuuccuagucuuucuccgcauuucaauaaaugcugucuuuccaauuucucuagaggaaccuaagaguuaucuuuucucuccuuuugcuugugguguccccuccagcccccauuauuuuggccuugaguuuaaguuacauucacugcuacugcaaugcuccuggccaccaacacuuuuuaaaaaucuagaauauugcacaaguuucauaaaguaucuuuauccccuuacuacccauuauccuaagccauucuccucuuagcgcuaagaauggccuucuugccgggugcgguggcucacgccuguaaucccagcacuuugggaagccaaggcaggcggaucacgaggucaggagauggagaccauccugucuaacacggugaaacccugucucuacuaaaaaagaaacccugucucuacuaaaaaauacaaaaaaaaauuagccgggcuugguggcuggcaccuguacaggagaauggcaggaacccaggaggcggagcuugcagugagccaagaacgcgccacugcacuccagccugggagacagagcaagacuccaucucgaaaaaaagaauggccuucuuaaaacauaggucaugaugauuccuugcuuaaaaucuuucaguuucauucucugacauucuuuuuugcucgcuggauuccacugaaacuagucuuucacaugcugcuuucagaugcauaccaaacuuuugugccuuaacacacuuugcaauacuuuucucucuacuggggcuuucuuccucauuguuuugacuuggcuaucuccuauugcugucaggcuuaguuuaaaugucauuucagagagaccuuucuuauucauccugucuguaguagauccuugugcccauauucucuaucucagccuuuuguuucugucauaggucuuaccacaauauguaauugcuuuauuuguuccccacaaaagaauguaagagaccauguaugcuuguuuaccagugugucccuagcucuuaaccgcaugccuggaacauaacuguucaauauuuauuuguuggaugaaugagaaaccaaauauuguuaacaagcuuguuagauuguuuaagauuuucuucuauaguagucugaguugcaugaacuuuaugauaucuaccucauuagggcugucgggcucacgaccuuuucagaugauuaauguucccaaaauuuaauauucaaauaagagaaaaacaauacaaaagcaccauuggguugagcaugguggcucaugccuguaauccuagcacuuugggaagcugagguggacagaucacuugaggucagaaguuugagaccagggccgggcacaguggcucacgccuguaaucccagcacuuugagaggccgaguugggaggaucacgaggucaggagaucgagaccauccuggcuaacauggcgaaaccgugucucuacuaaaaauacaaaaaaugagccaggcgugguggcaggugcccguagucccagcuacuugggaggcugaggcaggagaauggcgugaaccugggaggcagagcuugcagugagccgagaucacgccauuacacuccagccugggccacagagcgagacuuaaaaaagaaaaaaaaaagaagaagaaguucgagaccagccuggccaauauggcgaaaccccaucucuacuacaaauacaaaaauuagccaggcaugguggcagaugccuguaauccccgcuacucaggaggcugaggcaggagaaucgcuugaacccaguuggcggagguugcagugacccaagaucacaccacugcacuccauccugggugacagagcgagacucuaucugaaaaaauaaauaaaauaaaauuuaaaaauauaaaaagcaccauugcauuuuaggaaagcuaucauauguuguguauuucauagagcauuuucacuuaaacauuugugaaaagcaccaaguuuucucuacugcuaagaguuguuuaacaucaacuaauagugacuucuuuauuguuucuaauguuguacggaacaggaugcugaaaacgccauucaacagauggguggccaguggcuugguggaagacaaaucagaacuaacugggcaacccgaaagccucccgcuccaaagaguacauaugaguguagguguauuggagaagaaaaggaaauguggaauuuuggagaaaaauacgcuagauuuuaaauguuagagcuguucccggagacuuauugcagaaauagaugagaagcaaaucaagacuacuauucaaaaauguacuuaguuuucauuuuuguaauuauaaauaauauuauuucuaaugucaagucuccuauuaaauagaaaauacuggguaauuuuuuagacauucgugggggagguuuaauucugaacugaaguauaauauguguaauauaagcauuuugaucaagguuaauguuaccuuuacaguaguguagugaaugcuacuuuucucuuucugcacauuuuauuuaaugaauuaaagacauaaaccuuuucucucaccagcaaauaccaaacagcuaucauaugaugagguuguaaaucagucuaguccaagcaacuguacuguauacuguggagguguuacuucugggcuaacagguaugggagccuucccuguguggcauuaauuuuuaaagugcaaagcuuaauauuuguaggauuuuuauauaacuuagugugauuuguuuguuuugguuuuuugucuaacagaacaacuaaugcgucagacuuuuucaccauuuggacaaauaauggaaauucgagucuuuccagauaaaggauauucauuuguucgguagggaugguuuuuuaaaaaaacauuuuucuugguaauguaacuggaaaaccagaaaauaaauaaaaauaaaaaacuuuuuccuccaaaauauuuuuugaacauuuaccucguuuucuuaaaaauuuaccuugguuauaaaaaaguugaaauuuuggccgggugcgguggcucacgccuguauucccagcacuuugggaggccgagacggguggaucaccgucaugaguuugagaccagccuggccaacauugugaaaccccgucucuacuaaaaauacaaaaauauaaaaauuagccggcauggcggugcaugccuguaaucacagcuacucgggaggcugaggcaggagaaucacuugaacccaggagguggagguugcagugagccaagaucacaaucacugcacuccagcaugggcaacagagccagacaccaucucaaaaaaaaaaaauugaaauuucucuagcauccagcguauuugccucugugauuuuauagcucccucccuaacacaaggccagugaaacacacauucuuuguuaacacaaguugccccagaacuacaagaucuuugaaaaaaauagcaaagaaaauaugccauguuacgcaaacuguuuuaccucagacucaccuugauuuuuaaaaauagguuuuauucauaaauauuuaaaagaauuuguauuggugauucuuaauauuguuuucaauagguucaauucccaugaaagugcagcacaugcaauuguuucuguuaaugguacuaccauugaaggucauguugugaaaugcuauuggggcaaagaaacucuugauaugauaaaucccgugcaacaggugagaggguucuuaacuuugagaaguaauuguugggcuaauaauguuauuuuaaggugaagauuguugauaauccuuguuaauaaguuucuagcuaaaaugauaguauauaagggcucuuccuacauguauuauaguuccagaaugguguuucauggauugcaguggugacaugaugaaugugaccgccucaauugacucaugcucacacaguggauuuuaaaaugcuccgagaaaccuaaaaggguauuacaucuuuuuuuaauacuugguagauuuauucacauaccauuuggagaacucacaagcaugcuugacucaacugaaacaaaaauaaagcuguaaauauaguuauggccuuggcauuuuucuuccagauuuugcugccuuuuuuuuccaggcagcuuuagugguucaaacuugauuccacaaagauuucuaugaggaaacuguaaauggagcacagagaugggaguaagcaaauccuaaacuauauaagugucuuaaguaagcugaauauagaaauaauuaaucacaucuucccuaucuaaaggaaacaaucauguagauaguauaccaaacacuuaaacauucuacuaaguuuaacauuuauuacuaggguaucaacugaugccuuccaaaaacuaugccauucagaguaucacguagaguuacagcaguauaaccucacuuguuuuguuguuguuuuuuguuuuuuuuuuuuuuuuuuuuuuuuuuagcagucaacucuuguuuauccugucauuuuaauuguaaugauggcccuguguguuuuggcuaagaauuugugguaucagcauauuaggauuguauauauauaguuaacuucaaguaauacuaaauuuuauuuaauagcagaaucaaauuggauauccccaaccuuauggccaguggggccagugguauggaaaugcacaacaaauuggccaguauaugccuaaugguuggcaaguuccugcauauggaauguauggccaggcauggaaccagcaaggauuuaaguaagcauaucuuaugucuuccuuuacuaaccuuugaaaaugucuaaagaaauuuuaaguaggaagaaauuuuaagaauuaguggguaauagggccucuuauguaaagcguaacuauagccuugaaagaacuuaaaauuguuuuuuaguaagaaaauaagagcuuaauaguuguuaagcuuuucacaugacuaauggucacuuagccauucuuauauacacugaguuugaugcuaguuguuguauucauuaugcuuuuuucuguacaaaggguuuuuucaauaugccuuguuacauugcaagcuuccuuauacacccugaauuacacuauuuuacuuacauuucugaaaaacacacuggaaauaaaaauacuugagagguuaaaaaggaauuuagugggcugggcgugguaguuccugccuguaaucccagcauuuugggaggcugaaguggguggaucacuugaggccaggaguuugcgaccagccuggccaacauggcgaaaccccaccucugcuaaaaauacaaaaauuagccagguguaguggugcacaccaguaguuccagcuauuugggaggccgaggcaggagaaucacuugaaccugggaggcggagguugcagugagcugagacuacaccacugcacuccagccugggcagcagagcaagacucugucucaaaaaaaaaaaaggauuuugugguugggcaugguggcucaugccuauaauccuagcacuuuggaaggccaaggcaggcggaucacuugaguccaggaguuuaagaucagccugggcaacauggcgaaaucucaucucuacaaaagguacaaaaaaaauuagccaggcauggugguugcgugccuauaaucccagauguucgggagacugagguaggagaaucgcuugagccuggggagacguagguugcagugagcugagaucauaccacuguacuccagccugggugacacaaugaaaaccugucuuaaaaaaaaaaaaaaaagaaaagaaaagaaaaucuuguaauguuaugaauuuuuaugagcuuucauaugcuaauaauuguuuugauuucuucuuugaguaguauaauguuccuuuuucguuguagggaaccuaccugacucuuucagguagugguuuccucagcaaauauguucaaccaaggcauagagaugagauggauagcuuucuuuuccaagaaugggguuagguuuuucuauauucaaaggagaugaauguugauaaguucaggguauuuucuuagcuuuaauuucuaacaaaauuaaacuguccaaauuaaacauacagggaugcuuguuuuuaagagaaaaaaacuuuaguaaaagauuucauuuucccuagcauaaauuauucuauuugggauuaagaaaaaguauguuucccauuucccauauuuguucuuguuguuuguucuugccaauacuuuauuuuaaucaguggauuuccucuccccucugcuucuuucacauucuccaccagucagacacagucuucugcaccauggaugggaccaaauuauggagugcaaccgccucaagggcaaaauggcagcauguugcccaaucagccuucuggguaucgaguggcaggguaugaaacccagugaauaaggacuccagaaucuaaagccaguggcuugaggcuacagggaguguaguaaagccguuguuuacuuaaagauuuaucaaaucagucagugcaaaugucagauacaauguauuuauuuaaaagauucauuuuuaaucaugaaauuacuuaucauccacauuguuuuaaaaagaaacaagaugcuggaugucugccaauuuuugccuucauuaccuuuuuugauaaaguuucucagauccuuguuucaaacacaaaugcagggauugcugccacuuuuuaacuauuaagaggcagaaaauugcacaauauugaacuuuuuuccacugaaguagugugcaguucuaguuugcauuccugauaugauuuaaaacauguaauauaaagauguuaaaaaaaaaaaccaaaacugugcagagucuagaaguuguuugucaucuucagcuugugcacaauucuguuuuagguuaaaaaaaggcauuguuugagcugucccaucuccacuguuaucccuuugggguuuuuuaauauaaauuauuaguuuacaucauuuuuguaucuacaucuuuuuucacaaauuugucuugccuuauuaaaguucuguaaaauauacuuaaauggaaaaaaugauguucauuuagauugaaaacuuuucucagauggauugauaauugcauucaucuuguguuuuauaugagaaggugccucaagaauuuccuguuggauuuguuuaaaaggauuuuuaucuuucgugauaaacuuugcuguguaccaggaacuauaaaaacaaaaacuuguuacuaaagaaaauaucugaaaugugauaaguucuuaugccauguuaauuucaugugucaacuucaacauuuacauguauuauuucauuauguaaaauguuuuagcaauuuaauauuuugcacaguuagcaaacuuuguaugucauuuccuucaaggcaucaugcagaguugacaugagauuuauaagguuuuaaguuguuugcaugugaaaaucaaauacauacuuugguagucuuugaauacaaagucaucugcucuuguuuuucaagaauuuugagacacaaaguuguauguaaaggaauauauuaauuugccguuuucuagguagauuugcucaaaaagagugaaucaacuuaauauguacaaaugauagcugugaaacuguagaauaucuuugugucaggcuuggaguucauugugaccuccaaauuuugccugaaggaccagcugggcaaagcaucuuuuaaauguucagaggccaaaagauaaacaaaaaaaaaaccuuaaaauccuaccucuuuaaacagccuucagauaagagaauccucagugcaaucauuauuuugauucguuugguaccuguuuuccuggaguucccgauuuuauuauuuugggguggcuccaagcauuaagagguuuaaucuuugauggcauuguucuaguuuugaaauuucuaguauauuucagagucucuuagaagacuugugugggaaguuucacuuuguuuucagugaagaucacaaaccuccuucuuccuuuacucaagaggaaaggucccaguauacauauuugaaugguugaugguuuucaagaccuucagggagcucccugcauuuuaccuagaaacagaaaaggcccgcaaaaucuuaaguuuccuggccugcauuucccggguaggggcaaaugacuccaagcuggucucuaagccaauacccuuauaaaccagagcccaggaaagacagcucgaguguauaauucucuggagcucaauucuaugcaguugugcugauauuucauuaagucacuguguauuuuuaaguguugauacauuaaaagucgcuuuauggaagaugaguaaauuuuuuaaauacuuggaaauuuuauuuccuuguuaacuucuacagaucagggcaugcaaccaaaagcagcuuaaaugaaauauuuuaaaauaaaauaucaggaagcuauuuuuagauuucuucuggcuuauguuucuacuuuaggacccucauuguucucuuauuaaaaaaaauuauuuccugugcaucucauggacugcaggguaaauuauuugggcauaaauaauuuaaauaguuuucuuucauuuugacuaucuccaguaauaacaguuuuuauuauccagcauauuggcuuauugcacaaaucuuaaaauguacauugacuacuuucugagaagaaagugguaucaguacucaugaugaaaagguuacuacugaacaaauucacauuucaggaacaccucuaucuuugguuuaaaucuuacucuuaguuuuuccgucuaaaaaucauacugguauuaguaucagguaaggaaauuaaaguuuuuaaaaugguuucauucucugcaauaugcaaaauuuagauuuuacuuucugguacuguaaagaaccugaagugauuuacacuuaaugggugauuaauccaguauucuuuacccugaauguuuggauauuaaaguuccuuuauguuuucuauaaccugugggaucuucuugcagugauuauugugugugagauuuuuuuucuuuuuggucuauccauauuguuauauucacucagguauuuuuuuuuuaaucuuauuccagaaucagugguuuauauuggguuacuguuuaacaccaaauggaauuggcauucugcagauuuaauuaauuaugaaaccagggucucauuuuccuugcugauacuuguugaaaaugagauucacauucuagucuuuauuuuccuccuguuuugucccugugcuuguacaucuuccuuuuauuuguguguuauaguucuauuccauuugagaaggcaguugguaagaacuagauugcauguacaaagacagguuuacuaagugcuguacagugguccugagguuacaguugaauuagaaaaacgaaauguacuuacaggaaauaagaaagcaaaccuuucaaaugagagugaugauuucuuuaaaaaaaaucaguuuuuuucucucaaauaauguucuuuauuucacgaaaucgucaaucuuaagcaugagcagggauaaacaacuccuagaaggaacucaauucauucuuccuggauuuucucuguuguuaaaucacaaaaaugauaguccccaaucguuucuuuauaggagguuauuacauuucauuacagucacugcauuuugacuguuguguuuagaauuugaauguacauccaaaaugaugaguuucaauuuaagagccuuaauaaaaugugugagugugucucaauugaa

SEQ ID NO: 191646 - RNA, 41135 nt, Homo sapiens
aguuuggccccguuuguaaaaggccgcggcaggcgaagagagaagaggugagggcggucgucagcuaagggccccggggcucgcggggggugcgcagggcagguaaggggguagugcugagcaaggaccggggcggcgguggggcagggguguagagcucggguucccagcggaaagcauguccaaggagcggcugccggcgaggugaugcuucugccugggccuacuugggaccggaagugagcgcucgcgcggggaggaugccgggaagcaggucccaggggauaugugugugucgcugcagacccaucccggaagccggccgggaggugagcgucccggagucgggcggccgcuccguugacugcagggccccggcggucuuccuccgcuguuccgaggccguugagggcugaugugcuccauccucccacuugugguuuggcaagccauccagccgacuacaaacccacguuugugaguuaccugcuggcugugacgcuuccgucaaaucugaguaacaguuuccucaucucuaagauggguaacauaguaucuaccucacaggaucgugugggcaguacaugcauagaaaggauuuaacacgcaguguacucagcuaguuuuauuauuuauccguaaugaucauuuguucuuuuccccuaacugugccucacaagcaugaaacagaauccaccaaacauuuaggucuggguagugguuggauggaaacccaucgcggguuaacgcuuccaacaccagucccuugacacucucccgccgaggaggcugauuuguaaacuugcugagaagagaauacccagcagaucuuucagguuucaaauccacguucuuuacaaguuguguuaauuguuuguauaugcuuucgauauagagucucuaggaaguaauacuaguacauguuuuaaaauucaaauacugccaaacagugagauguaagucucccuccuaacuucuguuucccaaaucccaugucguuucuucugaugcaauagacauuguaugugugugugucuagauagauacauauguguaucucucgucuuuuuuuuuuucuuuuaaaagaguaaaaccaagaauagcauauuacaaagugcugcacuuuuuucacuccacaguguaucuuuuuuuuuuuuuaagagacagggucucacuauguugcccaggcuggucuugaacuccugagcucagugauccucccgccucagccucccaaagugcugggauuacaggcgugagccaccacguccagcuacucaggccauuuuuuuuuuuuuuuuuuugagacggagucucgcugucgcccaggcuggagugcaguggcacgaucucggcucacugcaggcuccaccccccaggguucacgccauucuccugccucagccucccuaguagcugggacuacaggcgcccgccaccucgcccagcuaauuuuuuguauuuuuaguagagacaggguuucacuguguuagccaggauggucucgaucuccugaccuugugaucugcccgccucggccucccaaagugcugggauuacaggcgugagccaccgcgcccggcccauuuuuuuuuuuuuuuuuuuuuuuuuuugagauggaguuucucucuuguuccccaggcuggagugcaauggcacgaucuuggcucaccgcaaccucuggcucccggguucaagcgauccuccugccucagccuccggaguagcugggauuacaggcauacgucaccacgcccggcuaauuuuguauuuuuaguagagauaggguuucuccauguuguucaggcuggucaggaacucccgaccucaggugauccgccugccucgccucccaaagugcugggauuacaggugugagccaccgugcccggccaugccauuuuuuuuuaaacagcuguaaaaauauuuuauuuucugggaaguauuccauuuuguaggcauaccauaauuaauuacaccaguaucuucuugagggacaucagguuguuucuuauauuuugcugcuacaaauauucuucauugaguugccuuauaauuucccucauuucacacaugugggagucagucuguaaaauaaauucuuaguaguguaauugcugggucagaauaucaaaucaaaauauacugauuccaaauaugcaaggaagauaucaaacaagcucaaauugagggacauuuuguaaaauauucgacucuucaaaacugucaagauuaggaaaaagaaagacaaacucacggacuugaggggacuaaggagacgugaugacucaaugcaaugugguaucuuggauuugauccagaaacagaaaaaaggggcaaagucuagaguucaguuaauaauaauguggcaauguuggucccuugguuuugacaaaugucccauguuuauauaugauguuaacauugggaaacugggugagugguguuugggaacuguguucuaucugccacuuuucugaaaaucuaaaauuagucuaaaagauuuauucuuuuuuaaaagggagauugaggccaggcauagcggcucacgccuguaaucccaguacuuugggaggccgagacaggcagaucacuugaggucaggaguucgagaccagccuggccaacauggagaaaccccgucucaacuaaaaauacagaaaaauuagccgggcuuggugguggacgccuguaaucccagcuacucaggaggcugaggcaggagaauugcuugaacccgggaggcagagguugcagugagccaagaucacgccacugcacuccagccugggugacagagcaagacuccgucucaaaaaaauaaauaaaauaaaaaggggcauuaguggacaacugguaaaaucugaauaaagccuguaguagaguuaauaguguuguaccaauguuaagaccuuauuuuugacaaaugccccauaguuaugugagauguuaacauuuggggagucugugugaaagguagguaggaagucucuguacugucuuuagcuuuccuauaaaagccaaaaugcagucggguaugguggcuuaugccuguaaucccagagcuuugggaggccgagguggguggaucaucugaggucaggaguucgagaccagccuggccaacauggugaaaccccgucucuacuaaaaauacaaaaauuagcugggcgugguggcaugugccuguagucucaguuaaucgggaggcugaggcaggagaauugcuugaacccgggaggcggagguugcagugaggugagaucacgccacugcacuccagccugggugacaaagugagacuccgucucaauuuaaaaaaaacuaaaauguaauaaauguguugaaauaaauuuucuaaaauuauugcaaaauugaaagcauuuuuaauaaagaaauauggauuuauaauguuaaagauacucacaaaucgccugcuggagggcauaaucaaaaaguaaaagaaaagacugggcacaguggcucaugccuguaaucccagcacuugagaggccgaggcaggcagaucacuugaggucgggaauuugagaccagccuggccaacauggugaaacccugucucuacuaaaaauacaaaaaaguuagcugggcgugguagcagguaccuguaauccccgcuacucaggaggcugaggcaggagaaucacuugaacccgggaggcggagguugcagugagcugagauugcgucauugcacuccagccugggcaacaagagcgaaacuccguugucaacaacaacaacaaaaguaaaagaaaagauaaaagaguggaacuccauuguugaugcuacagcuauuccuaugcuaaagcuacagcaccaacagcuggcaaaccaccuccucccuuaaugacagaaagguuuuuuuuuuguuuuguuuuguuuuuuaauuauuauuauacuuuaaguuuuaggguacaugugcacaaugugcagguuaguuacauauguauacaugugccaugcuggugugcugcacccacuaacucgucaucuagccuuagguauaucuccuaaugcuaucccucccuccuccccccaccccacaacuguccccagagugugauguuccccuuccuguguccauguguucucauuguucaauucccaucuaugagugagaacaugcgguguuugguuuuuuguccuugcgauaguuuacugagaaugaugauuuccaguuucauccaugucccuacaaaggacaugaacucaucauuuuuuauggcugcauaguauuccaugguguauaugugccacauuuucuuaauccagucuaucauuguuggauauuuggguugguuccaagucuuugcuauugugaauagugccgcaauaaacauacgugugcaugugucuuuauaguagcaugauuuauaguccuuuggguauauacccaguaaugggauggucaaaugguauuucuaguucuagaucccugaggaaucgccacacugacuuccacaaugguugaacuaguuuauagucccaccaacaguguaaaagucuuccuauuucuccacauccucuccagcacauguuguuuccugacuuuuuaaugauaugacagaaagguuuuuuuccacuuugauauguuaaaucaucauuagcaacauaauuuuuaaauuaauuuuuucuaagcucuuucauauauacaaauuguauauauguguguguguguguguauauauacauauacguauauauaugucguaucguagcuuugcagaugaaaaaauccugaagcucagaaguuaaaggacuuggucacagagaucguucaugguaaaaagcaaacugauccuucauguuuugacuuuggaacaauauucuaagaauccaugugggacugaaugagaauaccuacuaaagaaguucauugagcuaggaaggaaugcugugugaacaggcuaaugacucuacaucaguggcuuuuaacuggggcaguuuugccuccagaggacauuuggcauuaucuggagacuuuuuuuuuuuuuuuuuuuuuacaauuagggauggggccugcuaccgggaucuaguggguagaaaccagggauacuguuaaacauucugcaaugcauaggauagcccccacaacaaagaauuauccaguccuaaaugucagcagugccaagguggagaaacccugcuaugcaucuuauuucacaaagcacuuguuuuccuuaaaauauauauauauauguguguguguauauauauauauguguguauauauguauguguguguguguuuguguguguguguauauauauauauuuuuuuuugugacaaagucucacucuguuucccaggcugaagugcaguggugcgaucuuggcucacugcaaccucucugccuccuguguucaagcaauucucaugccucagccuccugaguagcugggguuauagacaugugccaucaugccugccuaauuuuuguauuuuuaguagacacagguuuucaucauguuggcuaggcuggucucgaacuccuggccucaagugacccucccaccucagccucccaaagugcuggcaauuacaggugugagccacugugccuagucuuuuuaaaacuuuuuuuuugacacggaauuucacucuugucacccaugcuggagugcaauggcgugaucucagcucacugcaaccucugccucccagguucaagugauuccccugccucagccuccggaguagcugggauuacagacgugcaccaccacgcccagauaauuuuuuuuguuuguauuauuaguagagacaggguuuuaccauguuggccaggcuagucuugaacuccugcccucagguguuccacccgccucggccucccaaaguggugggauuacaggcacgagccacugcgcccagccuaaaacauuuuuuuauuuuuauuuuuuuugagauggagucucacucugucgcccaggcuggagugcaguggcaugaucucgguucacugcaagcucugucucccggguucacgccauucuccugccucagccucccaaguagcugggacuacaggugcccgccaccacgcccggcuaauuuuuuguauuuuuaguagagacaggguuucacuguguuagccaggauggucuugaucuccugaccuugugauccacccaccucggccucccaaagugcugggauuacaggcaugagccacugcgcccggccuaaaacauuuuuuaagaagaauagagaccacugggcaugguggcucacaccuguaaucccagaacuuugggaggccgaggcaggaggauugcuugagcccaggaguucaaagccagccugggcaacauagugagacccccaucucuauaaaaaauuuauaauuagcugaguguaguggcacguaccuguggucucagcuauuugagagucugaggcaggaggauugcuugaccuugggaggucaaggcugcagugagccaugaucugcacuccaucuuugacaacagagugagacucugucucaaaaaaaaaaaaaaaaaaaaaaaaaauagggccaggcacagugguucaugucuguaaucccagcacuuugggaggccaaggcgggcagaucacuggaggucaggaguucaaaaccagccuggccaacauggugaaaccacaucucuacuaaaaauacaaaaauuagccagagaauugcuugagcccgggaggcggagguugcagugaaucgagaucacgucacugcacuccauccugggugacagagcaagacugucucaaaacaauuuuuuuuucucucuacaucuucuauccacugauuaacaaauuggaaaguacaaauaagaauaguuuuaaaauguccaccuuuucauuggugcuaugaacuaguccccgacuguaauuuuuacugaguaaaugaagcuguguggcucacacuuauaaucccagcacuuuaagaggacaaggcaggaggagcgcuugaggccaggaguucgagaccagccugagcaacaaagugagaccccugucucuaccaaaaaauuuuuuaaaaauuagccaggcauggcagcauguaccuauaguuucagcuacuugggaggcugaggcaggaagaucacuugagcccaggagguugagucugcaguaagcugugaucacaccacugcacuccagccuggguaagagagcagaaaaaugcauaaagcacucaaaaugugauguauuacuauuaggaaggaugaguuauugaccaauuauauaacauagcucuagguguguucuuuuuuuuuuuuuuuaaagagauggggucggccgggcgcauuggcucacgccuguaaucccagcacuuugggagucugaggugggcagaucacgaggucaggagaucgaaacacagugaaaccccgucucuacuaaaaauacaaaaaauuagccgggcaugguggcaugugcccguagucccagcuacuaaggaggcugaggcaggagaaucgcuugaaucugggaaguggagguugcagugagccgagauugcgccacugcacuccagccugggugagcagagugagacuccaucucaaagaagaaaaaaaaaaagagaugggguccugcucugucgccaaggcugggguauaauggcacaauuugcagccuugcucuccuggacucaggugauccucccaccucugccuccaacguagcugggacuacaggugcacaccaccaugcccagcuaauuuuuaaauuuuuuuauagaaaugaggucucacuauguuguccaggcuggucuugaacuccugggcucaagugauccuccaccucagcuuccuaaaucucugggauuacaggagugagccaccaugccagaccucuaaaguguucuugacaacccccuuuguaaugacauuagcaccuuuuuaccuuccuuacaguuggaaguacaaaacacuuaacccauuuccauaaucauuucugucaaauauuucucaaguaauugugaaagacuuugauuccuauucuguuugauuucuaacgaaagaaucauccugucuuuguauaacuuuaauauuuuuucuuguuuuacucgcagacuaucaagaucuccacuuagggaagugggaaucuuauuugcggaacauugggcagaagcuuugccauuggcugguggagaaggaggaggcagaaugucugcauuguuacaccauacagcucaaacuucagaagauuuuggguuaagcaguuaucauuagucugcaaaugaucguguuuucaccugaucauuagaaacuaaugaaacaccuuuuaagucuuaugaauucagguuacacuguuuuccagaugccuuggcagcugguacagguaggauugggcuagguuuuguggggaaugauggaagggaaaaaaacucaucuuucauguucucuaauucuugcugaaguuagacaucugggcauguaaagauuagguuaacuaacuuccguuguuauauagaacagaguuaaaucuggagaaaugcuuugauuauuaggauuuaaaaaaauagguaugaaaggcaguuuccacuuucauuuuguuuguagguuuaaauuuauguuguuuugugguacaguuuaaaaauaguggauagcagccaggcgccguggcucacaccuguaaucccagcacuuugggaagcugaggcaggcggaucacaaggucaggaguucgaggccagccuggccaacauggucaaaccccaucucuacuaaaaauacaaaaauuagcugggcgugguggcgggugccuauagucccagcuauucgggaggcugaggcaggagaaucacuugaacccaggaggcggagguugcagugagccgagaucgcgccgcugcacuccagccugggcgacagagcgagacuccgucuaaaaaaaaaaaauaguagauagcuuuuuuauauuuugccuucuguacuaaauaucauaagugauuuuaacuuuuugugugugaagguauacucauacuguuggauguauugucuuuuguagggccucugaaaaauggaaccaaauucucugaggacuaaagucccagcuuucuuaucugauuuggggaaggccacauugaggggaaucagaaaguguccccgauguggcacauacaauggaacccggggacugagcuguaagaacaagacauguggaaccauauuccgcuacggugcacgcaagcagccuaguguugaagcugucaaaaucauuacaggcucugaucuucaggucuacucagugcggcaaagagaccggggcccugauuaccgaugcuuuguggagcucgggguuucagagacaacaauccagacaguggaugggacgaucaucacucagcugagcucuggacgguguuauguccccucaugccugaaagcugccacucaaggcguuguggaaaaccagugccagcacaucaagcuggcggugaacugccaggcagaggccaccccucugacccugaagagcucgguccugaaugcaaugcaggccuccccggaaaccaaacagaccaucuggcaguuggccacggaacccacagguccucuggugcagagaauuacuaaaaacaucuugguggugaaaugcaaggcaagccagaagcacaguuugggguauuugcauacaucuuuugugcagaaagucaguggcaaaagcuugccugagcgccgcuucuucugcuccugucagacucugaaaucgcacaagucaaaugccuccaaggaugagacagcccagagaugcauucauuucuuugcuugcaucugugccuuugccagugaugagacacuggcucaggaauucucagacuuccuaaauuuugauuccagcgguaggugguaugguugaugugguuauuacguuuuucuaaaacugcaaugaaaagaguuccacugaugcauuuggagauugucuuagcaaccuucagaaacaguugcuagauaauucaaaugaaaaguguuccuucuuuuuuuuuuuuuuuuuuuuuuuuuuugagacaaggucucacuuuguugcccaggcuagagugcaguggccugaucacagcucacagcagccuugaccucccaggcucgagauccuaccaccucaguccccgcagauagcuaggaccacaggcacgugccaccaugccuggcuaauuuuuuuaauuuuuugcagauaggggucuuacuuuguugccgaggcuggucuugaacuccugggcugaagcaguccuccugccucaaccucccaaagugcugagaucacaggugugagccgccacaccugguugcauuccuucuuucagucucagucagcacacuugcauaaagguugguugguugguugaaauuaaugaucaagagacagaaucucuugauuuuuuuuuuuuuuuuuuuuuuuugagacagaaucuugcuccaucacaaacgcuggagugcaguagcacaaccuuggcucaccgcaaccccugccuccuggguucaaggaauccucaugccucagucucccaaguagccgggauuacaggcgccugccaccaugccugaccaauuuuuguauuuuuaguagagacaggguuucuccauguuggccaggcuggucucaaacuccuggccucaggugaucugccugccucagccucccaaaguacugggauuacaggcaugagccacugcacccagucuaaaggaacuuauuuauuuauuuauauauuuauugagauggagucucacucugucacccaggcuggaaugcaauggcgcaaucucagcucacugcaaucuccaccuccuggguucaagcgcuucuccugccucagccuccugaguagcugggacuacaggcaugugccaccaugccuggcuaauuucuguauuuuuaguagagaugagguuucaccauguuggccaggcuggucucaaacuccugaccucaggugauccacccgccucggccucccagagugcugggauuacagacgugagccaccgcacccggcccaaggaacuuauuuuaaaacaagcaaucacuccauaauuuuuuuuuuguuuuuguuuuugguuuguuuuuugagacagcgucugccucugucgcccaggcuggcaugcagugacauaaucacggcucauuacagccuugacccuccugggcuaaagugauccucccacuucagccucucgaguagcugggaacacaggcgugguaauuuuuuauuuuuuguagaguuggggucugccuauguugcccagccugggauaauucguuugggggauuuuuaaaaagaaauuaacuuuucgcuacauagaggccuauacuuauacuuacccuuggauaggauuaauaauucagaaaucuucuuuuuuuuaggucuuaaagagauuauuguaccccaguuagguugccauucagaaucaacaguaucugcuugugagucuacugccucuaagucaaagaagaggagaaaggaugaaguaucugguaagagucugguugguugguuuggugguauugucuuuagagauuguuuuacugcguuuuaugucuuugacugaaccucagcaauuauaagaaaauacuauauuuuauuuuauuuuuauuaaaauaaagagacaggggucuuaccaucuugcccaggcuggccucgaacuccaggccuuaagugauucucccaucuuggccucccagagugcuggaauuauaggugugagcuaucacaccuggccaagaaauauuauguuuuuguucuuauggguuuuuuuccugagaaaaguuuuacucuccauugaugauucuuuuucaaguuaagcuaaaaguuugaucccuuagccaaaaauaagauccaaccaaauucuacuuuuacuguauauguuuguacaucccuuaaacagauuaauuuuauaccuuaaucugccuuaggauaguauuaugaaguuuucauccauagaguguuuaaaaaaauuuugugacaaugguuauauuccccacacuaauuuagaaauauagguuauugucuucauuuucaguauauggagaaacacacacauacacacacccacacacacauuuuuuucuuuuuuuuuuuuuugagauggagucuugcucugucgcccaggcuggagugcaguggugcgaucucagcucacugcaaccucugccucccggguucaagcaauucucauaucagccuccugaguagcugggacuaagggugcacgcccaguuaauuuuuauauuuuuaguagagaugggguuucaccauauuggucagacuggucuugaacuccugaccucaggugauccacccgcuuuggcuucccauagugcugggauuacaggccugagccuguaauaaguaaggcgugagccgcugcacccagccuuauuuauuuauuuauuuauuuagagauggagucucgcucuguugcccaggcuggaguacacugaugcgaucuucggcucacugcaaccuccacugcccagguucaagcaauucuucugccucagccucuugaguagcugggauuacaggcacccaccaccaugccugccuaauuuuuguauuuuuaguagagacgggguuucgccauguuggccaggcuggucuugaacuccugaccucaggugauccacccgccuuggccucccaaagugcugggauuacaggugugagccacuaugccuggccaggccacauuuuuaaauucaaaugcuuaauacuagugucaguuaaggacucugauaaaucaauaugaaaauggugaaguauccuaguagguaagcaucaagagaccuagagucuaaacaaaaugaaaauauuacuugguccacacccauggaccaaacuccaaacuuacuaguagacagagaaaugcaaacauuuuagaaaugcaaaauuaaaacaggauaccuuuugcuaccaaauuagcaaaguuuguguguuuuuuuguuuguuuguuuguuuguuuuuuaagagaugaguucucacucuguugcccaagcuggagugcaggggcacaaucauggcucacugcagccuggaccuccuaggcucaagagauccuccugccucagccucccaaguagcugggacuacaggcacaagccaccaugccuggcuaauuuuuugguuuguuuuuuguagagacaggguuucacuguguugaccaggcuggucucaaacuccugaccucaagugauccuccugucucagccucccaaauuguuggaauuacagguguaagccaccaugcccagcuggcaaaguuuuuuaaaaugaugagaccacaggcaaagguaaaauccaggcucucuggcauggcuaguguaguauacauugcuauaaucauugguauauagcuuguaguaucuguuaagauccuuaaaaugguccuaccuauaggaaauauugcuagggauggaucagguggucaugcacaagaguuuuggugcugggaaguugaagaaagauggagaaacaaagugacauggucauuuguguauuuuagagaggcaauucuggcaggaauauagagcagaaauuguuguuaaauguuuacuuauuagucuuuccccuuuuuuuggaaauggagucuugcucuggauugugcaguggcgugaucuuggcucacugcaaccuccaccuccuggguucaagcaauucugcugccuuagccucccgaguagcugggauuacaggcuccugccaccacgcuuggcuauuuuuuuuuuuucuuuuuugagguggaguucggcucuuguuucccaggcugcagugugauggcgcgaucucagcucacugcagccuccaucucucggguucaagugauucuccugccucggucuccuaaguagcugugauuacaggugcucgccaccacacccagcuaauuuuuguauuuuuaguagagaugagguuucaccauguuggccagacuggucucaaacuccugacuucaggugauccacccgucucggccucccaaaguggugggauuacaggugugagccaccaugcccggccccacuucugaauaaucuuuucuaaggaaauaauuauugguauaggaaaaacauuuugucuggagauguugauuuuaugauuauuuagaaaauuaaaaaauuagaaacaacuaaggguuaaccacuggggauaguuaaaugaaccaugguaaagccacuuuaccauagaauaucaggcaggcauaaaaaugauuauagucugggugcaguggugcaugccuguagucccagcuacucaggaagcugaggcaggagggucccuugagcccgggagcucaaggcucuagcacacugugauuggaccugugaauagccacugcauuccagccugggcaauauagcaagaccucaucucuaaaaaauaaaaauuaaaaacaagugauaauaaagaauuugggaaaaugcucagaucacuuggguagccagauaaaguauagaauacucaguuaaacuugaauuucaguuaacaaauaauuuuuuuuuuuuuuugagacagucucgcucugucgcccaggcuggagugcaguggcgcagucucggcucacugcaagcuccgccuccuggguucaggcgauucuccugccucagccuccugaguagcugggacuacaggcaccugccaccgcgcccggcuaauuuuuuauauuuuuaguggaguugggguuucaccauguuagccaggauggucucaagcuccugacuucaugaucagcccaccugggccucccaaagugcugggauuacagaacgaauaauuuuuaguauaaguauuuccaugcaauauuugugacauacuuugauacuaagacauuauuuguuguuuaucugaaauuuaaaagaacauuuucuuuuugcuaaauuuggcaacucugguaaaaucacaacuacuuaaaaaucacaaaaccaauaacauauucacagagaagaaaacggaagacaguucacuagaaaagucaucguaauugucugacaggugggagcaauaagugaauuuuuuucuuccuuucauuucuguuuauucacccaauuuccuauaaagagcauaagaaagcuaaaauuuuauguguaaagacuaaugcuaacuccuagaaacugugaagcuaaccuagaaauuagcaaagacuguuuauauguuuuagacucuaaaaauuaacaucaaaucaauuuauauuuagcagauacauuguuaaaccuguaaugauuugugguuuaggugcacagaugaacaguucacuacugccucaagaugcagugagcaguaaucuaaggaaaaguggccugaaaaagccugugguugcuuccucguuaaaaaggcaggguaaguuucccuucccuagaauaggcuacagugguggaaagucauccuaaagaagccagaagcaguauaaucaugcacauugucacccaaagagucccagcauaaauacuaacagaagcacugaggcugaggucccuccugucccaccaguuucaaaucaugcucaaagcuaaauuaugcuggaggccauuauccuuagcaaacuaaugcaggaacagaaaaccaaauacaguauguucuuacuuauaagugggagcuaaaugaugagaacacauggacacauagaggggagcaacacacacuggggcuuauuggagggugaaacgugggaggagggaggaaagguggaagggggugagaggaucaggaaaaauaacuaauggauacuaggcuuaauaaccugggugaugaggcugggugugauggcacaugccuguaaucccagcacuuugggaggccaagccagguggauuacuugaggccagcaguucgaggccagccuggccaacguggcaaaacccugucucuaccuaaacaaacaaacaaacaaaacauauguguaauuaaauuuuaaaaauaccugggugaugaaauaaucuuuuuuaauuuaaaaaaauaauuuuuaaaaaaaacuaaauuaugucuaaaaccauaaagauagagaacagauuaguaguugccaggauuuaaagaggggguuggggcugagcacggugcucacgccuguaaucccagcacuuugggagacugaggcaggcagaucaccugaggucaggaguuugagaccagucuggccaacauggugaaacccugucucuacuaaaaauagaaaaaauuagccagaugugguggcagacgucuguaaucccagcuacucaagaggcugaggcaggagaaucacuugaacccgggaggcagagguugcagugagccaagaucgcaccauuuuccuccauccugggcaauaagagcaagacuuagucucaaaaaaaaaagaaagaggggguugggaggguuguaacagcagcaauaaaagaguagcacagggagucuuugugauggacuguuuuaugucuugacugugguguuggucacacaagucuacacaugcccuaaaauugcauggaacuauaugcaugcauaccacacacaaguacauaaagcuggugagaugugaauaaggucacuagauuguaaccaugucauuuuccugacugugauguacuauaguuuuacaaaauguuacucuugggugaauccggaugaaggguauagaagccuuauauuucuuacaacugcgugugaauguacaauuaccuuaaaaaguaauuuauuguauuuauuuuuauuuauuuauuuauuuauuggagauggagucucacucuguugcccaggcuggaguacaaugacaugaucuuggucacugcaaccuccgccucuggguucaagcgauucuccuguuuuagccucccaaguagcuggaauuacaggugcacgccaccaugcccggcuaauuuuuguauuuuuaguagagaugggguuucaccauguuguccaggcuggucucaaacuccugaccccaagugaucugcucaccucagccucacaaaguacugagauuacaggugugagccaccacgacuggccuaaauuaugucuuuaaacaaaaaaauucugacauguuuagcagcaggugucuugcaggauguguucaucuuauugcuuauuacucaugugcaauugguauagagauucaaaguugaaggaaaaaggcguuuuaugugacugggugugguggcucacgccuauaaucccagcacuuugggaggccgagguaggaguagugagacuccaucucuaccaaaaaaaacacaaaaaacaaaaaaaaauuagcuggguguugugucacaugccuguaaacucagcuacuuaggaggcugaggugagaagauugcuugacccugggaugucgaggcugcagugagucaugauugcaccacugcacggguaacaggaugaaaucuugucuaaaauaaagaaaaaaaagaauaauauaaaacaauacuaauuaaguaauucauuaagaacuuaugaccaagcacgguggcucacgccugugaucccagcacucugggaagcugaggcaggcggauggaucacuugaggucaggaguuugagaccagccuggccaacaugguaaaacccugucucuacuaaaaaguauaaaaaauguagccaaguaugguggcaugugccuguaaucccagcuacuugggaggcugaggcaggagaaucgcuuaaaccuggaaggugaagguugcagugagccaagaucaugcuacuagacuccagccugggcaacagagugagacuccgucucaaaaaaaaaaaaaaaaaaaaaaaagaacuuacgcacuuaggcauucuaggcauaaguguuuaaggaaagucacaaaguaagcagaucaacagcaucaaauagguuuuuuuauuauuuauauacauauauuuuuucaagacagagucuugcuuugucacccaggcuggagugcaauggcgugaucucagcucacugcaaccuucgccucccagguucaucucgugccucagccucccaaguagcugggaucacaagcauuugccacuauacccuucuaauuuuuguauuuuugguagagaugggguuuugcuauguuggccaggcugcucucgaacuccuggccuuaagugauccgccugccuuggccucccaaagugcugggauuauagcaauuagccacugugcuuggcugauuuuuaauaauuuuuugucacuuccuuuggugcaaagaaaaaggaagguagcuucaaucuaaauugucacuguaugccuuuaccucugauaaucuuaguuuuaaaugaauagucauugaggcauuaucucuacaaaaggugauacuguacuucagacacgugaagauauuuuguuguuggcgguauuuuuuuguuguguuuuucuuugacacaggucuugcucugucacucaggcuggagcgcaguggcggggauacagcucgcugcagccuucugggcucaaauuauccucccaccuuagccucccaaguagcugggacuacaggcacaugccaccacacuugauuauuuauuuguauuuuuaguagagacggaguuucgucauguugcccaaucuggucucaaacuccugggcucaagagauccacccgccucggccucccaaagugcuaggauuacaggcaugagccaccgugcccggaauaaagauauuuuaagaaaagaaauagaaugauagaucuguggaaggcucuugaauuuggagauauccagaugcauaucuucaucuuagaagagaggaacuugagauauggacccucgucacucaguggguggggauccuaggucccauagccuuuuuuuuuuuuuuuuuuuugagacagagucucacucugucgccuaggcuggaguacaguggcacaaucucagcucacugcaaccuccgccuccugggcucaagcgauucuccugccucagccucccgaguagcugagauuacaggcgcacaccacuacgccuggcuaauuuuuuguauuuuuaguagagacaggguuucaccauguuggccaggcuggucucgaauuccugaccucaggugauccacccgccuuggccucccaaagugcugggauuacaggcgugagccacugcacccagcuucccauagccuuuugacuccgaccucuaaacucuggcuccauuaaauuccaucacucguuacuguuuuuuccaguuauuuacuccagggcugcaagauuucacucuuucacuuauauuuaagagugaauuuggcugggugcaguggcucaugccuguaaugccagcacuuugggaggccgaggugguuggaucacgaggugaggaguucaagaccagccugaccaagaugucaaaaccccaucuguacuaaaaauacaaaaauuagccaggcacgguagcaggugccuguaaaucccagcuacucaggaggcugaagcaggagaaucgccugaacccgggaggcagggguugcagugagcugagaucaugccacugcacucuagccugggcaacagagcaagacucggucucaaaaaaaagugaauucauucauuuuacauuucugaauacaagguuuuagguuuuaagucuaaagguauuaucauugcaacccacagugcgugcaucacucagucaucuauuuguggucaaccuuggcaugaaagaauauguucauuauugagagggucuggggcauauggauacauguucaucaggaauaaaacuaauuuauaaaccucuaaaacagccauuauuuuuauuuauuuacuuauuuauuuuuacuugagauggggucucacucuacacccagccuggagugcagaggcaugaucucggcucacugcagccucugccuccugggcucaaacaauccucucaccucagccuccugaguaguugggaccacagucacgcaccaccaugccagguuaauuuuuuuuuuuugagauggagucucgcucugucacccaggcuggagugcaguggcacaaucucggcucacugcaagcuccgccucccggguucaugccauucuccugccucagccucccgaguagcugggacuacaggugccugccaccucgccuggcuaauuuuuuguauuuuuaguagagacgggguuucacuguauuagccaggauggucucgaucuccugaccucaugauccacccgccucggccucccaaagugcugggauuacaggcgugagccaccaagcccagccuaaaacagucauuauauaggaccauucuuuuauaugcaguuuaguguugcuucucauuucguauuuucuuuuucuuuuuuuuuuuuuagagucucacucuugcccaggcuggagugcuguggcacgaucucaguucacugcaaccuccgccucccggguucaagcaauucucccaccucagccuccagaguagcugugauuaaggugcaugccaccacgcccagcuaauuuuuguauuuuuaguagagacggggguuucaccauguuggccagccuggucuugaauuccugaccucagguggcucacgccuguaauccagcacuuugggaggccaaggcgugcagaucauuugaggccaggaguuugagaccagccugggaaacacggcaaaaacccugucucuauuaaaaagaaaacaaaauuggcugggcauggugacgcaccuguagucccagcuacucaggaggcugaggcaugagaaucgcuuaaaccugggagguggagguugcagugagcugagaucaugccacuucaccccaaccagggcgacagagugagacugaagaaaaaaaaaaaaaucccagaauaucuuauuucacuuaguuuauuugcuuucuuugaaguucagcuucaaguuuuuuuuuuuuuuuucuggacaaacuuauuaacacuucucccaggacuucagaaggcugaggcagguggauugcuugagccuaggaguucgaagccagcugggcaacaugacaaagccuugucaauaaauaaaaaacaggccgggcgcgguggcucacgccuguaaucccuacacuuugggaggccgaggcagguggaucaccugaggucaggaguuggagaccagccuggccaacaugaugaaaccccaucucuacuaaaaauacaacaauuagccgggugugguggcgggugccuguaaucccagcuacucaggaggcugaggcaggagaaucgcuugaacgcaggaggcagagauugcagugagcugagauugugcacugcacuccagccugggcaacaagggcgaaccucugucucaaaaaaauaaaauaaaaauaaaaaaacuuguuaacuuuuucaaacuucaauuagcuguuuauuuuguaagaaaaguuacuaaagaaguguguaugugugguuuuuuuuucccuagccuguggucagcuguuagaugaggcacaagugacuuuauccuuccaagacuggcuggccagugucacagaacgcauccaucaaaccaugcacuaucaguuugaugguaaguauuguucaucuaacugggcucuugcugaaaguaggagaaauuaagguaauugugcuguaauucuccucugauaggaaaaguaauuggacuucaguccagagagcacugggccacaagaaaguagaaaucuaauugaaagaaaaaaacaaucacauaguuaaaauucaggcgcagcaaaauuauuauaauuuagagacagaagagaaaaaacauagcaaauaauaaguaaaggcagguagucuuauugcuugcauaaguucgugugcacguguguguguguguguguguguguguguguguguggugagggagauacugaagcuuuaugagacuauucuaacucucaaacuuaaagcaaggggaaaaaagauuagagaaaaucuaagccugcacaacauagugaaccccaucucuacaaaaaauagugccauugcacuccagccugggaaacgaagcgagacccuguauggaaaaaagaaaaauugaaaaucuaaacacaugagacuaagauaguuauauagaauuacuaaacauacuggccgggcauggugacucucaccuguaauccgacacuuugggaggccgaggugggcggaucacuugaggucaggaguucaagacaagccuggccaacauggcgaaacccuaucucuacuaaaaauacaaaacaauuagccaggcauuauagugggugccuguagucccaaauaccugggaggcugaggugggagaauugcuugaacccgggaggcggagguugcagugagccaagaucgcaccauugcacuccagccugggcaacagugagacuccaucuaaaaaaaaaaaaagggacauaaacaugcugaggaagauuggagaacacaggcuggauuuggguguuauuuguuauagucucauggaacgucaccaguuucagaucuagccagucucugcuuguugccuuaaaaguauccuauuagcagccgggugcgguggcucaugccuguaaucccagcacuuugggaggcugaggcgggcggaucacgaggucagaagauugagaccauccuggcuaacacagugaaaccccaucucuacuaaaaauacaaaaaaauuagccaggugugguggcgggugccuguagucccagcuacucgggaggcugaggcaggagaauggcgugaacccaggagguggagcuuacagugaucugagauugcaccacugcacuccagccugggugacuaagugagacuccaucucaaaaaaaaaaaaaaaggauccuauagcugggcaugguggcagaggccuguagucccaacuacucaggaggcugagguaggugaaucacuugucgcccaggcuggagugcaguggcgugaucuuggcucacuguaaucuccaccucccagguucaagcaauucuccugccucagccucccaaguagcugggauuacaggcacgcaccaccaugccuggccaauuuuuuguauuuuuaguagagaugggguuucaccauguuaaccaggcuggucuugaacuccugaccucaggugauccaccuaccucggccucccaaagugcugggauuacaggcgugaaccaccgugcccagcccagaaaacagaauauugauaauacuauaagcuaaacacuuguaguccucuuccaucccauccuauucccucuuccaucccauuccuguaccacccucuauuccaucuuaccaucuccauuacuaccaccuuuguccagguuuccaucagcucgcuccuugacuaugaguguguguguuuuaccuuuuugaaguuaauucuuuuuuauuuuuugagacagucuugcucugucacacaggcuggagugcagugguacaaucucaguucacugcaaccuccaccucccaggcucaagaaauucucguguuucagccuccugaguagcugggauuauaggcaugugucaccacuccuggcuaauuuuuguauuuuuaauagagacaggguuucaccauguuggccaggcuggucucgaacuucugaccucaagugauccgccugccuaggccucccaaaguguuggaauuacaggugugagccaccacaccuggucuggacagaauuuuuaagaaagacugaacucacuugacccccuccccuuaacucuuuuuguugaccuaaugucugacaaguuucuuuucuuuuuuuuuuuuugagacagagucucacucugucgcccaggcuggagugcaguggcgugaucuuggcucacugcaaccuccgccucccagguucaggcgauucuccugccucagccucccaaguagcugggacuacaggcgcaugccaccaugcccggcuaauuuuuuguauuuuuaguagagauggaguuucaccauguuagccaggauggucucaauuuccugaccuggugauccaccugccucauccucccaaagggcugggauuacaggugugagccacugugccuggccgcaagguucuuuaagagguugguuaaguacuuucaaguauuuuaccugccuugaggucauauucagagagaaagacagaugcuugcuggguaagcaguguccuaacuuguagucccucagcauucauggugcugaccaucgggugagagagcaugucauuaguuugcuuagacaugaaugcaaauagcaagaaccuggggauagcgagcaaaagggaaucaaguggaggcagccaccucggccucauuguucucaucccaucuuacuucgcauacccuuuaagggggaaagucugugcuguguuggucuuuuuaaaauuugcggauuugaaauguuauacuugguggaugacaagggucuacuguguugguuuguuuuuucauugucuuuuuucuuuuuuuucaguggagucucacccuguugcccaagcuagagugcaguggcaugaucucggcucacugcaaccucugccuccuggguucaagcgauucuccugccucagcuuccugaguagcuggaauuacaggcacacaccaccaugcccagcuaauuuuuuuuuuuuuuuuuuuuuuuaguagagauggguuuucaccauguuggccaagcuggucucgaacuccugaccucagguaauccacccaccucggccucccaaagugcugggauuacaggugugagucaccacgccuggccucucuuuucuuuucuuuuuuuuuccuuuuugagggagggucucacucuguugcccaggcuggagugcaguggcgugaucauggcuuacugcagccucaaccuccucgacucaguugauccucccaccucagccucccaaguagcugggacagcaggugcauaccaccacgccuggcuaauuuaaaaaaaaauuuuggccaggcacgguggcucacgccuguaaucccagcacuuuggguggccgagguggguggaucacgaggucaggaguuugagaccagccuggccaacauggugaaaccccaucucuacuaaaaauacaaaaauuagccaggcgugguggugcacgccuguagucacagcuacucaggaggcugaggcaggaggauugcuugaacccgggaggcagagguugcagugagccgagaucaugccauugcacuccagccugggcaacagagugagacuccaucucaaaaaaaaaauuuuuuuuuauagacacugggucuuucuuuguugcccaggcuacacuguguuuuuuauguuugcaagggaucaacaguaggacuagugacaguucuuggcccagaaaggucaaucaaagccuucuuuuugccucuguauaaagaaaucucagugguauuuuuaguuauuaccgucccuugauuccuuuucuuucaccucucccuguacaucagaaaguccacugaguuucuuuaaaugaguuguuucuucuuguuucccauaggcaaaccagaaccauugguguuccacauuccucagucauuuuuugaugcccugcaacaaagaauaucuauaggaagugcaaaaaaacggcuccccaacuccaccacagguacaggauuucccuuugguauagugauggaugucucgaacauagagaauuauguuuggaaaaaaucuguguggaauauucaccgugaguauucagaguuaggacuucuacucacaugucuggagcacaaagccuucaaugaucagcauaucaauuaucuacaucaacugauuugucaccaaaaccuuuuauauauuugccucuagaauuucuuuuuaaaagugcugagaaucuauaaggaaauaauaguacuguauuagaaacuagguaacaaauacaacaaaagaaaauguuauuuuuugguaaucuaauuuuguccuuuuuucacguugaagcuuuuguucggaaagaugccuugccacugggaaccuuuuccaaguauacuuggcauaucacuaauauccugcaaguuaaacaaaucuuagauaccccagaggugagaguuuauuucuauaacagugggaggguugugaagggaagagagggaggcaaguacagggacuauauuugcacugguuccuugaguuacagacaccagaguuucuuuuuuucaugcuaagagauauucagaaauaucccuggcuuuauaguucugacuccaauuuuaauguguguucccuauggcuugaaaaaaguaucuuaaauuggaauauacuuuuccuuugccuuugggauuaaaaaaacauaauuuuucuuauaaauuaaauaaugauccccuaauacuuaugaugaguccuagauuugacuggcaggcagcuagaaaguauauaaauaauuugagaugauauaauauuugugaagucaguggcaccagcacaguuaaacccuccuccccaaacuacagcuuuguucucauuagagaaaugacccuuuuuauuuuauuuuauuuuauuuuugggauggagucuugcucugucacccaggcuggagugcaguggcgcaaucuuggcucacugcaaccucugccucccggguucaagcaauucccuugccucagccccccggcuagcugggauuacaggcacgugccaccauacccggcuaauuuuuguauuuuuaguagagacaggguuugaccauguaggccaggcuagucucaaauuccugaccucaugauccucccaaacugcugggauuacaaggcaugagccacugugccugcccgagaaaugacccuuuaaaaaaaauuuuuuuuuggucuuuuuuuuuugaauuuugguuuuuuugggacagagucuuacucuguugccuagucuggaguacaguggugcagucacggcucacucuaccuccaccucuugggaucaagugauccucccaccucagccuccugaguagcuuggacuacaggcauaugccaccaugcccagcuaauuuuuguagagaugggguuuccccauguugcccaggcuggucucaaauuccuggacucgagcaaucugucugccgcagucucccaaagugcugggauuacaggcaugagccaccaggcccacccuauuaauuaaaaaaaaaaaaaaauuuaagauagggucuugcuauguugcccaggcuggucucaaauuccuggguucaagcaguccucccaucuuggccucccaaaguacugugauuacagguguaaucugccucuuccagccacacuagacauuuuauguuuuuauuuuuauuuuuuggagacagagucucuugcucuguugcccaggcugcagugcaguggcacgaucucggcucacuguaaccuccaccucccagguucaagcaguucucaugccucaaccuccugaguagcugggacuauaggcacgcaccaucaugccuggcuaauuuuuguauuuuuaguagagacaggguuuugccauguuggccaggcuggucucaagcuccugaucucaagugauccgcccaccuuggcuucccaaagugcauggauuacaggcgugagccccugugccugucuuacacauuuuaaaauguuuuucgggcugggugcgguggcucacgccuguaaucacagcacuuugggaggccgaggcggguggaucacgaggucaggagaucgagaccauccuggcuaacacagugaaaccccgucucuacuaaaaauacaaaaaaauuagccgggcaugguggcaggcuccuguagucccagcuacucgggaggcugagucaggagaauggugugaacccgggaggcggagcuugcagugagccgagaucgcaccacugcacuccagccugggcgacagagcaagacgcugucucaaaaaauauauauguauguauguuuuucaaguagauccugaaaaucugagauggaguuuuuuuuccuacaguaauagaauuauguagaaaauucaggccgcgcacgguggcucacaccuguaaucucagcacuuugggaggcuaaggcagguggaucaccugaggucaggaguuugagaccagccuggccaacauggugaaaccccgucacaacuaaaaauacaaaaauuauccaggcaugguggcaggcaccuguaaucccagcuacuugggaggcugaggcaggagaaucgcuugaacccgggaggcggagguugcagugagcugagguugcgccauugcacuccagccugggggacaagaucgagacuucgucuccaaaaaaguagaaaauucagcauaaugugauuugauacauuaagaguagcuuaauugcaaggcauucuucuguucaggaaaaaaaaauaaguuguuugauagcuacagaauuuacaugugagccaggcaugguggcuauaauaccagcgauuuaggaggcugagaugaaggauugcuugaggccaggaguucaagaccagccuaggcaacacagcgaggccccuacuauuuuuuuuuuguuugagacagagucucacucuguugucuaggcuggaaugcagggcacaaucuuggcucacugcagccucugccucccagguucaagcaauucucccaccucagccucccgaguagcugggauuacaagcgcaccauccugcccagcuaauuuguauuuuuaguagagacaggcuuucaccauguugaccaggcuggucccaagcuccugaccucaggugauccacccuccuuggcuucccaaagugcugggauuacaggcgugagccagugcgccaggccagcaaaggccccuacucuuaaaaaaauaaaaagaaagaaagaaagaaagcaaaagaggcuggcgagguggcucaugccuguaaucccagcacuuugggaggccaaggugggcagaucaccugaggucagggguuugagaccagcuucgccaacauggugaaaacccgucucuacuagaauacaaaaauuagccgggcgugguggcuugcuccuguaaucccagcuacucgggaggcugaggcaggagaaucacuugaaccugggaggcggagguugcagugaacugagaucgugccacugcauucuagccugggugacagagcuagacuccaucuccaaaaaaaaagaaaaaaagaaaaagugaggccugguggugugugccuauagucccaaccacuaagaaagcugaagcaagaggaucacuugagccugggaguuggaggcuacagugagccaugauugugccacuguacuccagcaggggcaaccaagugagaccuugacucuuuuuuuuuuuuuuuuuuugacacggacuuucacucuuguggcccagucuggagugcaaucaugugaucuuggcucaccucaaccuccaccucccagguucaagcgauucuccugccucagccuucugaguagcugggauuacaggcgucugccaccacgccuggcuaauuuuguauuuuuaguagagaugagguuucuccauguuggucaggcuggucucaaacucccgaccucaggugauccgccuaccucagccucccaaaguucugggauuacaggcgugagccaccacuccuagcgaccuugccucuuaaaaaaaguaaauacaugugaacccuagaaaagggcuguguuggcauuaaaaacacuugaggaacuccuuuaaaugcacauggcacagaggcaguuuuuagccuggaauggaugacauuuagggagacacugaagcaacucagggugcaggcaugugggagaauagagcuaaccaucauggagcuucucacugucaggcauuacuuaccuccgucaccucauuugaccucccagccaugcccuggcauuaacugcauuuugcccgugagaaaacaggcucugagaaguuuguaauuugcucugggucaccacagcauccaguuccaguucugcuuggcucagucccaaggacaguaugaagcauacaggaugugaggugagcugcaggugcuaugaacaaaggaauuuaagagaagaaugcugcuagcagagcaguaggggaaggaaugaaacugauuuuagagcaggucugugccagcagcagucauguacccaugaagauguuagaggcucaauugguauauaguuuggcugggguggaaauuuaagauuuuagagaaaaaaggaaagccaugaaugauguaagggagaaaaggcagauuuguugacaggauuuucuugaaaaacagggaaguuguaauucauuugaauauacuuaacaagaaagaaggaauaauaaaagauuugucgucauccagguauuggucuguuuugaaaguuuucucucucaccuuuuuuugguauugucuugguguccagaugcccuuggaaaucacccguagcuuuauccagaaccgagaugggacuuaugagcuauuuaaaugcccuaaaguggaaguagaaagcauagcagaaaccuacggucguauagaaaaacaaccagugcugcgacccuuggaacuaaaaacuuuucucaaaguugguaagugaacuucaaaacugcaucuuccuuugagugucagcuggugaacaguacaguacacuguccaaagcuuuggaucuugaccuuaaacaaagaagacacauucauucaccuuguaaaggcaaucgugggauaagguauuuuguuucaauugaaccaguguuuucaaaaauaaaauuacaggccaggugcuguggcucacaccuauaaucccagcacuuugggaggccaagacagguggauugcuugacguuaggaguuuugagaccagccuggccaacauggugaaacccagucucuacuauaaaaauacaaaacuuagccaggcauaguggcgcaugccuguagucccagcuacucgagaggcugaggcacaagaaucgcuugaacccaggaggcagagguuacagugagccgagaucucaccacugcacuccagccugggcggcagagugagacucagccucaaaaaaagaaaaaaaaaaaaaaaagacuugcugaaugaauaaaugcaugccagccauaguuuuaacuaauuuagcuuugugaucuaucugguggccucccuuuguuucuucaguuuuguauuuauucuuccagaagaaauuuagaauuuauaauuauucugucaaauucuugugaauauuauuuuuuugcugcucuugugaaugaaauaucuauccugauucuaacuuguuauuuccaguuauggaaaucucuuaguuuuaauauacuuaauauuaaauugguacccuugaugaagucccaguagugauaauaguaaaugaaagcugggcacaguggcuuaugccuguaaucccagagcuuugggggcugaggcagcaggaucgcuucaggccaugaauucaagaccagccugggcaauauagcaagacccccacuuuacuaaaagaagaaaaauuaaaaucucuucuaagucuguuuuagacuguacuugaauuucaucugcuuuaugguguuuuccaaaucagguaacuggcuuuuuucaguucuaaauuuuuuuuuuuuuuuuggagagggagucucgcucugucaccaggcuggauagagugcaguggcaugaucuuggcucaccacaaccucugccucccggauucaagcgauuccccugccucagccucccgaguagcugggauuacaggcgcccaccgucacacccagcuaauuuuuuguauuuuaguagagacgggguuucaccauguugcccaggcuggucucgaacuccugagcucaggcaaucugcccaccucggccccccaaagugcuaggacuacaggugugagccaccaggccgggcccuaaauuugcuuuaaauuauuuccuucuuuugucuacaauaauuucucuuuuaaaauuuuccuaauauuuucuuggaacuguuuuauuuuuguagcuuuuaaaaggaauacuccgccgagggccgggcacgguggcucacgccuguaaucccagcacuuugggaggcugagacaggcggaucacaaggucaggagaucgagaccauccuggcuaacauggugaaaccccaucucuacuaaaauacaaaaaauuagcugggcgcgguggcgggaggcugaggcaggagaauggugugaacccaggaugcagagcuugcagugagccgagaucgcgccacugcacuccaugcacuccagccugggcaacagagcaagacuccgucucaaaaaaaaaaaaaaaaaaaaggaauacucggccgagcgcgguggcucaugccuguaaucccagcacuuugggaggccuaggcaaguggauuacuugaggccaggaguuccaaccagccuggccaacauggugaaaccccaucucuacuaaaaauacaaaaauuagccaggcguggccgggcguggugacucaugccuauaauuccagcacuuugggaggcugaggcgggcagaucacgaggucaggagaucaaggccauccuggccaacauggugaaaccccaucucuacuaaaaugcaaaacauuagcugggugugguggugugugccuguagucacagcuacucgggaggcugagguaggggaauugcuugaacccaggagguggagguugcagugagccgagaucgugccauugcacuucagccugggcgagagggccagacucugucucaaaaacaaacaaacaaacaaauaaauaaauaaauaaauaaauaauaaaaggaauaugcaauuuuuuaaauuaauguuugauaacauuuaaaguuauuaucugaaucaucuauaauuauaauuuaguuucucccuguccucaguaccuuguauuuaaaauuucaaauuaguugaggcuuuuaaucuucauauucuuaguuuccaauuucuaguuuuauuauuuugaggucagaagauguaucuuuaauuucuuucuuuuuuuuuuuuuuugagaccgagucucacucugucgcucaggcuggagugcagcagugcgauccuggcucacuacacccuccaucucccagguuuaagcaauucuccugccucagccuccugaguagcugggauuacaggcgcaugccagcaugcccagcuaauuuuuguauauuuagugagacaggguuuaccauguuaaccaggcugaugucgaacucuggacgucuggugauccgcccaccucggccucccaaagugcugggauuauagacgugagccaccaagcccggccuuaauuucuuucuuuuuaggaauuuuaaaauguuuuuucacuaacaauauaugauaugaauuugugcuagcauagauguuauuuauccaauauaaacucguauauaguuuuuguuuguuuuucagauacagucuugcucugucacccaggcgggagugcaguggcacgaucucggcucacugcaaccuccgccucccggguucaagugauucuccugccucagccuccugaguagcucagauuacaggcguaugccaccacacccugcuaauuuuuguauuuuuaguagauaugggguuucgccauguuggccaggcuggucucgaauuucuaaccucagaugauccgcccaccuuggccucccaaaguucugggauuacaggcgugagccaccgcgcccagcuauauauagcuuuuucauuuuauuuuggugguuuuuuguuuguuuguuuguuuguuuguuuugagacgggagucucgcugucgcccaggcuggagugcaguggugcgaucucggcucacugcaggcuccgcccccugggguucacgccauucucuugccucagccuccugaguagcugggacuacagaggcccgccaccucgcccggcuaauuuuuuguauuuuuaguagagacgggguuucaccauguuagccaggauggucucgaucuccugaccucgugauccauccaccucggccgcccaaagugcugggauuacaggcgugagccaccgcacccggccuuauuuugguguuuaaguccucuuuguuaucucuuugaccugccaaagacuagaagagucauuuuaccauuugcuucuaaaauuauguuucccugaaugacuucuuauauuucuaaaagccuuuaauuauuuuaaaugcaguguuguugguacaucagaguuauugccagauguuguuaacguaaauuguauguuaucaauguaaaaauaacuuugcccuaaauucuuuguccaguauuacaacagugacaccagcuuucuuuuguuuuuuauucuuuuaauuuuuuaaauuuuacucuuuuuuuuuuuuugagauagggucuugcccuguuacccaagcuggagugcaguggcacaaucacggcucacugcagccucaaacuccugggcucaagcgauccucccaccucagccuccugaguagcugggacuacaggcaugugccaccauucccagcuaauuucuuuuuauuuuuaguagggacgaggucuuacucuguugcccacgcuggucuugaacuccuggguucaagcaguccucgugccucagccucccaaagugcugagauuacaggcauaagccaccaugccuggccuguuuuuuauuuuuuuuaauauguucgccauccauuuaguuuuaacuuuuuugugacacuguuuuaauggaaucuuuuuucagagacagggucuugccauguugcucaggcuggagugcaauggcuauuuccaggugugaucauagugcacuacagccuugaacuccuggguucaagugauccuuccacucugccucccaaggaggugggacuacaggcacacaccaccaggcccaacuuagaugaaucucuuaucaacauuauauacuugguuuugaguuuuucuaauuuuaauggucuauccucuuuauauuuauuauaauuuauauaguuggucuuuugucuuauuuuuugcuaaauggacuacguucucugucuugucuucauaguuuuugaaggugauaccauauucuuuuuuuuuugagacggaguuucacucuuauugccuaggcuggagugcaauggggcaaucucggcucaccgcaaccuccgccucccggguucaagagauuguucugccucagccucccaaacagcugggauuacaggcaugugccaccaugcccagcuaauuuuguauuuuuaguagagaugggguuucuccacauuggucagacuggucuugaauucccaaccucaggugaucugcccgccucagccucccaaagugcugggauuauaggcaugagccacugcacucggccagugauaccauauucuuaguuuaguucugcuaguguuuaauuuuguauuuuucuuuuuuuuuuucuuuuuuuuugagauggagucucacucugucacccaggcuggagugcaguggcgcaaucucggcucacugcaaccuccgccucccagguucacgccauucuccugccucagccucccgaguagcugggacuacaggcacccgccaccacgccuggcuaauuuuuuguauuuuuaguagagaugggguuucaccauauuggucaggcuggucucgaacuccugaccucaggugauccacccgcuuuggccucccaaagugcugggauuacaggcaugagccaccacacccggccuaauuuuguauuuuucaaaaguauucuuuaaccuucuauguuuaaaucuuugaucugacagagcacagcagcucacaccuauaaucccagcacuuugggaggcugggguuggaggauagcuugagcccaggaguuugagaccagccugagcaacacaaggagaccccaucucuauaaaagaauuuuuaaaauuagccaggggcuccucugccuaugaaguagccauucuuuauuccuuuaccuucuuuuuaccuucuuuuuauuuuuuauuuuuuuagauggagucuugcucugacaccaggcuggagugcaguggugcgaucuugcucacugcaaccuccaccucccagguucaagcaauucuucugccucagccuccuuaguagcugggacuacaggccugugccaucaugcccagcuaauuuuuguauuuuuaguagagacgggguuucaccauguuggccaggauggucuugaucucuugaccuugugaucugcccgccuuggccucccaaagugcuggauuacaggcgugagccaccaugcccggccuccuuuacuuucuuaauaaacuuacuuucaaaaaaaaaaaaauuagccaggaauggugguacaugccuguggucccagcuacuuuggaggcugaggugggaggaucgcuugggcccuggaggucgaggcugcagugagccaugauugugucacuacgcuccagccuaggugacagagcaagaccuugucucaaacaaaacaaaacaaaacaaaacaaaaaacuuugauucucuggaauuuaucaugauguaaguuagguaaguuauagguaagauucuaccaccuuuuauuuucuuccagauggauaucugguugauacaaaccauuuauuagaagaaacacuuauuuguucuucuuuuaguaguuacaaaugccaucuuuaucuuaggcuaaauuccuguuguauuugugucuauuucuaaucuuucuguuuucuuccuuuaaucugucuagaugcaugcuaguaccacacucuuuggguuauuacggguuuauaauauauuuuagaaccaugucagauuuuuuuuuuuuuuuuuuuuuuuuuuuuuuuaguaaaaauuucuuacagagaugggggucuuacuauguugcccaggcuggucuugaacuccugaccucaagugauccuccacccugauccucucaaagugcugggauuacaggcaugagccacugugcccagcugaccauguagauuuuaauucuauucuuugugauucuugaaauuuggccuuuucuuguucgucuuccuuuuacucucauccagcugccuuuuccucccagucugagcucuccuuaaugauucuggccuuacuuucauaaaggcuggaucuuauuuuuuuucuuuuguggaugcuaaacaguucccugaaauuucuguguuuuuuuuuuuguuuguuuguuuguuuuuuugagacagagucuugcucugucacccaggcuggagugcaguggcgcgaucucggcucacugcaaccuccaccucccggguucaagcgauucuccugccucagccucccgaguagcugggauuagcccgccaccacgcccagcuaauuuuuguauuuuuaguaaagacgggguuucaccacauuggccaggcuggucucgaacuccugaccucgugauccacccgccucggccucccaaaaugcugggauuacaggcaugagccaccgcgcccggccguuuaaauuuucuuuuggauagauauaucagucauugcuuucccuuccuuugauucuucuagcuguuuacucccuuuuccuuauguaguuuuuuuuuuuuuuaauuuccuguucuuuucuuuacuuauuacugaacagauuaagaucuguccagacuuugggaggccaaggcggguggaucacgaggucaggagaucgagaccauccuggcuaacauggugaaaccccaucucuacuaaaaauacaaaaaaauuagcugggcgugguggcgggcgccuguagucccagcuacucaggaggcugaggcaggagaauggcaugaaccugggaggcagagcuugcagugagccgagaucgcaccacuacagccuggcgacagagcaaaacucugucucaaaaaaaaaaaaaaaaagaucuguccagacucaaauucugguaacaggcagguugcuugggaccacuccugcaugauggcuggcucccucucagaucuguauguggagcgcugaugcagaguucucagaucuaauguuucucuuuccuaccacaguggcaucuccugaccaucucugccuccuucauugcuaauaauggaauauaggaaaaaaacacacaaaacuaagauuccccgcauauauaguuuucaaggguuucuccuccuucucacacccaaauugcuuuacuagugcagacuguaccuuccagaacacacucugccacugcuauucacuuuuuuuuuuuuuuugagauggagucuugcucuguugccuaggcuggagugcaguggugcgaucuuggcucacugcaaccccugccucccagguucaagcaauucuuuuaucucagccuucugaguagcugggauuacaggggcgugccaccacgccuggcuaauuuuuguauuuuuaguagagacggaguuucaccaucuugaucaggcuggucucgaacuccugaccucaugaucugcccggcuuggccucccaaagugcuggguuuacagacgugagcgacugcaccuggcccugcuauucaccuuaaaugcaccuacucuccuccaaguccccuuugcagucaucaagaauucagguacaugaguggggaggggugugugugagauguucuaaaggaaacgaaguggcgcugcucauuugcugcucuguacaaguacuagccagggcacaaacagugagagagacaaaguauuuuccugccuuuuuccauguagccucccuuuaugaaggaaagaugggauaugcuauggccaaagucuggguagguuucuuuccauccaucuccaccuguuuuauauuuccucccagaagcugccaguagucuuaguguucaucaguuguaaguuuuuaucuuuuucuaugucuucauugauauuuaagugaaaaguuggcagcagcuccagauaucauuugaaauggaagcuagaaugucugugacaaacaugaacuagauaauaccuaacauuuauauucuaugacuaaaagaaaccaaacagaccaaaauacccugccaaugaaguuguuagucugggguggguggauggaugcuuuguuucucaucauaucagugaugucuuagucuuugugagaaaggaccaaaagaaguagagggaaggaauuuaaaaggggugacuauuuaggcuaaaguggagggagaguaacauagugaaguuaaaaguaaaauauaagccaggcgcaguggcucacgccuguaauccccacacucugggaggcugaggugggaggaucaucagaggucaggaguucgagaccagccuggccaaccugcugaaacccugucucuacuaaaaauacaaaaauuagcuggacaugguggugcgugccuguagucccagcuacuuggaaggcuggagaaucaccugaacccaggagguggagguugcagugaaccgagauugcaacacugcacuccagccugggcaacagagcaauacuccaucucaaaaaacaaacaaacaaacaaaaaaguaaaauauuagcuuaugaagucaaagauuuaguagugcugagagaaaaauguauauacauuguuaauuuuuauaauauaaaaauguauauacauuaauuaauccauccuucuuguuuuuuuauuuuuuggggguguuuuuugaggcggagucucacucuguugcccaggguggagugaaguggugcgaucuuggcucacugaagccuccaccuccuggguucaggcgauucuucugccuuagccucccgaguaacugggauuacaggagcaugcuaccacaccuggauaaucuuuguauuuuuaguagagacgguuuugccguguuggucaggcuggucucaaacuccugaccucaagugauccgcccaccucagccucccacagugcuggaauuacagguguaagccacugucccuggccuauccuucuuguuuucuuguauuacuuuguuuuuuugagacaaagucucacuguauugcccaggcuggcauugaacuacuggguucaagcaguccucccaccucagucucccaaguaguugggacuaugggcacauuucaccacaccuggcuaauuuaauuuuuuguagagacagggucucacuuuguugcauaggcuggucuuaaacuccuggccucaagcuauccucucgccuugcccaccaacacuguugggauuacaggcaugaacuaccaugccuggccuaaauauauauguuuuaacuucaugauggcugggcgugguggcucacgccuguaaucccagcacuugggagucugaggugggcggaucacaaggucaagagauugagccauccuggcuaacacgaugaaaccccaucucuacuaaaaauacaaaaaauuagccaggugugguggcacgugccuguaaucccagcuacucaggaggcugaggaaggagaaucgcuugaacccgggaggcaaagguugcagugaacugagauugcgccacugcacuccagccugggugccaaagcgagacuccgucucaaaaaaaacaaaauaacccaaaaacuucaugaugaucaauaaaucugauaucccaaucaccacugaauuuauaaaccucauucggccuucugauuaucaaagcugaacaggcugcuccaauuccggacacuuuuuuugcaauuaggaacacccauuagaguuagguggaauuguacuaauacuccuuucuucucuuuaggcaacacuuccccagaucaaaaggagccaacaccuuucaucaucgaguggaucccagauauccuuccccaaucuaagauuggcgagcugcggaucaaguuugaguauggccaccaccggaaugggcauguggcggaguaccaagaccagcggccccccuuggaccagcccuuggaacuggccccucugaccacuauuacuuucccuuaaagcaaaacaagauaauaaucuuuugcugcuuaauuugcacauccccaccccuugacaacuuuaaaugcuaguuaggcacuuagauggcccuguuccuugguaaacugcucuuagcuaagaugcaaauucucagugcuuucaaguggauucuguugaagaaaaucucuuguaaauagccuuuuugaugcugcuguguacagucuucauuaugcauugggcaguauuucuggcuagaguuuuaaaaggaacagaaagaaaaccagcuuauuuuccuucuuacggacucaucuuuagcguuuauuucaaccuuuugcuaauucucugagaaaucugcagcacucagccauacaccaacaguguuggaaaguuaacacccugguuagggcagaauguuaaagaccaucuuggcagaguuccagccacgcucuuuauucuguucucaaauaaagcagugucacuaguuuuuccuaa

SEQ ID NO: 191647 - RNA, 1750 nt, Homo sapiens
uuaagacagcaauucccagcuuuuucaaauaugaagcauuuuuuaaccaauccguuuuuuaauucuuaaauucuugacauuacagaacuaaacugaaauuuauuaacauuccacucuuacauuucuuaucgacaaacagaaauaaaauucaugagccaaaaaacccaaaacaaaacuaaaaacagggaaaagcuuauaaaacuaaauauggaucccagcauuaacagcugaacagagaaugugauuuuuaaauucuuagcggaugauaaaguuguguagaaacugaacacuuacaaauuauuuaaaaccuggaaucacugaccagaaauuacacaguuggaucaugggagaacagcagaaagggguuauugagggaaccuacacuguucuagcugcaccccaugcccuucucagaggaaagccuggcauugauuagauacugggccagacuaauacuggcagcagagccagugauaguaaccugccuaccagaggagccuuccacuggguuggcaauuuugaucugggccccggacaucuggcggaucucauuaauguuggcgccuuggcgcccgauuaugcagccaauuaaguuauuuggaauggugaguucaugggugguuugaguagaugcauccaaacuugcccaauagccuuucaccucuggagagcuggagucaauuccggcgaauccggucccgccgugcaucauggcaaagugagacuguugucuugccaccugguucagcuuggccagaucgagcggagaaaugguguguuguccuugaaucgaguaggcaucuagagguggucccuccaggucauggguggcauggggguagcccgcagcgucgcugcaccgaucuuggccgcccgcgcagaugacuggggagcuggccggcaugggcugguacggaauggucaugacucucccuugcggagacugggagagcgucuccagcaugaccaggcaaaucugcuugacacacucggugacagacugcggcacgccagcgauggugauggcccgcucgguggaguugggcagcauaucccccgccaccuggaccugcgcccccguacucucgcggaucucuuugaucuuacacccgccuuucccaaucagggagccgcacuggguggccggcaccaccagccucagggugaccgggggccugcuggccgcgguacuguuggucauggagcuguugauaucuuccuccagcuugucgaugaucauagcgaaagccuuaaagauggcauugguggggccggucagagugaugauucucuccggacaauuccccuccgagauguugauccgcgcgccacucuccucgcggauccucuuaaccgacuccccuuucuucccaaugaugcuuccuacuuccuuuccgugcauaagaagccgaauggugagagucacauuuaguccacuuucagucacaccggcauccauggcgagcggcgggcggcguucgggggaguugggcucguuacguggucaagucuuuggcggcuggcggggggaggggagguguaggcccaaaacugccggcgcgaggcgagcgagggccgcgggagcgagcgggagcgggcgggaggccgcagcguagucgcaggggcgggcggcggcggcggagggggcgagcggggccgggagcggcgggcgggcgggugggcgagggcgcggcgguggcgacuccggcggcagccucggcggucugggcggggcgggaagcccgcuuuc

SEQ ID NO: 191648 - RNA, 49910 nt, Homo sapiens
accaggaagaaaauauuuaaugauuaaaaacaaguaugaccuggaaagauauuagacuaaaaggaggaaucacaaugagcaggugaaaauguuaaaggaaagcuuucaauacaccaacugaaaaaggcauuucuaauuggccaaccaaauuauucuuuuagauuauuuuagccaaauaaaaagaaauuuacagauggauaacugagguccacuaacauaagguagaaacaaaguuuaagcuaaaaauuaaaucuauauuuuguugcagauaaaugugagauuuaccuacagcaauuuucuauugaugcuaaauuaaaagcaugaauugacaucguucuaacagaaaugguuugacagauauuuucuuggcuuuaaaauguucuuacgcauaugcauagaaaugcaaugaggauaagaauaaucuucuguauugucuguacaguucauaaggccuuugucauuguuagucaccuucgaugugaauaucaguagggccauuaaauuaaagcuggccuaaaaaguuuucaaagugcuacuguuuccaacugaugaaaucuucaguuuucuggauuuucugggugacgauuauuuucaauucuuuuuuucuggugauauauacaagaaguuacagcagauauauaaagggaagaucagaagccugcuguccaaguucaucaccacuuguuccuauaagacagauuuguagauucaaugacaauuagauaaaauaaaaacaaaaaaccaaacuguugaacugagugaaccaaaggagauaguguccugagucugagauccacaacuccacucuccaaacucccacccauuagcugugugaccuugucaaaugcagcuuccucacuguaagauggggacaguaagaguaccugacuuaaaggaggauuacaagagauaauacacaggggguuuugcaaagccagcuaucuauuaaguacucaauaaugguaguuauuuucauuauugcaaaaauuucuaucaaauacuuacauauuuugucaacagauacaaugucuagaaauacauaaacuucucacugggcuucaauuuuuaaaaaaauuuauuuccuuuuacaaaauuaauuaauuauuuuuaaaaaugagauagggucuuucuauauugcccaagcuggccuugaacuccugggcucaagagaucuuccugccucauccucccgccucagccuccugaguagcugggacuacaggcaggugccacugugccuggcuacuuggcuucaauuacugauggccguuggguacagcaaaucacccagaugaaggucgggagucauuaucaucaucaaaaagcaggguuccuacuauugacauuucccacugucccuaugacaaacauguaauuugucuccugaaacauaaaauacauuaucauggaaaagcaauuucagguucaguuacaucaacacacacaagaaugcucagaacucccagagacaggagcugacacuacacaaauauaacaucccugaugcuacagaucucuguuuggaaccucauauauccuuuacuagaagcauuugguaaauagaaucaauccucagaguaaaagaagaaacacuaaaaugagaauuccuacguuuuaaaugccugggauaugcucucugcaauaguaugcauuaguuacacuuuauuuauuuuggauaagauacuauuaaacacuguuuaaauccaaaguuuuaauuuuuuacugagacauguauuccugcaugaagaggaacuaaaacuagaauaucugugugacugaagcagacucacuagacacagcuucuguguugagggaacaagaagauaaauuugaauaaagaagguagagaguacaaaugucucacacacacacacacacacacacacacaaacacacaaucucucucucuguacgagggaaagugguauuauaaaaagacaucagugaacaaaaucaggggaggccaucaccuagacugugcuaacaagugucaccagagaggaauuaugccaaagcaugguuggucuucagaugcuugagacauccugaacuagucaaaauuuauaucaauaaucugggugaaggcacauuuaccaaauuuguugaggacaaauguuuugaugauauguauaucugaugauaaaaaucaagauucuguuccauaacuaaaaggcucugaggaagauuagccuucuaguauuugaauacaguuaagauugaggcagggaaggguaggucaaagggccaacucuggagaaagaaggaaggcacguggauaucacuuggcugaauggauacaccaauuuuugaauauuaaauuguauuaauccccacucuccauucccaaacaggauaggucgauccgagcuucaucaaaucuguuguuucaccuaaagguucaaucugcaucuacauuugcauugaaguaccuuuauagcaaaguucuauuuuccuuauuccauuguggauggaaucuguggagcccacauauagcagcagcagagcagcagcaacuuccuagguccccauuucuacuuccagacaauuaaauaaauuucuggguauuuguuguuguugguaguguuuuuugucugucuguuuuuguuuugagacagggucugacucugucacccaggcuggagugcgguggcaugaucauggcucauugcagccucagccucccaggcucaagugaucuuccugccucagcuuccaaguaggugguaccacaggcacaugccaccacgcccggcuaauuuuucaauuuuuuguauagauaggguuuugcuaaguugccagggcuggucuugaacuccuggucucaagcaauccucuggccuuggucucccaaagugcugggauuacaggcaugagcuaccacgccaagccugcaauuuggcuuugauucuccaucccagcuuuucaaugucucaccagguuaccuuuuuuguccaucucuuaaauaccaguggucccuaggguucuauccugucauauucucuacacauuuccuguacauuaucucauccaauuauuauuucuaguucaggcauuacuuguaaacuccaaauccauuauucaccagccuaucaaauuuucaccuugaugcucucaaauuaaacaugcccuaaacagaauucaucaucucuucaccaucaccaacacuaugucauguucauuuuccuuccuauaauucaaaucucagguaaaaccacuacuguaaauuaaauugcucaaaucagaaaaccaucugacauuuccucaugcacacacacaauuaagaaucaaauucucaauugcaccacuuuauuuccagaacccaucaauauuuuccucuucauugcuacauucuuuaagguucuuaucacuuuuaaucugaauuauagcuauauaaucauaaauuguuuuauugccauuaucauaucuuuaauccuuccuacacauugcugucugacggaaccuucuauagugaaaauccauuuagcauggucuuauaagauggacaguuacaaaauaaauauacaaaaaucacuaacuuucuuacauuaucaaaaacuauuagaacaaaugauucauuucauauuagcaacugaaauguaaaauacuggcugggugcgguggcuuacaccuguaaccccagcacuuugggagccugaggugggcggaucacgaggucaggagaucgagaccaucuuggccaacagagugaaacccugucucuacuaaaauacaaaaaagcugggcgugguggcaugugccuauaaucccagcuacuugggaggcugaggcaggggaaucgcuugaacccgggagguggagguugcagugagcugagaucacgccacugcauuccagccuggcgacagaacaagacuccguuucaaaaaaaaaaaaagaaauguaaaauacuaaguguuauacuuccaggaaauacacaggaacaauaugggaaaaacuacaaauuuuagagacagacauaagggaagaccuacguaaauguagaaaauaccauauuccagaaaggaagacaucaaugguccacaaacuacucuacauauuuaaucauauaaauuaaaauccccauaggaauuuuugcaaggaaacuugauaaaaugauccuacaucccauacaggagaauaaucaugcacaaagaacugagagauuuuugaaaaaaagaaaaaugaaggugguuuugcguaacuaaauauuaaaaugcauuuuaaaguuagccuaauuaaaacaaugccuugucuucauaacaaagaaaucaauaaaacaaaaaguccagaaaugaaagcaaguuuauaaguauuucauguacaauaaggcauuucaaauacauugauacauccaguacauuucagauauaucgucaaauacuccaaaguaaaaaauuaagccauaaaaagaacagaagaauauauagaugacuauuuauauaauccuaguaagauggaggccuaaggauaacaccaaaaaaaagaaaucauaaaagaaaaagauagauuguuuugaagguugaaaagacaaaugacaaaaauguaaaaacuguuugggccugguggcucaugccuguaaucccagcacuuugggaggcggaggcagguggaucacuugagccuaggaauuccagacaagcccaggcaacguggcaaaaccucgucucuauaaaaaaauacaaaaaaguuagcugggcaugguggugcgagccuguagucucagcuacuugugaggcugaggugcguggaaagguugggcccaggagguggaagcugcagugagccaagauuguaccauugcacuccagccugagugacagagugacaaccugucucggaaaaaaaaaaaaaaguaaaaacuauagaguaucacaaauguauuuuuaauauauaaaagcuguuaaaaauuagcaagaaaaaaaugaaauuuuaauaaaaaauuaaacaggaacaauauaagcugucaguuuacaugagaugauacguucaauaagcauaaaaaaacccaacaauacaguaaccaaagaaaugaaaauugaaaauuaagggccaggcgcgguggcucacaccuguaaucccagcacuuugggaggccaaggcagguggauuacuugaggccagaaguucaagaccagccuggcuaacauggugaaauccugucucuacuaaaaauuagugcacuccagccugggcgacagagcaagacucugucucaaaacaaacaaacaaaaagaaaugaaaauuaaaacaaauauuuguuuucacauuuacuacgcugggauagagaugaaaaagaauaagauacaauauuggguauacucuccuguacugcugccagggggaaguauaaauuggacaguagcuuuggagggcaauuuggccauuagaaaauuguaugcaccaugcaacaagaauucuacuucuuggaauuuaugcuuuaaaaauaucauaaaaauggacaaagauauauguauauuuccuauaguaaugaaaaaaaaugagaaacaacuuuauccaauaaagaggaauuaucuaaguuacgguauagccaaaacaacuaauauuaugccguucauaaaaaugaugcugugaauauauauuuauugaccaaaaaaagcuauguacaacaaagugaaaaaaaaaaaaaaagguuacaauuacuaccucacugucugaugcaccuaggcucaccuggccuugggcucugaaagaggaccaagccuuucuucuacugggcccaggccaggugaccccauuuugccucucccccaggccugaccacuaugcgaccaacaaguucucccaggccacugacuuggccaugaagaagacagaggacaacaaugcacuuguguucauuguggaugucgaggucaaaaagcauaagaucaaacaggcuguggaggagcucuaugacaccaauguggccaagaucaacaccgugaucagggcugauggagagaagaaagcccauguucagcuggcuccugagcaugcugcuuuuagaggcugccaaaaaauugggaucaucuaaguugaauccagcuggcaaauucuaaauauauauguuuuucaccauuaaaaaaaaaagcagguuacaaaauagcuaaccuacugugauccaauuuugcaaaaaugauacaggugaaggaaaaacucagcaauguaucugagugguacauguaugauuguuguuucagcugacucauauuuucuauuuuuucgacaacaucuauaaccuauauaaaacacggagacaacucccaaaguaaaucucccaaacuccauccacagcccucaugcccuggcucuaguuauacugaacucuuccaaccaucuuucaguuccuugaauaugacccauguauucccuugcuuccggaaaucuuacucaccauuugaggcuugguucagguaugcauucacuuuaacacuuuuccaggagaggauguuuucccugagcugucuuucuuucuccuccuccuccaauaaccacccccaaccacggcagcugcucaguuacaggucagagucuucucccucaagguugcacacucugagcuaauucuaucaugcuacuuacacuaggcuauauuaacacaagccugucuuuauuucuucuacuucuagcugagaaccaagcacaugguggggacacaaauguuugcugaaggaacaugggaauacaacuauuaucuuggccuggugcuuuuuuaggucucuggcuggguuugagccaugacaguauuuuucaugaaguuucagguagaagauaaagauagucauugucuguucagcugcagagguuacaagaaggaccaacagagaguucugauggaggcagauuuggacuuucucauuauauaccugccuugaaauggacauuccuacauauuaccuuucauguaagaugggggucaguuagaguuucaacaauggguggaugacccccucuguaagaaugcuguuaaaagaaguucucauauagggcaugugagguuacaaugaucacuuccgggguuacuugcaaugcuaaggauguucuaugauagucucuucagucugaggaaaacuacuaacuucucauaauuuauguaaacuauaacaggcuuugaauccuuuaauaaaacauuaugcccuuuggaaugaugauuacuuuuaauagaaauaaaguuccucaauauuuuaacagcuuucaguuuuacuuuuaaaaauggucuacuuucucaucaugacacuuugaaacuucuccaugugugugauguaugaauaaauaaauggcuuuggagauaaucuggggaacauugcagaguuugccaucuuacgaaccuaaugggcuagagaauaaugcucuuaugauauucggagcuauggagacauacaggauugucuuuaagaugccugcugugaauguauaaauaaaugcacuauguacacaauggauaaagcacuuaagauuccuaaaauuuuaggaaugaauuuuagugcugcugauauucaggauaaacaauuauuuccuuauaaucaguguuucccugccccucaaacaguguuuucuuuuuuucuccuaauuaugcuuccauugggauggggucaauuaugcauaagugaaugugguacuuucaucuuuaccuucaaaagacuuuuaaaccaacuuuuaggucaaaaugccaucacuuuaauguuaauucuacuuaagaauuuucaaaagaggauucaaaagacaaauauuaugaugacauaccagaagauaaucgaacauaccugauccuuuucaaguguaaguauuugauagccaguuguucuacuacauauuaguuuuccacuacuaucaaaagaagccaaacguaaucuaggauuaaaaaaaaaauaaaaaauaaacacaagauuuuuaaaccacagauuaaacaagcucuuccuuacuuucauauuuacuuuuuccucuguuuuuuauuugauaaaagacuuuuaggaagucuuuucaaacuguaaucugacugcauucagugacaagccugugcuauuauacauaucuggccaagagaaaucauuuauaaauguuuuuauugugguaaaauauacguaacauuuaucauuuuaaccauuuuaaaguauauaguucuguggcauuaaauauauuuccacauuguucugcacccaucucuagaacauuuuaauuuucccucgcugaagcuccuuacccauuaaacacuaacuccccacuuucccuucccucaggcccuggcaaccaccaguguauccucuguaccuaugaauuugucuacucuagguacuucguaugaguggaaucuuacaauauuugugcuuugugaguggcuuauuucacuuggcaugucuuccagguucauccauguuuagcauguaugagaauuugcuuccuuuucaaggcuaaauaauguucuauuuuauguauauaccacauuuuguuucucuagcaucugucagugaacauguggguugcuuccaccuuuuggcuauugugaauaaugcuguuaugaacauaaguauacaaaaauaucuguuuaagucccuauuuucaauucuucuggucuauagaagagaaacugcuggaucauaugguaauucuguuuaauuuuuuugaggaagugucauaccaugcuccauaguggcugugccauuuuacauggccacgagcaguacacaaggguucuaaauacuccacauccuugccaacaccuguuacuuuuguuguuuuuuuucuauucuguuuuuacuaauagcuauccuaauaggugugaagugauagcucauugugauuuugguuuguaugucccuaauuaguaauguugaacaucuuuucauguguuuauuagccauuuauauaucuucuuuggagaaauguuuauggaagucuuuggcccauuuuugagcugaguugaguuuucuuuuuaaauuauagaguuguaggaguuuucuauauauucuggguauuaaugucuuaucaaauguagcguuacaaauaucugcucucauuccauggguugccuuuucacugucuugacacuguccucugauacacaaguuugugauuuugaugaaguccaauuuuaucuacugcuucuuuuguugccugugcuugggugucuuauggaagaaaucacugccaaaucaauuguuaugaagcuuuuccccuauguuuucuuccaagaguuucauaguugcaguucuuaugcuuagaucuuugauccauuuuaaguuaauuuuuguauuugguguaagguaaguauaaauauaugacuuuuaaaucauguucauuaagcuacuguccaauuugucagcuucugguauccucucagaaaaagauugccagcaacuacugggcaaaauuuaacauauuaaauccuuuaaaaaguuaaggauaauauguguuuuccuggaaacauaccuugcuacauauuucaacagucuggaucuuuuauuugcuaggaauagcaacaaggcaacgacuucaaggcugauauucccuacugguauauauuccagccuauucauucucccugacauacuagauccuaugauucugauuacuaacaauagauuucacaggaauggagccucgucauuuccuaccacuuccacauauacuguagcuuaccaaaguucuacuaauguugguguaaauuaucaagguuuuauuucuuauauuuucucuggagugaggaggagugggguggggaaaucucauccuaccuaaaugcuaugcuccuucgaggcuguaaacugacagauccgcuacauggcugauucaguguauugcguuugaaaaugauguaucgauugguguaaguuacaaguaggucgaagccgaaguuaaaaccuguccaacgccagcaguacuaaaaaauacaagagagaagacuuauuucaguuuaucauauuagcaaguagaaaauaaaaaauucaaaaugucuuuuugucucuaacucauuccaaguauuucccucauggguggucgacuuuuugucagugacuuuuucuuaaggcuuaccacccaaaacuauuuaucuaagcuagaaaagcugcccuuaaugaucauaauucucuaagcuacuuuccucuucaugaucaguuuccuuaucucuccauacugcaauucuaccauaaauaauaaggcuuuuuuuuuuuuuuuuuuuuuuugagacagagucucauucugucacucaggcuggagugcaguggcaugaucuuggcucacugcaaccuccaccucccggguucaagcgauucuccugccucagccucccaaguagcugggacuacaggucccugccaccacgcccggcuaauuuuuuuuuuuuuuuuuuugagacagagguuugcucuaguugcccaggcuggagugcaauggcaugaucuuggcucaccacaaccuccaccucccggguucaagcgauucuccugccucagccuccugaguagcugggauuacaggcaugcgccaagccuggcuaauuuuguauuuuuaguagagacgggguuuuuccauguuggucaggcuggucucgaacucccgaccucaggugauccgcccgccucggccucccaaagugcugggacuacaaaguguaagccacugugcccggccuuuuuuuuuuguauuuugaguagagacgggguuucacuauguuggccaggcuggucuugaacugcugaccuugugauccacacgccucggccucccaaagcgcugggauuacaggcgugagccacugcacccagcaauaauaaggcuuuucacugcaacucuaaguggguauauagcuuagagcacuaagaguuucuagagcacuaagguaauuaagagcccauuaaaauccaccuugcuuuaaaaauacucuuaagggcugggugugguggcucacgccuguaaucccagcacuuugggaggccgaggcggguggaucaccugaggucugagguucaaaaacagccuggccaacauggcgaaaccccaucucuacuaaaaauacaaaaaagaauaaaaaaaaauaaaaauaaaaauaaaaauaaaauacucuaacucaaguaacacacaacuggguuauuuaaauaucaucaugggguucacgaguuuguuuauucuaucagcuaauaguuaaugugagaguaucagauaagguagugugauacagagaaguaguuagggcuucaaguguuuggcugacacccugaauugcaauucaguauuuaacugauauuuauugagcacauauuauaugccaggcacuccucuaagcaauggaaucauagcaguaaauaacauacaguuucugcccuaguagaggugauaacuguaagggcaaagcuuuuuuuuuuuuaaagagacagggucucguuauauugcccaggcugaacucuaacuccuggguucaagcaauuuuuccaccuaagccucccaaguagcuggaauugcaggugcauaccacugugccuggcuggagcaaagcuuuugaauaggugagcauggauagaguccaguacaaagagagggaauggacuaagauagaaguaggcaguucauuuuucuaauaagaugaaaugcauagcgcauagcuacaggugcagguagacuggcagaacuacugguaagaugauguacagauucucuuuucauugcaguaggcagcaaggccaucagauaagaauaagggugggagcauugcccuuuuaaggagagaagguaugaguuaccucagcuaaugggaggaucaauucacuaggaaaaugcagacagaucaugaugcagcacuaaccuacuucaaguucaugguuaccacauucaaguggaacccaaugggguacgguguuugucuuuaaucacauucaucugucuggaugcaggcauggagugcaacccuugacaagaguugggguuuagccaggugaguuuaacaugucaaugaggaaaaagaaaaguuaaaagaguauaagcaagggaccaauuuuacgauggaacauaaaauauaagucaagcaaaauaagaaguagaaauguggucagaaaggugauagggaaagguuguaaaaacaauguauuguauauccagaauggaguuaaaaaauuguuggaguccaggugcuagagagaaugagcuagaaagacgagguggggucugaaaacgggaugccugaaauggagauuuugaaggugguguaguaauuaauaaugcaaaaauugaggguaugcucacaggaauggaugccugagguaggguggagcacaagagcaugggggaaggaaggucagggaacagagauauugaaaucaacacgaccgagaauaagaguagugguaaagaaagguagugagggcuggacgugguggcucaugccuauaaucucaacaauuugggaggccaagguaggaggaccacuugagcccaggagucugagaacagccugggcaacauagugagaccucgucucuacaaaaauuuuaaaaaauuagccaggcgugguggugcauucuuguagucccagcuacuugggaggcucaggugggaggaucacuugagcccaggaagucaaggcuucagugagucaugaucaugccacuacacuccagccugggcaacagagugagacucugucucaaaaaaaaaagaaagaaaagaaaagaaaggcagugaacucagugaauuauggccacaauaagaguaguaggugguauaguaggagaauuugcuucaaaguaacaagaagaucugaaagcagcaacaaggaagaaugagaacuaaagaaaacuauucuuuuauacucugaacauuuaucauaauacaaaggcaaacauaggcugggugugguggcucaugccuauaauucuagcacuuugggaggcuaaggcaggaagaucucuugagcccacuaauucgagacuagccugggcaacacagggagacccccaacucuacaaaaaguaaaaaaauaaaauuagcuggcuguggugacacgugucuguagucucagcuacuccagagacuguugcuuuuaguccagagcauugaggcugcagugagcgaugauugugccacugcacuccaaccugggcgacacagugagacacuguccaucagucaaucaaugugaacguaaaauaaucaacuuuuaaaaauuaaaaauaaauaaagucaaaaugaggaaaaguuugggagagaaauaaccaaauagguaucuauauaagguugauuuuuuuugaaaaacaaaaauuaugauuaguuaggggggaauauuuaaaaauguaguucaugucucauuaguggauuguaaaaucaauuuaauaagauacaaucaguuuuuuuuuuuuuuucuugagauggagacucgcucugucaccaggcugaagugcagugucacaaucuugacucacugcaacgucugccuuacgaguucaagcaaucuccugccucagccuuccgaguagcuaggacuacaggcauacaccacuacgcccagagaauuuuuguauuuuuaguagagacaggguuucaccauguuagccaggauggucuugaucuccugaccucaugaucugccugccucagucucccaaagugcuggaauuacaggcaugagccgccgugcccagccacaaucaguuuuuuuaaaaaaauauuaaauagaaggcugggcaugguggcucaugcuuacaaucccagcuauuugggaggcugggaugggagaagugcuugagccugggaguuaaaggcugcagugagcuguggucacgccacugcacuccagguugggugacagagggagagccugucucuaacaaauaacauaaaauaaaaguauuaaauagaaaaaauaauuucuggaugcacagggguaaguauuguuuuuaaauacuuuucuuucacuuauauacauuuauauugggugguaaugaaaaaauaucuuuuuuuuuuugagauggagucuuacuuugucgcccaggcuggagugcaguggcaugaucucggcuuacugcaaccucugccucccgaguucaggugauucucgugccucagccucccugguagcuggguuuacaggcaugcaccaccaugccuggcuaacuucuguauuuuuaguagagaugggguuucaccauguuggccaggcuggucuugaacuccuggccucaagugauccgcccaucucagccuuccaaagugcugggauuauaggcgugagccaccgcaccuggccaagaaaagguaauuccuaauguggguaacaaucaauggauuugaaugucuuugauuuaggacaacuguaacacagaaucacuuuuaagacuauguaacagaucccucacaauuucuucuuuaucuuaauuucuggauugcuaagggacccucuucuuguaugucuuaucugaacucaaaauuuaaguucagcauucucauacaaggccaaguaaucaaucacuacugagugugguggcuguaacuacuuucccagcagaucaugcuacagaaaguguaucaaacaagcucuucugagguaugacaggugucaugauuacuacuuacaggugcaggaugugcugauaauacaauuuguauaagaauauuaacagucacaacccauacuuacuucaccaucuuuggcaagcuuucuaccacaccucaugcuguuucccucuaguucuucuuuauugauuucuugaggccuaaaaauauacauaaaauaugaacguucauagaaaauaugcaacuaauaauuaaaaaagaacuaugaguuaagaacagaaaaucuugcuaccagauuuaaaaauaaguuuuugugguacagauaaaaauaagaaaguguugauuaaauuuaguccauuauuuuugcuagauaaaaaagauuuaauaucuucuauguuucacuuauugcccugacuucuggacuacuuuuauuagggcucagccaaaccagaguagaggaaaaaaaaccugaaaaauucuauuugccaaaaaaaaaaaaaaaaaaaaaaguaaaagucuaacuacaaguaaaauaagcuaaaaucuauuauuucuguaaauaagaugugacuugauaucaccuaccacuuaauauuacuuguuucacaugcaaaccauuuuucauauaguguaacuaugcaaaaucaauauuaauagaaaauggcuguaaaauuuuaucaguuaagucuuuauuugguucccuaguuuaaaaaccuuaaucaacuaagagaaauacuguuaucuaaaguuguaauaaauaugguauuauaauuagcaucauuauuccaaaugauaacaguaauauaauacauucauucauauauucauucacaacaugaaaugccuagaaauuggguacaauaauagcauauauaauacauaauaaaauaaugaaacaaauacaauaaauaaauaaguguaaauaagacuaauaaaacauauccuugauauccaagagcucaguucaguagggaacuagacauaaauaauaauuauacuacaguuaauuauaauaauauuaauaauuugugguuugugauguuaagcacaugaagaagguacagauuuauugccuaggauuagagggggaucauuagagaguaaauauuauuugugcccgaguggaagcuuguugggugggguggaggugaggggugaauucuauggagggguaagaguauuccaggcagaagaaauaguggauaaaaaggaacuggagcauaacagaaaaccaaaauguaaaggaauuuaaugcagcugcagcauaugaacauaagaauuuagugcacauuuagugcagaugaacaugaaaggagaggaagcuaaagacaucugggauagaaugcugacaguccccacagaucaugcuaaaaaguuucaacugcucuuguagguaacaaguucccaagcauuuauucuguaacuuuuaaacuuuuuguuacgaaaaacuacaaacauaugaaagcagagaaaauaguaugagccaaauuuucuuaccaucuagcuucaauaaucuugaacagcaauacuauaaucccuuaacugucaucaaauaucccuggacauauuuaaguagagaagugacacaguuuuauuucuguuuuagaaagauaacccucuuggcaacauagacaagaguuuuaugaggagaagcccagagggaaauuugacaccagauuauaaccuagcauccagggaauauagugucuuccucacuuuagcaguccugcagcagugagcagaugcuugguaucugcugaacagaacauuuccuaagaggggauauaucauauacaguugacccuugaacaacagguuugaacugcuuggguccauuuauacagauuuuucucaaccaaaaucagaucaaaaaugcaguauuuguaggaugugaaaucuguguauauggagagccaacuuuucguauauguggguuuugcagggucaacuaacugcgggacuagaguauguguggauuuugguauacgcagggguccugaaaccaauucccccaaaaugacuguacuucuuaaggcaaaaaacuaaagacuuauucuagugcaguaucuuagaugagacucuguauuaccucaauaaggacaugggugaggaaaaucaugaaaaauaaagaacauccaaaauuuaaaaauugaauauacagaagaaguaggaugauuuauaaguuacuucauacacuacaaaaugcuucaguucugaauuccauuaaauagcucaucguuacuucauauacuacaaaaugcuucaguucucaauuccauuaaauagcucacuuuuugauuucaauuuauuauuuguauuucaacaaucuuuuuuuuuuuugggauggaguuuugcucuuguugcccaggcuggagugcaauggcgcaaucuuggcucacugcaacuuccgccucccggguucaagcgauucuccugccucagccuccugaguagcugggauuacaggcaugcgcuaccacacccagcuaauuuuguauuuuuaguagagacaggguuucuccaucucggucaggcuugucucgaacuccugaccucaggugauccacccaccccggccucccaaagugcugggauuacaggugugagccaccacacccagccucaacaaucuuacuauuauuuaugcuggauaaauauacugggaauauguuugaaaaaauauauaauuauaaucaaaguagaaacuaggauccuggauaauaaaaaugacauaaucaucaugaauuuauguaauacuuucauacacuuacuguuaggaugaaaacuuauaauuaggucauuauuuaaaaaaauuauuuaguauauaaaaaugaguucaaagagaucagggcaaaaaauuaaacuuugaaggucuuucuguacacucagucucuccacaauaccuauauauuaagaagcuagcagaaggaucaaaucacaaauauaaaaguucugugaacuacaaagcacuauaauaaucuuuccuuuaagaugaagaaagaggauuaauguuuuguggggggagucauauguuuuuggggaagguaucuguaaccagaugguguuuuuuuguuuguuuguuuguuuuguuuuuuugagacugagucucacuuuaucccccaggcuuggaagugcaguggagcaauuuuggcuuaccgcaaccuccacuuccaggguuuaguagagacgggguuucacuauguuggccaggcuggucucgaacucuugaccccaagugauccucccaccucagccucccaaagugcugggauuacaggcgugagccaccgugcccagccuggaugguuuuuaaauucauuuuagacuuaaagaucuucaaaaacuauuuauuacauuaaucagaauuugacaauacuaccauaagaaaaacagauuuaccuagacauaaauauaaaaauuaugcuuuaugaaagcauuaccucaaauaauaguucaguauguugaaagaaaaucauaugauacuaagugaaacaaaguauauauggauuacauguucaauuuuacuaauaaagcaaaugacauuuccauaauugcauuauacuaucuaauugaccagaaagacauuuauaagacugauaauguugcaaaaauauaauaaaaagugauuauaugaucuuuacuucaacagcuugaguuuucaauacuguuaaugauuuuucaacauaaugaaugcauuaaaaaauucauagcaaauuuuuuuaaugaaaaaugauaagguauaauauacuuaccccaccucacuguccuguucugcccgcagcauagcaaaccacugcuguuuauacacagaagagagccauucugaaauguaagaauaaauuaauaauaauaaauaacgacugaagaacauaaaggauuuaaacauucauaguugacaaaauuguuaccauuucuaaauacaaguuuaaaauagcaauuuaaaaauuagguagcuuaggccaagcaugguggcucaugccuauaaucccagcacuuugggaggccaaggcagguggaucaccugaggucaggaguucgagaucagccugacuaacauggcaaaaccccgucucuacuaaaaauacaaaaauuagccgggugugguggugggcgccuguaaucccaacuacuuggggggcugaggcgggagaaucgcuugaacccaggaggcggagguugcagggagccaagaucaugccacugcacuccagccugugugacagagcaagacucugucucaaacaaucaaacagacagacaaacaaacaaacaaacgaaacugguagguagcuuauauuuuacaaaaauacuauaauggcugaaugaucuuuaaagugguaaagguuuuacagcuuugucucaggcuagacuguacuuauuacauugcauacauuuaaauugggauaguuaaaagcauauucuugcguuuaacguuuucccuuucauaguucauauuaauuuuucaauuguaaaaaucauaucugaaacuauauuuuuaguguuuacagaaguucugacagaaaauugaauaauaaacucuuccauuauuaacauaaaaaaacaauuaauugguuuuuugggaaauaagccaucccuaaauucguagaugaaacaugcacacucaauaaauaauucuagaauauuagauuuagauaacauaaaaauuaaaauauuuuaaauuauucuaaauagaauaaaaauuguaauuacagacauuccuuuaauaauaaauauuuuucccacaaaauaagccuguguaaguggaaacauuagcuauuuuagauaaaaacagauuaaaaauaagaguaggccaggugagauggcucaugcuuguaaucccaagcacuuugggaggcugagguaggaggaucacuugagcccaggaguucuagaccagccugggcaacauagugagaccugaucucuccaaaaccacaaaaauuaggugcgugcaccuguagucccagcuacucaggaggcugaggcagaaagaucucuugagucugagagaucaaggcugcagcgagcccuggacaugccaaugcacucaaaaccugggcaacagagcaagaaccugccucaaaaaaaauaaauaaauacaaauagaauuggcucagcacuauuuaucuuucugcucuuguuuauucccaacuagaauggguaguuuuucuauuuuuuuuuaaguucuuaaauuauuucucaaucucuauguaaaagagggguagaaaucguagugcaauuaaaaucuggauugucacuuccuaggucucuacuuaauaaaaguaauccggugacuuccaaugauuuacuggugucuuuccuuaaaacaucccauauauacuuuuuuuuuuuuuuuuagagagagagagacacggucucacucuguggcccaggcugggguccgguggcccuaucuugguaaacugcagccuugaacuccugggcucaagcaguucuccucucagccuccagaguagcugggacuauaggugucugccaccaugccuagcuaauuuuuccauuuuuuauggagaaggggucuccugcuucggccaccuaaagugcugggauuacaggcgugagccaccaugucuggccuaaauacacuuuugaaucuuucuuucaggguccuccaaaauuacauucuugcuauuauaaggaauuuaagugucuaguacagauaauuugucuucauagguaaauacuaguagcaacuauuacaugacucagcacacauacacacauauauuuaaaaaaauucauauauauauauauauuuaaagcugaucccuaccuauuaaaauaccuggaguuugaaacucauugaucuagagauagcauauggcauuucaugacucauuuguaaaauuggaaugaaagagucagacauacguaaauauucucaaauaucauguuagauguaucccauaaauuuuuuuuuuuuuuuuuuuuuuugagacagagucuugcucugucaccaggcuggagugugguggcgcgaucuggguucacagcaaccuccaccucccagguucaagcgauuccucugccucagccucccgaguagcugggauuacaggcaugugccaccacaccuggcuuauuuuuuguauuuuaguagagacggaguuucaccauguuggucaggauggucucgaucuccuuaccucaugauccaccugccucggccuuccaaagugcugggauuacaggcgugagccaccacacccggccaaaaauguuuuagaauuuaaauuccaacaauuuuugcauaaccuccuuuaaaaccaaaagcauuugaacaaguuaaaaacaugaguacauauuuuuguuccucuugucauaguuuaauccaaaagaauaaaaagucaaacuugaaaucuuucuggucauugguagcucaaggauucuaggucccaugucuuaaaagcagcauuccaaaaauaagucaauguaacacaaguucaaaugcaauguuaauagcauugcaaaaggaaaaaaaaagaaucccugguaaaauaugggaugaaaauaagugaagcagguucuuuuacacagaguuuucaauauguuuguaugcaaucaucuccaaaaaggaagaaacacuaggaagaguuugccagaacccuuuuuggcagagagcuacuguuagcuggaaagauucugaaaaagugccuucaagaaacuuugacuaaguagacuaaauuuugacuaaauaguaauauguuuccgcacuuauuuuaaacuuuaucagaccaagguccaaaacaaaaacucaaaauaggggcuggguacagugacucaugccuguaauuccagcauuuugggagaccgaggcagaagcauugcuuaagacuagaaguuugagaacagccuggguaacauggcaagacucugucucuacccaccugccccuccccagccugcagggggaaaaaauauggacauuucaaggugguauuugacagcgucacggaucugaucugcagcugugaucuagucuacagcaguuuugaauauaaacccaguauuuucccaauggaauaaaugagauacauuagauugaauuuauuuagauuauuucccuaguuuuacacaaagaauaugggaaagggcccucuaaaaccauauuauuugaaaaucucaugucuuacauucacaaacuuuaaaaagcaaaaaaaagauacuuccuaauuugcccaguauuuuuuguuuaagugaagggaaaaguguaucuucagguauacauacacuaacaugaauccacuuaaaacuaauauggcuuauagcaaaaaacuaagccuacaaguugaacaacuuaugaaacacauaaauuagauguagauaaugaagaugagugacuaaacauuuacauaguaaaaauuccuacauggacaaauaagaguauucuguauagaguaucuagguauaaaauauuaacacaaaauuauggagaagccugguucaaaaaugcuuauguauaauaacgucaaaaucuaguucugaagcuauuuucugaguuuauuacauggauuuacauaccuuuucauuuucaguaacuuauuuucacaaaacugacaaugagguaauuggguagaaaguuggaacagaguggcagaaauugauacaauugcugaaggaaaugaaaaagagaaauaaugaacuaaaaguaguguaagaagucccaagguucaagcuuaguguugaaaugugaauuugcagugacaccaauacaaaagcuguaggaugaucugcaguacucagcacaaaguagaggguauaggaacaaagaagguuuaauuuaguucuaggauuuugccaagugaaggacacagaguugaagacaacugugagagugaccuaacaugaucuaucaugaaauccaagccugagagggaagaaaagacaggagagguuugaaagacuggcagaaaaugaagggcuuaaaauggguuggaaguuaaagagcaguguaaaagggaaugaggcuaugaacaugcuaggcuauauaauagccugaaaacuaccagguuucugaugcugagaaauucuggguucacaagguucauggcauauccagguuuuaggaagaaagugccuaauguuuggcaaagaggucaaauaacuaggaggcugagagcugaggucaaaaaacuacuaggaggcugggauauuaaauguauuuguucauauggacauauuaugugacuggauugggggagaaauagacaguaaaauaagugucuaagucuuaaaugaaugcaaagaaaugauuaggggucagaagagaaaacaggcucagauggcaugcaauaaugguuuggaaagugcacacugagggggcuaggacgguggucuccuggcccuauauuaguagggugugagagccagaaagucuucuacggagggaaaauagcuuauucuggaaguuaaaaaaaaaaaaaaaaaaaaaaaaaaaaggagggaagagauggaagauuuuguugucccugguuccagggcauauaguagaaaggucugggaggaauaguaacaagauaggucagagguauccaaguggaggaaagcaugacaagaguauggaauaagacaguuaaugaaccuaaugaccuaagauaaaccuaauuccaugaaauaauggaguugaacugugcuugacacaguugaauccuaaaauaaagugcuucuauacaaagucccaauucaacuuuuaauuaaacaugcuucuaaauuuuucaccuaaagaugguaaacagauguacccaaauuccccauauugccaaacgccuaacuuugauuaacguuaacacauguuuggcacuauuucugaaaaaugaucaaguuuuagguugauuaaucaaaauaauuucaacuaauuucaaaucuaagauaccuuccuacugagagcauauaucagccuaucucaauaaugugaauuagguggcuuccuucugucucuucacaaugugauaaauaauuaucuguaagauacgguaacaaugacugaaaucugccaaaaaauacaggaucuaaauucuuucugauuuuauacugaacaaaauauuuuagacuagaaauacuuguacccaucuugcaauccaaaaauauaaagcuuauccacuugcaucacaggcacacuuaaauuaaacuacuuuagaacagacuuuuccccaaucucuuacaaaauacauuugcaaaaagccuuaaaaggaaguacaguuagagcggcauauguaauuggcuuuggcaucuaacauuacauuauugcuagggccugguauuuaacagauacuaaaacuauuauagaacugcuauacuauaagcaauguaaaauucagagaauuugugacuuaaacaguaucuauaaacuugcuaaagugauuuuauaaaaaugcaucacuuccaaauauaccagaagaguuaacucuaaguuuuccuucccuucaauuucuuuccaaauaaguauacagauaucaggaacaaaaaucuauaaacauauagcuaugucacaauuaaggugucaaaaauaaucacaacuuuuuagacaaaucuauaauuauuacuacaaacauuacauguaaauguucaaacagaaauucuauuuucaauuuuguauauguauauauaguacuaaauagaauuauucacaagcacuagagauuuaacucagaaagguaaaucaguaguuauuucaaaaaauuuaaauuauaauuagcaaagacacauuugcuucaacaugaaguuuaagacuuuagaauaagaaaaaaucaaaauaaacaaauuuaaggagcacuaauagaaaaaucacuuaugaucuuuaaauacuucaaaagucauuuuaaaaagucucauccaaaaucauguacugguuuauuaaauuaaagaacauccauauuacagaauacuagauaaucauuuaaauauucuagagaguauuucaugaaauaugauaugggaaaauacucaugauauguaagcacagaaaauuacuucuauaggaugauuccacuuuggcauaaagauguauaccuuuuugggauuaauaauaauuucuacuucuuuccuuguucuuuucuaugaucuauauuacuuuauaaucagaaauauauuacuuaaaauuacaaauuauguucucuuaccugaagguacuacagcaucuuguucaauaauucuugcagaagccagaucacugauaauauauuguaaccuuaaaugucugaauacugacacaaaugguuuuccuuguucaguuucaagaaaggccauaccuucaaaaucuauaaaaaaccauguaaguuaaacagccauucuuuucaaaccuauuauucuuaaauguuuuuguggacgggggauacguacauucaugucuauuagaauacaaaauaagcuaguuuuaaaguucucaagaauuuuauaaaccuuagguuuacagauaagaacauaaggagauuuauuuuaaaaucccaggaaauuaacuuuggucuuaaugaaacccccaggcugggaauucagcuguuucugggcauuuggcauguauagugcagcaaguugggaaaggaaggcuugagaaagguacuuaggauuacacauucucgccagaaucccccucccaagaccugaacaggccagugaaacucuggagcccaaaagccucacucaaggauaagguacacaggacaaagaauaucucuuaauuucuuuuaacuuacauuucagcuacauguaaugaacacuaguuaauauauuaauucucuauugaaauacaaaauaagaaagacacuguauggcuaggcgugguggcucacgccugugaucccagcuacucaggaggcugagguggaaagauugcuugagcccaggaguuucagcuugcagugagcuaugauugcaccacugcacuccagccugugugacagagcaagaacuugucucuaaaauaaguaauaaugauaauaauaauaauaauaauaauaauaauacugaaaauagaauaauuuggcugggcgugguggcucacgccuguaaucccaacacuuugggaggccgaggaggguggaucacgaggucaggaguucaagaucagccuggccaagaugaugaaacccugucucuacuaaaaauacaaaaaaaauuagcugggugugguagugggcaucuguaaacccagcuaacugggaggcugaggcagagaauugcuuaaacccgggaggcagaggaugcagugagcugagauugcgccacugcacucuagccugggugacagagugaaacucugucucaaaaaaagaaaagaaaauagaauaauucaaguuuaugaaguauauaauuuuuuuucuuuuagggagaauuuaagguuauuccuaaaaauuacccucaguuacauuccagugugcuuucaugagucagaaggaaagguuuagaguuacugcuaucaaacagguauuugugcaugagcccuagucuauguuuucuguuaaacgacauauacccaggagaguauguauacccaguccuguugcuauuaaggauaaggagaaaaacaugacaguugccauuauagacuauuaugucucaaaccaugcuucacauggaacacagguuuucuguagaccagaagguguuccccacuaaaauauuuuuuuccugaaaauuguaaaaagacagccaaguuaaugaaaagaauuuccacauuaucucauauauuuuuuguauucccuuggcaccugccuagagucagcaaagcaaacaagaaagcaguaaauucauuaaaaaauuaauaguuaacuucacuuauuuauacaacaggugugugacaguggauuuauaucucuugaguuuaaaaauaacaacauugguuccaguucauauguugaauuaaaugugccaauuucagggggugugcugagaauaccauuuuguuuuuacaaguguucugucacaugaacaagauauaaaaaucuaauucuggauugucucauagaaaucuggugauucuaacucaugaagccuuuucgucacggcuguagaagagacuggcucauuuacuucuguaagaauuuauagaaccaaaaaaaauguuuuaaaguuucuugcuggacaacauguggccauacuuauuccaucagccaaauucaauagcaauccuuaaguauaauuguguagaaaacuuucuaaauuucuguuguuucuuguaguccugauccauauagaucugaaaagucaaauaauuaagaaaacuuaaaagaaauauacaaaaauauauggcaggugugguggcucaugccuguaauccuagcacauugggaggccgaggcaggcagaucacucgaggacagaaguucaagaccagccuggccaacauggcaaacuccaucuguacuaaaaauacaaaauauuagcugggugugguggcaugcaccuguagucccagcuacucgggaggcugaggcaggagaauugcuugaaucugggagguggagguugcacugagccaagaucgcaccacugcacuuccagccugggugacagagcaagacucugucucaaaaaaaaaaagacagacagacauaugccaaaauauaacgagugagggaucacaggugauuuuucuauccuauuuccuaaguaugcaucuuauuuauaauuuuaaaacuauugaaaaugacucuguaaaaucuucauagaaaaacaagagcaucagacauacauuuugguuugugcaaucaaugucuccuugaaaaguuaucuugaacuguauacuuucacaccucaggggcugggagggagagccucaagugggaauccagaaguggaccacagcuugcuucucuaguuucugccacuuaggcuacagggcaauuucucuuuugauugauugcugugguggaucuaucuggagcacaaaugaucauaagguucuaucaacauuugccuaauaucuacuguuucuacugagucucuuugucuuuuuaacuucuucaccauccuugucucuuucagcuuuucucucucuucuauuuaaaugcuuuccccuacuuuucuccucuauaauuucccuaguccuucuuuaauugccauaacguaacacaaaaguauaauuuaagauacaaguuuaguauuuuuguucuucaaggaaaucaaguuauauuucacugauaugguucuuuacacauuuuuacuucaggaacuuuauagaaaauuaauuuaucuggcucugagguagguaauuugacuacauaaaauaauucuauaaaauguauuuaacuaagauauaaagagcaugaaauuuuaaaacuaagaauaucuauucaucaaaagacauuuuuuuuccuuuugagacagggucucacucugcuguccaggcuggagugcagugguguguggccauggcucacugcagcccugacacccccagggucaggugauccuccccccaguagcugggaauacagacaaguacaugccaccacgcccugcuaauucuuuuuuuuugagacagaguuuugcucguugcccaggcuggagugcaauggcgcaaucucggcccccugcaacuuccgccuucugguuuccagcgauucuccuccuucagccucccuagcagcugggauuauaggcgaccaccaccauacccggcuaauuuuuguauuuuuaguagagacaggguuucaccauguuggccacgcuggucuccaacuccugaccuugugaucugcccaccucagccucccaaagcgcugggaguacaggcgucagccucccaaagugcugggaguacaggcaucagccuccgugccaggcugcccugcuaauucuuuaaacuuuuuguagggacagggucuugauauguugcccaggcuguccuugaacuccuggucucaagugagccuccugccuugaccucccaaagugcugggauuacaggcaugagccacggcacccaaccaaaaagacaucuuuaauaaauuaaaaagauaaccuacaaacuggaagugcagaacauauguaugacaaaggauuaguuaucaggaauacauaaagaaugccuacaaaucaauaagaaaagacaaaucugacauuaaaauaggaaacauaccugaacagauaucucacagaagaggaaacauauggcuaauaaccauauuaagagucauucaaucucuuuaguuauaaaggacauuaaaauuaaggccacaaugugacauaguuccauaacaacuaaaacaaaaugauauauuauacaguggcguguugcugcuagcucauaggagcugugugcaucuccuuucucauucagugaugucauguugguagcuugcaaucaaucagccaugaugggaaaauuuguaccaugggaauuaagaaaugguacuaaucaaggauuauuuuuucagagucagcuuauuagcacaccacuauguaauauauguuaagacguauauacauggugcaauaauauauauuuauaaagcaaaagaauaaacaugaaguucaagauagugguuaggaaaagucagagggacacaauagaaaagaagcacaugaguuaagacugaaguuacugauguucuaguacucaaagauuaggucacaaaggcucaacguauuaaaaauaaaccaaaaagguggccauaaacuaagaaaaucacgaacuaaggauuuauccaguucuuugcaccugacagccguaaaaaauacuuuuucuagauauguuuuagcaaaguaaaaaauaacauacauacauuuuaacuuaguauacacauguauuuuuuuuauauugcaugcccuccuuugcacagauaagaccuuauagcaguugaucuuaaccaauuuuagaucagucuccacuaagaaucugacggaagguauggaagcucuccucucacaaauguaugcagcagcacacacacauaucaaauucuguacccacuuuugggagucagugacacaugaaagccuaucuauggccccuauguuaagaaugguugccugacgggguauagcuuguuagagaaaacucaguguggucaagacaaaugcaaucaacaagaucuguuagugauaaaaugggaaaaacaauaguuuuuggcgaucaagaguaugaugacaguucaaggaguaacaauucagauaaugauaguuaagguauuuuucuuaucuagccuugauuuucucacuguaaaugaggggugaaguagauaauugcuaaggucuucuccaagcucuaaaauuaagucuauaaacaagucagggccugauuucauuuaauuaauuaauuuauuuauuuucuguucucauggggccugauuuuaacaaauuuccuuuuaaaagacaaguucucaaaaacuucaggccuaccuuuccucuguuuagaaaaccagacaucuguuucugucaaaagcuguuuuaaagauccauuccaagaaggcacaaguugaaggaacauccacuaaguuaaaaaaaauuaaauaagaaaacaauuaugaaauuucaucauuuuaugauuuuacauuuucaaauugcuuucaccuuaaaauauaauagcuaaaaaauuuaacuucuacuuuaccagcaauugcaagaaagaaaguacaacuauaagcacucaauuuaucauggcauuaucauaguccaauggcugggugcuguggcucacaccuauaaucccagcacuugggaggccaaggugggcagaucacuugagagagguuuagaccagccugggaaacauggucaaaccccaucucuacacacagaaaaaaaacuagcugggcauagugguaugcaucuggagucccagcuacucaagaggcugaggugagagaaccuuuugagcccuagaggucgaggugcagugagccaugaucgcaccacuauguucuagucuaggugacagagcgagaccuugucuccaggaaaaaagaaaaaaaaaucauaguccagugauaaaaauuggaugugugugcuaaggaguaagccaauccuucagaaguauuuaugguaacacacuggagauuacuguauuaaaaagguaaagguuuaauauauauguauauuaauuagaaauuuuauacuaauuuauucuacuaacaacucaauuucacuaaauacuauaugagauuauaaaagcaagaaaugaacaugggaaaaaggagcuucuuugucuuacugcugcugagauaauacgcagaguagguaagagcaaaaacuuuuaaauccugaaccuggcacuuaagagccgggcacauuaccuaguaucucugggccuuaauuucuucauuuguaaaaugagcaugauaauauguuuaccucauaggacauuaaaauauuuaauauacauaaauacuuagaauggugcacggcacguaaacauccuguaaguauuaguacuuaccauuacuggcaaaaagcaguuuuaauaacagaaaugaaugccacugugacaacucacugcaggcuccaccuccuaggcucaggugauccucccaccucagccugcugaguagcugggacuacaggcacgaaccaccacacccagcuaaucuuuuguauuuuuuguagagagggguuuuugccauguuacccaagcugaucuugaacuccaggccucaagcgauccgccagccugggccucccaaauugcugggauuacaggcguaagccacugugccugaccucugcaccaauuuuuuaaaagauuggauagcccagauaguaaaguuccuugaagaaaaacaguaacaaaauuucaccucuaccauagaaacaaacaaacaaagagucccuaugagauaagcuagaaagugucucagucugaaguuucacaacuguguuaaauacucacaacacuguuuugcggacaaaaggguaaaggcaggauuaugcaguaggaagagggcaauggacuaggacucccaagacccagucucugccucaaaccugcucugagucucacuaucuacauggaagaauaauggcugaucugugucuucaaagaguugugaaaauaaaauuagauuuuuuaaauguugaaacuuuucaaaagcaugaaguaaaacauaugccagacacacaaacaggccuuuaaaagaaaaauuucaacauuucuuagaaaaagcguguguaaaaaugccaucauuaacugaagcucaacuuugaaaacguuccuaaaaacaauauaaaacauuuuugauuauguaaauaaacaaauagcaauaacauauuuuuuguuaaagaaaagucugggaaaaaacagaaaaguauuccuaaaauagaaaaguacaaaaaauaaaguuaaaaucacuaaugauuccaaaucccuaaauauaaagacuuuuuaagguuucggccuauuuccuuuuccuacauuuauaaccaucccuuuauuacuggauacuguuuccaguuuuucaccauuauacgcauugcugaggugacauccuuguauaauaugacaucauauuacgucaguaccuuuuuuagagcaguguauauauccaucuccacuugcaucacaaauaaguuagaugaaccaaugagcuguuucaugacauuuauacugaaaaggauaaauagagggagugagcuuaucuuuaggcacaggcuaaaggauccugguagaaauaaaagcuuuaagucuuucuuguaaaaaaauauguggaauuaaaaaugacagcaguccuucugcccaagacaaagaaucuuagaaaacaaucuaucuggauacaaggauacuuuuaauucagauagugcaaucuaucuggauacaaggauacuuuuaauucagauagugugcugugaaagguccuuuucacacugauagggaaacaaagagcucugaucugcugauuaaucaaguuaaagcaagguuccgguaagauaacuuuaaguaugcucugauaaaauggcagucuuccucuuuugccuuccaccacuccacuucuacguuuuguuuuguucuuuaaaaaaaggccaggcauaguggcucacaucuguaaucccagcacuuugggaggcaggagaaucauuugaggccagauguuugagaccagccuggacaacauggugagaccucgugcuaccaaaaaaaaaaaaaaaaaaauuagccaaucauguuggugugcaccuguagucccagcuacucgggaggcugaaggggugggaaggaucgcuugagcccaagagguggaggcugcagugagccaagacuguuaccacugcacuccagccugggcaacagagcaagacacugucuccaaaaccaaaaaaaaaaagacacuaaaacagcuauaucgucaaaguaaucuuuaaccucuaggcuuaagagaauugcuuagucauaaacuaugguuuuaguacuauucaagacaauaagaucaagaaacgugcuaguuauuuagagugaaaaugauaucaccaguuauuuguuuuguuuugcuuuuccuuuguucuuucuuuccuuugagccauaaaaagccaagagagcacguggguuuuuaagaggauccugcuccuuuuucaaaaaguucagugagaaauuagagucaucccccuguaucugugggggauugguuucagaaccuccuacaaauaccaaaauccucuaugcucaagucccuuauauaaaauggcauaguauuugcauguaaccuaugcacauccucucauauacuuuaaaucaucucuagguguucuuacaguaccuaauacaauguaaauguuaugcaauaguugucauacuacauuggguuuuuuuguuauuauuuuuuauaguuuuucccccaaaucuuuucaaucggcaguugguagaauccacaaauggagaacccauggauaagcaggguugacuguauuaaaguguuucuaacgauuuucaaaucaaacauucuacggugauuuauuuaugccuugacaucaccaggugaugaaagucucucacacuucucuaccaaauuaucucguaaaggcaaaagaaaggaaaaaaaccccauaaucuaggagguggucuaaccauaaaaaguaacauuucuauaaauuguaucuugagaguucaaggaaauuugaauucccucuauuccauaauguauuuaaacauaaaaauauuuaccucuuccccaccuccuccccaccaaaaaaaaaaaaaaaaucaguaaaauucacauucugggaagcuauguaauguuugacuuugguuuuguacauuuccaucagaaugucacauacucucggacacauuuguauccuugucucagaagcacugcugucagggaaaugcaagccagaaaaugacuguaaugccaaccagccuucaaaaguuaacugcuagccagauuuucucagacccaucacaaauaucuuagucccauuacuacaaauaagcucuuugacagcaagagaccaugacaaaaucaucucugcauucuucacagccccuaauagaguaucuuuacauauaaaggacagucaggaaguacuugcugcaggaauaaauggauaauaugcguacuuaauccaaaaagccaaacuaagcugggugcagugguaugugccuauaaucccugcuacuuggaggcugaggcaggaggacugcuugagcucaggaguuugagucuagccugggcaacauaccaaggcccccaucucuuuaaaaaagaaaggcugcucugcagcuuggguggugggcagggugggcaguccucauugucaccgccauauuucuuguagguuuuuagaacccuggaauccauuucucacgggugacugcgguccuauuauuccagcuuggacuacauaguccacaggugauggagaaaucuuggaccucuggcuccaucuccaggaccucuggcucugcgcugugcugcgucugaccaggucccgcuugaggacgaaggcggcgcaguugacugcaggagccucugcagccccagccugaagccugcaugggacccuguguggcgcuaacagguuuuuuuuaaaggaagauugauauuuucucaaagagaggggaugucacuauguugcccaggaugaucucgaacuccuagauucaagcaauccucccaccuuggccucccaaagugcugggauuauaggucuagguuuucccaaaucgcuuuucugguagagaaacccugaggacugauuggcuuuugcuugucuaaaaccauggccugugaauuuguaacauucagggacauggccacagacuucucucaucaggagugggaauaccuugaccugguucagaagaccuuguaccaggaggugacggugaagaaccaugguaacuugucucacucucacugaggcuggagagcagugucgcaaucacagcucacugcaaccuugaccucuauggcuuaagcaauccuccugccucagccuccagaguagcugggacuacagauuuggauucaaggugugaaauaaucagagauggaaaaauauacauuuauaggagacacacauuuguuacuccacaucagagaauucauccuagugagaaaacggaucaacaugaaaaguuuuugaagguaaaaaaaaaaaaaaaaaaaggccaaaacaguuucuucaaacuuauuucucaauaaaaaagaugauuuuuaaaauauaacuuuuaaauucucuaacagccuggcaaaaccugaaacuuuucuauagucuuauaacaguaaugcauuuuucgguuaaaacaguagacauaauauccauuauauuauucacaacaaagaaauaaguuugcacagcauuucuucaguuuauggauguagucaagcccuuucauuaaauuguuugcuuuuucauaauauauuuuuguguucuacaaaaauguuauguacuuuaacaaaugauaaacaauauuuuaggaugacuaauuaugaaguuacuugaaauucaaauaccugaguucuuuaaaaaguucaacauucuggugagucaucaaauuguuuagaagccauucaaggcaccugaaauuaaaauauauaauuauuacauuauaugccauguauuuacaauuuauuaaguaggacuuauaguuaaaauaaaaucagauuaaucuugccagaacaugcucaaaacuuuuagcuuaacaauaggaaauuuaguauuauuuuugucaguggauauuauuaagagaauauuuccuuuauauuaacgagagcauuuccaguuuuaaaacuucauuuugaguuuguguuaaauaguuuauuaaggggucugcauacuaguauaaccuucuuuaaaaucucaaaacagguacugcaacucucaagaguuagaaggacugucagucuaucaggccuacuucuuaaacaauuuuaauagaaaauauacuauaaagugcaguggcaugaucacggcucauugcagucuugaaccuccugggcucaaagaauccucugaccucagccuccagaauaguggggaccacaggugcaugccaccaugccuggcuaauuuuuaaaauuuuuuguagagauggggucucccuacauugcucaggcuggucuuaaucuccugggcccaagugaucuuucugccuuggccucccaaaccacugggauuacagguguuagccaccacacccgaccaaggugaccaugguuuuuauaagcauguauauaacccaccuauggucacuuacaaagacgacacuuuugaggaauuuacuaauuaguccaaaaguuaaaaggggcuuuuuauuuaauaaaauuccaucccccuauccuauuuuuccuuaauucuuucuuucuuauagcuauacauucucuuaagaaacuaaagcaaccaaauuccuaaaagugggauaggaagaaaaacaagaaaggcaacucacuuuuucuuuacagaaucuaauccauaggucccugcugauguguaauagccacauacaguuuucacauuaacuguuuccuucauugucucaccacacugcuguauuaaaccguccuguaaauauaaauaagcacuggaaaggcccauuucacgugggaaaaauuagcucugacagcuuuuacauauuaaaaaguaaaagaaaaaaaaaaagaagaaagaaaagaaagaaaacucauuaagugcagcaaaccuaaguuuuuuuuuuuuuuuuuaacaaguccaauaaaaauacugaaaaaaguucagcaaguauucaacuaaauacuuggaauuugaaaauggaaggugggggggaguaguaagguagagaaugaauacugcuauucuuuuucuuuucuauucuuccccugucugagaccuuugcaaauuucuuuagcagcauuuugucuguuuugccauuucuuuuuaaauuaagaagucuacauagucaguuaaccaugugaugggacuaaacuaacaguaugcauuagcagaaagugaucaaguuuaaaauaacuacaauaucuaagagauagacuuaaaacaaguauauuauuauuucaaaugauuaacauuaaaguuuuaaccuaaaauguuuauauagguuuuaagugaacuaacuuuaauauaugggaagaauacuacuuuucauucaaauuucugaaauacauucaucaugcagguauauuaaguuaaagaguuaguaaaucauaaaaguaagcagaaggugaauuuagaacaaaaccaaaaggaccagaguuagauaauaaaguauacuuauuggaaguaaguauugaaaggaucaaaacauuuugaaaaucaaaugaucucaaccaaggauauuuagcaagcuauuaauacuucaaauaaaucaguacaaaaauaccacauaaaaguaaacaauuuuuuaagauuaaaauaaaacauugacuccauuaggauuuuaaacuuaccuggaaaucauucuagacuccuccccuuuccucuuaacauuuagucuaucaccaaguccaguggauuaucccugaaucucucugguauccacuuuuuccccuccaagcuuauugcuacuacccuacuuuccucccuuggacgaaugcaacaaguuuuugucucuaaugcuguacucaucuuuccuucaauucaucugucacauuguuacugaaguauucuuucuaaaacauaacuucgucuuuccccugauuaaaauauuccaaagguacuguguaugcuaaacuucuuagcaauguauagauguauuuucaugaucuggcuucugccccccucuucugcaauccuucuuauguuuaugugggagccauguuucuguuagagucuugaauccuccauuauuucacaucacuagaucuuaguuuacucuguucucucugucugaaaugcucuuccuuccccucuucuuacuuugcaauacaaacacacuuucaagacucugugugaaaauguaacuuucguaugugacaccaccaggaugaacugaccacucccuucuuuauccauucacuaaaugcuacaggauguuuauuaucauaccuauaauauugaacagcucuuacuuuaccuuuggguuuguauaucaacccucccuccccucuccacacauacauacuauguugugaacuuuuugaaaguaaggauuacgucuuaaguuaccuuuggcuuucugugucuaguuugacacagugcucaacacacuucucuucaaugaacaaaucugucauucugccaguagauuaaaauacauauaugugauuuauacacaauucuuucaaaauuaagagaaauuuaaauaguaggcaugcauguuuauuugaacccaugaaugaaauuaauugguaaucauaagccaucugcuuaauagucaagucauuaaugaaaucuguaaaugaccuuagacaaguacguuuuuuccacauuauagucauacuaagauaucuacacagaaauggccugcauucauuuuaugcagacaucaugacucccucgguuguaauaaauugcuuuugguuaggcauuuuaaaugauuuauaauaaaugucauauuuauacauuucauuuuuauuuaaaaacuccaaaaaagcuaagcuuuauuuuuguuuuuggaguacacacuuugagacaaagauuauuauucugaaccuuucuucgaauaacgugcauacuuaccaacugcagcaaacaagcugcugccaaaauggcaacaacucgacugggcuuuaucaagacaucaucucgauacagugaaccaaaugcaaccugcagugcugaaagcaagguacacauguaggaugaaauaauauuuauaucuauuacaaguguuauacaaauaacaacaacgacugucuucacacacaaagacauccgucuaaauguggcaugcacauaaaaggauaacagaaguaucucuaauuaaaacgcuaguaaugguuacugguugacacuguuaauuuaauaacaagguuauaaauuucuguuuauucuaccaaaucuagcugcauucuucuaacauguaaucuugacaucaguggucacaaccaagaugccuugcaagaaguuguauaagauacuccucaguagaccaaucguuaaguacaaauacgcagacucaaagauaaucuuaacccggcugcuuucagcacuccaccacugagaaaugugguacagcuccugaguccuguccaugccacacucauucccagcccccacagugaucuaugccuguucauccuuccuccacugccacuguuaugaaugucccacaugguuugcuuuguaaauauucuuuuuuuuuuuuuugagauggagucucgcucugucgcccaggcuggagugcaguggcgcgaucucggcucacugcaagcucugccucccggguucacgccauucuccugccucagccucccaaauagcugggacuacaggugccugccaccacgcuuggcuaauuuuuuguauuuuuuuaaguagagaugggguucaccauguuagccaggauggucucgaucuccugaccuugugauccacccaccuuggccucccaacgugcugggauuacaggcuguaaauauucuuaacuaaaguauuucuuugccuuuguaucgcaccagguacuuccauguggaccaccaaugaggggagcagcaagagcacuggaaugggaaugaggagagcuguagucugacacaggcucacuaaacugcucugagauccaaaauaagucccuuaacuccucugagccucagcuuccucaacuaaggauucuuuuagcucuaaaacaauauuuuuauuuauuguucccagaaaacaucuucauacauagggaauaaucaguauuauuuaucagauuuucuauguaauuaaaaaaaaaaauggucauacuuuuccuuccuccauccuacaucuuccauaucccaggugggcauauuuacaaagauaaguaaacaaacugauaaggcccaaaugacaaaacagauuagugauaagauggacagaacugauaaacuaugguguaaaucaacaucaaauuaucaccuugaggugauaaaaggaguuuucuagacuacaaggcuggaaggaauuauuuaucuucuaccagaagaauaagauuauguuuuuacgauuguugcauaauaguaauuauugugguaguuaccuucuacaucaauguucuggucaggaaucuccaguucaauaauauucaugcuggauucuuuccaagaaccacugaacauacuagaaaaguagccagacuuaaacaaaaaaaaaagucaacgauuaucaaguacuuucugugucuuccaaauuauuugcccauuucuaauucuaagcaacuauucuauccauuaacuaaacucauccauucuauuacuucaacagaaaaagaacugccaaauauguccacaggagaaaagaaauuaagauaaggacacuauuagguguaucaaaauauacuuuugguuuaguacuauuuuugacaaaaaacuaaaauucuuauauuacuaucuaaauugaauucauguauauuauuugaaccugguuagcuuuuuacucaaacuguugaaucuuuacuguacaccugaauggcuauaaaggaccaaaccagucccaagucagcaaaaacaggaugaucgccaaagaaaccagggaaaauccaaaauuuaguuuaaugagaaauguccagaauggaccugaauucuuggaaagguacagaaugaagucuuuagguaucugccagauagcacuccucauaauuagaauuacuuugaaauggaucaaauauuaacuaauuuauuuaaaaauguuacugaguacuuaguauguagaaggcacugugaauauagcaauaaacaaaaucgauauuguuucuguccucagggggcuuauauuuuagcauguggcuugaauuauaauacaucuuccacgagggguaaaguuuuaacagagguauucuuacccucaaguucacaaaacugcuuucagauauuaaaaagaaacaacaugaaucauacccugaaguuaaaagcaauauucugauauaguaucugggcaacauacuucaagccaaaauaaauuuguuucaaaaacacauuuuaaaacaugauuaaaauguuagagaaggcaauucauuuucaaauacuuuuacugaaaaauuuuauacuaugcugucuuaccaguaauuauucucaaaugguaaagaggaaaaauguaaguuccaaaggauaaaaacuguuguuuuauuucuagugccucaaacaauaccuagcuuauagauuugaugaaagaaaaugaauaaaauauuugggccauuagagcaacauuguauucuauuuugaaagcuccgauuuuuuuuuuuuuuuuuuuuuuuuuuuugagacagagucucgcucuguugcccaggcuggaaugcagugguacgaucucagcucacugcaaccuccaucucccagguucaagcaauucuccugccucagccuccugaguagcugggauuacaggugcccaacaccacgucagcuaugaaaguucugaauuuuuaaagugggguggcagguaguaauauuuucaguacagaaaucuacuuagucuauauacuuuuugguguugucuuuaccugcauuuuucaggagagaacuuucuauucacacucaaugugaacuacaaagcaacauuucagaugaguuuauccaauuuaaauaaccauaagcaaaauaaacacuacaaucuuaacuuuaauguuaaauauuuuuuccccaacuuuuccccuuuuaucaacagaaggcaccgaaaaaagcauuuuaugaaguaaugacaaauacguaguauuaggcuagucugauacugaaauaucaaaaucucuuucuagaccaaacuuaguuuucacuaacaauguuugccauuuuucuuacagacugaucaaaugagaggauuuaaccacuaugguguucaugcaaaagauuacugugaagugcaaugaggaagaacaugacuuaagaguuucagugacuacccuguuacucaaauagaaaaaauacuuacuugacauaaauauauuuuguguaagcuccauucuucuccuagagcacaaaucuuaaugucacuguuuucaccauucaaaaauaauguuugauaaauauauuuagauguacucuuuaauuuuuuccuguuaaaagaaaugaaaaagucacauauuuauauaaaacugaauguuuuacugauuuugcauauauuucuaaauacuccuuuuauucaauuucuauuaaauagagucaacuuaccuauuguguaaaaggauagggagauaguauauauucaaauuuucuugugucuagaagaguacauaagaaacuaauaauagugguuaucucugggguccucuaugcacgggagagauaguggagaaaggggggcagcaugggaggcagacuuuucacuacacauguuuuagcaauuuuggacuaauuuaauuacccauucaauagauuaagaaguuagcauguugauuuuuugcuuauuuccuuauuuagaaaccagcacuaugaaggagcucaaauagcgcaauaaucugcaaguaggaaauggagaacaagaguaaacauuucaccuacccaaguaauuuuaaaauaauuuacauuuaaucuuauuuugguaccaaccuauucuuaaacuacuuaaaauguuuuccagccacuggacaaacgguuugcaaccuuagaucaaagguuuucuuuucuuuuccuauuuguuuuuuaaaauuauuuauuuauuuauuuuagaugaaagguuuuuaaaacugcucaaaggagaagucuuaggggccaccaaggagagcuaaggagugaacugugagcaucccaucuaacuucaaccagagcagcaucaccuauucuaucuguaaacauacuggauuucugcacagauuuaauuuaaaggaagacuugacuaaaaaaauaaaguuugaaaaucauugcucaaaaugauccaguaacuaagaaaaggccuuaggcagaggcugaucaauaucuuaaauuccugaccaauucugaaagcuuuccuagcacauaaaaccuucaaucucuuuuuaaaaaugaaguaauuguuucagaugacauccugaauuggcgaauuuaacaccuguguacuuaacaccucuuccuagccgacaauaaaaacagcacaugucuuagugguaacagacuuggguuugagucccagcugcucaguuaucacagcuguaaaaagaggacauuaauaguauccacuucacucguuaugaugcgaaaucaagagacaauguaguuuccaguuccugacggcagaauguacacauguuggcuucccaucccuccccaaauuacauuaaagauuaagaguacaaaaaaggaauaaguccacaccaggaaaaggugaggguaggcucaucacuugaugagagauuuauacagaucugaaaguuagaaaacaaauucaaaugaaaaagaacagugacagccacagccaaaaaauacauuauggaggacuaggauggaggcuaagcuuaucugcccaucagaacccuugggagaaaagaaggaugaggucucagggaaacaaaggcagaaguaagaagaggggcagaaaauggggaaacuagugccuucuccacucuaugaacacagaguauagauaaggagaguacagauacugaggcaaaaagauuccaagguuuuucuagaaauagcacaaagcuaauggaagaucuaaggcuguaguguagcugcuggugcccagacaaagcaauccucauucugaaauuuaaagaaucuguggccuguucacucccaauccauucacccuaagucaugguucccaaaccgugugugaaauucaccaguucaggauaccaucugaacuuagagcaccacagccaacucagagaggcauguggaguauuuuaaauucgaaggaaacacaguaacaucuuucagauaccaugcaaucugcuaucauuagguuguuuggcccuaacuaugagguauuucuuuuggaccaggggugaaaauuacuaaaauaugaaaugugcugugauccaugaaagcuugggaaccucugcucuacaaagcaugccccaccuauaaccaacuucguagucuucuuacucaaagaagagguacauuggaaauagaucuauuuccucaauuaaaacaccauacaccaguuacuccuucuuaaauauaaguggacaagcaaggaaggaucacccaccaugaggaagaauaagagcauaucagagagacagagagacucccuccaccccuggaaacauauaauucagggaaaagagaggaaaaaaacacccucucaccaguauaccuagagaucugagauuauuauauuuaccccauagacugcuaugauaaaggaucacucagaacaagaaagagcuuuuagagacuaaagacaugauuacugaaauuuaaaaaaacaaauaaaccaaagaauaguuuguuuguuuuucuuccucauguugggugauccuuccuugcuuguccacuuauauuuaagaaugaauaacugauguaugguguuuuaauugaguaaauagaucuauuuccaagguaccucuucuuugaguaagaagacuacgaaguugguuauagguggggcaugcuuuguagagcagagguucccaagcuuucauggaucacagcacauuucauauuuuaguaauuuucaccccugguccaaaagaaauaccucauaguuagggccaaacaaccuaaugauagugaugaaaaaguuaaaggaaauuucccagaacauaaagcaaaaagacaaagaaaggaaaaaagaagagacaggcauaauccaagaaauccaaaauccaguuaagaggcaucccagaaagaaaaaauaaagauaagaagcgaaaggaaauuauggaagaaauuaauggaaaaaaauuucccaaaacuaagguaguauaugagucuccagauuauaaggauccaacaaguaccaaggccauuaaaagacccacacuuaagcacauucuaauuaaaucccaaaauaccaaagaaaaaguuccacaaguuccagagagcaaaaauggucaccugaaaagagaauuacaccagaaucaaauuuuucaucaagacuguaggccugaagacaaugaagcagcgucaucaaagauaugaagaaaguuacuuuagauuuccauacccagucagaggaugaauaaaguaaaagagacuaaauuuauauuuagauacgcacaaauuacccccuuuugcacccuuccuuggaaaauacuugaggauguauuaaauaguuccuaaaauaagcgagaaagaaaugcaggcuacacaaaauaguggauucaauccuagagauggggugaaaguaagucccagcauaagaguagacaaauccagauuggaacaggaggauggaagaggucuagguuuuagagaaggauuccaugaaaguguguuucaaaagacuuuucuguguuuuuucagaaaaacccgaagccaugaugaaggaauauuguuauuuugacaagagugggggaaaggccauuauaaacucuaggacaauaaaaaagcaauacaaaaaaaggcacuguccaaauaagauaaaaacaaaagcagggccugacuuuaagcacuugauggaauacaagaaaagauuccauaugacugugagguuagaaaaauuucucccuuugaacagacaagcaguugugacacuggacccaucaaguaugauuuauaauccuagcauacuacuuaacucuucugaaacaauauuuacuuaguuauaacuauguaaugucguuucaauuuuuuagagacaagcuacggacaaaacacucaagaucugguuguagaacaguguggguuuuaacagucucguaaauguaaaaguagaacaugcaguugacaaagguaugagguggaaguugggccuaaaagcuaaaacuucucauaaaguggucuguugaugugggagagcacaccagacaaccucaggaaguauauacuagggccaacacacaaaauucaacaucuuaauacuuucucuuuuaaauuuuuauuuguuuaguuuuugagacagggucuuacucuguugcucaggcuggagcgcaguggcgcaaucuuggcucacuacaaccuccgccuccugaguucagguaauucuccugccucagccucccaaguagcuaggaauacaggcgugcaccaccaagccuggcuaauuuuuguauuuuuugguagaggcgggguuucacuguguuggucaggcuggucucaaacuccuggccuaaagugaucugcuugccuuggcuucccaaagugcugggauuacaggcgugagccaccacgccuggcccgucuuaguauuuucuuacacccugcauccguauugggcugaauaauccaagcaucuuccaguaauauacagacacuaaauucugauaugcauuuuccgauaaagguuugccuuaaaaacuuuccauuccaguccacucauguagucuaggaguugguacacuuuuucuguaaaggucuagauaguaaauaucuuuagccuucugggccaaaaggccuccaaauaauuuuguuggcauccuaguaggcaguguccuacuugccagccucagcuuaccacacuugagcaaacuuuuccaccauccagugggcuacagccacaccuccuucaacaucaucugaaucuuagcuugggaaaggggugggggcaccuauuccaaauuuguuccuucuguggcuauucugccucagccuuagaaguacugacuacuacauguauuuucuagggaucucuuuaccuuagcguuuuguccucaguaguuaauucucugugccuuguuaauaauguuuauauuaaauuuccuguauucaaauugcugugugauuucucuccuucaaaugcacugugacauauauuucaauaauuacguuaaauauaaguggucuaacuacuaauugaaagguuagauuguccuguuggacaaaagaagcaagacucaacuauaugcuguuuacuugauaucuguuuuaaauauacacagguaaaaagugaaaggagggaaaauaagauaucauucagacauuuaucaaaagaaaguggcugauggauacacuacaaucccagacuucaccacuacuuguuauauacaugugagaaaccugcagcuguacccccuaaauauaaauaaauaaauguauauauguauguauguaugugguaguggcuaaauuacuagggauaaagaaggaugaacauuuuguuaugauaaaggggccaauucaucaaggagacauauuuacugcaugcuuacauucuagacauugugcauuuguuuguucucauauuugucaaagccuaaaaggcagguauuuauaucuccaauuuacauaugagggaaauaaggcuauuaagugcagaauacagacaagaagucagaauuuuuuuuuuuuuuuugagacagagucucacuuugucacccagacuggagugcaguugugcgaucuuggcucacugcaaccucgccucccagguucaagccauucuucugccucagcgucccgaguagcugggauuacaggcagcugccaccacgacugguuaguuuuuauauuuuuaguagagacaggguuucgccauguuggccaggcugguuuugaacuccugaccucaggugaucugucugcuucagccucccaaagugcugggauuauaggcaugagccacugcaccuggccaagaacucagaacucuuaaaacuaugcuauagguuggcaaugguggcucacaccuguaaucccaacacuuugggaggucaaggcaacaggaucacuugaacccaggaguuccaggccagccugggugggcaacagagugagaccuuguuucuacaaauaaaaaaauuagcugggugugguggugcaugccuguggucucagcuacacagaaggcugaggugggagaauugccugauucugugaggucgagguagagugagucaugaucccaccacugcauuccagccugggcgacacagcgagacccugucucaaaauagagaaaaauuuuuccaaaggaaaaaaaaacuaugcuacacugacgcuucaaaaagguuacagggucaggcaugguggcucacaccuguaaucucagcccuuugggaggcuuaggugggaggaucgcuucaacccaggcguuugagaccagccugggcaauauagugagacuccuuuagaaaaaagcuccaaaaaucaaacaaacaauuaaaaaaguuacugaauaguauucacaguagggguacauuuuuguauaauaaauacaaauauucauacaaaaaaagguacaaaagguuuuauaaaccaaacuauuaaguuuuuaaucuaugauuccuuuuuuacaauauauaacacuuguauagcaaaaccuuuuugaaucugcuuuuaaaguuuaauuuuaggccgggugcgcaguggcucacgccuauaauuccagcacuuugggaggcugaggccagcagaucaccugaggucgggaauuugagacaagccuggccaacacgaugaaaccugucucuacuaaaaacagaaaacauuagccaggcgugguggugcgcgccgguagucccagcuacucgggaggcugaggcacaagaaucgcuugaaccaggagguggagguugcagugaguugagaucgcaccacugcacuccggccugagugacagagcaaggcucugucucaaaaagaaaaagaaaucauuuaaaaaauuucaugugugacccuaccaaauaaccuuuaaaaacaaaagcagaaaaaccaaauuguuuguguaagcauauauucuaccuauaaacuacauuccaggucacaagucaauauuccaucuuucaacucauccaaaaaaaaaaaaaaaagggguuaaacaagcugcagcagcaccgcccuacauacaguacauccacggucaacgacuucaucaacuacuagaaacuugcacagacucuguuccuaguuaggaacaaauguacacuauugauaaacuucaccuuuacaauuaacaagaacuccugugugcaauuacuuacccuccacugagugggcgacaauaagagugccuauuucagagauuacauuuagugucuguacuaaggcaaccggaugcaaaacaacuuacucugcggcuacccacuugagagggcaaagguggacugggaaggccagccagccgggcgucucuaagguuuaacgagacgcgagcucgggcuuggcguuucucauccucaucuuggggcuguaacaacacccuggaagcgucugugguugaaaaugcggaacaccuggcgucucccaaggcgcuccccaguccgccccgcaucgggccggcuuccacauucacccugucaagggcacguccccucuccauaggcuggggagcgcugcaccccgcaagcgcacgaggcgccggcucggccccaggcccaacaggugcggguccggguccgcgcgggugcgugcccccacguaccuucgagggguguugaggagccgcugcugcucgucccccuccuccucauccucguccgucuccgagucagggugacaguagcagaaggacccgcugcuccgcuugcgcuuguggcugcccgcacaguaacagaauccguggcccgccgcaucgucuccaguguccggccuccgggccgagccccccgcccuggcacccugcgccugcugggcaagggcuggucuuggcuggcgcagcacccggcugcucaacgaucccaugggucacggcuccccgagacuucagggagcccagagaagggggucucccgccauggcucggccgccgccgccagccuuccccgagcgcaggugccuacaccgccaccuucucacgcgcagccccaaccguugcagcggacgccacagucuccauccucuuccccgcccgcagcguccggucgcgccgcgcucuagcaccgcagcacc

SEQ ID NO: 191649 - RNA, 67486 nt, Homo sapiens
gguugcuggcggagcccgggaggcggagaaggcugucguugccuuggccgucgcauccccgagggagucgugucggcgccaccccggcccccgagcccgcagauugcccaccgaagcucgugugugcacccccgaucccgccagccacucgccccuggccucgcgggccgugucuccggcaucaugugugguaagggggccgggagcggggggcguguugccggguggcgcuggggugcggugcgggugccgcuaaggcccaaggcgacgggcggaagcgggaguguggagggugcgaagucugggugaugggcaaggggcgcccagugguggcugcgggggcgggggccggcauccacgggcgggagaggggguggcggccgggagaaaggcaccugagaggaaggcgggcccccuuugccgggggcuagcgggcgccuuggcgcggagaaggaaccgaaaggggagagaaacgccuuuauugaaaaaggaggagagagcugagggaauugagguguggaggggguugccuucaaaagggcccaccaggugagugaggaaaccuguggaaccucgggcgaggucucuugaacuuaccuugcauuuuucuaaaaaucuuuaaaaaaauauuuuacuuguuucuggggaggcccaauagaaaacagacccuagcuagagccacgguagugccauuaaacgugauacuuccugccaucccuugucucaacagaaaccauugcuaaucaauaacuugguucaugggcuuagaccugauccucugguggaagaggccuucaaaugucuguggcgauagguuauacauaauuuaucauuugcgugugcacccauuaaaaaugccagcucugaaaaauaucaguuauaccuuggauguauaccccuuuagaauaccaacuaugaaaaauaucauuuaucccuugcaugugcauccauuaaaaauacuagcuauggaaaguugagcaaauaucuuuccuagagccuuaaaaaauuaagguuaggcccuuuuauuccauguuuugagagucguuuauuaugaccuaaguguuagugaaagagacuuugagaaucgugucugacaugacugauaucuucuaaaauugguguuaauuuggcuauugccaguaaaaauaauuguauucuuaccuuucuuauugaaauuuacaaccgacuuuaucccuggaagaaaguacacuuuuuuuuuuuuuuuuuaaagggaaguaccauuguaagagaauugaaaacucucugggagacuucuuauuugcagccuuuuacacgaaggaacugaacaggagguggauuguacucguuaguguauauauuuccuguauuuaacuuuaugcucauuucagcuucugaaaaugaggagcagguuuaaauuuagaguagauuaaaaaaaaacccacauaaaaacagaaacaccuauaaauagcuuacugaaauuauuagaguagagcugacuucagaaucagacuuuugcagugucuacuuaguagaaugguuuugcauuuaguuuggagcugugaaguagugaauuugcaaacuggucaaucuccagugugcuucauuugguaguuaacuguuccugaaugaugaggggugugccucaucaaguacucaacauucugguugcaggucauuucaucauguuccaagaaaaaaacguagucaaaguacuuacugaaaaaaaaauaaauaaauaaauaaaucagcgcugggcgugguggcucccgccuauaaucucagcacuuugggaggccgaggcagguggaucaccugagcucaggaguucaagacuagccuggccaacguggugaaacuccaugucuacuaaaaauacaaaauuagcugggcguggugguacgcgccuguaaucccagcuacucgggaggcugaggcaggagaauugcuugaacccaggagguggagguugcagugagccgggaucgcgccauuguaauccagccuggguaaaaaagagcaaaacuccaucucaaaaaugauaaauaaauauaaauaaauaaaucagauauggaaaucagguucagauaagggagauaccuuuaggguggagacuaaauguugggaguuuucacauaguuugugucuccauuccauagaguuuuacggcugaggaaacagguauugaagaaauaaaaagugaauauuugaggcauuucugagguccugcuuuuaagucauaccacgguuuugccugauucuagggauaggguucagaauuuauuuucucucuaauguaaauucugaaagauaagaagaugagugucauuauuuuccucccacaucuuagucauugaacuaaaauuccugagcagagaaauggagugaaaauuagacuagaugggaaaaucuggaagcuuacuuucugauuacuugcuaucuaguuaaguuuuucucuuucuuuccuucuuucuuuucuuuucuuucuuucuuucuuuuucuuucuuucuucuuucucucucuuucuuucuuucucuucuuucuuuucuuucuuucuuuuuucuuuuuuuuuuuuuuuuuuugugacggggccucucucugucgcccaggcuggagugcagcggcaugaucuuggcucacugcagccucugucuccgggguucaaccucccgaguagcugggauuacagggguguaccaccacaccuggcuaauuuuugcauuuuugguagaggugggguuucaccauguugaccagacuggucugcugaccucagguaauccaccuaccacagccucccaaagugcugggauuacaggagugagccaccuuacccggcccuaguuaaauuugccuaaaagauuauuuuauuucaacguugugcauuguugaagcagaagaaugaggauugaagauucugaugugcuuuuuuucaaucagauauacugauaaaauugauauguuuaccagcuuguauugggauguuaauaaguguuaggaaaaaagauccucugguccaguaaauuugggaagcaacauauuaaaucgcgugguaauguuuuguuuuguuuuuugauuggaggauuucuuggaaucuuuaauguauuaauaauaagcauugagaaucucccagagaagaauagugugucuauuuuccaaauuuauuuuaucuuccuuuuucuugguaguuuggaauauacuuuguccuuuuuauuugcauuauuuuugguuuugcugagugucaagucacuuaagcuaucccuagcuuuuaacagauuuugcuauuguuuuuauaaaugugaaguuauacccuucugauucgacgguguauauaaaauggaauuuuggggaugggcgcgguggcucacgccugcaaucccagcacuuugggaggcugagguggguggaucaccugaggucaggaguuugagaccagccugaccaacauggugaaacccugucucuacuaaaaauccaaaaaaauuagccgggcguaguggcgcaugccuguaauccuaguuacucggaagcccgaggcaggagaaucucuugaacccaggagguggagguugcagugagcugagauagugccauucuacuccagccugggcgacaagagugagagacugucucaaaauaaauaaauaaauaaguaaauaaauaaauaaauaaauggaauguuugcaaaugagauccuuuuuaaaagcaguaaaggaacuugcaauuuuaaaguauccuaaaaugaauuuuucaaaaguuuuuuguaauuauacugucuaauggcuuuggagauaauugagggaugcugagauuggcugcuaggauuggucauaaaaccaguacuauuaacauauccuuacauauacuggauaugaagaaguugugagagaaaauaauugcuuaauaagcauuucuucaauuguccccuggaaauggagguuaauagguucugguaaugagcaguagaaggcgggaaaggguuuuguaacacaaguuugggaaauucugcucuuggagauucacaauuagcaagauuaaagguuccagaaaguucuaaauauauaccuaacuuuaaccagguaguucuuaaaccuuuaauuaugaaaccuuucuuuacuucauuccuuuuuagcauccggugaaauaguguucuguuucugugguuugagaauuuuuugaccguauauuucaggugccuagaaaguguuagaagauacuugcagguauuugaaaugauggcuuuauacuuggcacucugcccuuugcagagaugacuaaaauaagagaguugccuucaagaaauugcugccugaucagaggaaagaaaaugaaugcacaugcaacagcuucaggugaaaauacacaguccuuguucauugccaugucauagaccacaaguagaaugaguagaaauuuagagacuggagagcucugggguuuggguuucuguguuagguucaggaauguucugggugauggggcaggacuuuuacucaacuuguagaguauuaguauacugugagagguaaucauuaauggcauauguuaaccgucagugaauggaggcggaaauaguuugagaacuacuaccagaugaaggaggaaauagaagugccaggaaaacagaccaaggaacagugguuaaaggcagaagaguuccaaaguaguauauugccuugaacagagucuauaaaaguagaaaaaggucauucauauguaauacugcagagaaguuaauuggauaugguuaugaagaaauuauuagagaaauugcauaugucaaggcagaagggucucaguuuguguuuaggaggagggcugcaaguaauaugaaaaagaagaggauuuugggauugagguccccugggaguguugagaaguugaauucuagagcugugguuccugaccuacaagcccugaaguuguuacaggguguucauugcuuauucauaugcuuauaacuuugucuguaaguugaauaaagauuguucuagaucauugaauaauaaaaauuuaacccauuguugugaaggagccucagaauauuuugauguuaacaaaagaguucuguauuuacaaaguuggagaaacacucaucaagaguuaggaguaaggcccagugugggguucccucugguaauaccagcauuuugggaggcugaggugggcgaaucacuugaggucaggaguuugagaccagccuggccaacauagcgaagccccaucucuacuaaaaauacaaaaauuagccagcuguugugguacgcaccuguaaucccagcuacuugggaggcuaagggaggagaagugcuuggaccugggaggugaagguugcagugagcugagaacacgccacuguaccccagccugggugacugagugacacucugucucaauuaaaaaaaaaaaaaagaguuauaaguagccaguguuuuggcuuacaccuguaaucccagccacucaggaagcugaggcaggaggauugcuugacgcuaggaguucaagaucagcccgggcaacauagugagaucccaucucuauuaaaaaaaaaaaaauuagccaggcaugguggugcauaccuguaguccagucuacuuagaagacugaggugggaggauugaguccaggaguuugaggcugcagugagcuaugauugugcugcugcacuccagccuggguacugggugacagagcaggacuguuaaaaaaaaaaaaaaaaguuacaaguaggggagaggcuagcuucagagaguaguauguguaauaugucucucuugagauuacaaggaaggaugagaaguauuuauauauuguuaaacuguugaaaagaagaugggugaggggcagugacucaugcuugugaacucagcauuuugggaggcugaggugggaggaucacuugaggcuuggaguuugauaccagcccggacagcauauugagaccuugucucuauauuuuaaaaacaaaaaaagaaaaugaagacuuuaauucuggccaggcgcaguggcucacgccuauaaucccagcacuuugggaggccgaggcgggcagaucaccugaggucaggaguucgagaccagccuggccagcguggugaaacccugucacugcuaaaaauacaaaaauuagccaggcgugguaacacacgccuguaaucccagcugcugcucaagaggcugaggcgggagaaucgcuugaacucaggagguggagguugcagugagcugagauagcgccacugcccuccagccugggugacagaacgagacucugucuaaaaaaaaaaaagacuuuaauucuauaaaguaagaaucuaccaaaaaugaaaaagaagcugggaagagaaaaugaggauuugagaguaguauguagcuuagacucuaaaauaauaucugggagaaguuugaaaguuaagcaagugaugaauuaauaggauuggucagcaguucggagggcccauccgaaaguggaccgaaauggauaggauagaugaguucuccuuggcugucauaguucaguguagagaugcucagagacuaggagucagagcacaguggacccagaggguuugacuuggcaguaugaugaaaaauuguagucugaugugaauggucagaagagagagagauggaauauuugaagauugugagcaggaaguacaugcuuuuuuuucucaagaaagaugaugacauagguugacugugagggaauguauagagaugucaugacuuaacuagugauuugagcuccagaauguuaaaugugcaagagacgugucauggagccccuucuaguggcaauaguuacaguaaaguaggggagacaugaaccaauuaaacacacaaauaauugaaagucuuaauuguuucacuccauauguuauuuuuguaugugugauuuauuuuauuuuacuuuuacauuuuuuauuuuuuugagacagagucucacugugucgcccagccuggagugcaguggcgcaaucucggcccacuucacccucugccccaccuccugggcucaagugauucuucugccucagccuccugaguagcugggacaggcacgcgucaccaugccuggcuaggaauuuuguauuuuuaauggagacgggguuucaccauguuggccaggcugaucucgaacuccugaccucaagugauccacccuccucagccucccaaauugcugggauuacaggcgugagccacggcaucuggccuuuauaugugcuuuuaggauuguagaagauguaccuuggcuggaugcauuggcucaugccuguaaucccagcacuuugggaggccgaaacaagaggaucgcuugaguccaggaguucgagaccagccugggcaauguaguaagaccucauuucuacaagaaauaaaaaaauaacugggcgugguagcuuacgucuguaaucccagcuacuccagaggcugaggcaggagaauugcuugaaccugggagacagguugcagugagccaagaucgcaucacuauacuccagccuuggcgacaagagcaaaacuccaucucaaaaauuaaaaauaaauaaguaaauaaauaaauaaauuacaggcacauuagcaugugccuguggucccagcuacuugggaggcugagaugaggggaucacuugaguccaggagguggugguuuuaaugagcugggauugugccacuguacuccagccugggcgacagagcagaccccuggugaaaagaaaaaagaaaauguaucucaaauaauacuuaauuuuaaagaaaucuuaaauguagaaugugauuccauaauuauaauauugacuaguucacugcaaccuugaaccccugggcucaagugauucucucaccucagccuuccaaguaucugggacuacaggcaugcaccaccaugccuaauuuuuuauuuuugguagaggcagggucucccuguauugcccaggcugaucucaaacuccugcccaugauccucccgccuuggccuacgaaagugcugggauuacagguaucugcuacugugccuggccuguagaaaaauuuauagcugaaggacugggaguguguguaugggaauaacaguaguuaucucugagaaagggguuggaaccuguguggagacagaaaggagagauuuucacaauucuguagcaucuguauaguuuuaauauuuauuuauuuauuucaaauuuuaauagagacagggucuugguauguugcccuggcugguuucgaacuccugagcucaaguaaccucugccucucuucccacagugcugggauuacagaugugagccacugcuccuggccuacuuugaauuuuuaaugauggugaugaauuaauuugugacuagcauuauaagaaaaauaaaauuuagaguuuaagugacauuguagguagauuuugauucagaaguuuuaaguuuagagaaugaauuugaacacuuaucacugauaaguuacaauguuuagggucccaaaauauugcagcugucaaaugauaaaauauauaaaaauaaaauuuaguauucauaaggacauaaaugcaaccagacauaggaauuuuaauaauuugacgagucaguuuucuuuucaguaagguuuaacagucuguauuugcagcuacauugcuuucaaccaggugugucuagucugugauccagauugcuucugaaauuuuguuagcaaggugcucauaauugcuuuuuugucauugaauuuaaguugccauuuauugagaaugaugccuguagguucaagcaucugcuucaguuauggaguuauuuuauuccaaguauauuccauuaguaagaaagcuuacacuugugaagugcaugcugauuuggggguagagaaucuaugcuuauacagcuacugugugugcucuuagagcaauuacugaagaguggcggaaaguugauauuaggcuuuugucauuaccuuacuuaagaacuguuuauugggaguuuaggccgggugcaguggcuuaugccuguaauccuagcacuuugggaggcugaggcgaguggaucaccugaggucaggaguucgagaccagccuagccaacauggcgaaaccccaucucuacuaaaaauacaaaaaauuagccgggcauggcggcggccacuguaauuccagcuacuugggaggcugaggcaggagaauugcuggaaccugggagguggagguugcagugagcugagauggcgccagccuuggcgacaaagcgagacucuguuucaaaaaaacaaaaaacaaaaaacuguuuauugggaguuuugauaagacaagucaaagaccugaaaauagaggucagacuaacgauuucugcucuaacaagcaucauugugaguugugaaugccucccuugugaacaugcccuguguaccugaugaauugcugccaguauugucucgggcaccccaagauuacaguuaacccgguauccccgcagguggaaugucuugggcuaguagugcuaucaagggacagggcuaugaaacugacagguucaacuucuuagcucccauuuuccucaucagguaugucugaggcuaauccccuuccuucuucuagcucuguuacuuuuuuguuuguuucuuuguuuguuuuuuugagacggagucuugcucuguugcccaggcuggagugcaguggugcagucuagguucacugcaaccucugccucccagguucaagcuauucucgugccucagccucccgaguagcugagacuacaggcacgugccaccacagcuggcuauuuuuuuuuuuuuauuuuuauuuuuaguagagacgggguuucaccauguugguuaggcuggucuugaacuccugaccucgugauccgcccgccucggccucccaaagugucgggauuacaggugugagccacugugcccagccaaaauguucuuaagcucucaagauucauauagugagccauuauaaaccaaggagauuggaguuagaaguauuauuaaaguugaaugcuguuguugaguuacauuauuaaaaacagugaauuuaauauugcauuacuuaaucuuuuuuuuuuuuuuuuuuuugagacggagucuugcucuguugcccaggcuagagugcaguggcacgaucucagcucacugcaaccucugccucccagguucaagcaauucuccugcuucagccgccugaguagcugcgauugcaggcaccugccaucaugccuggcuaauuuugguauuuuuguggagacggaguuucagcguguugcccaggcuggucuugaacuccuuaccucaugugauccacucgccuuggccuccaaguugcugggauuacaggcgugagccacccagcccugccgcauuaaucuuuaaaaaaaaguagagucuauaaauugucuuaaaaacaauuuuauaucauuagcauuuaaauaguuuuaacacauucauauacaucuuuaaucuuuaaaucauuuaccauccggcuuacauuuuuauguuuuuaccaacuuucauuuuuaucaucuggcuuacauuuuuacuuuuacuaucagacuuagauuucuuaaaaaagagagaguuuaggagugaguuuuucuggaugugcuuagaauuuggcagcucuggacaaucugcaaacaauccucgacaggcuucuguuuucaaauaagcuagauuguauccuccuuuaguggacucuagcugaugcagucacaguggugggaacuaguucagauucaguuuuuuucacacuuuuuuuuuuuucuuuugagauggagucucgcucugucucccaggcuggagugcagcagugcgaucucggcucacugcaaccuccgccuccuggguucaaggguucaagugauucuccccgucucagccuaccaaguagcuggaguacaggugcacgccaccaugcccggccaauuuuuguauuuuuaguaguaacuauggguuucgccauguuggccaggcuggucuugauuuccuggcuucaggugaugcgccugccuuagcuucccaaaguugggauuacaggcgugagccacugcaccuggcccacauuuguauuaaaguauuguuuuagaaaagauuugugugcuguguauugucuuuuaaugaccugguuaaaauacuuaauugauaguuaucuguacguguuuaaucuuucucaaagaucagugacccauaggugaagagugcaaaguuugauuuacaauuggguuauucguuuauucauauuacagauacuucaugaaggaacagcaguagcaacaaaaaccccggacucauucuucugaauuaaaugggugcagauuggucuggagacucuucugcugcccucuaguguuuauaucaugaguagccauugaaaguuggaagcugcacauugcugugccgcuaccacucuuaccuuagcaauauccuuaagcagcauguuguuuauccuuaucuuaauugcugugcuuugagguugggaaugcuauuuguggguaucucugggauaucaguuaacucaauuucuauuuuugaauuauguaagauagauguucuacccucccuuacagggugguggugcugugaaaguaagaugacuguacauuacaggaaagcuuaaaaaaauaaaaauguaagguguguguguaucuuuuuuuaaucugaaugaaauaugggauuucuguaagucuuuggccuggaacugcuucuuuggggagaguugaaaccguuguuucagguuauuuuggauuuuaaugugugaguuucucuuuuuuagggcauaauaauuuauuugagaaaauugcaauguauugaucauggugaucagcauguauguuauggcuuuccuguuggguaucaacaaugugccauuuuuguauacugaaauauuucaguaggaucacacucuauagaaguaaaugucucuuuucagauggaaaugaagacuaguuuuuugggaguucuaucucacagaauuaauuuaaacuucuuaugaaucagaauuacagugaaauguaguuaagaaaaaaggaaguuuuaaaauaagcagcuugaacuuguauuuuuguauauuuuauauaauuuagucuucaguuuugauacauuaaagcuguguccacucuggccaaagcacagccauggaaaaccucagauaaugcccaugcugccauuccuaaaaguguggauuuccuuuaccuguguuuuguuacuucuuugcuuaucccguucaguucacauuguauuacugcuuugauuucuaguuuuguuuuuccaaaugauugcucuuuuucugugaauuuucaaggguuguuaugugguugucauuugcuaaugugaugaacaaguaauucaagcaauuaucuuuuaagauaguuauauauuuggucaguuuuuacuauuuuacguaauuauuuaaggggugaguauuuuucauaucauuuauuccuaaaugucacugauagcaugguuauuggaaauaagcaaaauuaaucucauugguacagauuuuagggccuauauauguugcuuaaauuacuuuagaaauuuuuuucuugaaacgaaaugcucuguauauaggacauaaaccaugaauuuguuaauugguuuuuaaaaaaauuaaauuucacuugacaaaaauggcagucauggaaaauaaguagccagcuuuauaagcuucuuugccaggugcaguggcucacaccuguaauccuagcacuuugggaggccgaggcgggcagaucacgaggucaggagauugagaccauccuggcuaacauaguaaaaccccguuucuacuaaauauacaaaaaauuagcugggcgugguggcaggcaccuguagucccagcuacucgggaggcugaggcaggagaauggugugaacccgggaggcggagcuugccgugagccgagaucgugcugcuggacuccauccugcgugacagagugagacucugucucaaaaaaaaaaaagaaaaaauuauaaauguguauuuugacauguuuaguuuuuuauacuuaugagaaacucccccuugaaaaaguuccauugccuuuaaacgguuugaaauguuugaaagacagaaucuaacuucacguuuuuucacauacuugacauaauuaugcuaauuuugauuuuuuaaaucagaauuuuucauuaaauauuuguuuauuugcagguauauuugcuuacuuaaacuaccauguuccucgaacgagacgagaaauccuggagacccuaaucaaaggccuucagagacuggaguacagaggauaugauucugcugguacuuuaaaaaaaauacuauggauuuugcaugauucuuuaaauagauacuauuuuuauuguuauuaggagacuagacuauuaaagucuguuuuguuuugaguaaguguaaauuggaagaauuuuugucuuuuaucauauuuaaaggauuuauuuauguaaucucaacaguguuaccauuuauguggaguauugcuuaugaugaucucuuaagaauauuauuguaaaaacaucauaugggggauuauugugguaaaacaaaauucgugaaggucuuacucuaaauucuuuuuucuuuccuauaacuuuaauuuuuauccauugauuucaugcuuugacacauaaacuugccucagauucuuuuuucuuauuuuuauuauuuauuuuugagauagggucucacucugucaccccagcuggaguguaguggugcggucauagcucacuacagucucgaacucugggcucaggcaauccucccuccguagccuccucaguagcuaggacuauagcugugugccaccaugcccagcuaauuuuuaaaaaguuuuuguagacacgagagucucacuauguugccugggcuggucucaaacuccuggccucaagugauccuccugccuuggccuuucaaagugcugggauuacaggcaagccacugauuccagccucaucuaucuuaaauaaauuacacauaaacauaacuuucuggcaacuuuauguucuacccuagcuccuucccucaacuaugucagagguuccuaagaccauccucagauuugacgauucccuaggaggacucacagaacucagcauuugguuguacucauggcuauguuucauuauaacaaaagaauacaaagcacaaucagcaaagggagaaggugcaggaauugaagucuugagaaagcuaggcacaagcugcucaccaguggaucagugccuaagguuuucauuggggguuggucacauaggcacccucugcccagcauguaccaaaauucuagacucccaaaauaagagcagauguucagcauaaaccacuuuguuugcacaguuuguguagugagacacuuuugguuagggugguaggaauccuuccaaaaaccaaguuucuagacaccagugaagggccaaccuugaaaacaggccuuucugaggauagcaguuucacaccugcuguguuaacucuuuuuuguacacuuaacauugccacauggaauggacauuugucuuccuugacuuuccuuaguaauggaaagucaguuccucaacuccuuuguuuuuaaaauucucuccuuccuuagcuuccuugacagcacaucuuauucucuuccuaagaugcuaagauuacuucuuuucuguuugcuuuggaggcuccuuucuucuacuuacagcucaaauauuaauguucuucaagauucuuuuuuuuuuugaggugagucuugcucugucacccaggcuggagugcaauggugcgaucucggcugacuguugcaaccucugucuuccggauucagcugauucuucugccuuagccucuccaguagcugggauaacaggcaugcaccaccacgccuggcuaauuuuuguauuuuuaguagagaugggguuucaccauguugccuaggcuggucuugaacuccugaccucaggagauccacccgcccuggccucccaaagugcugggauuauaggcgugagccacugcacccagccaauauucuuuucuagauccacuucucuuauuuggugucuucaugggugagcucugacucaucaaucuucuuuuuuuuuuuuuuuuuuuugagauggagucucacucugucacaaggcuggagugcaguggcgugaucuuggcucacugcagccuccaccucccgaguucaagcaauucuccugccucacccuccugaguagcugggauuacaggugccugccaccacacccagcuaauuuuuguauuuuuaguagagacgggguuucaccauguuggccaggauggucucgaucuccugaccucgugaucugcccgccucggccucccaaagugcugggauuacaggcgugagccgccgugccuggcccaucagccuucuguuaauauauguugguaacuucuuuguuuuauucuuuuuauuuuuuauuuauuuuuaauuuuuauuuuuuugagauggagucuugcucugucgcccagccuggagugcaguggcaugaucucagcucacugcaagcuccaccucccggguucacgccauucuccugccucagccucccgaguagcugggacaacaggcacccgccaccacgcccggcuaauuuuuuguauuuuuaguagagacgggguuucaccauguuagccaggauggucucgaucuccugaccucgugaucugcccgccucacccucccaaaaugcugggauuacagacaugagccaccgcgcccggccaguauuuuuuauuuuuaauuuuaauuuuuuugugugagaguauguuggugacuucuaauccagauguauuucuuuuaauccagauuuaucucccaagcuguauucuaggccuccuacaaguuucuuccuagauagaccaugauauuuuaaacuuugcauguucaaaaauugaacugaggccgggcguggugacucacgccuguaaucccagcacuuugggaggcugagguggauggaucacuugagguaaggaguucaagaccagccuaaccaacauggugaaaccccaucucuacuuaaaaaaaaaaaaaaauuagccacgcauuguggugugcaccugugaucccagcuauuugggaggcugaggcaggagaauugcugaaccugggaggcagagguugcagggagcugagauugcgccacugcccuccauccugggcgacagagcaagaaccugucucaaaaaaaaaaaaaaaaaagaaaagaaaagaaaaauaagcugaauacauugcaguccucacccugcuccccacccuguuuuuuguuuguuuguuuuugagaugaaucucacucugucgcccaggcuggaaugcaguggugugaucucagcucacugcaaccuccaccucucggguucaagccauucuccugccucagccucccaaguagcugggauuacaggcaugcccacucuguuuuucuaugucccuuuuauugagaaucauucaacaaguccuucaagccauucaacaaguccuuugagguauuccacacuucuccugcuuucucacuuacauucagucaguuccacuuuucaauaucauuuauuucugucugcauuaccacuguuuaguucagguccucuucauuuuugcuuugcuguagcuguagcuuuugacagcugguuucuuccuuccguuucucucccuccaguucuuucccuacacuuguuucuagaagggcuuugcuaaacauuuuugccgaaucacuucucugcuuaaaggacaguguuuucccaguaucuucaggguagcuuuuucaaauuccuuagcaacuuaaggagacucuuaagagauguauucugugaccuucuuuccuuagcuaccuucugaggugggugcccaucuuuugcauuucuccauuguaucccaauuguaaccuguaguauuuuuauuauaauucauaaucacgcugaauuauuuuuuccuugucugucuucucgauagacuuagaaauuugaggacaggaauggaguuauuuuuguuuuugugucuagcagcuauccugguucuugacacacaauagguuuucaguagguaauugaauuaauacauuagugaauuaauuagaugagaauguauuuuuuaauuaaaaauuuugccucacauuaauaauuuuaucaguagccaguuucuaaauuuugcuuuuuuaccucaugaugguuuaggugugggauuugauggaggcaaugauaaagauugggaagccaaugccugcaaaauccagcuuauuaagaagaaaggaaaaguuaaggcacuggaugaagaaguucacaguaacguacuuaauuugauuuuuguccccuuuccccuucucuuccuuuuccccuccccauucuccucuaaguuacucccuccccccauauuuugggaccaauuuuaaugauaauggucuguaacauugaagggaggaaagaaaaguaguuuuguuacugucuggacuaguuuuaaaauguaccugagccugaaaaauaaucauugcaacuagggaaggaaauuaguuagguauauuaccuucaguguaagcucugaauauuaaaugaaguaucuucagagccaccauuccugaggaagagcuuuucauaagacaaaagguauuuuuagugaugcccuuuuacacaugucuucacuugcuaauugucuucacuuuggauuaaaugccuagcuuggauguagucaauuuugacauugcaccuuugaauaggucugauauaaucugguaaguaucauguuuucccucacaguuuucuucucuggcacaaggaguugucagagauguaugccccaucaaagaggauuuacuucucaguauuuagaucauaacauuauucuuacacauuuuauuuuuuucacaagaaacuugaaaacaaagcaaacuuugaaguagauugauugaaaaaauauuuuuaaaauucuccacaaaacccaggaaaccgcaaguauuuuauguaccuacucauaugaaugccaucauaaucauuguaaaagaguacagguagaggaaaaugauggauuuugucuuuuuuuuuucccacauaagccauacguuuagcucuguaguacuuguuuaacgaauuaaaucaauacuuauuuugccuguauuguaguguaagauuagcuagggguaaagcagacacccaaauaacuauacuucaaaaacaguaguauaaauaucuacuauguguucugcauccuguauaccaggcugauuguagcagguucuguaggagagaacagacauugcugugagauucaggggagaguucccacaaguugacgagacugggaauacauagggaaugggugcugauuauauuuggucagugaagaugugaagggaggaccuucugaguagauagcauagcaagauaagaagaguaauggcaggcguguugauggaaugauaguaguccuuuuuauuuacaguauugguagacaaauaagggaggcuagaaaggcagauugugaacagaaucaccauuuuucaaugucagcauauugaaacaugccucuucguggucaacuuuuuuuuuuuuuucuucccuucccagauggagucucgcuguaacgcccaggcuggagugcaauggugcaaucuugguucacugcaacuucugccucccagauucaagcgauucuccuguuucagacucccgaguggcugggauuaccaggcgugugccaucaugcccggcuaauuuuuguauuuuugguagagaugggguuucaccauauuggccaggcuggucuugaacuccugaccucaagugauucgccugccucggccucucaaaguagugggauuacaggcauuagccacugagccuggccaacugguuuguuuuugaaguguaguuaucugagugucuacuuuacucacagcuaauuuuuuuuuaagauggacucuuggucuguugcacaggcuggaguguagugacacaaucucgguucacugcaaccucugcuuccugguucacgccauucuccugccucagccuccugaguagcugggaccacaggcgcccgccacaacgccuggcuaauuauuucguauuuuuaguagagaugggguuucaccauguuagccaggauagucucgaucuccugaccucgugaucugcccgccuuggccucccaagugcugggauugcaggcgugagccaccacaccuugcuaauuuuuguauuuuuaguagagacgggguuuugccauguuggccaggcuggucuugaacuccugaccucaggcgauccacccucuuugaccucccaaagugcuagaauuacaggcuugaaccacugcaccuggccaaccccuagcuaaucuuacccugcaauacaugcaaaauaaguauugauugaauuuauuaucuacaaauggaaacuuguagauauugcuggugaauuuguaacugguaaaucacuuuaaagagcaaucuggccauaucuacaugggaaaugccuauaaccugagacuaagcacuuccacucuuggauauauacuugaaggaaacacagugaacaaggugacaugacaacaagauucacuguugcaaaauuuagaaacagccuaaaugucuauaaguaagggaaugggaugauauaauaaguugugugugccgggcgugguggcucacgcuuguaauccuggcacuuugggaggccgaggugggcggauugccugagcucugguguuugagaccagccugggcaacauggugaaaccccaucucuacuaaaauacaaaaaauuagccggguguggcggcgugcaccuguaguuccagcuauucgggaggcugaggcaggagaaucacuugaauccaggaggcggagguugcagugagcugagaucgugccacugcacuccagccugggugacagagugagacuccgucuccacaaaacaacaacaacaacaacaacaacaacaaaaaauaaguuguauaugauagugaaugagcauauguagcuuuugaaagaaguguacugaaucugguucugcauaugggaacauggauaauuccugguauguaaaguauaggacauuuaaaaacacaaaacgguacuaucauuuauggucucauguuaacauaaucauaguuuaaaaggcaugaauaguaagacugugucaacuugaaaaucuucugaggaguaagugaaugggauggggauauaaaggagguuaucaacugcauuuuuuacauuuauuuauuucaaguuuccauauaccacacugauuuuuuacauuuuagaucuuaaaaaauauguaaagcacagaugacuagauguuuuguuaacucugaguauggguaguuggguguucauuauucccagcaaauuuaaauauguuugaaguauuuuuuuugaaaagggaagaugacaucugagaaaaggcaggcagagggcaaggagccaugggaguagagguaggguaagauagaagaugcaaaugaggaaauuauugaagcacuacggcccaagaagaucaaggcacaggcaaggaguuagccuuuaaaggaaaaaguguacuuuaggaaucaaagaugaaagacaaacuuaaagcagauaauuaccaggugagaggacaaaagcugaguaaaguggaaauugagggauugcagguaggauugagcuuuauggagaauagaaaagauaugaugaacugucagggaacuggauugagcuaucaguuuaaugaauaaggaacuuggauacauguuucuuagguagcaacagugaaauagauaugugaauuugaaagggucuuaauuuacagaauuuucugacuuucuucaguauugcuuggcaguagaugggagaagagaaaccgaguguggggguuaaucuagacuuaagauucagcaaagggcuuuaaaauggguaacagacaauaaggaagcgucaaggauucaaagucaugauuaauuuauaugacaggaaauauuuauuaugagaaaugugcuuauugucauagcaauaauuuuuucuuacuagacauucgguaauguuccuacagcaacagugaaauaaaggugugguaauuaucaugaauuugaaauggauucaauauauagaaucuugugacuuucuccaguauugccugccagcaugugcaaggagauacugcuuuaauuauaguuagcuuaaaaaaguugucaaagaggccaggcgugguggcucacgccuguaaucccagcacuuugggagguugaggugggcggaucaccugaggucaggaguucgagaccagccuggccaacauggugaaacccugucuguacuaaaaauacaaaaaauuagccaggcgugguggugcgugccuguaaucccagcuacucaggaggcugagauaggagaaucgcuugaacccgggagggagagguugcagugagccaagauugcgccauuguacuuacuccagcuugggcacaagagcaaaacuccguuucaaaaaaaaaauaaaaaaaguagucaaagauguuuucauuucuugcauuggccuguugaauaaugguaaaugguauuuuucuugaggucauuuaucagguugccuuaauuacuuagaacacaguuaagccaggaaagaauagaugccugaguuuauucauugauagauugagccauccaacaaaaagguaucugccauguauaccuuuuagugcuuaggauucaaaaauaauaagguaggcugcuguuuuuguagaacucaaauucugguggaagcuagguugacaacauauaaauguuauaguacaauagaauauaccauugugguuuuauuuauuuauuuauuuacuuauuuuugagacggagucuugcucuuucgcccaggcuggagggcaguggcaugaucucagcucacugcagcuuccccuuccuggguucaauugauucuccuaccucagccuccugaguagcugggauuacaggcgugugcuaccacgcccagcuaauuuuuucaguagagacaggguuucaccauguuggccaggcuggucuuaaacuccugaccucuggugauccaccugccucagccucccaaagugcugggauuacaggcaugagccguggugcucggccaguuugcucuuaauuuagaccuaacucugauaaacuuuguuaucuggguucuuagccaaauuaauuuuauauuuaggaaauuaagagcauuacuaguuaauaacuggagcuguccauuuuuuuaagaaaccccaagaaaagauagcuuauaugaaaaauaagaaucagcuacuucuuuuuuuuuuuuuuuuuuuuuuuuuugagagggagucucgcucugucacccaggcuggagugcagugaugugaucucagcucacuguaaccucuaccuccuggguucaagcgauucuccugccucaaccucccgaguagcugggauuacaggcgcgcaccaccacacccggcuaauuuuuguaguuuuaguagagacaggguuucaccauguugguaaggcuggucuuggacuccugaccuugugucccacccgccucugccucccgaagugcugggauuacaggcaugagccaccacaucuggacaaaucagcuacuuuucaagauaaaggaacauuggccuaugccgauuucccaguagccccauacuuucauagcauugcucgguucuuaaauaccuauuugauuuuggaggcacuccauaguugcaguuucuauugugagacguguguacacucaccagagaccaaagaaauugcagucauaagguugugugucauugggaaaaugaauuuauuuuuacauguuuaauuaaauugauaaugacuuuuuaaggcaagaauuaaauauagauuuaaaagauuacauuaauuguuuuuguccuuaacucuugaguauuuguaucuccaggaaacuugaaagaauaguacauuauuaccuauauauacuucaccuaacuuuaucuguuauuaaaauuuugucauguuugcuuuaacucuguauuaguuuuuugguuguuauugaaaccauuugccuucaauauuucaguugcauaaacuccuaaaucuuuauuuaucuuuauuuuuaauuuuuguggguauauaguagguguguaaacuuacuggguacaugagaugucuugauacagacguacaauguguuccuaagucuuuuuuuuuuuuuuuugagauggagucucgcucuguugcccaggcuggagugcaguggcaugaucucagcucacugcaaccucugccuccuggguucaggcgaauauccugccucugccuccggaguagccaggacuacaggcgcgugccaccaugccuggccaauuuuuguauuuuuaguagagaugggguuuccccauguuggccagacuggucuugaacuccugaccucaggugauccaccugccucggccucccacagugcugggauuacgggcgugagccacugcacccugccuccuaagucuuuuaaucacuauuuugaauaugccugaucuuuaguuucagugauuguauauuccaagagagcagcauuguaauaauuguauuuaaauauagcuuauagcauuaucucugcagcaugauuuaauauugaaauuuuucuuuucauauucuucagagcaacaagauauggauuuggauauagaauuugauguacaccuuggaauagcucauacccguugggcaacacauggagaacccaguccugucaauagccacccccagcgcucugauaaaaauaaugguauggaaagauuuuuugugcuuuggaaugauuguggaaaccuaauaaugggggcagaaugaaggcuuuuagauuuucauuauuuuaauaauuuuucaucuggaaaauuucaaacauucagaaguaguagagagcauauggagcugagagugcuggcucaugccuguaaucccagcacuuugggagccugaguugggaggauugcuugaguccaggaguucacgaucagccguggcaacauagugagacccugucucuacaaaaaauaaaaaaauaaguuaggcauuguggugcaugcuuguagucucagcuacucgggagacugaggugggaggaucguuuaagcccaggagguagaggcugcagugagccguggucacaccucaugccauugcccuccaaccuggacaacagaaugagacccugucuguccaccaugccuggcuaauuuuuguauuuuuaguagagacgggguuucacuguguugaccaggcuggucuugaacuccugaccucaagugauccucccgucucggccucccaaagugcugggauuauaggcaugaaccacugcuccuggcugagaacuuuuguuauugguuuuguccuuagggcauaucucucuagaaauguauaaucaaauuacuguguuuuagaguuacuuggaauagucuuucuccaugcaguugugcuacguguuacuuuaauauguuuuagaaacauuuuuuuuauuuuuauuauuauuuuuugagaccaagucucgcugugucgcccaggcuggagugcaguggugcgauaucggcucacugcaaccuccaccuuccagguucaagcaauucuccugccucagccucccaaguagcugggacuacaggugugugccacuacacccggguaauuuuuuguauuuuuaguagagacggcauuucacuguauuagccaggauggucucgaucuccugaccuugugauccgcccaccucagccuccuaaagugcugggauuacaggagugagccacuguaccuguccuauuuuuuauuuuuaaggauugauauucuuuaaaaauaaauguuauuuauaauuauuuaaaauauuuacauaauuccgaagucacaucuuuaaaauaagacacacuaaaagaagucuacccagcacuuuggaaggcugagauggagggauugccugagcccaggaguuugagaccagccugagcaacauggcaaaauccugugccuacagaaaauacaaaaauuagcuugaugguggcaugcgcccauagucccagcuacucaggaggcuaaggcaggaggaucaccugaaccuggggguugaggcugcagugagccaugauugccccauugcacuucagccugggugacagagugagacugucucaacaaaacaagucuagacucuucuguuuccucuuauuccccucguagguaacauucaccaauuauugagucuguucuuucauuuaaaaaaaauaagcaaauacauacagaauacauacaaaaguguguauguguguauuuaucccuccccauuuuuuuuccuuuuauuuuagagacagggucucacuccuccacccaggcuggguacaguggugggaucauagcucacuguaaccucaaauucuugggcacaagugaucuuccugccucagccuccugaguagcuaggaucacaggcuugcaccaccacacccagcuaauuuauuuuauuuuuguagagauaggggucuugcuuuguugcucaggcugguuacaaauuucuggacucaaguaaucuucccaccucagccucccaaagugcugagauuacaggcaugaaccacugcacccagcccuugcugauuuuuaguuuaauucagaagcugccuauuuaggcuucuugugcuucaauacuuacuguugaauuugaucauaaugcuagcaauaauuuagacuuuugacacugacaaggccuuuaugaaagauucccgaaaacuuacaucuagauuauguuuugagaauuuggcuuuaaguuaagaccuuuaaauuagcuguuuauuaaucucuuuguucuagcaugaaguuuuuuuuuuuuuuuuuuuuugagaaggaaucucgcucuuucuccaaggcuggagugcaauggcaugcuuuccgcucacugcaaccucugccuccuggauucagcgauucuucugccucaagccucccaaguagcuggaauuacaggcgccugacaccacgccuggcaauuuuuuguauuuuuaguagagacaagguuucaccauguuggcuaggcuggucucgaacuccugagcucaggugauccaucuaucucagccccccagaaugcugggauuacaggcaugagccaccgcacccggcaaguuuuuuuauaaauuuauuuuugugguugcuaucaucucuaaaaaaucuagugaaaauguuuauuauuugguuucuaauuacugucagccaaaauaucagaucuuuauguauauuaagaacauuguugggggccggguguggugacucaugccuguaauccuagcacuuugggaggccaaggcagguggaucaccugaaauuaggaguuggagaccagccugaccaauauggcaaaaccccgucucuauuaaaaauacaaaaauuagcuggguaugguggcaugcaccuguaaucccagcuacuugagaggcugagccaggagaaucgcuggaacccaagagguggagguugcagugagccgagaucgugccacuucacuccagucugggugacagagcaagacuuugucucagaaaaggaaaaagaacauuuuggccuggcauaguggcucaugucuguaaucucaagacacuggaaggaugaagugggaggauugcuucagcucaggagacuagccugggcaacauagcgagacucucucuacagaaaaauaaaaaaauuaguugagugugguguaagcagcuguaaucccagcugcuuggaaggcugauguggaagaaucaccugagcccaggaguuuaaggcugcagugagucaugauugagccacuguacuccagcuuggugacagagcaacaucgugucuccaaaaaaaaaaaaaauauuuugauaauuucauauaaaauuuaauuuagcaguaauuuuucuccuaacugaaaugaacucugaauaauaaauccaggauugguaggauuuuuuuuuuuuuuuuuuuuuuugagacagaaucucacucuguugcccaggcuggaaugcaguggugggaucucggcucacugcaaccucugccucccagauucaagcgauucuccugccucagccucccaaguagcuggguuuacaggcacgugccaccacgccuggcuaauguuuuguauuuuuaguagagacaggguuucgccauguugaacaggauggucucaaacuccugaccucagguggucugcccaucucgaccucuuaaagugcugggauuacaggcaugagccaccgugcucagccggauugguaguuuuuauguaccagcagucgcuacaaauaaugauauugucaacucuugauuaucuguucuuacaguuuucaaaauuaguuaaaaaagaugaaaauuaucccgagaucaugucuauuuucucuuggaaugauauuuuaacauuuauguuucugacauucuaugacuuauuuggaucucaaacaaguaaauuuaacuauggaacugauugguuuuucuuagcaaauuccuuaguucuaguucuuaaauucauuuaguguaaaucagauuauuguuuuaguuugaaaggacuucucuuuaaacuuuuacucaagaaugaaugaacagagaaauaagaagaauauuuaguucagcucucucauuuugcaaaugaggcaacagacccaauaaacuugcuccuuucacauggguaacauuugauuacuaguuuagccacaacugaaauuguuaucucuagacuuccuguuuauuucccuacuguacccaccuccccugcacuguuugcuucagcuaugccacauaaacaaugcugcugaucuaccugaugauaaucugguaaaugagaaguagauguaauuauguuauaaauaacauaaauaguauauagcauguuaaaaauuuuugacuugagaaaaauccaguuagaguaauagcuauuuuagauuuaucauacuucuaacuuuuuugucuucaacacuuuuaccucuuuuagaauuuaucguuauucacaauggaaucaucaccaacuacaaagacuugaaaaaguuuuugguaaguaaggugaccucaaaagaccccagucuuugagaauacuucuaacgagagcacuggggucgguuguugggaugugcaacaaacaccauaugugugucaucaauuaauuucuuggacaauuccaagggcacggugguuuauuggauuuuucuuugcuaacaguggaacaauuguguuuuuuaauaugaaaaggaaaugauuagcauuugacuguaauauacaugacaaaaggcucaaauaaaauuggaauuuuguggagacauuuuuugcauucugagagauugucaugcuuuaaaguuccuaggauauauuaauacaagaagaaucaggacaaauuaaaugaaaguuuuaugucguaaauagcuauauacuguauaguaguggucauagugcugaccugcaugagugcuuucuuagggcuguucaauugaacuuucuccaguguuggaagacaguguaucugggcuauucaguauaguagccacuguccacaugugguuguugagcuaguaugacugaggaacugaauuuuaaauuuuauuuaauuuuaauuaaauugaaauagccacauacagcuaauggcuauuuauuagacaguaaguuaaguguauguucaguuaaacagagucccacacuguuuuagagucacugaucagcuggugacuuuaauuuugaauaaugggauaugguguucaaagaauauuagaaauuaguggcauuuugacggaacaauucuguagaaaagguuuuuuuaucauuaauauuucuuuaauuguaucuuuuuuuucuuucuacuuacaggaaagcaaaggcuaugacuucgaaucugaaacagacacagagacaauugccaagcucguuaaguauauguaugacaaucgggaaagucaagauaccagcuuuacuaccuugguggagagaguuauccaacaauugguauuaagccacauuuuuaaagauaauuaugccaacauuaaugcugagaaacuuucuggaaauuaaguuugauaagcaggaacugugcuauuuuuuuauuuuuggcuuuuauuucucauauaacuauucaaguugaauaauuuugagaaacugauugauuuauugauucccccccacccuccauuuaaaauucuacuuacuucauucagguuuaaugucaugaaaaugaaaauuaauccaaaaucagugugucuaaaaacuaugcauauaugcacacauccauaugcaccacacguggacauguacacaguacacacgauggaggauuaguuauucccuugcuucuugcucauccgaguguucuucucaaccaauaacuuagcacaauaguagcuucacagcuaccacaguuuauuuucugggauaaugccugcuugucucugagccaacaaagucaacuacuuauuuuuccuuuuggggacuuucccuuggcucugaacuucuauagaaaagcauuuccaagcccaugagaaaaucaguauucuuuuugauuccauccaacauuccuaauuaaagauuaaagacaucaaagaucuacaaauguccaaauccauagugauaccuacauuucccuuccccacucauaacucuagcuuucccacuuaaaaguccuuuacuucccaaauacgguccagcccucacuucucucccaccugcacccaaaucuuauaucuguagcaaaaagaggaagcaggaagauggagaauguagaggccuauuccuucccuuuccccaaggcagaguggaguagugugccuucccagccuuuucucguuucuaacaggcuuugccuuuuauucauuguauaauccaguuuguguuccaaggugguucuucccucuccuacuucauguuccucuuuuaucuguucuugauuccuguaagcucugucccugaggauucggguugauggaguuguauggugugcauguuaauaauuguauauauuuauaucucuaauaucaaggucagaaagaguggaaguuaacagugguguacaauuacuagggcagagaauagguuuuggauuuugaucuuaggaucuuuucuaauucugucguuccucugauaauucauaguauuaugacgauauagauagguagaugauggagauaggauauauagguucagaaguguucauagccuguagaaaggaugacuuuuuaaaugaucuauuuuuguaguuguuaucuauugagcauauuuuggguguaggcuugguuaaaaaagugggucuuggcugcgcgugguggcucacgccuguaaucccagcacuuugggaggccgaggugggcagaucacgaggucaagagauggagaccauccuggccaacauggugaaacccugucucuauuaaaaauacaaaaauuagcgugggggugcgugccuguaaucccagcuacucgggaggcugaggcaggagaaucacuugaaccagggaguuggggguugcagugagccgagaucgugccacugcaccccagccuggucacagagugagacuccaucucaaaaaaaaaaaaaaaugugggucuuggauacaccaaagcuuaggaguaaguguuuacuuaaacuuuagacuuguuuauaaacugguacaaaagagcauuugugugaacaaaaaauuucugcgcugaagccaguauguucuaggcauuucugacuugauaauugauuaaauagugcuaauggauuuuuuucccucccuaggaaggugcuuuugcacuuguguuuaaaaguguucauuuucccgggcaagcaguuggcacaagguacauauaacucuaacaaugacuaauguauuucaacauauuugaguuacauguuuauucuucguagacuauacaugacccuuuauuauaaaggcucugcccuuuauuagauauauucaugugagcauauuuucacaucuuccuucuugucuguugcuuaccacucuuccauuuaacagaaucccugaagaaagcaaauacaggccgggcgcuguggcucacaccuguaauccuagcauuuugggaggucgaggcaggcggaucaucugaggucaggaguuugagaccagccaggccaacauggcgaaaccccgucucuacuaaauauagaaaaauuagccgggugugguagcacaugccuguaaucccagcuacucgggaggcugaggcaaggagaaccgcuugaacccaggaggcaagagguuucagugagccgagaucgugccacugcacuccagccuggccuacagagcgagacucugucugaaaaaaaaaaaaaaaaaaaaaaaaaagaaagcaaauauauuuuggcauuuaauuggccuuuugucuuuguugggcgcaccaagguuacuuugugaauuuggauauugaauauuaucuaauaaaguuaaaauauuagcuuuuucuguauuuuuugaaacauauauucuagacagauuccuagauaauuguaccaucacuacuucuugcuaggauauuuaggccugaucaugaaguccuaagugaggcgcccuaagauauuaugguaagagagauauuuuuaaucugaaaacagggugacuaaggagaaggugcuacacuuucauauauuggcauucugugcacaauugaaaggaagguucccuuuaacauuacaaaggaaaaaaauuaaaauacauuguuacagaacagguguuggcaaguuuucuggagugggccggauaguaacuauuuuaggcuuucuggaccauguagccucuguagcaacuacucaacuuugcaguuguagugugaaagcagcugcagaaaauaaguaaaagaaugggcauggguauguuccaaaauaacuguauuuaauacaauuuuuauuugucaauuaagaaaaauaauuaaaaaaaaaccaaaaaccuguauuaggcugggcguggugacucaugccuguaaucccagcacuuugggaggcugagauggguggauugcuugaccccaggaguuccagaucagccuaggcaacaugacaaaaucccaucucuauaaaaaauaaaaaauuuagcugggugugguggugcaugccuguagucccagcuacucaggaggcugaggcaaggggaucacuugaggccaggaggucaaggcugcagugagcugugauugcgccacugcacucuagccugggagacagagcaaggcuguugucaaaaaacaaacaaauaaacaaaaaccguuuauuuauaaaaauaaacccuggggcugcaggucaguuugcugaccccugauagagaauauuuuggauauaggaucuuguucugucauccaggcuggagugcaguggcgcgaucuuggcucacuccaaccuucaccucccagacucaggcaauccuccuaacucagccuuccgaguagcugagacuguaggcacgugccaucacaccuggcuaauuaggagacgggguuuugccauguuucccagaguggucuugaacucgugggcucaagugaucugccugccuaggccuccugaagugcugggauuacgggugugagccauugcaccuggcccaauacugauuuuuuuaaaaaauucuuuuuaucuaguucuuauaucugaaguugagcuuggggaggaugauuuaaacauuugaagaguauuggcccauuaaauuuuaugucauuaguccauuauuuauaaaaaugguuuaauucuaacugcuuuugcaauuuacaggcgagguagcccucuguugauugguguacggagugaacauaaacuuucuacugaucacauuccuauacucuacagaacagguaaaauuaccucuacaaaugcagugcaguagauaugaagaauuauuuuccuuaaguuggaauagauggcucuuuggucagaugcacauguauauauaguucugucuagacaugaaaaagauuuguuuuugugaguucucugaugauuagaauuuuuuucuguuguguauccuuagcuaggacucagauuggaucaaaauucacacgguggggaucacagggagaaagaggugggaaaugcacucugcauggauggggaggaucuuauccucuuuuguuuauucuuuacuaauucuuuuguucuuggagugaaugaaugugcugggccucuaaaaaugugcuuauuuuguggggaagcauauuuugacauuuuucuaauuugcggaguauauuuugcgugucugcuuuuggcauuuagaaagugcuuuuaauaauuucauuaaaauuucugaaauuugagaaaauaguugaaauuguaaauuauuuuuuccuuuguuuuaaaaucauguaggauguaugcuuagauuaggaaaagagcauugugugcuagguuauuauagauugacuaagugguaguuauuugaaucauuuaggcuaacuuuuaacugaaauauguuuaaguggucuuuauuuuuuauacaugacauauuguuggauuuacauuugcuaucuugauuggcuuuauuugaauuuguagugauuguucuuuuauauuguuuauguguaaaguuuauuuuuuguuuuucuuauuuauuuacuucgauguaacuuuuuuauagagcggcagggggagacagggucuugcucuguugcccaggcuggagugcagugcagugguauggucauaccucacugcaauuucgaacucuugggcucagguggauccucuugccucagccucucaaauagcuaguacuacaagcgugugccaucauacccagcuaauucuuauuuuuagccaggguuuugcucucucagccaggcuggagugcagugguuucgucauggcucacuucagccuuggcugccuaggcucaagugauucucccaccucagccucuugaguagcugggaccacaggcaugugccaccacccccagccaauuuuuuuauuuguaaaaaggaagucuugcuauguuggccaggcuggucucaaacucuugggcuuaagggauccucccaccucaaccuccuaaauuacagggauuacaggaaugagccacugugccuggcucccagcuaacuuuaaauuuuuuguacaaauggagucuugcuauauugcccaggcuguucuugaacuccuggagucaagugauccaccugccucagccucccaaagugcugagaucacaggugugagccacugugcccagcccagaaguguucuuuucauuuaaacagacauugauaucucaaauuuuuuuuaccuuauuuauuuauuuuuugaaacagucuuguucuguugcccaggcuggagugcagugacaugaucuuggcucacugcaaccucugccucccggguucaagcgagucucaugccucagccuccagaguagcugggacuaccagugcacaccaccacacccggcuaacuuuuguauuuuuaguagagacgggguuucgccauuuuggccgggcuaaucucgaacuccugaccucaggugauccgcccaccucggccucccaaagugcugggauuacaggugugagccgcugcacccagccucaaauuuuuuuuacauauuuuaacuaaauauacuuuguuauuugaagaaugaaauuaucaauauuuggagaaaaaacacagugaaacucaagccuauuaggacauuuuauaagcaaaaguaguuguuuuuuuuuuuuuuuuuuuuuuuuugagacgaagucucgcucuguugcucaggcuguagugcaguggcgugaucucggcucacugcaaccucggccucccggguucaagcgagugucuugccucagccuccugaguagcugggauuacaggcacgugccaccacacccagcaaauuuuucuauuuuuaguagagacgggguuucaggcuguugcucaggcuggucucaaacuccugaccucaugauccgcccaccucggccucccaaagugcugggauuacaggccugagccaccacaccugguugcauuuauuuuuuuaaaaugcugagcucucuuuuuauguguuuuuaaauucacuuuuuuguuuuguuuuugagacaaagucaugcucugucacccaggcuggagugcaauggcacaaucucaccucacugcaaccuccaccucccagguucaagcgauucucccaccucagccuccggaauagcugagacuacagguguacucuaccacucucagcuaauuuuuuguguuuuuaguagagacgagguuucaccauguuggccaggcuggucuugaacuccugaccucaagugaucugcccaccucggccucccaaagugcugggauuaaaagcaugagccacugugccuggucucuguuuuuuaacauacaguaauauuuacucuuuuucauguaguuucaccaauuuugucagaugcgaaauugcauaaguaccaccauaaucaagauacagaacaauuucaucacucaauaaggucccucaaccugcccucugucaucaacccuugucucauucccagccccuggcaaacacuaauauguuauuuuucuauaauguuacuuuuucuuggaugucaucuuacauuuauuuuucaguuuggcaucuuugcuguuaaauaugaaugggaaaaguuacuuuguuuucaucacuaaaacaucaaauaaucacagaugguggaaaacuucgaauauacuuuuuuuggcuuuuauuuuuaauagauauauaauuauauguuuaugugguguauauuucaauacauguguacaauguauaaugaucagcucaggauaaauagcacauuugaaugcacauuucugauaauuaucaagucugccuuuauaugugcauuuuaagaggauagaugaaauagcaguuuuuauaaguauacuugugauguucucuggcuauuguguccauaguucuaaguucuguuauguccuggccuugaagaaaggugcauuuuugucucuaggacauuuauguagucuucaacuaauagauuuuuuuccuauauaaggccaauuuauaaaaccuuagcauuccaguuuugaugaaaaaguuaauauuaaugucuugacaaauuaaguagaggugucauaauucugaaauacaagaauuaaaaggauauuagcuuugcaaaaagacccuacuuuauccugacuuaaaggaagaguaagaaaacccaaguugaagaaaggagaguuucuugguuuauaaauuuugucucuaacagugggugccacauaugauauaccgugauuagagagugauaugcaucuguuuuguuuucaaaucagaauuaguguagacuacaacuugauuuguuaugcugacuugcugcuaaaaucuagugagguuuuguuaugauacaauaaaaauuaauuugccacuagccuucauuuucuuuuucuuuuuuuuuuuuuuuugagacagaguuuuugcucuguugcccaggcuggaguacaauggcgugugauuucggcucacugcagccuccacuuccuggguucaagugauucuccugccuaagccucccaaguagcugggauuauaggcgucugccaccacgucuggccaauuuuuguauuuucaguagagaugggguuucgccauguugaccaggcuggucuugaacuccugaccucaagugauucaccugccucggccuuccaaagugcuaggauuacaggcgugagccccuguguucauuuuauuuuucguugcacaauuuugauauuuuaaauguaauuuuguuauaauuauagguacacaaacuuuuauguguuaagaucauuguuuuguauaaaguuaaaauuaauuuauacauacuuuugauuuaaaaaaccgguuaauauuaaggaauuacuugucuuuuaccuggaaaauaaauauuauauuaaaaaaacauauaauguagcacuuuuaccugccacgcacucuuugauaguugcuacuucacuguacacuuuuugucuguucuuauuggcuuauugcauggaaauaaggugaucuacuuggcuuuuuaaauuugcuaaaauuguuuuguguugcuaugauuuuuucuugauuuuauagaauauuaugcauauuucuacauuggacaugauuuucuacauguuugccaauucauguuaacuauaugcuuuaggcaaagacaagaaaggaagcugcaaucucucucguguggacagcacaaccugccuuuucccgguggaagaaaaagcaguggaguauuacuuugcuucugaugcaaggugagcuuccuuaguugauucaaagagauuuuuaguaaaacuucucauucugcaggaaacccaagaagucauuguguaucagucuaguugugcucugugagauaacuuuuuaaauuaaagaaauacaggugaccauuuuggagauggggcuguaaggacacuuuuucugucauuucaaaguaugugggucaguuuacuaagaacacauauacugcuugagacuuguuccaguguauuuauuuuagagcucuuacauuuuuuuccuucuuauuucaggagccuuauccagguuuugaagggaggagauucuagauugaagaguaaaauggcuuaguuaguaucccaauaguuauagcauaguugcuaaacuauuguaguuuuagucuaauguagauacucaucuuuuacauuuagaauuaauuugcagcauaaucauuuuuauaaagggauaguaguagacuaagauauuuugagagaaaaugcagggggauguuuacaugcauuuguaaaugaaauaguaaugaggauaaaauaaaaucaccgaaauugcaaacaaguauuugagucauccacuguaccugaaaauaagagaaaauaauaaaaauaagaaaauaaugccauuuaggacaucagggaauauauuaucucagugggaaaacaagcuuuacucuuuaauguuuuuacagguguguaagguguguagucagggcuaagauguguaagauuacacaguugacaguuauggcuuaaauacacuggaauuacagaaacauaucagccuuuucucauucauuuauacauucauauugaacacugggugaagucauaugcuagcgucaggagauaauggugaguaaaaauaaaaauauuacuuuuccuuaggagcucuuccauagugaggaggcaaauuuuaaacaaugaucacagaaguguagaauuccagcugugacaagagcugcagaaugcuaguaacagagugauuuacccuugguggguaaauuucuuuaagggaaugauguuugaacugagaguuaaggagagauuaggaguuaauuagguuaacagguagagggaggaacauucauucuuugcaaauggcucagccugugagaguuuaggauggcuuugaguguggccagaauagagagagugagaggaagcuuggggggagaugaagcuggagaaggagguauagggauuacgguaaggcacuuuguugucucucugagagccaaagggaaacugucaaaugguuuguugagugaaggagaaaucuuuauuagaguuguugccuuuugauaucaauuuuggcagaaauggaggauggacggagagagaucagagagaaaguggguggacuaauugggagaucgcugcaguaguccacccgaggagcugaugggagcuugaauuugucuggugguggacauagaaacuaagaauauuuggaaguuaaaauuucaggacuugguaauggauagaaugaggaggaaacaaccaugcuuucugaucuaaucuguuugguuuagauugcuaugcagaguuccuuuuauuuuuuguccacaaugaccaccuuccccauacuuuccuguagggguuggcauuaguaaccagaaaauucucugagauacugcagagugauagaguuuauauugaaauuugguucuuguauccaaaugauaguuucauuuguaauaaugauccuugguuaucgauuguaauaucuccuugaaaacuuuauagugcugucauagaacacaccaaucgcgucaucuuucuggaagaugaugauguugcagcaguaguggauggacgucuuucuauccaucgaauuaaacgaacugcaggagaucaccccggacgagcugugcaaacacuccagauggaacuccagcagaucaugaagggugaaaguuuuugucauguuauagcuugcuguccuuacuggaaagaauauauucuacuuccuuuccuagcauauuaaaucuaguaaugaaugaugaguggaaucuuccacaugauuagugaagggacaacgcuaggaaaagggaugauucuuuagagaaauuaucugcuguuuuuacaaucgucuucaaacuaauuaaugauuuguuauuuguaacauuauaaaaagguuauuaacacuugauacuuuaaagauacuuuauaaacauaaaaauaguuaauguucuguuccuuuuuauucucuuugugcuuuaguuuucuuauauauaacaugaggauaauauagccugccucauuaagguuguuuugaggauuaagaagcuacuauauggcugggugcgguggcucacaccuguaaucuuagcacuuugggaggccgaggugggcagaucaccuaagguggggaguuugagaccagucuggccuugccaacguggagaaaccccgacuguacuaaaaaauacaaaauuagcugggugugguggcgcaugccuguaaucccagcuacucgggaggcugaggcaggagaauggcuugaacccgggaggcagagguuucagugagccgagauugcgccauugcacuccagccuuggcaacaagagcaaaacucugucucaaaaaaaaaaaaaagaagcuuaaaacagugucugacacacuuagucguauguaauauuugcuucuguuaacuauuauaauuauuaugauuuggauuauuuuauuccuuucugaugggauugugguaggaauaaaaacuaacauuggccaggcacgguggcucaugccuguaaucucaacacuuagggaggccaagguaggaggaucacuugagcucaggaguuugagaccagccugggcaacauagugagaccuuaucucuacuacaaacuaaaaaaaaaaaaaguccaggugcacuggcucacaccuguaauccuagcacuuugggaggcugaagcaggcagauugccagagcucaggaguucaagaccagccucagcaacauagcaaaacccuguuucuacuaaaaauacaaagaaaauuaugggcaugguggcauguaccuguagucucagugacuggggaggcugaggugggagaaucacuugaacccaggaggcagagguugcagugaggugagaucgugccgcugcacuccagccugggcgacagagugagacucugucucaaacaaaacaaaacaaaacaaaacaaaacuaugagccgggcaugguagugugugccuguagucucagcuacucagguggcugaggugugagaauugcuugagcccaggagauugaggcugcagugagcggugaucuugcggugaucacuucagucugggugacaaagacccugucucaaaaaaaaaaguaaaaauaagaaauaacauuuauugcauaacucuauauauauauaugucagauuuuuugcuuuauuaauccauacuacaauccauacugugaaguaauuggucucuuauuuuauagauuaauaauuuccccaguuuagauaguaaaggauagaacuacaguuuggguggguugcacuccaaaacuuaaagcuugucccaguugacugagugcgguggcucacgccuguaaucccagcacuuugggaggccgaggugguuggaucaugaggucaggaguucgagaccagccuggucaguauggugaaaccuugucucuacuaaaaauacaaaaaauuagccgggcgugguagcacacgccuguagucacagcuacucaggaggcugaggcaggggaaucccuugaauccaggaggccaagauugcagugagccuacaucaugccacuccacuccagccugggugacagagcaagacuccgucucaaaaaaaaaaaagcuugucucauucacuuguuguaacugcacauuucaaguaugaaguuaauuaaaagugacuuuuacuguuauuuuuuuccacagaguaaaauauguucacccaaucuuuuaggcagucaugucuauugcaugaacuuuuguuauauuuuauuuaccaagauuauauuaaaggaaacuuuuaguuguguacaaauucuuuuauuugauuuguuuuuguuuuaauuaugugauuucuauuacuauaggcaacuucaguucauuuaugcagaaggaaauauuugagcagccagagucugucgugaacacaaugagaggaagagucaacuuugaugacuauacugguaauuacauaugaauuauuuuauuauuucagugucucugacaguaggaggugccauuaacaaccugaaaguucauugcccuuaauagccuuguagaacaacuacagcugccagccaucaguggagcccagccaucuuggaaaaaguucuuuagugugugauucuaccuauauaagauaucuagaauagucagauucacagaaagagaaaguagauuaaugguuaccaagggcuguggggaggggaaauggggagucacuguuuaaaggguacagaguuucaguugugggaugaugaaauuacagaaauggauuguagugaugguugcacaauaaugugaaugugcuuaaugccacugaauuguacauuuaaacauaguuaaaaugguaaauuuuauguguaggucacccacuguguaccagggacuguccuagguacugugaauucuaagaagaauaagaccuggucccguugcugggcagcuuauguguaucugccuggccuagguuuccuuucugaguguauaaauaaguaaaagugugaacuuccccagaggucuuucaguuauuugccugaugccuuuggauaaccuguacccuccugcauuuuuaagguagaggugagaguacaacacuacucuuuuuuuuaggauggaguuuugcuauuguugcccaggcuggggugcaguggugccaucucggcucaccgcaacugcugccucccggguucaagugauucuccugccucagccucccaaguagcugggauuacaggcauguaccaccagaggaauuguaucugccucuguagacagaggugguuguugaagaugguugagcuggaagaacugggagaguagcaguaaauucuuuuaugguauuuauggaaaugaggucaggaaaaagauuuguuuuauaagggaagaaaaugagacaaacuuugggaaguucacgguuuuaaaaaguacuuuuggcugggugcaguggcucaugccuguaaucccagcgcuuugggaacccaaagcgggaggaucgcuugagcucaggaauucuagaccagucugaccuccuuuuuacuaaaaauuuuuaaaaaauuagcugggugugguggugggugccuguagcccuggcuacugaagagccugaggugggaggauugcuugagcccuguagaucgaggcugcagugagcucugacuccaccacugcacugcagccugguugaaagaccugucucaaaaaaaaaaaauaaaaaagaguacuuauaucuguauuauguacauaaaaguucuguaauaaaacaggauagcugucaucuuuuuuguuguuaggaugaggagauugaggcuuucaguuugucaaaggucacauuguuagucauuuauugaaccaaacuacuccccauguauucauuguucuaagugcucuccauccccuccccuguccaucaggcauucuuucuuuugccuguagugauggcuuaccucaucucaaaagggaucaggcuuuucucaaaagcaucaaauuuagagcuuugggcagcuucuuucagaacuaucccaacuauccucagccaccagaaauuucuaggacuaauuuuaaggaaacaaccguggccagcuaaucucacugucuuacauccaugucauucuuugucaucaucugcaauacaggucuuucugguaguuggucugccuuuuuuuuuuuuuuuuuuuuuuugcuuugcuuuuauauugagucuuugccuuugcaugacccugauccagccuuuuacugcuguuuccuuucuucucaaacauuuguaauuaaugccaaggucuguggaaaacacuguaggcagagguacacaaacaggcuuggucuagugcaguaacagcaagaaggccagucuggcugguguggccugagugagaagggaugugcuaggucagaguaagcaggagacaggucuuaugggacuugaaggccaaaguaaguaguucggauuugauuauaaauuauuugggaagcuagugacacuuuuuauuuuguuugguuuuguuuucuacuugcuaauuuuuuaaaauagagaaacauaccuucuuucauuauugaaauucaaaacggagaacauauaauuauucaaaagauaaaaaguaaaacacauaccuugguuuuauaguauaacuaacuaagauaaaaaagaagguggacuggcugggcgugguggcugacaccuguaaucccagcacuuugggaggccaagguggguggauuacuugaggucaggaguccgagacgagccuagccaacauggugaaacccucucuacuaaaaauagaaaaaaauuagcugggcgugguggcucgcggccuguaaucccagcuacuaaggaggccaaggcuggagaaucgcuugaaccugggagguggagguugcagugagccgagauugcaccacugcacuccagcuugggcuacagagcaagacucugucucaaaaaaaaaaaaaaggugaggagaugaagagagcaggggcagaguagacagacugaaaaugguucagagagagcagcaggaugaggcccacgaggagguaccugucauucuccucagccagauuuggaauuguuugaguccagaagcucucagugccuugaccacuauauuuacuuggugggugauuagggaauuuuaguugaccaguugaaugaauguugaaugagaauuucucacagauagaaaacuagccuguguggaaggauuucuggacaagacacauggagaacaacauguaaauagcuauagaaacugaaaaugaaaaagaggacagacuucauuggagggucuuuauguuuuuaaaggaucacuguaagagauccuucugguagcauauggagagcagacuccaggagguggagaacagaagagagaacuggagaauguugcugucguccagggagagaugcuggguuugaagauaaauguggagggaucagaacaaucaagcauuuugacugaagcauuaggggaauggggacggcaaagacugagaggagaguggguuuauguuacucuacagagcaccuuucugggcaccagaggggaaauaaacguaacugagauaauguuuuucccagacagguuuauugagacauaauuagauauaauaaaauucaccauuccuaguguauaacucuaaguuugacaaaccucuacaacauagucauaaucauaaccucuacaaagucaagauguagaacaguuccaucacucccaaaauuuccuugcacccuauuguugucaaccccuccuccagcuccagcccucuacaucuaaugaucuguuuucugugucccucuacuuuugccuuuaagauaacuuucaaagagaagaauguaaaaauaacuaacuaagguagaauguaauaaauacuguaauuguguggggauguagagaggugaguaaggucaguuacaaguuugggggcgccagugaaguugugacuuauuuaauuuacuuuucaaaauuacagagaacugugcuuuccaagaggaauauuaauucuuuaaaacagcaguauucuuccucauauuggcaguggauacucacaaaaugcgauugccuaguucacaugguucuuugcuaaauaauuauguacacaaacuuuuauuucagugaauuugggugguuugaaggaucacauaaaggagauccagagaugccggcguuugauucuuauugcuuguggaacaaguuaccaugcugguguagcaguaagugcuuuuuaaaauuuuaauuauguugaauauuagagaauaucuguagaccaaguaguagucuaauaacauacuguguaaaacuauguuuuguuaauguguuaucuuuucccuuuugugauaaaaaaagaagguaaggggagaaauuuaccagcugcuuggaauuauuuauccauggaagaucuguagaaaaggucccuagauauacagauagaccuccugcaacggacuucaugaaaggccaagagggggagaguuuguguacuguccuagacuuguagccuagggagcuugccuacauguguaagagccaucguuggguuuugcuuagcauuguucacuugcccuagacagauggccugcaucaugugugaaccucagugcaauuuuacuuugugggcacauuacugcaaagaaagguagucugcuuuuuuuuuuaaaucagauuuuauucuuuaaauuguucuuuuagaagcugaaauucaguaucaaaaauguguauugucagugcagaagcauagguguaugagggucuuuuauuccaauaaaagaccaauauuugcccacguaguuuccuuagaaagagacaguuuauguguugcugaugucaacuguuaugaacagaagaccuuuacauucaauuucugcuuuuaggauugacuuccaaaguuccugacauaacuuauuuauuugcugaggcauaaauauuuauuaggagccauuuauuuaagcagugagugaaacuaucuggucaccugcccuugcaucucaacaagcuuugcucuuuucuaagacuacaccaaauaccuccuccccuccucccccaaaauuauaugguccuaaacagaaagucuauguaauguugaaggguagaggucuaaaaaagugauuguuuugucuggguguuguggcucacaccuguaaucccagcacuuugggagggcaaagugggaggaucaguugacccuaggaguuugagccugggcaacauagcgagaccccgucucuaccaaaaaaaaaaaauuaucggggugugguggcaacucccuguaguccuagcuacuugggaggcugaggcaggaggaucgcuugaguccagaaggugaggcugcagugagccuagauugcaccgcugaacuccaaccugggcgacaaaaccaggcccugucucaaaaaaaaaaaaaaauuuugaacacgggaagaagaaagauguaaacacguuagugguggcuuagaucuauuacugaaugagcccuguauucagaaauagaaaauuugauuaaacgcuucaucuaacgcuaagacaauuugggggcagaaauuauauacucuguuagaauucucuaauguaagauuuuuuguuguuuuguggaugccaagacuacuguaguaaacaaacauuagaaaucccccugugguuuaucagacaaaauaguaccauuuauuuuauccuguuuuacauuuuuguuguuguuucaugacacauuuacauguuuuuuuuuuaguaucuauauccugaauaacugacuacacucuaaucauucuuaacucauuuaugccagagguugcaaaauuuuuuugugaaaaaucaucagaccuuggugcugaccuugagcaguaggauauaaauaacucccacaugcuuaacguuccagugauggaacacuaggcauaaaugauuuaaguauagccuacuuaauaugcuuuucaaaauuuuaauuuucucuagguuuuguaguggcauucaguggaauuuauagcauuaaguuacucuauugugauggaaauaugucauuuuguguauuuauaaaaaguuguucgcagcugggugcaguggugugugccuauaguuccagcuccucggaagcuggggcaggaggaucacuugagaccaggaauuugaggccacagugcccuagaaucaugccucugaauagcugcuacacuccagccugggcaacaaaccaagaccccaucuuuaaccaaaaaaaaaaaaaaaaaaaaaaaaguugccccaacuaaaauaauaaacuauuaauuagcacagauaaaucuugagauuacuuuuuugggguuuauuacuuuuaaauaucugguaagccuccagauuucuaucuuucucucuucuuuccccaucuuuuuauuuugaagaauaugauuccaauguaacauuuauauuauaaacugggugaaaagguuugguuuacauuuauuugugggaaaacauuuagcauuuuagugucgguaacuuaauuauguauaauaaaauauauuaauggaaaagaauaauaaaaaauaggagcauuuuaucuucaaugauuuucuuuacaugauguuguaauauuguuaaaaaaugccaaaucaaaguuauuuaauauuuuugggggaaccaaguaaaacgauucuguucaaauuugugggcaagcaaaaguuaagggcuaugaaauaagggcaccuuuaaguucuuuauugcugagaaggaggaaagcugagaugggugagagauggggagggccacuugccugaagaggcuggugaaaggcugucagguuaggugagcuccacaguuagaauuaaagcaacacuaaauguauacauugguugagcuuaaaguuuuugcugccuaaaagauaauuuuucuguuuuugauuuuccgauguuuaguguaaaaauaauuagaauggaaauuuacugaaaugaagguuaaacuacguuuugcacagaggcauacugcucccuacuucauucccccugccccaugccacaaaaguugaaaauagugagcccuguuaaacaagauuucuaaaauauauugacuucuuuugggaaauggucauauuuaugaauacguuguacuuuuaaaguguuuaauuuuucucuauauauuuguacaucuguuaccugauuugaaaccccucccuaacauggguauuacaugaauuuucauuuuaaagauuaggaauugggagguuagagauaacacacaagcugacucagaaccaugcucuuuccacuucucaaaacguuuuauauguguggguauguuuccuuauaagaauguauguguccaggcgcaguggcucaugccuguaaucccagcacuuugggaggcugaggcgagcagaucaugaggucaggagauugagaccauccuggccaacauggugaaaccccaucucuacuaagcugggcaugguggcgcacgccuauagucccagcuacucaggaggcugaggcaggagaauugcuugaacccgggaggcggagguuacggugagccgagauggcaccacugcacuccagccuggcgacagagcgagacuccgucucaaaaaaaaaaaaaaaaggaauguauacauagauaguugucuaaagagacugauaguaaaauguuagccaugcuuaucucaagugguaggauuuugauuuuuuuuuuuuaaauauuuuaaucuggguuguuuuuauuuucuaacgugucauuuuuguaaucagaaaaagcaaaaacuauacauugaauccaaagaaguccgaugaaagaguauuugaaggaaaguucugugaccaagucauauuuucucugcagacacgucaaguucuugaggagcugacugaguugccugugaugguggaacuagcaagugacuuccuggacagaaacacaccagucuuucgagaugauguuugcuuuuuccuuagucaaucagguguguuaauuuuaaagacuuaaaaggaaggaaaguuauucuuucuaauaauucuagcauaucuuggcaaaagcugauauuuaaagauaaacuggcauugcagaugacuugacgaauacagauuuauuuuaauguuacauaauucuuuaugaauuaguaaaaaugaacaccuuuuguguucaaagagcuggauuuucaaugacagagaaggaagagagauccugacaagccauauuacuuaaaguuuuauaaauuuauuaaguggauguuuuguauuuuauuuaaaacaaguaauauuguugaaaguguggucaauuuguuuuugcuccuaagaaacagcauauguuaaaacuguucuguguguuaugguuggccuacuuuuuacacaggugagacagcagauacuuugaugggucuucguuacuguaaggagagaggagcuuuaacuguggggaucacaaacacaguuggcaguuccauaucacgggagacagauuguggaguucauauuaaugcugguccugagauugguguggccaguacaaagguaaauucuugacucauuucucugaugauuauuuaaucauagugucagugaagcagacuagucuguagacuagucuguaucuuauuuuuguuagcaguuauagaacucacacauuuuauuuuuguuagcaguuauagaacucacacauuuuacuaaucauuguaauuauuguaggacuuuagggucagauagauaaaagacuugucauucucucccucuuccugauagaguuuaaaagggacuuauguauauaauguaaguccauuuugaaaaggucucugcuggcuauccuugucuaucgcuuacugcccuccugcuaggcacaguaggauacauaacaaguauauaacauccccuucuuuuaugaaguauagucuggaauuugaaaaguaacaaauuagaaacauccacuuuaaccauuuuuggaauuuuuauuuaccuauuuaugguuucuaauaaauaauguaaaaauauacauacuaccucugaaaguuuguaaggaggaauacaccuuugguauaaaauuuggcaacugccaggcaugguggcucacgccuguaaucccagcacuuugggaggcugaggcgggcggaucauuugagcucaggaguucaagaccagccuggccaacauggugaaucccgucucuacuaaaaauacaaaaauuagccaggugugguagcacgugccuguaaucccagcauacccgggaggcugaggcaagagaaucacuugaaccugggagguggagguugcagugaagcgagauugugccacugcacuccagucugggugacagagcaagaguccaucuaaaaaaaaaaaaaaaaaaaaaaauuuaaaauuuggcaauuaaaaaaaauuuuuuaaugaguauuguaugacaauaucuuucucuuuagauauugcucuggggagguuuaaagguacugucuuguguuuugaaggccugguaagacuacuuugcucuuuggaauuggaauaugcauaaauuuagguggcuaauaaaaauaggaaaucuuagaaaguuguauaaauacaagagauguuaucccuccacaaguguuuuuuugggguuuuagguuuguuugguuguuauuuagagacagggucuuguuuugucacccaggcuggggcuggagugcagugacaggaaucauagcucccugcagccucagacucaugggcucaagugaucucugccucagcuuccugaguggcugggacugcagaugcaccaggcuaguuuuuuuuuuuuuuuuaagauggggucucacuauguuguccaauguguuacuuuuuaugauuucacauuuuuguuuucucaauauuuuucuacuuaaguuugauauuucuugcugauuaucuaauaagauguugggauauugguggauuugaguuuaauuaaaggauugugaaagacaauguuaauguguacauaacugcauuugaauucuuuucccucaaagauucucauagagaauuuuuuguagaaaguuugugauucuuauauaaaaauucuucuuuucuuuuucuuuuucuuuuuuuuuuuuuuuuuggagacagacucucacucuguuggccaggcuggagugcaguggcgugaucucagcucacugcaacccccgccuccuggguucaagcgauucuccugccucagccucccagguagcugggauuacaggcaccugccaccacgccuggcuaauuuuuguauuuuugauagcaaugggguuucaccauguuggccaggcuugucuugaacuccugaccucaagugaucugccugccucaaccucccaaagugcuggaauuacaggcaugagccacacuguaccuggccccccaccuuuuuuuuuuuuuuuggagacagggucucuccucuuuaucauccagaguacauagagugcaguggugcucauggcuuacugcagccuggaccuucccaggcucaggugauccucccaccuuagccuccugaguagcugggacuacagguacaggccacuacccaugccuggcuaauuuuuguauuuuuuuguagagacggaguuuuaccauguugccuaggccagucucgaacucuugggcucaaacgaucugccugcuuuggccucccaaagugcugggguuacaggcauaaaaacucuugagugagauuuuuauuucuuggguauuucgauauugcuaacacuauaauuuacagagugcugaaacuugaauuuucuccauaugguaauuaaaacguguuacauguuugugcuuggguuuccauccuguggcugaauaaaugaccagccaccuuuaguagcacuuaaggauuugauugggggauuggaaucccagaggcucuuuauuuauaacagauugugaaacaagggcuacaacgugguguaugugggauaugggauuguuuggauggaugccauugacuuaaucuuuucauaaaauguuucuggaauugugagcugccaagggaaauauauauuuuacauuucucauuccuuuguuuaugagaacuuuaauuugccucaacauuuuaugaugaugauuuucaaauauacagcagaguuuuaaaaauuuuacauacaggcugggugcaguggcucacaacuguuauccuggcacuuugggaggcugaauugggaggaucacuugaggcuaagaguucaagaccagccgaggcaucagagugagaccuuaucucuauaaaaaauacaaaaauuagcggggcaugguggugcgugcguguagucccagcuacucaggaggcugaggcacgaggaucccuugagccugagaguuugaggcugcagugagccaugaucacaccacuacacucuagcuuggaugauagagugagacccugucuuaaaaaaaaaaauaaaaauuuuacauuagcauugguauacccaccaucuagcuucuaccauagcauauucaccaauuuuaaguguacaguuuuaguaaauucauuuggcuguacaacuguuaucacaauccaguuuuagaagaugaucaccugaaauauuccuuuguguuucuuuguagucaauccuuacuccuacccuccagccucauacucaggaacuacuguuuucucuugcuguauuauggcauuuuccagaaaauuuuuguaaauggaauuguauaacacgucuugugugucuagcuucuuucauuuagccugaaguuuguuuuuuaaauaaagccaguuaaauuuagcagugagguauuguauaccaacuuuaguaacgcuaauguuaaugaguucuagugacccacuauuggacuacccuagccugaaguuuuugagauuuguucauguuguuauuuguaucauuaguucuuucuuucugcaaaucuuuuuuuuaaauauuuuuauuuugaaauaacuauauaggaaguugcaaagauaguacagagaagucuuacauacuuuuuacccauuaccccagugguuaccaccuauauaagaaaaauuagcaucuuuuuaguacagacuuuaauuuuuuucaaaaauaacucuuaaaaaaauugaguaaguauggcaauuuaguauuucauuuuucuuggauucuaaaguaauuuuauucaaaugucuuagacauuuugggcuuaguuacuuacaauaaguuuuggguuauuuagucacagaccauuccagguggcaaauaagaguuuuuauguuaauggguauugaaagaagucgauuauuauuacuauuauuauuauuauuuugagauggaguuuugcucuuguugcccaggcuggagugcaguggugugaucucugcucacuguaacuuccgcccuccgguuucaagugauucuccugccucagccucucaaguagcugggauuacagguaacugccaccacgccuggccaauuuuuguauuuuuaguagagacugggugucaccuuguuggccagucuggucucgaacuccugaccacgugauccacccgucuuggccucccaaagugcugggauuacaggcguaagccaccgcgcccagccaaaaguugauuauugauccuaaucccugggcccagugauggagcacauagaagaauucugugaucuugccuguaaauucucaacuuugccugaaaaacugucaggauuagagggaucuuacugaguuucucauaguaucagaccauagacaaguugauacuacuggaggaauugauggguauaaaugguagguucagcaauuuuuauauguuauugcagguguuuagaauuucaccacagugcugacuuuuguugauuuaaaaaaauaaaaauguaacuuuguuuuuggcugaacaaaaagaaaaaccaaguuuaaaauuucagagucagcauuuuccugguaaacucuuucaaaccucgguagauucugaauguaggguauagcuuauuuuuccucauaauugguuuccugguauguauugaugaaauuaaaaauaugaaauucaaauuagaaauuaaacuguaauagcaaugcaauggaaaaacauggauuaaaguugcuccguuuaauauuuguacuuaaaaacuaguguucagaugguuucaguucaaacaaauaaacacuaguuuguagaauaacauuuuuaguuaugggcuacaggaacuggaauacucauuaucugaucaguuuggauuggaaacaguuuaaguauuccagggguccaagauaccucuggccugguaguauguuuugugauuaauugauuaauugaaaaguaaaccacaguaggaagaaguagacuggaagagucuggaauuuagaauauagaugugcucauuagucucggaggcagaggacuccaaauucacuuuaguguuaugggaaaagauuccagucugcugguggaauauaauagguguacagggaggcaguuguggaggaccaugugagcagcuggaggcugggaaguccagcaggaggaaacagggagucucauuuaacuauugggauguuaaggaguuaccagacugugauuuuauuauagagggagucucauccacaucaugccaggaaaucacuaauggaguaaucccuuaucaagagaagaguaauagaaauucagcauauaauccgcgcgcgcacacacacaccccucagcauaaauuuccuaaagcuaaaauuauaucuaacacuguaacugacaacagcacaauaaccuacugaaagagauguaaauaaaagccucaaauaucugaaacauaaaaauguuuuucaaaauaacuauuggauuaaaaaaaaucagaacuaccauuaagaaagacuuacuagaggccgggcgugguggcucaugcuuguaaucccagcacuuugggcagaucacuugaggacaggaguucaagaccagccuggccaacauagugaaaccccgucucuacuaaaaaaacacgagaaaauuagccgggcaugguggcgggcgccuguaaucccagcuacuugggguggcugaagcaggagaaucacgcgaacccaggaggcugagguugcagugagccaagaucaugccauugcaauccagccugggcaacaagagcaaaacugugucucaaaaaaaaaaaaaaaagaaaagaaaagaaagacuagaaaaaaguaaacaauaaauaauagggguaaaaauuuagaguguguggccaaagugauaaauagagggaaauagcauuaaauuccuagcacaaauugaugaaaaugccauauuuuuaaauggaaagauuguuuuguaaagaaaugacauaucuuggguuagaauuaguguuccuucaacuugcacuaaaauuaauuucaaacaggcuaaaaaggaaaauguuaaaaaaauaaaaaggaacagugaaaacaaaagaaguaagaaaauuuaauaauacuuaguuuauguaggauguggaagaguuaucugagucuaaaaguacuacguaaaaguuaaaaaauuaugucagcaccaauauaaaaggucaguccacgaugagaaaaaauauuugagacauaacaauaacuaccuucuuuuuuuuaauuuuagagaauaguauuguauugaauacguuuuauucacagaaaaauaaacuuuaaucuacaaugaaugccagauuauacagcagaaagcaguuuucuuaguuuuccacauagaaagguucuuacuaagugaaaaaaaccauaaaauuauauucagaaauauauuacucugucucaaaacauuucacaugauuauucacaauacuaauacaauuagaucagucauucagucagguuaaaauauaacaguaaugaaaaaaaugcaaaaucuaacauaaauuauauuaaaacccuuguuacaucacaccaaaaaugcaaauuucuuacuaaauccagaaaaaugguaacauauauaguaauuuaagguauuacauuaaugguacagaauaagaaagaagugguaaacucugaaaaucuguaggcauaucugcaaacuucagacuucaaaguagaaucugaccacccaaacauuaauguagcauuugucuaauuuuuuuguuuugaacaauaacuaccuucuuaaaaccaauuugaauaaagaaacucaaguugaaaaacaggugaggaacaacaaagucaguugucaaaagagaaaauauaaauggucaacaaacaugaaaaaaaagcuuagcuuuaggauucaagauauguaugcuaaaauaguagugaagguucauugucccgcagucaaaaugguaaaaguuugcuaaagagauaauucucaguauuucacagaacuugacaaaacaggcacaucucacagucacauaaaguuaguaagaaugaaaauagucuuggcaguaggauugugaguuuugaaauacauacaauucuguauccuaagaaacuaauugucuuuuaguucaagcugucaucaauaaaauuuauaguacguuuugagccugugugucagggauuauacagaacugaaugcguuacauuugucucauuuaauugucauuauaaucuuguaagugucaugugcauuuaacagaugggguaucugaggccuaaagagaugaaaacugcucaagguuauaauguaacuugacagaguucaguuuuaggauuacacuuguacuauuauuuaggagugaaagcaaguuauaaaauuguaccugcuaauuaauuuucuuaacuguguaaagaaaagaaaaacaguaaaaacuuuaaggcaauauucacaaguguuauuaauagcauauuauuaauguaauuauuucuaauaacagaugagauuaaauauuauuucuguuuacuuuucuacaacuguaguuuuccuuuuuuuuuuuuuuaaugcaaacuuaaaacauaaaacugggauugaggaacaggcaauaggcaaagguggaaaucaaagagcaauuaaaaaaaaaaauccagcaauaccagugcaaguaccccaaggagaguuuaucaagcacuugccuuuugacuuacaccaaaaacuaaaugugguuaggcacaugcugauuugcucaucuuuuccuuccuuucuuagggauauuaggaauuuuauaagcauucaauggguuauaagguguuuggcuuuuguaucuaagaaauaaagguugagucauuuguucaagauucagaaaaggagaauagugauagauuucccaaguacugguucaguucacuguuacuaagauaguuuauuuuuguuuuuuggagacagggucucacucugucccaggcugcagugcuguggugcgauccugguucacugcaaccucugccucccgggcucaagugauccuccugaguagcugggaccacaggugcacaccaccacacccagcuaauuuuuguauuuuuuuuagagacaggguuucgcuauguugcccaggcuggucucgaacuccuaagcucaagcgaucccccugcccuggccuuccaaagugcugagauuacaggcaugagccaccaugcuuggcccuaacguaguuuuaagagauagagaauauauacuguaaaaccaaugggaauuuuauuuucagcuuuuuaaaauuaaaaguucuaaauucuucagaugcagcugcaacuaauuguccugcuuuuuugugauguuucaggcuuauaccagccaguuuguaucccuugugauguuugcccuuaugaugugugaugaucggaucuccaugcaagaaagacgcaaagagaucaugcuuggauugaaacggcugccugguacaaagacacucauauauuacacuuuuguugucuaagggaguggguaauagguaaaauucucuuauccuugaagcuguggcuuguagcuauuuagucaauaagaucuuucuacguuugcuccgauguauuaaaaaaauacccauacugauugauagcacagaggaauagaaacacuggucuuuuguuauuugcugccaauauauuguuauuuuauuuguuugguuuauuguccuuuuuugcuaauauuacuucuuagauuugauuaaggaaguacugagcauggaugacgaaauucagaaacuagcaacagaacuuuaucaucagaagucaguucugauaaugggacgaggcuaucauuaugcuacuugucuugaaggggcacugguaaguuuucucaguucuaauuaguaucaguccauugaccugcagaccugacacauagucauacuuuuacauuaaaugaaugaaauagguagaacuuuugaaagugcuucuguauuuaugcauugugguuuguuuacuuugagaaagugcaacagagaacucuguucagaagugaaaaucaaaaagaguacauuuuaacaugauaaacuuggauuuagcaaguaacuuggguuaauuuguucaaauaugaauaaagauuaaguucucuagauaagaaauuuaauugaggucaagcugggcacaguggcucacgucuauaaucccagcacuuugggaggacauggcagguagaucaaacuugaagucagaaguucgagaccagccuggccaacguggugaaaccccaucucuacuaauaauacaaaaacauuagcuggaugugguaaugcaugacuauaaucccagcuacuugggaggcuaaggcgggaagaucacuugaaccuaggagguggagguggcagugagccgagaucacaccacuguacuccagccugggcgaucgaagaagacucugucuuaaaaaaaaaaaaaaaaaggguuaaccagaaauaugaauauguuugugauaaucuaaaaucuuuaaaaaguccuuguggagcuuuaaaacuuccaauuacauguugauaauauagaaauagugaucuauuaacuuguuagauauauuuauagaucagugguccuuuaauacuuuuggauagauagacaguggcuugacauaucagaugcuuuuuauaauauuuacuuaaacauggauuuuugaaaaguggauugaagacaaaucugguucuuuccuauuagaaaaucaaagaaauuacuuauaugcacucugaaggcauccuugcuggugaauugaaacauggcccucuggcuuugguggauaaauugaugccugugaucaugaucaucaugagagaucacacuuaugccaagugucagaaugcucuucagcaagugguugcucggcagguaagucgggggacugugagaacaccuuggggaucaaagaggggaguuacgcuagcuuauuugaaugacuuacaaaacauguuuacacguguuaacucauuuacuuuggaauacagccuuugagguuuacaugugaggaaucagauacuuaagaguuuuuuuuuuuuuuuuuuuuugagauggagucucugucacccacccuggagugcaguggcacaaucuuggcucacugcaaccucugccuccuggguucaggcaauuuuccugccucagccucccaaguagcugggauuacaggcacacuccaccacgccuggcuaauuuuguauuuuugguagagaugggguuucauguuggccaggcuggugucgaacuccugaccugaagugauccaccugccucaaccccccaaaguucugggauuacaggcaugagccaccccgccuggcccagauacuuagagcuuuaagaagaccaaggucauagaucucauauugggcagaaccaagaccagaacugaggucuuggucuccacauccugucuucuuuuaguuaacauaugcuguuccuuuuuaauuuaauacuucuaaaacauuuaaaaauguauuuuaaaauauuuuuaaauauauauuucagcugguugcaguggcacaugacuguagucccagcuacucuggggacugaggcaggaggaucacuugaguccaggaguuugaauacagccuggguagcauagugagacccugucucuaaaacaguaaauaaaauaaauuaaaaaaaauuacacacacgcgauauauuucaggggaaaucuaacaucuagguuuuauuuuaauauuauauaauugaguuuucuucagaucaguuggcuuuauauauaaauuccaaaagauauuauucccuaagcacaauguggugguaaugaacuugagcuuugaaguuaggcaaaccugcagucaaguacuaagccugguauuucuuaguugcaugaguuuaaacaaauuacuggaucccauaacgcuucuguuuccucgacuauaaguaauaacaaucagauuuacuacacaggaauuuaaagaagucuguccgugaggcuucauauggauuaugcagugcaauuuuugcacauucguaagcuauagcccugccuuugcccaccagugauguuguguaugugugugauuuucuuuccuaggggcggccugugguaauuugugauaaggaggauacugagaccauuaagaacacaaaaagaacgaucaaggugccccacucaguggacugcuugcagggcauucucagcgugaucccuuuacaguugcuggcuuuccaccuugcugugcugagaggcuaugauguaagucaucuaccacugcagaaaucuugggaugguuuuuuaccuggauacauucugauuuuuuucuccuaaauuuuuaacaauaguguuugagaaaucuaucaaauauauaucugucaccuguuauauuuucauggcccaauuuguagguuacaucacaacaucuucuuacccauagaacuugaaggaaccuugggguucaccuccaagauugugacucaccuuggguagucuccaccuguuuucuuaauauaaccucuaucucuuaacagggcagcuauuggcauuuggcaggacaauucuuuuuuguuuggaacugucccacacauugaagacuuuguagcauuccugguuucucagccauuguggcaaccaaaacauagugcuuuuguuuuuaguguccccuaugagggcuacuacuucuguagaggaccacaguagcucuuucugugugaacuggcaccuuuagaaugcuuuuuccuaaccaauuucaguuuuuuucaggacacauuaugugauuauauuuucuaaucuaauucuuuguagucuguaauaaagaugguuaaugaauguauuguuuucuguuuuuauaaacaaaaauaauuugcuuauaguaaccacccccuuccccagucuauauaaucucucaaaucuugcuuuuuuuuuuuuucuuuuugcagguugauuucccacggaaucuugccaaaucugugacuguagagugaggaauaucuauacaaaauguacgaaacuguaugauuaagcaacacaagacaccuuuuguauuuaaaaccuugauuuaaaauaucaccccuugaagccuuuuuuuaguaaauccuuauuuauauaucaguuauaauuauuccacucaauaugugauuuuugugaaguuaccucuuacauuuucccaguaauuuguggaggacuuugaauaauggaaucuauauuggaaucuguaucagaaagauucuagcuauuauuuucuuuaaagaaugcuggguguugcauuucuggacccuccacuucaaucugagaagacaauauguuucuaaaaauugguacuuguuucaccauacuucauucagaccagugaaagaguagugcauuuaauuggaguaucuaaagccaguggcaguguaugcucauacuuggacaguuagggaaggguuugccaaguuuuaagagaagaugugauuuauuuugaaauuuguuucuguuuuguuuuuaaaucaaacuguaaaacuuaaaacugaaaaauuuuauugguaggauuuauaucuaaguuugguuagccuuaguuucucagacuuguugucuauuaucuguagguggaagaaauuuaggaagcgaaauauuacaguagugcauuggugggucucaauccuuaacauauuugcacaauuuuauagcacaaacuuuaaauucaagcugcuuuggacaacugacaauaugauuuuaaauuugaagaugggauguguacauguuggguauccuacuacuuuguguuuucaucuccuaaaagugguuuuuauuuccuuguaucuguagucuuuuauuuuuuaaaugacugcugaaugacauauuuuaucuuguucuuuaaaaucacaacacagagcugcuauuaaauuaauauugauauauucaguauucucuucaacuuugucacgaggaagaauuuccuguaguuaauuuuaacuuuccuucauuacauuguugcauaaaacuagucccuuagugccaguuuggaaguuacuugcaauuguuuggaagauuugcaggucgcugaccucaucauuucacucuaaguauaugugguaggcuaagcucagaaaaagguauguaugcuuuacacugauaggcaccaaauuuaguauuguauccuaaguauuuuuccucuucuguauuuucugugcucuaccccugaaauauauuuaggaauaaagaagauauaaauaaagugauauugggguauguucagcuuguaagugucagaaauggaaguugacaauuuggauuaaaauauuuaaaguagaauguuauuauuugauacccccaaaauugugaguaauaauuucuuaauggagcuuuucuggccagaucuucagggcuauaggagaguguguuuguuuuuggugaaguccuucuuuuucaaagguuuuuacuuuuaaauugugaagauaagcuauuuagcacaauuauuuaaguaagcuguuuuuuccuuucuuuucuuucuuuucuuguuuuaacuucugggugagguuaagauuuucuaauaguuauuguuguugccagagaagcauagaauucugcuugugucuuaggguuagagaaagauuuguuauauuuugagguaauuuggaaggacuuucauacauggugacuagaaaccugaucuuuuuaagaauaaaauagggucacuauuuacauuauauauaauauauggcuauuauagcuauauuaaucuacuuuaauuguuucuaagauuauuuuguguaagucagcuagcguguguauagugucauuucuuauguuuuguauauuaacguuuuacaaacacaauuuguguggguuuguagcauuucuuauaguuuaaaguaugauucagcauucuaaguuaaaacuaauaugugaagucagucauuagucugcauaaucucugucucccucugugugugucuuucuauaaagcacauguguacacacacacacacaaauauacugaaagcuaggguaaguucuaaacugaauaucaaaaaccaaaaucaagaacaaagaagugauauuuuccaaacaaacauggauucucugccgggugcaguggcucagccuguaauaccagccuccacuuugggagucugaggugggaguauugcuugagcucaagaguuggagaacagccugggcaacauggugagaccuggucuuuacaaaaauuuuuuuggccggacgcaguggcucacaccuguaaucccagcacuuugggaggccgaggcagguugaucaugaggucaagagaucgagaccauccuggccaacauggugaaaccccgucuuuacuaaaaauacaaaaauuagcugggagugguggcgugcgccuguagucccaacuacuugggaggcugaggcaggagaaucgcuugaacccaggaggcggagguugcagugaggcgagaucacgccacuacacuccagccuggcgacagagcaagacucucucaaaaaaaaaaaaaaaaaauuuuuuuuuuaaaugggcugggcaugguggcuugugccuguagucucagcaacuugggaggcuuaaguaguaggaucgcuugagccugggagguugaggcugcagugagcugugauugugccacugugcuucagcuugagugacagagugagacccuccugacucaaaacaaaaaacaugguuucuccucucucuccugucuucuuacucucuaucccauuugauguagugauuuuuaaaugcuuuuguaaguuaauucuuaacacaaaagagacauuguaaugaggcacaccacuaaagugagcaugcccaauuaaaaccaguguaauauaggauaagaaaaucugauuuuucaaaaaagauacucuacauaaagaauccuucauauaaaaaguucuuucuuguaguacauuuaaaguuuuaauucacucauguauaacugagaguuccuuugagcccuuuuuaggcagggaggcaugucugucaucuagcguguggcccaguaagugauuauuacauuggaaucaguuuuucagucuuuuaaaauaaauucugugccauaagaauaaaagauaaagagaaaaauuaauguuaacuauuuuuagcuuauuauaacuaugucaacaaguguuuauuaauaccuauuaugggaaagucacugugguuggcauugaaaauuacaucaucuuuaaagcaguauuuguccccagauggacucaucacuagcaaagacuagguucauuggaaggcauagggugagagaaugggaagaugaaguggaggcggguuguuaaagugcugucagugagugauuuugucuacuugaauaaugguccauguuugggggcauauuguguuucauaagaagugaaagguauuugcaaaguaagcuacaaaugacccauaaaucuguuaacaacaguccuuaauaugcaaagaugaaaaacaagcauuacugcuacccaaagggaacuggugcuuggugaugugcagauggggcuguugguuaagagagcuauuacagguuuucucucuuagguuucauaggagguaguuacugagaugagauuguuuuaucuuuuugaauacagaucucuugucuugaguuaguucugaggaugggaguaauaaaggaguuuuuuguuuuuuuguuuguuuguuuguuuuggcuccuuaguaauacuccucugacauuuauuucuauuauucuucaaagaaaggaaaccaacugaaauguuugcuuuaacaaacauuuuaauaaguucucuggguuuuuuuuuccccuuuuaaaaaaauuagcauauaccauagcaauaaaagaacuaauguuaacuauuguaugcuacaacuuaagugauuuuucuaaagaagcacaaugucauugaaaguauuauugaaaaggaucauagucacauugaauuugugaaggccaaagaaauugaagggagugauauuuucauuuuaugauauucacauauuuaguaaauuuuguguacaagaauaccaggcagaguguuuuacccauggaaacagguuucagauuacuuuauuuuuacuguuagagucucaaguuuagaaaugcuaacacuuaaaucaguuuuuuucucacuauacuugaagauuguuaauauuuugauaucuuccuagcuugaugaauuuaaacauaucuucagaucugugacagugacagccaauaggacugauaauauuagcuucaaaccaauaauauccaggguuaaaauaaaaaucauagugaaaguacgauuguaaaauuaugcuauauuaacuuuuaagucuguaauaacuugacaucaaaauguuauguaauuaccauaaauaauggcuagcgagaacaucuuuggaaauucucaaauuaccuuucuuacuacacuguuugcagaaugaauguagaaaugauccuguuagcuuucugaauguucugugguugaauguguuuuugcuuaaauaaagcuuuugguauuuguuuaaauuacacuucuugagaaguggaaauuuuaggaucaucuuugcuuuguuucaguuuugugauuuuugaaaugaauguuuaguuuacugagccaguuggucauuucuuccucaugucguuaaguccagugaguaagccugaacugugaauaaauuaccaaaaacuugcuuagaauuucauuuugaagcaauuugcuaauauuugaaguguauacacauuuguaguuauguuagaaauuguauuguacuaagaauguaaucaaugucuacuuuaguuguaaacauuucugaugucaaaacuuuauucauuacuguugauuuuaagaauaagaaaucacugccuaaauauuaccaaaagccacugucucuacccgaacuucccaguuugggaaagaaucguuagauaaaacaaaggcucugcccuuucugauaccaaacuccacagauacuuucucacaucuuuuaaaacauuuugcaauaacauauuguuuauaggaaguuuacgggguaugcaaugauuaaaacuuuuaagugaauugauaguugcaaaagaaaggauaauauuuaaggucagugaguagcaagacaaucuaaaguuucuguaauaucuggcucucuguuaauuauagagcaaaguuucccuuacagaauccuuuuaugaacagcaagcuagagucuaucccuagugguuauagcaccugcugcguuuuucaggagacaguuaggccagggugauuugaauggauagaugugcuguuuugccugcuuguagaauucagcccagucuuuggucucucucucucucucccuccuccaccucucccucucucuucuucugcaccagagccuaaggcugcgccaccaagaugcgucauuuuuuccagaggcuucuuuuuuuuuuuuuugagauggaguuuugcucuguugcccaggcuggcaugcagugcugcaaucuuggcugacugcaacuuccaccucccguguucacacgagucuuuugccucagccucuggauuagcugggauuacaggcacgugccaccaugccuagcuaauuuuuguguuuuuaguagagacgggguuucaccauguuggccaggcuagucucaaacuccugaccuuaagugaucugcccgccuuggccucccaaagugcugggauuacaggcaugagucaccguguccugcccagacauaucaaauuugacagguauuguauacccuuuggaucuuuaggaauuaauuuuugccucugucacucagcuuuguauauuuugaaauggagauaaguauagggaggucuuggaaggaaaauugccagaauucccaaaccauguaacacucauugagaauuccagauccauuauaucuaaagggcaagugaaggaaacaguauugugaacuggguauaacuccuugguucuuaacuaguacauucuuaaucugugagacccaaagguugauaaacaauaauuuaagauuguacaguacucuaaacgucugcaaaggucuagauguuaucaguaucacuaguuuuuauuucugccaguagcucccuuuuagguuacauuguuguccucuuuccagugucgcaucugucauugguuuuucacuauggcaaguucauuaaaaagcuugcuccauuguuaucuucaaguaaugcccauaaggagauggaagauaucugagacaauuaaggcuuuagcuucuaggcaagagaaauaacguugcauuaaauuucaaguuucuuucugcuagacuugaaugugucuagccacucuaauuuaugggggcuuuugguuuuuuccuauuguacuuuguauguagaauuguuuugaaauaucaagcauauuuacuuugaauuugaacucuuucuuaauuuuguauuuauccuuugaauaaaauguaaauccaauauuuauuauu

SEQ ID NO: 191650 - RNA, 67486 nt, Homo sapiens
aauaauaaauauuggauuuacauuuuauucaaaggauaaauacaaaauuaagaaagaguucaaauucaaaguaaauaugcuugauauuucaaaacaauucuacauacaaaguacaauaggaaaaaaccaaaagcccccauaaauuagaguggcuagacacauucaagucuagcagaaagaaacuugaaauuuaaugcaacguuauuucucuugccuagaagcuaaagccuuaauugucucagauaucuuccaucuccuuaugggcauuacuugaagauaacaauggagcaagcuuuuuaaugaacuugccauagugaaaaaccaaugacagaugcgacacuggaaagaggacaacaauguaaccuaaaagggagcuacuggcagaaauaaaaacuagugauacugauaacaucuagaccuuugcagacguuuagaguacuguacaaucuuaaauuauuguuuaucaaccuuugggucucacagauuaagaauguacuaguuaagaaccaaggaguuauacccaguucacaauacuguuuccuucacuugcccuuuagauauaauggaucuggaauucucaaugaguguuacaugguuugggaauucuggcaauuuuccuuccaagaccucccuauacuuaucuccauuucaaaauauacaaagcugagugacagaggcaaaaauuaauuccuaaagauccaaaggguauacaauaccugucaaauuugauaugucugggcaggacacggugacucaugccuguaaucccagcacuuugggaggccaaggcgggcagaucacuuaaggucaggaguuugagacuagccuggccaacauggugaaaccccgucucuacuaaaaacacaaaaauuagcuaggcaugguggcacgugccuguaaucccagcuaauccagaggcugaggcaaaagacucgugugaacacgggagguggaaguugcagucagccaagauugcagcacugcaugccagccugggcaacagagcaaaacuccaucucaaaaaaaaaaaaaagaagccucuggaaaaaaugacgcaucuugguggcgcagccuuaggcucuggugcagaagaagagagagggagagguggaggagggagagagagagagagaccaaagacugggcugaauucuacaagcaggcaaaacagcacaucuauccauucaaaucacccuggccuaacugucuccugaaaaacgcagcaggugcuauaaccacuagggauagacucuagcuugcuguucauaaaaggauucuguaagggaaacuuugcucuauaauuaacagagagccagauauuacagaaacuuuagauugucuugcuacucacugaccuuaaauauuauccuuucuuuugcaacuaucaauucacuuaaaaguuuuaaucauugcauaccccguaaacuuccuauaaacaauauguuauugcaaaauguuuuaaaagaugugagaaaguaucuguggaguuugguaucagaaagggcagagccuuuguuuuaucuaacgauucuuucccaaacugggaaguucggguagagacaguggcuuuugguaauauuuaggcagugauuucuuauucuuaaaaucaacaguaaugaauaaaguuuugacaucagaaauguuuacaacuaaaguagacauugauuacauucuuaguacaauacaauuucuaacauaacuacaaauguguauacacuucaaauauuagcaaauugcuucaaaaugaaauucuaagcaaguuuuugguaauuuauucacaguucaggcuuacucacuggacuuaacgacaugaggaagaaaugaccaacuggcucaguaaacuaaacauucauuucaaaaaucacaaaacugaaacaaagcaaagaugauccuaaaauuuccacuucucaagaaguguaauuuaaacaaauaccaaaagcuuuauuuaagcaaaaacacauucaaccacagaacauucagaaagcuaacaggaucauuucuacauucauucugcaaacaguguaguaagaaagguaauuugagaauuuccaaagauguucucgcuagccauuauuuaugguaauuacauaacauuuugaugucaaguuauuacagacuuaaaaguuaauauagcauaauuuuacaaucguacuuucacuaugauuuuuauuuuaacccuggauauuauugguuugaagcuaauauuaucaguccuauuggcugucacugucacagaucugaagauauguuuaaauucaucaagcuaggaagauaucaaaauauuaacaaucuucaaguauagugagaaaaaaacugauuuaaguguuagcauuucuaaacuugagacucuaacaguaaaaauaaaguaaucugaaaccuguuuccauggguaaaacacucugccugguauucuuguacacaaaauuuacuaaauaugugaauaucauaaaaugaaaauaucacucccuucaauuucuuuggccuucacaaauucaaugugacuaugauccuuuucaauaauacuuucaaugacauugugcuucuuuagaaaaaucacuuaaguuguagcauacaauaguuaacauuaguucuuuuauugcuaugguauaugcuaauuuuuuuaaaaggggaaaaaaaaacccagagaacuuauuaaaauguuuguuaaagcaaacauuucaguugguuuccuuucuuugaagaauaauagaaauaaaugucagaggaguauuacuaaggagccaaaacaaacaaacaaacaaaaaaacaaaaaacuccuuuauuacucccauccucagaacuaacucaagacaagagaucuguauucaaaaagauaaaacaaucucaucucaguaacuaccuccuaugaaaccuaagagagaaaaccuguaauagcucucuuaaccaacagccccaucugcacaucaccaagcaccaguucccuuuggguagcaguaaugcuuguuuuucaucuuugcauauuaaggacuguuguuaacagauuuaugggucauuuguagcuuacuuugcaaauaccuuucacuucuuaugaaacacaauaugcccccaaacauggaccauuauucaaguagacaaaaucacucacugacagcacuuuaacaacccgccuccacuucaucuucccauucucucacccuaugccuuccaaugaaccuagucuuugcuagugaugaguccaucuggggacaaauacugcuuuaaagaugauguaauuuucaaugccaaccacagugacuuucccauaauagguauuaauaaacacuuguugacauaguuauaauaagcuaaaaauaguuaacauuaauuuuucucuuuaucuuuuauucuuauggcacagaauuuauuuuaaaagacugaaaaacugauuccaauguaauaaucacuuacugggccacacgcuagaugacagacaugccucccugccuaaaaagggcucaaaggaacucucaguuauacaugagugaauuaaaacuuuaaauguacuacaagaaagaacuuuuuauaugaaggauucuuuauguagaguaucuuuuuugaaaaaucagauuuucuuauccuauauuacacugguuuuaauugggcaugcucacuuuaguggugugccucauuacaaugucucuuuuguguuaagaauuaacuuacaaaagcauuuaaaaaucacuacaucaaaugggauagagaguaagaagacaggagagagaggagaaaccauguuuuuuguuuugagucaggagggucucacucugucacucaagcugaagcacaguggcacaaucacagcucacugcagccucaaccucccaggcucaagcgauccuacuacuuaagccucccaaguugcugagacuacaggcacaagccaccaugcccagcccauuuaaaaaaaaaauuuuuuuuuuuuuuuuuugagagagucuugcucugucgccaggcuggaguguaguggcgugaucucgccucacugcaaccuccgccuccuggguucaagcgauucuccugccucagccucccaaguaguugggacuacaggcgcacgccaccacucccagcuaauuuuuguauuuuuaguaaagacgggguuucaccauguuggccaggauggucucgaucucuugaccucaugaucaaccugccucggccucccaaagugcugggauuacaggugugagccacugcguccggccaaaaaaauuuuuguaaagaccaggucucaccauguugcccaggcuguucuccaacucuugagcucaagcaauacucccaccucagacucccaaaguggaggcugguauuacaggcugagccacugcacccggcagagaauccauguuuguuuggaaaauaucacuucuuuguucuugauuuugguuuuugauauucaguuuagaacuuacccuagcuuucaguauauuuguguguguguguguacacaugugcuuuauagaaagacacacacagagggagacagagauuaugcagacuaaugacugacuucacauauuaguuuuaacuuagaaugcugaaucauacuuuaaacuauaagaaaugcuacaaacccacacaaauuguguuuguaaaacguuaauauacaaaacauaagaaaugacacuauacacacgcuagcugacuuacacaaaauaaucuuagaaacaauuaaaguagauuaauauagcuauaauagccauauauuauauauaauguaaauagugacccuauuuuauucuuaaaaagaucagguuucuagucaccauguaugaaaguccuuccaaauuaccucaaaauauaacaaaucuuucucuaacccuaagacacaagcagaauucuaugcuucucuggcaacaacaauaacuauuagaaaaucuuaaccucacccagaaguuaaaacaagaaaagaaagaaaagaaaggaaaaaacagcuuacuuaaauaauugugcuaaauagcuuaucuucacaauuuaaaaguaaaaaccuuugaaaaagaaggacuucaccaaaaacaaacacacucuccuauagcccugaagaucuggccagaaaagcuccauuaagaaauuauuacucacaauuuuggggguaucaaauaauaacauucuacuuuaaauauuuuaauccaaauugucaacuuccauuucugacacuuacaagcugaacauaccccaauaucacuuuauuuauaucuucuuuauuccuaaauauauuucagggguagagcacagaaaauacagaagaggaaaaauacuuaggauacaauacuaaauuuggugccuaucaguguaaagcauacauaccuuuuucugagcuuagccuaccacauauacuuagagugaaaugaugaggucagcgaccugcaaaucuuccaaacaauugcaaguaacuuccaaacuggcacuaagggacuaguuuuaugcaacaauguaaugaaggaaaguuaaaauuaacuacaggaaauucuuccucgugacaaaguugaagagaauacugaauauaucaauauuaauuuaauagcagcucuguguugugauuuuaaagaacaagauaaaauaugucauucagcagucauuuaaaaaauaaaagacuacagauacaaggaaauaaaaaccacuuuuaggagaugaaaacacaaaguaguaggauacccaacauguacacaucccaucuucaaauuuaaaaucauauugucaguuguccaaagcagcuugaauuuaaaguuugugcuauaaaauugugcaaauauguuaaggauugagacccaccaaugcacuacuguaauauuucgcuuccuaaauuucuuccaccuacagauaauagacaacaagucugagaaacuaaggcuaaccaaacuuagauauaaauccuaccaauaaaauuuuucaguuuuaaguuuuacaguuugauuuaaaaacaaaacagaaacaaauuucaaaauaaaucacaucuucucuuaaaacuuggcaaacccuucccuaacuguccaaguaugagcauacacugccacuggcuuuagauacuccaauuaaaugcacuacucuuucacuggucugaaugaaguauggugaaacaaguaccaauuuuuagaaacauauugucuucucagauugaaguggaggguccagaaaugcaacacccagcauucuuuaaagaaaauaauagcuagaaucuuucugauacagauuccaauauagauuccauuauucaaaguccuccacaaauuacugggaaaauguaagagguaacuucacaaaaaucacauauugaguggaauaauuauaacugauauauaaauaaggauuuacuaaaaaaaggcuucaaggggugauauuuuaaaucaagguuuuaaauacaaaaggugucuuguguugcuuaaucauacaguuucguacauuuuguauagauauuccucacucuacagucacagauuuggcaagauuccgugggaaaucaaccugcaaaaagaaaaaaaaaaaaagcaagauuugagagauuauauagacuggggaagggggugguuacuauaagcaaauuauuuuuguuuauaaaaacagaaaacaauacauucauuaaccaucuuuauuacagacuacaaagaauuagauuagaaaauauaaucacauaauguguccugaaaaaaacugaaauugguuaggaaaaagcauucuaaaggugccaguucacacagaaagagcuacugugguccucuacagaaguaguagcccucauaggggacacuaaaaacaaaagcacuauguuuugguugccacaauggcugagaaaccaggaaugcuacaaagucuucaaugugugggacaguuccaaacaaaaaagaauuguccugccaaaugccaauagcugcccuguuaagagauagagguuauauuaagaaaacagguggagacuacccaaggugagucacaaucuuggaggugaaccccaagguuccuucaaguucuauggguaagaagauguugugauguaaccuacaaauugggccaugaaaauauaacaggugacagauauauauuugauagauuucucaaacacuauuguuaaaaauuuaggagaaaaaaaucagaauguauccagguaaaaaaccaucccaagauuucugcagugguagaugacuuacaucauagccucucagcacagcaagguggaaagccagcaacuguaaagggaucacgcugagaaugcccugcaagcaguccacugaguggggcaccuugaucguucuuuuuguguucuuaauggucucaguauccuccuuaucacaaauuaccacaggccgccccuaggaaagaaaaucacacacauacacaacaucacuggugggcaaaggcagggcuauagcuuacgaaugugcaaaaauugcacugcauaauccauaugaagccucacggacagacuucuuuaaauuccuguguaguaaaucugauuguuauuacuuauagucgaggaaacagaagcguuaugggauccaguaauuuguuuaaacucaugcaacuaagaaauaccaggcuuaguacuugacugcagguuugccuaacuucaaagcucaaguucauuaccaccacauugugcuuagggaauaauaucuuuuggaauuuauauauaaagccaacugaucugaagaaaacucaauuauauaauauuaaaauaaaaccuagauguuagauuuccccugaaauauaucgcguguguguaauuuuuuuuaauuuauuuuauuuacuguuuuagagacagggucucacuaugcuacccaggcuguauucaaacuccuggacucaagugauccuccugccucaguccccagaguagcugggacuacagucaugugccacugcaaccagcugaaauauauauuuaaaaauauuuuaaaauacauuuuuaaauguuuuagaaguauuaaauuaaaaaggaacagcauauguuaacuaaaagaagacaggauguggagaccaagaccucaguucuggucuugguucugcccaauaugagaucuaugaccuuggucuucuuaaagcucuaaguaucugggccaggcgggguggcucaugccuguaaucccagaacuuugggggguugaggcagguggaucacuucaggucaggaguucgacaccagccuggccaacaugaaaccccaucucuaccaaaaauacaaaauuagccaggcgugguggagugugccuguaaucccagcuacuugggaggcugaggcaggaaaauugccugaacccaggaggcagagguugcagugagccaagauugugccacugcacuccagggugggugacagagacuccaucucaaaaaaaaaaaaaaaaaaaaacucuuaaguaucugauuccucacauguaaaccucaaaggcuguauuccaaaguaaaugaguuaacacguguaaacauguuuuguaagucauucaaauaagcuagcguaacuccccucuuugauccccaagguguucucacagucccccgacuuaccugccgagcaaccacuugcugaagagcauucugacacuuggcauaagugugaucucucaugaugaucaugaucacaggcaucaauuuauccaccaaagccagagggccauguuucaauucaccagcaaggaugccuucagagugcauauaaguaauuucuuugauuuucuaauaggaaagaaccagauuugucuucaauccacuuuucaaaaauccauguuuaaguaaauauuauaaaaagcaucugauaugucaagccacugucuaucuauccaaaaguauuaaaggaccacugaucuauaaauauaucuaacaaguuaauagaucacuauuucuauauuaucaacauguaauuggaaguuuuaaagcuccacaaggacuuuuuaaagauuuuagauuaucacaaacauauucauauuucugguuaacccuuuuuuuuuuuuuuuuuaagacagagucuucuucgaucgcccaggcuggaguacaguggugugaucucggcucacugccaccuccaccuccuagguucaagugaucuucccgccuuagccucccaaguagcugggauuauagucaugcauuaccacauccagcuaauguuuuuguauuauuaguagagaugggguuucaccacguuggccaggcuggucucgaacuucugacuucaaguuugaucuaccugccauguccucccaaagugcugggauuauagacgugagccacugugcccagcuugaccucaauuaaauuucuuaucuagagaacuuaaucuuuauucauauuugaacaaauuaacccaaguuacuugcuaaauccaaguuuaucauguuaaaauguacucuuuuugauuuucacuucugaacagaguucucuguugcacuuucucaaaguaaacaaaccacaaugcauaaauacagaagcacuuucaaaaguucuaccuauuucauucauuuaauguaaaaguaugacuaugugucaggucugcaggucaauggacugauacuaauuagaacugagaaaacuuaccagugccccuucaagacaaguagcauaaugauagccucgucccauuaucagaacugacuucugaugauaaaguucuguugcuaguuucugaauuucgucauccaugcucaguacuuccuuaaucaaaucuaagaaguaauauuagcaaaaaaggacaauaaaccaaacaaauaaaauaacaauauauuggcagcaaauaacaaaagaccaguguuucuauuccucugugcuaucaaucaguauggguauuuuuuuaauacaucggagcaaacguagaaagaucuuauugacuaaauagcuacaagccacagcuucaaggauaagagaauuuuaccuauuacccacucccuuagacaacaaaaguguaauauaugagugucuuuguaccaggcagccguuucaauccaagcaugaucucuuugcgucuuucuugcauggagauccgaucaucacacaucauaagggcaaacaucacaagggauacaaacuggcugguauaagccugaaacaucacaaaaaagcaggacaauuaguugcagcugcaucugaagaauuuagaacuuuuaauuuuaaaaagcugaaaauaaaauucccauugguuuuacaguauauauucucuaucucuuaaaacuacguuagggccaagcaugguggcucaugccuguaaucucagcacuuuggaaggccagggcagggggaucgcuugagcuuaggaguucgagaccagccugggcaacauagcgaaacccugucucuaaaaaaaauacaaaaauuagcugggugugguggugugcaccuguggucccagcuacucaggaggaucacuugagcccgggaggcagagguugcagugaaccaggaucgcaccacagcacugcagccugggacagagugagacccugucuccaaaaaacaaaaauaaacuaucuuaguaacagugaacugaaccaguacuugggaaaucuaucacuauucuccuuuucugaaucuugaacaaaugacucaaccuuuauuucuuagauacaaaagccaaacaccuuauaacccauugaaugcuuauaaaauuccuaauaucccuaagaaaggaaggaaaagaugagcaaaucagcaugugccuaaccacauuuaguuuuugguguaagucaaaaggcaagugcuugauaaacucuccuugggguacuugcacugguauugcuggauuuuuuuuuuuaauugcucuuugauuuccaccuuugccuauugccuguuccucaaucccaguuuuauguuuuaaguuugcauuaaaaaaaaaaaaaaggaaaacuacaguuguagaaaaguaaacagaaauaauauuuaaucucaucuguuauuagaaauaauuacauuaauaauaugcuauuaauaacacuugugaauauugccuuaaaguuuuuacuguuuuucuuuucuuuacacaguuaagaaaauuaauuagcagguacaauuuuauaacuugcuuucacuccuaaauaauaguacaaguguaauccuaaaacugaacucugucaaguuacauuauaaccuugagcaguuuucaucucuuuaggccucagauaccccaucuguuaaaugcacaugacacuuacaagauuauaaugacaauuaaaugagacaaauguaacgcauucaguucuguauaaucccugacacacaggcucaaaacguacuauaaauuuuauugaugacagcuugaacuaaaagacaauuaguuucuuaggauacagaauuguauguauuucaaaacucacaauccuacugccaagacuauuuucauucuuacuaacuuuaugugacugugagaugugccuguuuugucaaguucugugaaauacugagaauuaucucuuuagcaaacuuuuaccauuuugacugcgggacaaugaaccuucacuacuauuuuagcauacauaucuugaauccuaaagcuaagcuuuuuuuucauguuuguugaccauuuauauuuucucuuuugacaacugacuuuguuguuccucaccuguuuuucaacuugaguuucuuuauucaaauugguuuuaagaagguaguuauuguucaaaacaaaaaaauuagacaaaugcuacauuaauguuuggguggucagauucuacuuugaagucugaaguuugcagauaugccuacagauuuucagaguuuaccacuucuuucuuauucuguaccauuaauguaauaccuuaaauuacuauauauguuaccauuuuucuggauuuaguaagaaauuugcauuuuuggugugauguaacaaggguuuuaauauaauuuauguuagauuuugcauuuuuuucauuacuguuauauuuuaaccugacugaaugacugaucuaauuguauuaguauugugaauaaucaugugaaauguuuugagacagaguaauauauuucugaauauaauuuuaugguuuuuuucacuuaguaagaaccuuucuauguggaaaacuaagaaaacugcuuucugcuguauaaucuggcauucauuguagauuaaaguuuauuuuucugugaauaaaacguauucaauacaauacuauucucuaaaauuaaaaaaaagaagguaguuauuguuaugucucaaauauuuuuucucaucguggacugaccuuuuauauuggugcugacauaauuuuuuaacuuuuacguaguacuuuuagacucagauaacucuuccacauccuacauaaacuaaguauuauuaaauuuucuuacuucuuuuguuuucacuguuccuuuuuauuuuuuuaacauuuuccuuuuuagccuguuugaaauuaauuuuagugcaaguugaaggaacacuaauucuaacccaagauaugucauuucuuuacaaaacaaucuuuccauuuaaaaauauggcauuuucaucaauuugugcuaggaauuuaaugcuauuucccucuauuuaucacuuuggccacacacucuaaauuuuuaccccuauuauuuauuguuuacuuuuuucuagucuuucuuuucuuuucuuuuuuuuuuuuuuuugagacacaguuuugcucuuguugcccaggcuggauugcaauggcaugaucuuggcucacugcaaccucagccuccuggguucgcgugauucuccugcuucagccaccccaaguagcugggauuacaggcgcccgccaccaugcccggcuaauuuucucguguuuuuuuaguagagacgggguuucacuauguuggccaggcuggucuugaacuccuguccucaagugaucugcccaaagugcugggauuacaagcaugagccaccacgcccggccucuaguaagucuuucuuaaugguaguucugauuuuuuuuaauccaauaguuauuuugaaaaacauuuuuauguuucagauauuugaggcuuuuauuuacaucucuuucaguagguuauugugcuguugucaguuacaguguuagauauaauuuuagcuuuaggaaauuuaugcugaggggugugugugugcgcgcgcggauuauaugcugaauuucuauuacucuucucuugauaagggauuacuccauuagugauuuccuggcaugauguggaugagacucccucuauaauaaaaucacagucugguaacuccuuaacaucccaauaguuaaaugagacucccuguuuccuccugcuggacuucccagccuccagcugcucacaugguccuccacaacugccucccuguacaccuauuauauuccaccagcagacuggaaucuuuucccauaacacuaaagugaauuuggaguccucugccuccgagacuaaugagcacaucuauauucuaaauuccagacucuuccagucuacuucuuccuacugugguuuacuuuucaauuaaucaauuaaucacaaaacauacuaccaggccagagguaucuuggaccccuggaauacuuaaacuguuuccaauccaaacugaucagauaaugaguauuccaguuccuguagcccauaacuaaaaauguuauucuacaaacuaguguuuauuuguuugaacugaaaccaucugaacacuaguuuuuaaguacaaauauuaaacggagcaacuuuaauccauguuuuuccauugcauugcuauuacaguuuaauuucuaauuugaauuucauauuuuuaauuucaucaauacauaccaggaaaccaauuaugaggaaaaauaagcuauacccuacauucagaaucuaccgagguuugaaagaguuuaccaggaaaaugcugacucugaaauuuuaaacuugguuuuucuuuuuguucagccaaaaacaaaguuacauuuuuauuuuuuuaaaucaacaaaagucagcacuguggugaaauucuaaacaccugcaauaacauauaaaaauugcugaaccuaccauuuauacccaucaauuccuccaguaguaucaacuugucuauggucugauacuaugagaaacucaguaagaucccucuaauccugacaguuuuucaggcaaaguugagaauuuacaggcaagaucacagaauucuucuaugugcuccaucacugggcccagggauuaggaucaauaaucaacuuuuggcugggcgcgguggcuuacgccuguaaucccagcacuuugggaggccaagacggguggaucacguggucaggaguucgagaccagacuggccaacaaggugacacccagucucuacuaaaaauacaaaaauuggccaggcgugguggcaguuaccuguaaucccagcuacuugagaggcugaggcaggagaaucacuugaaaccggagggcggaaguuacagugagcagagaucacaccacugcacuccagccugggcaacaagagcaaaacuccaucucaaaauaauaauaauaauaguaauaauaaucgacuucuuucaauacccauuaacauaaaaacucuuauuugccaccuggaauggucugugacuaaauaacccaaaacuuauuguaaguaacuaagcccaaaaugucuaagacauuugaauaaaauuacuuuagaauccaagaaaaaugaaauacuaaauugccauacuuacucaauuuuuuuaagaguuauuuuugaaaaaaauuaaagucuguacuaaaaagaugcuaauuuuucuuauauaggugguaaccacugggguaauggguaaaaaguauguaagacuucucuguacuaucuuugcaacuuccuauauaguuauuucaaaauaaaaauauuuaaaaaaaagauuugcagaaagaaagaacuaaugauacaaauaacaacaugaacaaaucucaaaaacuucaggcuaggguaguccaauagugggucacuagaacucauuaacauuagcguuacuaaaguugguauacaauaccucacugcuaaauuuaacuggcuuuauuuaaaaaacaaacuucaggcuaaaugaaagaagcuagacacacaagacguguuauacaauuccauuuacaaaaauuuucuggaaaaugccauaauacagcaagagaaaacaguaguuccugaguaugaggcuggaggguaggaguaaggauugacuacaaagaaacacaaaggaauauuucaggugaucaucuucuaaaacuggauugugauaacaguuguacagccaaaugaauuuacuaaaacuguacacuuaaaauuggugaauaugcuaugguagaagcuagaugguggguauaccaaugcuaauguaaaauuuuuauuuuuuuuuuuaagacagggucucacucuaucauccaagcuagaguguaguggugugaucauggcucacugcagccucaaacucucaggcucaagggauccucgugccucagccuccugaguagcugggacuacacgcacgcaccaccaugccccgcuaauuuuuguauuuuuuauagagauaaggucucacucugaugccucggcuggucuugaacucuuagccucaagugauccucccaauucagccucccaaagugccaggauaacaguugugagccacugcacccagccuguauguaaaauuuuuaaaacucugcuguauauuugaaaaucaucaucauaaaauguugaggcaaauuaaaguucucauaaacaaaggaaugagaaauguaaaauauauauuucccuuggcagcucacaauuccagaaacauuuuaugaaaagauuaagucaauggcauccauccaaacaaucccauaucccacauacaccacguuguagcccuuguuucacaaucuguuauaaauaaagagccucugggauuccaaucccccaaucaaauccuuaagugcuacuaaagguggcuggucauuuauucagccacaggauggaaacccaagcacaaacauguaacacguuuuaauuaccauauggagaaaauucaaguuucagcacucuguaaauuauaguguuagcaauaucgaaauacccaagaaauaaaaaucucacucaagaguuuuuaugccuguaaccccagcacuuugggaggccaaagcaggcagaucguuugagcccaagaguucgagacuggccuaggcaacaugguaaaacuccgucucuacaaaaaaauacaaaaauuagccaggcauggguaguggccuguaccuguagucccagcuacucaggaggcuaaggugggaggaucaccugagccugggaagguccaggcugcaguaagccaugagcaccacugcacucuauguacucuggaugauaaagaggagagacccugucuccaaaaaaaaaaaaaaagguggggggccagguacaguguggcucaugccuguaauuccagcacuuugggagguugaggcaggcagaucacuugaggucaggaguucaagacaagccuggccaacauggugaaaccccauugcuaucaaaaauacaaaaauuagccaggcgugguggcaggugccuguaaucccagcuaccugggaggcugaggcaggagaaucgcuugaacccaggaggcggggguugcagugagcugagaucacgccacugcacuccagccuggccaacagagugagagucugucuccaaaaaaaaaaaaaaaaagaaaaagaaaaagaaaagaagaauuuuuauauaagaaucacaaacuuucuacaaaaaauucucuaugagaaucuuugagggaaaagaauucaaaugcaguuauguacacauuaacauugucuuucacaauccuuuaauuaaacucaaauccaccaauaucccaacaucuuauuagauaaucagcaagaaauaucaaacuuaaguagaaaaauauugagaaaacaaaaaugugaaaucauaaaaaguaacacauuggacaacauagugagaccccaucuuaaaaaaaaaaaaaaaacuagccuggugcaucugcagucccagccacucaggaagcugaggcagagaucacuugagcccaugagucugaggcugcagggagcuaugauuccugucacugcacuccagccccagccugggugacaaaacaagacccugucucuaaauaacaaccaaacaaaccuaaaaccccaaaaaaacacuuguggagggauaacaucucuuguauuuauacaacuuucuaagauuuccuauuuuuauuagccaccuaaauuuaugcauauuccaauuccaaagagcaaaguagucuuaccaggccuucaaaacacaagacaguaccuuuaaaccuccccagagcaauaucuaaagagaaagauauugucauacaauacucauuaaaaaauuuuuuuuaauugccaaauuuuaaauuuuuuuuuuuuuuuuuuuuuuuagauggacucuugcucugucacccagacuggagugcaguggcacaaucucgcuucacugcaaccuccaccucccagguucaagugauucucuugccucagccucccggguaugcugggauuacaggcacgugcuaccacaccuggcuaauuuuuguauuuuuaguagagacgggauucaccauguuggccaggcuggucuugaacuccugagcucaaaugauccgcccgccucagccucccaaagugcugggauuacaggcgugagccaccaugccuggcaguugccaaauuuuauaccaaagguguauuccuccuuacaaacuuucagagguaguauguauauuuuuacauuauuuauuagaaaccauaaauagguaaauaaaaauuccaaaaaugguuaaaguggauguuucuaauuuguuacuuuucaaauuccagacuauacuucauaaaagaaggggauguuauauacuuguuauguauccuacugugccuagcaggagggcaguaagcgauagacaaggauagccagcagagaccuuuucaaaauggacuuacauuauauacauaagucccuuuuaaacucuaucaggaagagggagagaaugacaagucuuuuaucuaucugacccuaaaguccuacaauaauuacaaugauuaguaaaaugugugaguucuauaacugcuaacaaaaauaaaaugugugaguucuauaacugcuaacaaaaauaagauacagacuagucuacagacuagucugcuucacugacacuaugauuaaauaaucaucagagaaaugagucaagaauuuaccuuuguacuggccacaccaaucucaggaccagcauuaauaugaacuccacaaucugucucccgugauauggaacugccaacuguguuugugauccccacaguuaaagcuccucucuccuuacaguaacgaagacccaucaaaguaucugcugucucaccuguguaaaaaguaggccaaccauaacacacagaacaguuuuaacauaugcuguuucuuaggagcaaaaacaaauugaccacacuuucaacaauauuacuuguuuuaaauaaaauacaaaacauccacuuaauaaauuuauaaaacuuuaaguaauauggcuugucaggaucucucuuccuucucugucauugaaaauccagcucuuugaacacaaaagguguucauuuuuacuaauucauaaagaauuauguaacauuaaaauaaaucuguauucgucaagucaucugcaaugccaguuuaucuuuaaauaucagcuuuugccaagauaugcuagaauuauuagaaagaauaacuuuccuuccuuuuaagucuuuaaaauuaacacaccugauugacuaaggaaaaagcaaacaucaucucgaaagacugguguguuucuguccaggaagucacuugcuaguuccaccaucacaggcaacucagucagcuccucaagaacuugacgugucugcagagaaaauaugacuuggucacagaacuuuccuucaaauacucuuucaucggacuucuuuggauucaauguauaguuuuugcuuuuucugauuacaaaaaugacacguuagaaaauaaaaacaacccagauuaaaauauuuaaaaaaaaaaaaucaaaauccuaccacuugagauaagcauggcuaacauuuuacuaucagucucuuuagacaacuaucuauguauacauuccuuuuuuuuuuuuuuuugagacggagucucgcucugucgccaggcuggagugcaguggugccaucucggcucaccguaaccuccgccucccggguucaagcaauucuccugccucagccuccugaguagcugggacuauaggcgugcgccaccaugcccagcuuaguagagaugggguuucaccauguuggccaggauggucucaaucuccugaccucaugaucugcucgccucagccucccaaagugcugggauuacaggcaugagccacugcgccuggacacauacauucuuauaaggaaacauacccacacauauaaaacguuuugagaaguggaaagagcaugguucugagucagcuuguguguuaucucuaaccucccaauuccuaaucuuuaaaaugaaaauucauguaauacccauguuagggagggguuucaaaucagguaacagauguacaaauauauagagaaaaauuaaacacuuuaaaaguacaacguauucauaaauaugaccauuucccaaaagaagucaauauauuuuagaaaucuuguuuaacagggcucacuauuuucaacuuuuguggcauggggcagggggaaugaaguagggagcaguaugccucugugcaaaacguaguuuaaccuucauuucaguaaauuuccauucuaauuauuuuuacacuaaacaucggaaaaucaaaaacagaaaaauuaucuuuuaggcagcaaaaacuuuaagcucaaccaauguauacauuuaguguugcuuuaauucuaacuguggagcucaccuaaccugacagccuuucaccagccucuucaggcaaguggcccuccccaucucucacccaucucagcuuuccuccuucucagcaauaaagaacuuaaaggugcccuuauuucauagcccuuaacuuuugcuugcccacaaauuugaacagaaucguuuuacuugguucccccaaaaauauuaaauaacuuugauuuggcauuuuuuaacaauauuacaacaucauguaaagaaaaucauugaagauaaaaugcuccuauuuuuuauuauucuuuuccauuaauauauuuuauuauacauaauuaaguuaccgacacuaaaaugcuaaauguuuucccacaaauaaauguaaaccaaaccuuuucacccaguuuauaauauaaauguuacauuggaaucauauucuucaaaauaaaaagauggggaaagaagagagaaagauagaaaucuggaggcuuaccagauauuuaaaaguaauaaaccccaaaaaaguaaucucaagauuuaucugugcuaauuaauaguuuauuauuuuaguuggggcaacuuuuuuuuuuuuuuuuuuuuuuuugguuaaagauggggucuugguuuguugcccaggcuggaguguagcagcuauucagaggcaugauucuagggcacuguggccucaaauuccuggucucaagugauccuccugccccagcuuccgaggagcuggaacuauaggcacacaccacugcacccagcugcgaacaacuuuuuauaaauacacaaaaugacauauuuccaucacaauagaguaacuuaaugcuauaaauuccacugaaugccacuacaaaaccuagagaaaauuaaaauuuugaaaagcauauuaaguaggcuauacuuaaaucauuuaugccuaguguuccaucacuggaacguuaagcaugugggaguuauuuauauccuacugcucaaggucagcaccaaggucugaugauuuuucacaaaaaaauuuugcaaccucuggcauaaaugaguuaagaaugauuagaguguagucaguuauucaggauauagauacuaaaaaaaaaacauguaaaugugucaugaaacaacaacaaaaauguaaaacaggauaaaauaaaugguacuauuuugucugauaaaccacagggggauuucuaauguuuguuuacuacaguagucuuggcauccacaaaacaacaaaaaaucuuacauuagagaauucuaacagaguauauaauuucugcccccaaauugucuuagcguuagaugaagcguuuaaucaaauuuucuauuucugaauacagggcucauucaguaauagaucuaagccaccacuaacguguuuacaucuuucuucuucccguguucaaaauuuuuuuuuuuuuuugagacagggccugguuuugucgcccagguuggaguucagcggugcaaucuaggcucacugcagccucaccuucuggacucaagcgauccuccugccucagccucccaaguagcuaggacuacagggaguugccaccacaccccgauaauuuuuuuuuuuugguagagacggggucucgcuauguugcccaggcucaaacuccuagggucaacugauccucccacuuugcccucccaaagugcugggauuacaggugugagccacaacacccagacaaaacaaucacuuuuuuagaccucuacccuucaacauuacauagacuuucuguuuaggaccauauaauuuugggggaggaggggaggagguauuugguguagucuuagaaaagagcaaagcuuguugagaugcaagggcaggugaccagauaguuucacucacugcuuaaauaaauggcuccuaauaaauauuuaugccucagcaaauaaauaaguuaugucaggaacuuuggaagucaauccuaaaagcagaaauugaauguaaaggucuucuguucauaacaguugacaucagcaacacauaaacugucucuuucuaaggaaacuacgugggcaaauauuggucuuuuauuggaauaaaagacccucauacaccuaugcuucugcacugacaauacacauuuuugauacugaauuucagcuucuaaaagaacaauuuaaagaauaaaaucugauuuaaaaaaaaaagcagacuaccuuucuuugcaguaaugugcccacaaaguaaaauugcacugagguucacacaugaugcaggccaucugucuagggcaagugaacaaugcuaagcaaaacccaacgauggcucuuacacauguaggcaagcucccuaggcuacaagucuaggacaguacacaaacucucccccucuuggccuuucaugaaguccguugcaggaggucuaucuguauaucuagggaccuuuucuacagaucuuccauggauaaauaauuccaagcagcugguaaauuucuccccuuaccuucuuuuuuuaucacaaaagggaaaagauaacacauuaacaaaacauaguuuuacacaguauguuauuagacuacuacuuggucuacagauauucucuaauauucaacauaauuaaaauuuuaaaaagcacuuacugcuacaccagcaugguaacuuguuccacaagcaauaagaaucaaacgccggcaucucuggaucuccuuuaugugauccuucaaaccacccaaauucacugaaauaaaaguuuguguacauaauuauuuagcaaagaaccaugugaacuaggcaaucgcauuuugugaguauccacugccaauaugaggaagaauacugcuguuuuaaagaauuaauauuccucuuggaaagcacaguucucuguaauuuugaaaaguaaauuaaauaagucacaacuucacuggcgcccccaaacuuguaacugaccuuacucaccucucuacauccccacacaauuacaguauuuauuacauucuaccuuaguuaguuauuuuuacauucuucucuuugaaaguuaucuuaaaggcaaaaguagagggacacagaaaacagaucauuagauguagagggcuggagcuggaggagggguugacaacaauagggugcaaggaaauuuugggagugauggaacuguucuacaucuugacuuuguagagguuaugauuaugacuauguuguagagguuugucaaacuuagaguuauacacuaggaauggugaauuuuauuauaucuaauuaugucucaauaaaccugucugggaaaaacauuaucucaguuacguuuauuuccccucuggugcccagaaaggugcucuguagaguaacauaaacccacucuccucucagucuuugccguccccauuccccuaaugcuucagucaaaaugcuugauuguucugaucccuccacauuuaucuucaaacccagcaucucucccuggacgacagcaacauucuccaguucucucuucuguucuccaccuccuggagucugcucuccauaugcuaccagaaggaucucuuacagugauccuuuaaaaacauaaagacccuccaaugaagucuguccucuuuuucauuuucaguuucuauagcuauuuacauguuguucuccaugugucuuguccagaaauccuuccacacaggcuaguuuucuaucugugagaaauucucauucaacauucauucaacuggucaacuaaaauucccuaaucacccaccaaguaaauauaguggucaaggcacugagagcuucuggacucaaacaauuccaaaucuggcugaggagaaugacagguaccuccucgugggccucauccugcugcucucucugaaccauuuucagucugucuacucugccccugcucucuucaucuccucaccuuuuuuuuuuuuuugagacagagucuugcucuguagcccaagcuggagugcaguggugcaaucucggcucacugcaaccuccaccucccagguucaagcgauucuccagccuuggccuccuuaguagcugggauuacaggccgcgagccaccacgcccagcuaauuuuuuucuauuuuuaguagagaggguuucaccauguuggcuaggcucgucucggacuccugaccucaaguaauccacccaccuuggccucccaaagugcugggauuacaggugucagccaccacgcccagccaguccaccuucuuuuuuaucuuaguuaguuauacuauaaaaccaagguauguguuuuacuuuuuaucuuuugaauaauuauauguucuccguuuugaauuucaauaaugaaagaagguauguuucucuauuuuaaaaaauuagcaaguagaaaacaaaaccaaacaaaauaaaaagugucacuagcuucccaaauaauuuauaaucaaauccgaacuacuuacuuuggccuucaagucccauaagaccugucuccugcuuacucugaccuagcacaucccuucucacucaggccacaccagccagacuggccuucuugcuguuacugcacuagaccaagccuguuuguguaccucugccuacaguguuuuccacagaccuuggcauuaauuacaaauguuugagaagaaaggaaacagcaguaaaaggcuggaucagggucaugcaaaggcaaagacucaauauaaaagcaaagcaaaaaaaaaaaaaaaaaaaaaaaggcagaccaacuaccagaaagaccuguauugcagaugaugacaaagaaugacauggauguaagacagugagauuagcuggccacgguuguuuccuuaaaauuaguccuagaaauuucugguggcugaggauaguugggauaguucugaaagaagcugcccaaagcucuaaauuugaugcuuuugagaaaagccugaucccuuuugagaugagguaagccaucacuacaggcaaaagaaagaaugccugauggacaggggaggggauggagagcacuuagaacaaugaauacauggggaguaguuugguucaauaaaugacuaacaaugugaccuuugacaaacugaaagccucaaucuccucauccuaacaacaaaaaagaugacagcuauccuguuuuauuacagaacuuuuauguacauaauacagauauaaguacucuuuuuuauuuuuuuuuuuugagacaggucuuucaaccaggcugcagugcagugguggagucagagcucacugcagccucgaucuacagggcucaagcaauccucccaccucaggcucuucaguagccagggcuacaggcacccaccaccacacccagcuaauuuuuuaaaaauuuuuaguaaaaaggaggucagacuggucuagaauuccugagcucaagcgauccucccgcuuuggguucccaaagcgcugggauuacaggcaugagccacugcacccagccaaaaguacuuuuuaaaaccgugaacuucccaaaguuugucucauuuucuucccuuauaaaacaaaucuuuuuccugaccucauuuccauaaauaccauaaaagaauuuacugcuacucucccaguucuuccagcucaaccaucuucaacaaccaccucugucuacagaggcagauacaauuccucuggugguacaugccuguaaucccagcuacuugggaggcugaggcaggagaaucacuugaacccgggaggcagcaguugcggugagccgagauggcaccacugcaccccagccugggcaacaauagcaaaacuccauccuaaaaaaaagaguaguguuguacucucaccucuaccuuaaaaaugcaggaggguacagguuauccaaaggcaucaggcaaauaacugaaagaccucuggggaaguucacacuuuuacuuauuuauacacucagaaaggaaaccuaggccaggcagauacacauaagcugcccagcaacgggaccaggucuuauucuucuuagaauucacaguaccuaggacagucccugguacacagugggugaccuacacauaaaauuuaccauuuuaacuauguuuaaauguacaauucaguggcauuaagcacauucacauuauugugcaaccaucacuacaauccauuucuguaauuucaucaucccacaacugaaacucuguacccuuuaaacagugacuccccauuuccccuccccacagcccuugguaaccauuaaucuacuuucucuuucugugaaucugacuauucuagauaucuuauauagguagaaucacacacuaaagaacuuuuuccaagauggcugggcuccacugauggcuggcagcuguaguuguucuacaaggcuauuaagggcaaugaacuuucagguuguuaauggcaccuccuacugucagagacacugaaauaauaaaauaauucauauguaauuaccaguauagucaucaaaguugacucuuccucucauuguguucacgacagacucuggcugcucaaauauuuccuucugcauaaaugaacugaaguugccuauaguaauagaaaucacauaauuaaaacaaaaacaaaucaaauaaaagaauuuguacacaacuaaaaguuuccuuuaauauaaucuugguaaauaaaauauaacaaaaguucaugcaauagacaugacugccuaaaagauugggugaacauauuuuacucuguggaaaaaaauaacaguaaaagucacuuuuaauuaacuucauacuugaaaugugcaguuacaacaagugaaugagacaagcuuuuuuuuuuuugagacggagucuugcucugucacccaggcuggaguggaguggcaugauguaggcucacugcaaucuuggccuccuggauucaagggauuccccugccucagccuccugaguagcugugacuacaggcgugugcuaccacgcccggcuaauuuuuuguauuuuuaguagagacaagguuucaccauacugaccaggcuggucucgaacuccugaccucaugauccaaccaccucggccucccaaagugcugggauuacaggcgugagccaccgcacucagucaacugggacaagcuuuaaguuuuggagugcaacccacccaaacuguaguucuauccuuuacuaucuaaacuggggaaauuauuaaucuauaaaauaagagaccaauuacuucacaguauggauuguaguauggauuaauaaagcaaaaaaucugacauauauauauauagaguuaugcaauaaauguuauuucuuauuuuuacuuuuuuuuuugagacagggucuuugucacccagacugaagugaucaccgcaagaucaccgcucacugcagccucaaucuccugggcucaagcaauucucacaccucagccaccugaguagcugagacuacaggcacacacuaccaugcccggcucauaguuuuguuuuguuuuguuuuguuuuguuugagacagagucucacucugucgcccaggcuggagugcagcggcacgaucucaccucacugcaaccucugccuccuggguucaagugauucucccaccucagccuccccagucacugagacuacagguacaugccaccaugcccauaauuuucuuuguauuuuuaguagaaacaggguuuugcuauguugcugaggcuggucuugaacuccugagcucuggcaaucugccugcuucagccucccaaagugcuaggauuacaggugugagccagugcaccuggacuuuuuuuuuuuuuaguuuguaguagagauaaggucucacuauguugcccaggcuggucucaaacuccugagcucaagugauccuccuaccuuggccucccuaaguguugagauuacaggcaugagccaccgugccuggccaauguuaguuuuuauuccuaccacaaucccaucagaaaggaauaaaauaauccaaaucauaauaauuauaauaguuaacagaagcaaauauuacauacgacuaagugugucagacacuguuuuaagcuucuuuuuuuuuuuuuugagacagaguuuugcucuuguugccaaggcuggagugcaauggcgcaaucucggcucacugaaaccucugccucccggguucaagccauucuccugccucagccucccgaguagcugggauuacaggcaugcgccaccacacccagcuaauuuuguauuuuuuaguacagucgggguuucuccacguuggcaaggccagacuggucucaaacuccccaccuuaggugaucugcccaccucggccucccaaagugcuaagauuacaggugugagccaccgcacccagccauauaguagcuucuuaauccucaaaacaaccuuaaugaggcaggcuauauuauccucauguuauauauaagaaaacuaaagcacaaagagaauaaaaaggaacagaacauuaacuauuuuuauguuuauaaaguaucuuuaaaguaucaaguguuaauaaccuuuuuauaauguuacaaauaacaaaucauuaauuaguuugaagacgauuguaaaaacagcagauaauuucucuaaagaaucaucccuuuuccuagcguugucccuucacuaaucauguggaagauuccacucaucauucauuacuagauuuaauaugcuaggaaaggaaguagaauauauucuuuccaguaaggacagcaagcuauaacaugacaaaaacuuucacccuucaugaucugcuggaguuccaucuggaguguuugcacagcucguccggggugaucuccugcaguucguuuaauucgauggauagaaagacguccauccacuacugcugcaacaucaucaucuuccagaaagaugacgcgauugguguguucuaugacagcacuauaaaguuuucaaggagauauuacaaucgauaaccaaggaucauuauuacaaaugaaacuaucauuuggauacaagaaccaaauuucaauauaaacucuaucacucugcaguaucucagagaauuuucugguuacuaaugccaaccccuacaggaaaguauggggaagguggucauuguggacaaaaaauaaaaggaacucugcauagcaaucuaaaccaaacagauuagaucagaaagcaugguuguuuccuccucauucuauccauuaccaaguccugaaauuuuaacuuccaaauauucuuaguuucuauguccaccaccagacaaauucaagcucccaucagcuccucggguggacuacugcagcgaucucccaauuaguccacccacuuucucucugaucucucuccguccauccuccauuucugccaaaauugauaucaaaaggcaacaacucuaauaaagauuucuccuucacucaacaaaccauuugacaguuucccuuuggcucucagagagacaacaaagugccuuaccguaaucccuauaccuccuucuccagcuucaucuccccccaagcuuccucucacucucucuauucuggccacacucaaagccauccuaaacucucacaggcugagccauuugcaaagaaugaauguuccucccucuaccuguuaaccuaauuaacuccuaaucucuccuuaacucucaguucaaacaucauucccuuaaagaaauuuacccaccaaggguaaaucacucuguuacuagcauucugcagcucuugucacagcuggaauucuacacuucugugaucauuguuuaaaauuugccuccucacuauggaagagcuccuaaggaaaaguaauauuuuuauuuuuacucaccauuaucuccugacgcuagcauaugacuucacccaguguucaauaugaauguauaaaugaaugagaaaaggcugauauguuucuguaauuccaguguauuuaagccauaacugucaacuguguaaucuuacacaucuuagcccugacuacacaccuuacacaccuguaaaaacauuaaagaguaaagcuuguuuucccacugagauaauauauucccugauguccuaaauggcauuauuuucuuauuuuuauuauuuucucuuauuuucagguacaguggaugacucaaauacuuguuugcaauuucggugauuuuauuuuauccucauuacuauuucauuuacaaaugcauguaaacaucccccugcauuuucucucaaaauaucuuagucuacuacuaucccuuuauaaaaaugauuaugcugcaaauuaauucuaaauguaaaagaugaguaucuacauuagacuaaaacuacaauaguuuagcaacuaugcuauaacuauugggauacuaacuaagccauuuuacucuucaaucuagaaucuccucccuucaaaaccuggauaaggcuccugaaauaagaaggaaaaaaauguaagagcucuaaaauaaauacacuggaacaagucucaagcaguauauguguucuuaguaaacugacccacauacuuugaaaugacagaaaaaguguccuuacagccccaucuccaaaauggucaccuguauuucuuuaauuuaaaaaguuaucucacagagcacaacuagacugauacacaaugacuucuuggguuuccugcagaaugagaaguuuuacuaaaaaucucuuugaaucaacuaaggaagcucaccuugcaucagaagcaaaguaauacuccacugcuuuuucuuccaccgggaaaaggcagguugugcuguccacacgagagagauugcagcuuccuuucuugucuuugccuaaagcauauaguuaacaugaauuggcaaacauguagaaaaucauguccaauguagaaauaugcauaauauucuauaaaaucaagaaaaaaucauagcaacacaaaacaauuuuagcaaauuuaaaaagccaaguagaucaccuuauuuccaugcaauaagccaauaagaacagacaaaaaguguacagugaaguagcaacuaucaaagagugcguggcagguaaaagugcuacauuauauguuuuuuuaauauaauauuuauuuuccagguaaaagacaaguaauuccuuaauauuaaccgguuuuuuaaaucaaaaguauguauaaauuaauuuuaacuuuauacaaaacaaugaucuuaacacauaaaaguuuguguaccuauaauuauaacaaaauuacauuuaaaauaucaaaauugugcaacgaaaaauaaaaugaacacaggggcucacgccuguaauccuagcacuuuggaaggccgaggcaggugaaucacuugaggucaggaguucaagaccagccuggucaacauggcgaaaccccaucucuacugaaaauacaaaaauuggccagacgugguggcagacgccuauaaucccagcuacuugggaggcuuaggcaggagaaucacuugaacccaggaaguggaggcugcagugagccgaaaucacacgccauuguacuccagccugggcaacagagcaaaaacucugucucaaaaaaaaaaaaaaaagaaaaagaaaaugaaggcuaguggcaaauuaauuuuuauuguaucauaacaaaaccucacuagauuuuagcagcaagucagcauaacaaaucaaguuguagucuacacuaauucugauuugaaaacaaaacagaugcauaucacucucuaaucacgguauaucauauguggcacccacuguuagagacaaaauuuauaaaccaagaaacucuccuuucuucaacuuggguuuucuuacucuuccuuuaagucaggauaaaguagggucuuuuugcaaagcuaauauccuuuuaauucuuguauuucagaauuaugacaccucuacuuaauuugucaagacauuaauauuaacuuuuucaucaaaacuggaaugcuaagguuuuauaaauuggccuuauauaggaaaaaaaucuauuaguugaagacuacauaaauguccuagagacaaaaaugcaccuuucuucaaggccaggacauaacagaacuuagaacuauggacacaauagccagagaacaucacaaguauacuuauaaaaacugcuauuucaucuauccucuuaaaaugcacauauaaaggcagacuugauaauuaucagaaaugugcauucaaaugugcuauuuauccugagcugaucauuauacauuguacacauguauugaaauauacaccacauaaacauauaauuauauaucuauuaaaaauaaaagccaaaaaaaguauauucgaaguuuuccaccaucugugauuauuugauguuuuagugaugaaaacaaaguaacuuuucccauucauauuuaacagcaaagaugccaaacugaaaaauaaauguaagaugacauccaagaaaaaguaacauuauagaaaaauaacauauuaguguuugccaggggcugggaaugagacaaggguugaugacagagggcagguugagggaccuuauugagugaugaaauuguucuguaucuugauuauggugguacuuaugcaauuucgcaucugacaaaauuggugaaacuacaugaaaaagaguaaauauuacuguauguuaaaaaacagagaccaggcacaguggcucaugcuuuuaaucccagcacuuugggaggccgaggugggcagaucacuugaggucaggaguucaagaccagccuggccaacauggugaaaccucgucucuacuaaaaacacaaaaaauuagcugagagugguagaguacaccuguagucucagcuauuccggaggcugaggugggagaaucgcuugaaccugggagguggagguugcagugaggugagauugugccauugcacuccagccugggugacagagcaugacuuugucucaaaaacaaaacaaaaaagugaauuuaaaaacacauaaaaagagagcucagcauuuuaaaaaaauaaaugcaaccaggugugguggcucaggccuguaaucccagcacuuugggaggccgaggugggcggaucaugaggucaggaguuugagaccagccugagcaacagccugaaaccccgucucuacuaaaaauagaaaaauuugcugggugugguggcacgugccuguaaucccagcuacucaggaggcugaggcaagacacucgcuugaacccgggaggccgagguugcagugagccgagaucacgccacugcacuacagccugagcaacagagcgagacuucgucucaaaaaaaaaaaaaaaaaaaaaaaaacaacuacuuuugcuuauaaaauguccuaauaggcuugaguuucacuguguuuuuucuccaaauauugauaauuucauucuucaaauaacaaaguauauuuaguuaaaauauguaaaaaaaauuugaggcugggugcagcggcucacaccuguaaucccagcacuuugggaggccgaggugggcggaucaccugaggucaggaguucgagauuagcccggccaaaauggcgaaaccccgucucuacuaaaaauacaaaaguuagccgggugugguggugugcacugguagucccagcuacucuggaggcugaggcaugagacucgcuugaacccgggaggcagagguugcagugagccaagaucaugucacugcacuccagccugggcaacagaacaagacuguuucaaaaaauaaauaaauaagguaaaaaaaauuugagauaucaaugucuguuuaaaugaaaagaacacuucugggcugggcacaguggcucacaccugugaucucagcacuuugggaggcugaggcagguggaucacuugacuccaggaguucaagaacagccugggcaauauagcaagacuccauuuguacaaaaaauuuaaaguuagcugggagccaggcacaguggcucauuccuguaaucccuguaauuuaggagguugaggugggaggaucccuuaagcccaagaguuugagaccagccuggccaacauagcaagacuuccuuuuuacaaauaaaaaaauuggcugggggugguggcacaugccuguggucccagcuacucaagaggcugaggugggagaaucacuugagccuaggcagccaaggcugaagugagccaugacgaaaccacugcacuccagccuggcugagagagcaaaacccuggcuaaaaauaagaauuagcuggguaugauggcacacgcuuguaguacuagcuauuugagaggcugaggcaagaggauccaccugagcccaagaguucgaaauugcagugagguaugaccauaccacugcacugcacuccagccugggcaacagagcaagacccugucucccccugccgcucuauaaaaaaguuacaucgaaguaaauaaauaagaaaaacaaaaaauaaacuuuacacauaaacaauauaaaagaacaaucacuacaaauucaaauaaagccaaucaagauagcaaauguaaauccaacaauaugucauguauaaaaaauaaagaccacuuaaacauauuucaguuaaaaguuagccuaaaugauucaaauaacuaccacuuagucaaucuauaauaaccuagcacacaaugcucuuuuccuaaucuaagcauacauccuacaugauuuuaaaacaaaggaaaaaauaauuuacaauuucaacuauuuucucaaauuucagaaauuuuaaugaaauuauuaaaagcacuuucuaaaugccaaaagcagacacgcaaaauauacuccgcaaauuagaaaaaugucaaaauaugcuuccccacaaaauaagcacauuuuuagaggcccagcacauucauucacuccaagaacaaaagaauuaguaaagaauaaacaaaagaggauaagauccuccccauccaugcagagugcauuucccaccucuuucucccugugauccccaccgugugaauuuugauccaaucugaguccuagcuaaggauacacaacagaaaaaaauucuaaucaucagagaacucacaaaaacaaaucuuuuucaugucuagacagaacuauauauacaugugcaucugaccaaagagccaucuauuccaacuuaaggaaaauaauucuucauaucuacugcacugcauuuguagagguaauuuuaccuguucuguagaguauaggaaugugaucaguagaaaguuuauguucacuccguacaccaaucaacagagggcuaccucgccuguaaauugcaaaagcaguuagaauuaaaccauuuuuauaaauaauggacuaaugacauaaaauuuaaugggccaauacucuucaaauguuuaaaucauccuccccaagcucaacuucagauauaagaacuagauaaaaagaauuuuuuaaaaaaaucaguauugggccaggugcaauggcucacacccguaaucccagcacuucaggaggccuaggcaggcagaucacuugagcccacgaguucaagaccacucugggaaacauggcaaaaccccgucuccuaauuagccaggugugauggcacgugccuacagucucagcuacucggaaggcugaguuaggaggauugccugagucugggaggugaagguuggagugagccaagaucgcgccacugcacuccagccuggaugacagaacaagauccuauauccaaaauauucucuaucaggggucagcaaacugaccugcagccccaggguuuauuuuuauaaauaaacgguuuuuguuuauuuguuuguuuuuugacaacagccuugcucugucucccaggcuagagugcaguggcgcaaucacagcucacugcagccuugaccuccuggccucaagugauccccuugccucagccuccugaguagcugggacuacaggcaugcaccaccacacccagcuaaauuuuuuauuuuuuauagagaugggauuuugucauguugccuaggcugaucuggaacuccuggggucaagcaauccacccaucucagccucccaaagugcugggauuacaggcaugagucaccacgcccagccuaauacagguuuuugguuuuuuuuuaauuauuuuucuuaauugacaaauaaaaauuguauuaaauacaguuauuuuggaacauacccaugcccauucuuuuacuuauuuucugcagcugcuuucacacuacaacugcaaaguugaguaguugcuacagaggcuacaugguccagaaagccuaaaauaguuacuauccggcccacuccagaaaacuugccaacaccuguucuguaacaauguauuuuaauuuuuuuccuuuguaauguuaaagggaaccuuccuuucaauugugcacagaaugccaauauaugaaaguguagcaccuucuccuuagucacccuguuuucagauuaaaaauaucucucuuaccauaauaucuuagggcgccucacuuaggacuucaugaucaggccuaaauauccuagcaagaaguagugaugguacaauuaucuaggaaucugucuagaauauauguuucaaaaaauacagaaaaagcuaauauuuuaacuuuauuagauaauauucaauauccaaauucacaaaguaaccuuggugcgcccaacaaagacaaaaggccaauuaaaugccaaaauauauuugcuuucuuuuuuuuuuuuuuuuuuuuuuuuuucagacagagucucgcucuguaggccaggcuggagugcaguggcacgaucucggcucacugaaaccucuugccuccuggguucaagcgguucuccuugccucagccucccgaguagcugggauuacaggcaugugcuaccacacccggcuaauuuuucuauauuuaguagagacgggguuucgccauguuggccuggcuggucucaaacuccugaccucagaugauccgccugccucgaccucccaaaaugcuaggauuacaggugugagccacagcgcccggccuguauuugcuuucuucagggauucuguuaaauggaagagugguaagcaacagacaagaaggaagaugugaaaauaugcucacaugaauauaucuaauaaagggcagagccuuuauaauaaagggucauguauagucuacgaagaauaaacauguaacucaaauauguugaaauacauuagucauuguuagaguuauauguaccuugugccaacugcuugcccgggaaaaugaacacuuuuaaacacaagugcaaaagcaccuuccuagggagggaaaaaaauccauuagcacuauuuaaucaauuaucaagucagaaaugccuagaacauacuggcuucagcgcagaaauuuuuuguucacacaaaugcucuuuuguaccaguuuauaaacaagucuaaaguuuaaguaaacacuuacuccuaagcuuugguguauccaagacccacauuuuuuuuuuuuuuugagauggagucucacucugugaccaggcuggggugcaguggcacgaucucggcucacugcaacccccaacucccugguucaagugauucuccugccucagccucccgaguagcugggauuacaggcacgcacccccacgcuaauuuuuguauuuuuaauagagacaggguuucaccauguuggccaggauggucuccaucucuugaccucgugaucugcccaccucggccucccaaagugcugggauuacaggcgugagccaccacgcgcagccaagacccacuuuuuuaaccaagccuacacccaaaauaugcucaauagauaacaacuacaaaaauagaucauuuaaaaagucauccuuucuacaggcuaugaacacuucugaaccuauauauccuaucuccaucaucuaccuaucuauaucgucauaauacuaugaauuaucagaggaacgacagaauuagaaaagauccuaagaucaaaauccaaaaccuauucucugcccuaguaauuguacaccacuguuaacuuccacucuuucugaccuugauauuagagauauaaauauauacaauuauuaacaugcacaccauacaacuccaucaacccgaauccucagggacagagcuuacaggaaucaagaacagauaaaagaggaacaugaaguaggagagggaagaaccaccuuggaacacaaacuggauuauacaaugaauaaaaggcaaagccuguuagaaacgagaaaaggcugggaaggcacacuacuccacucugccuuggggaaagggaaggaauaggccucuacauucuccaucuuccugcuuccucuuuuugcuacagauauaagauuugggugcaggugggagagaagugagggcuggaccguauuugggaaguaaaggacuuuuaagugggaaagcuagaguuaugaguggggaagggaaauguagguaucacuauggauuuggacauuuguagaucuuugaugucuuuaaucuuuaauuaggaauguuggauggaaucaaaaagaauacugauuuucucaugggcuuggaaaugcuuuucuauagaaguucagagccaagggaaaguccccaaaaggaaaaauaaguaguugacuuuguuggcucagagacaagcaggcauuaucccagaaaauaaacugugguagcugugaagcuacuauugugcuaaguuauugguugagaagaacacucggaugagcaagaagcaagggaauaacuaauccuccaucguguguacuguguacauguccacguguggugcauauggaugugugcauauaugcauaguuuuuagacacacugauuuuggauuaauuuucauuuucaugacauuaaaccugaaugaaguaaguagaauuuuaaauggagggugggggggaaucaauaaaucaaucaguuucucaaaauuauucaacuugaauaguuauaugagaaauaaaagccaaaaauaaaaaaauagcacaguuccugcuuaucaaacuuaauuuccagaaaguuucucagcauuaauguuggcauaauuaucuuuaaaaauguggcuuaauaccaauuguuggauaacucucuccaccaagguaguaaagcugguaucuugacuuucccgauugucauacauauacuuaacgagcuuggcaauugucucugugucuguuucagauucgaagucauagccuuugcuuuccuguaaguagaaagaaaaaaaagauacaauuaaagaaauauuaaugauaaaaaaaccuuuucuacagaauuguuccgucaaaaugccacuaauuucuaauauucuuugaacaccauaucccauuauucaaaauuaaagucaccagcugaucagugacucuaaaacagugugggacucuguuuaacugaacauacacuuaacuuacugucuaauaaauagccauuagcuguauguggcuauuucaauuuaauuaaaauuaaauaaaauuuaaaauucaguuccucagucauacuagcucaacaaccacauguggacaguggcuacuauacugaauagcccagauacacugucuuccaacacuggagaaaguucaauugaacagcccuaagaaagcacucaugcaggucagcacuaugaccacuacuauacaguauauagcuauuuacgacauaaaacuuucauuuaauuuguccugauucuucuuguauuaauauauccuaggaacuuuaaagcaugacaaucucucagaaugcaaaaaaugucuccacaaaauuccaauuuuauuugagccuuuugucauguauauuacagucaaaugcuaaucauuuccuuuucauauuaaaaaacacaauuguuccacuguuagcaaagaaaaauccaauaaaccaccgugcccuuggaauuguccaagaaauuaauugaugacacacauaugguguuuguugcacaucccaacaaccgaccccagugcucucguuagaaguauucucaaagacuggggucuuuugaggucaccuuacuuaccaaaaacuuuuucaagucuuuguaguuggugaugauuccauugugaauaacgauaaauucuaaaagagguaaaaguguugaagacaaaaaaguuagaaguaugauaaaucuaaaauagcuauuacucuaacuggauuuuucucaagucaaaaauuuuuaacaugcuauauacuauuuauguuauuuauaacauaauuacaucuacuucucauuuaccagauuaucaucagguagaucagcagcauuguuuauguggcauagcugaagcaaacagugcaggggagguggguacaguagggaaauaaacaggaagucuagagauaacaauuucaguuguggcuaaacuaguaaucaaauguuacccaugugaaaggagcaaguuuauugggucuguugccucauuugcaaaaugagagagcugaacuaaauauucuucuuauuucucuguucauucauucuugaguaaaaguuuaaagagaaguccuuucaaacuaaaacaauaaucugauuuacacuaaaugaauuuaagaacuagaacuaaggaauuugcuaagaaaaaccaaucaguuccauaguuaaauuuacuuguuugagauccaaauaagucauagaaugucagaaacauaaauguuaaaauaucauuccaagagaaaauagacaugaucucgggauaauuuucaucuuuuuuaacuaauuuugaaaacuguaagaacagauaaucaagaguugacaauaucauuauuuguagcgacugcugguacauaaaaacuaccaauccggcugagcacgguggcucaugccuguaaucccagcacuuuaagaggucgagaugggcagaccaccugaggucaggaguuugagaccauccuguucaacauggcgaaacccugucucuacuaaaaauacaaaacauuagccaggcgugguggcacgugccuguaaacccagcuacuugggaggcugaggcaggagaaucgcuugaaucugggaggcagagguugcagugagccgagaucccaccacugcauuccagccugggcaacagagugagauucugucucaaaaaaaaaaaaaaaaaaaaaaauccuaccaauccuggauuuauuauucagaguucauuucaguuaggagaaaaauuacugcuaaauuaaauuuuauaugaaauuaucaaaauauuuuuuuuuuuuuuggagacacgauguugcucugucaccaagcuggaguacaguggcucaaucaugacucacugcagccuuaaacuccugggcucaggugauucuuccacaucagccuuccaagcagcugggauuacagcugcuuacaccacacucaacuaauuuuuuuauuuuucuguagagagagucucgcuauguugcccaggcuagucuccugagcugaagcaauccucccacuucauccuuccagugucuugagauuacagacaugagccacuaugccaggccaaaauguucuuuuuccuuuucugagacaaagucuugcucugucacccagacuggagugaaguggcacgaucucggcucacugcaaccuccaccucuuggguuccagcgauucuccuggcucagccucucaaguagcugggauuacaggugcaugccaccauacccagcuaauuuuuguauuuuuaauagagacgggguuuugccauauuggucaggcuggucuccaacuccuaauuucaggugauccaccugccuuggccucccaaagugcuaggauuacaggcaugagucaccacacccggcccccaacaauguucuuaauauacauaaagaucugauauuuuggcugacaguaauuagaaaccaaauaauaaacauuuucacuagauuuuuuagagaugauagcaaccacaaaaauaaauuuauaaaaaaacuugccgggugcgguggcucaugccuguaaucccagcauucuggggggcugagauagauggaucaccugagcucaggaguucgagaccagccuagccaacauggugaaaccuugucucuacuaaaaauacaaaaaauugccaggcguggugucaggcgccuguaauuccagcuacuugggaggcuugaggcagaagaaucgcugaauccaggaggcagagguugcagugagcggaaagcaugccauugcacuccagccuuggagaaagagcgagauuccuucucaaaaaaaaaaaaaaaaaaaaacuucaugcuagaacaaagagauuaauaaacagcuaauuuaaaggucuuaacuuaaagccaaauucucaaaacauaaucuagauguaaguuuucgggaaucuuucauaaaggccuugucagugucaaaagucuaaauuauugcuagcauuaugaucaaauucaacaguaaguauugaagcacaagaagccuaaauaggcagcuucugaauuaaacuaaaaaucagcaagggcugggugcagugguucaugccuguaaucucagcacuuugggaggcugaggugggaagauuacuugaguccagaaauuuguaaccagccugagcaacaaagcaagaccccuaucucuacaaaaauaaaauaaauuagcugggugugguggugcaagccugugauccuagcuacucaggaggcugaggcaggaagaucacuugugcccaagaauuugagguuacagugagcuaugaucccaccacuguacccagccuggguggaggagugagacccugucucuaaaauaaaaggaaaaaaaauggggagggauaaauacacacauacacacuuuuguauguauucuguauguauuugcuuauuuuuuuuaaaugaaagaacagacucaauaauuggugaauguuaccuacgaggggaauaagaggaaacagaagagucuagacuuguuuuguugagacagucucacucugucacccaggcugaagugcaauggggcaaucauggcucacugcagccucaacccccagguucaggugauccuccugccuuagccuccugaguagcugggacuaugggcgcaugccaccaucaagcuaauuuuuguauuuucuguaggcacaggauuuugccauguugcucaggcuggucucaaacuccugggcucaggcaaucccuccaucucagccuuccaaagugcuggguagacuucuuuuagugugucuuauuuuaaagaugugacuucggaauuauguaaauauuuuaaauaauuauaaauaacauuuauuuuuaaagaauaucaauccuuaaaaauaaaaaauaggacagguacaguggcucacuccuguaaucccagcacuuuaggaggcugaggugggcggaucacaaggucaggagaucgagaccauccuggcuaauacagugaaaugccgucucuacuaaaaauacaaaaaauuacccggguguaguggcacacaccuguagucccagcuacuugggaggcugaggcaggagaauugcuugaaccuggaagguggagguugcagugagccgauaucgcaccacugcacuccagccugggcgacacagcgagacuuggucucaaaaaauaauaauaaaaauaaaaaaaauguuucuaaaacauauuaaaguaacacguagcacaacugcauggagaaagacuauuccaaguaacucuaaaacacaguaauuugauuauacauuucuagagagauaugcccuaaggacaaaaccaauaacaaaaguucucagccaggagcagugguucaugccuauaaucccagcacuuugggaggccgagacgggaggaucacuugaggucaggaguucaagaccagccuggucaacacagugaaaccccgucucuacuaaaaauacaaaaauuagccaggcaugguggacagacagggucucauucuguuguccagguuggagggcaauggcaugaggugugaccacggcucacugcagccucuaccuccugggcuuaaacgauccucccaccucagucucccgaguagcugagacuacaagcaugcaccacaaugccuaacuuauuuuuuuauuuuuuguagagacagggucucacuauguugccacggcugaucgugaacuccuggacucaagcaauccucccaacucaggcucccaaagugcugggauuacaggcaugagccagcacucucagcuccauaugcucucuacuacuucugaauguuugaaauuuuccagaugaaaaauuauuaaaauaaugaaaaucuaaaagccuucauucugcccccauuauuagguuuccacaaucauuccaaagcacaaaaaaucuuuccauaccauuauuuuuaucagagcgcuggggguggcuauugacaggacuggguucuccauguguugcccaacggguaugagcuauuccaagguguacaucaaauucuauauccaaauccauaucuuguugcucugaagaauaugaaaagaaaaauuucaauauuaaaucaugcugcagagauaaugcuauaagcuauauuuaaauacaauuauuacaaugcugcucucuuggaauauacaaucacugaaacuaaagaucaggcauauucaaaauagugauuaaaagacuuaggaggcagggugcaguggcucacgcccguaaucccagcacugugggaggccgaggcagguggaucaccugaggucaggaguucaagaccagucuggccaacauggggaaaccccaucucuacuaaaaauacaaaaauuggccaggcaugguggcacgcgccuguaguccuggcuacuccggaggcagaggcaggauauucgccugaacccaggaggcagagguugcagugagcugagaucaugccacugcacuccagccugggcaacagagcgagacuccaucucaaaaaaaaaaaaaaaagacuuaggaacacauuguacgucuguaucaagacaucucauguacccaguaaguuuacacaccuacuauauacccacaaaaauuaaaaauaaagauaaauaaagauuuaggaguuuaugcaacugaaauauugaaggcaaaugguuucaauaacaaccaaaaaacuaauacagaguuaaagcaaacaugacaaaauuuuaauaacagauaaaguuaggugaaguauauauagguaauaauguacuauucuuucaaguuuccuggagauacaaauacucaagaguuaaggacaaaaacaauuaauguaaucuuuuaaaucuauauuuaauucuugccuuaaaaagucauuaucaauuuaauuaaacauguaaaaauaaauucauuuucccaaugacacacaaccuuaugacugcaauuucuuuggucucuggugaguguacacacgucucacaauagaaacugcaacuauggagugccuccaaaaucaaauagguauuuaagaaccgagcaaugcuaugaaaguauggggcuacugggaaaucggcauaggccaauguuccuuuaucuugaaaaguagcugauuuguccagaugugguggcucaugccuguaaucccagcacuucgggaggcagaggcgggugggacacaaggucaggaguccaagaccagccuuaccaacauggugaaacccugucucuacuaaaacuacaaaaauuagccgggugugguggugcgcgccuguaaucccagcuacucgggagguugaggcaggagaaucgcuugaacccaggagguagagguuacagugagcugagaucacaucacugcacuccagccugggugacagagcgagacucccucucaaaaaaaaaaaaaaaaaaaaaaaaaagaaguagcugauucuuauuuuucauauaagcuaucuuuucuugggguuucuuaaaaaaauggacagcuccaguuauuaacuaguaaugcucuuaauuuccuaaauauaaaauuaauuuggcuaagaacccagauaacaaaguuuaucagaguuaggucuaaauuaagagcaaacuggccgagcaccacggcucaugccuguaaucccagcacuuugggaggcugaggcagguggaucaccagaggucaggaguuuaagaccagccuggccaacauggugaaacccugucucuacugaaaaaauuagcugggcgugguagcacacgccuguaaucccagcuacucaggaggcugagguaggagaaucaauugaacccaggaaggggaagcugcagugagcugagaucaugccacugcccuccagccugggcgaaagagcaagacuccgucucaaaaauaaguaaauaaauaaauaaauaaaaccacaaugguauauucuauuguacuauaacauuuauauguugucaaccuagcuuccaccagaauuugaguucuacaaaaacagcagccuaccuuauuauuuuugaauccuaagcacuaaaagguauacauggcagauaccuuuuuguuggauggcucaaucuaucaaugaauaaacucaggcaucuauucuuuccuggcuuaacuguguucuaaguaauuaaggcaaccugauaaaugaccucaagaaaaauaccauuuaccauuauucaacaggccaaugcaagaaaugaaaacaucuuugacuacuuuuuuuauuuuuuuuuugaaacggaguuuugcucuugugcccaagcuggaguaaguacaauggcgcaaucuuggcucacugcaaccucucccucccggguucaagcgauucuccuaucucagccuccugaguagcugggauuacaggcacgcaccaccacgccuggcuaauuuuuuguauuuuuaguacagacaggguuucaccauguuggccaggcuggucucgaacuccugaccucaggugauccgcccaccucaaccucccaaagugcugggauuacaggcgugagccaccacgccuggccucuuugacaacuuuuuuaagcuaacuauaauuaaagcaguaucuccuugcacaugcuggcaggcaauacuggagaaagucacaagauucuauauauugaauccauuucaaauucaugauaauuaccacaccuuuauuucacuguugcuguaggaacauuaccgaaugucuaguaagaaaaaauuauugcuaugacaauaagcacauuucucauaauaaauauuuccugucauauaaauuaaucaugacuuugaauccuugacgcuuccuuauugucuguuacccauuuuaaagcccuuugcugaaucuuaagucuagauuaacccccacacucgguuucucuucucccaucuacugccaagcaauacugaagaaagucagaaaauucuguaaauuaagacccuuucaaauucacauaucuauuucacuguugcuaccuaagaaacauguauccaaguuccuuauucauuaaacugauagcucaauccaguucccugacaguucaucauaucuuuucuauucuccauaaagcucaauccuaccugcaaucccucaauuuccacuuuacucagcuuuuguccucucaccugguaauuaucugcuuuaaguuugucuuucaucuuugauuccuaaaguacacuuuuuccuuuaaaggcuaacuccuugccugugccuugaucuucuugggccguagugcuucaauaauuuccucauuugcaucuucuaucuuacccuaccucuacucccauggcuccuugcccucugccugccuuuucucagaugucaucuucccuuuucaaaaaaaauacuucaaacauauuuaaauuugcugggaauaaugaacacccaacuacccauacucagaguuaacaaaacaucuagucaucugugcuuuacauauuuuuuaagaucuaaaauguaaaaaaucagugugguauauggaaacuugaaauaaauaaauguaaaaaaugcaguugauaaccuccuuuauauccccaucccauucacuuacuccucagaagauuuucaaguugacacagucuuacuauucaugccuuuuaaacuaugauuauguuaacaugagaccauaaaugauaguaccguuuuguguuuuuaaauguccuauacuuuacauaccaggaauuauccauguucccauaugcagaaccagauucaguacacuucuuucaaaagcuacauaugcucauucacuaucauauacaacuuauuuuuuguuguuguuguuguuguuguuguuguuuuguggagacggagucucacucugucacccaggcuggagugcaguggcacgaucucagcucacugcaaccuccgccuccuggauucaagugauucuccugccucagccucccgaauagcuggaacuacaggugcacgccgccacacccggcuaauuuuuuguauuuuaguagagaugggguuucaccauguugcccaggcuggucucaaacaccagagcucaggcaauccgcccaccucggccucccaaagugccaggauuacaagcgugagccaccacgcccggcacacacaacuuauuauaucaucccauucccuuacuuauagacauuuaggcuguuucuaaauuuugcaacagugaaucuuguugucaugucaccuuguucacuguguuuccuucaaguauauauccaagaguggaagugcuuagucucagguuauaggcauuucccauguagauauggccagauugcucuuuaaagugauuuaccaguuacaaauucaccagcaauaucuacaaguuuccauuuguagauaauaaauucaaucaauacuuauuuugcauguauugcaggguaagauuagcuagggguuggccaggugcagugguucaagccuguaauucuagcacuuugggaggucaaagaggguggaucgccugaggucaggaguucaagaccagccuggccaacauggcaaaaccccgucucuacuaaaaauacaaaaauuagcaaggugugguggcucacgccugcaaucccagcacuugggaggccaaggcgggcagaucacgaggucaggagaucgagacuauccuggcuaacauggugaaaccccaucucuacuaaaaauacgaaauaauuagccaggcguuguggcgggcgccuguggucccagcuacucaggaggcugaggcaggagaauggcgugaaccaggaagcagagguugcagugaaccgagauugugucacuacacuccagccugugcaacagaccaagaguccaucuuaaaaaaaaauuagcugugaguaaaguagacacucagauaacuacacuucaaaaacaaaccaguuggccaggcucaguggcuaaugccuguaaucccacuacuuugagaggccgaggcaggcgaaucacuugaggucaggaguucaagaccagccuggccaauauggugaaaccccaucucuaccaaaaauacaaaaauuagccgggcaugauggcacacgccugguaaucccagccacucgggagucugaaacaggagaaucgcuugaaucugggaggcagaaguugcagugaaccaagauugcaccauugcacuccagccugggcguuacagcgagacuccaucugggaagggaagaaaaaaaaaaaaaaguugaccacgaagaggcauguuucaauaugcugacauugaaaaauggugauucuguucacaaucugccuuucuagccucccuuauuugucuaccaauacuguaaauaaaaaggacuacuaucauuccaucaacacgccugccauuacucuucuuaucuugcuaugcuaucuacucagaagguccucccuucacaucuucacugaccaaauauaaucagcacccauucccuauguauucccagucucgucaacuugugggaacucuccccugaaucucacagcaaugucuguucucuccuacagaaccugcuacaaucagccugguauacaggaugcagaacacauaguagauauuuauacuacuguuuuugaaguauaguuauuugggugucugcuuuaccccuagcuaaucuuacacuacaauacaggcaaaauaaguauugauuuaauucguuaaacaaguacuacagagcuaaacguauggcuuaugugggaaaaaaaaaagacaaaauccaucauuuuccucuaccuguacucuuuuacaaugauuaugauggcauucauaugaguagguacauaaaauacuugcgguuuccuggguuuuguggagaauuuuaaaaauauuuuuucaaucaaucuacuucaaaguuugcuuuguuuucaaguuucuugugaaaaaaauaaaauguguaagaauaauguuaugaucuaaauacugagaaguaaauccucuuugauggggcauacaucucugacaacuccuugugccagagaagaaaacugugagggaaaacaugauacuuaccagauuauaucagaccuauucaaaggugcaaugucaaaauugacuacauccaagcuaggcauuuaauccaaagugaagacaauuagcaagugaagacauguguaaaagggcaucacuaaaaauaccuuuugucuuaugaaaagcucuuccucaggaaugguggcucugaagauacuucauuuaauauucagagcuuacacugaagguaauauaccuaacuaauuuccuucccuaguugcaaugauuauuuuucaggcucagguacauuuuaaaacuaguccagacaguaacaaaacuacuuuucuuuccucccuucaauguuacagaccauuaucauuaaaauuggucccaaaauauggggggagggaguaacuuagaggagaauggggaggggaaaaggaagagaaggggaaaggggacaaaaaucaaauuaaguacguuacugugaacuucuucauccagugccuuaacuuuuccuuucuucuuaauaagcuggauuuugcaggcauuggcuucccaaucuuuaucauugccuccaucaaaucccacaccuaaaccaucaugagguaaaaaagcaaaauuuagaaacuggcuacugauaaaauuauuaaugugaggcaaaauuuuuaauuaaaaaauacauucucaucuaauuaauucacuaauguauuaauucaauuaccuacugaaaaccuauugugugucaagaaccaggauagcugcuagacacaaaaacaaaaauaacuccauuccuguccucaaauuucuaagucuaucgagaagacagacaaggaaaaaauaauucagcgugauuaugaauuauaauaaaaauacuacagguuacaauugggauacaauggagaaaugcaaaagaugggcacccaccucagaagguagcuaaggaaagaaggucacagaauacaucucuuaagagucuccuuaaguugcuaaggaauuugaaaaagcuacccugaagauacugggaaaacacuguccuuuaagcagagaagugauucggcaaaaauguuuagcaaagcccuucuagaaacaaguguagggaaagaacuggagggagagaaacggaaggaagaaaccagcugucaaaagcuacagcuacagcaaagcaaaaaugaagaggaccugaacuaaacagugguaaugcagacagaaauaaaugauauugaaaaguggaacugacugaauguaagugagaaagcaggagaaguguggaauaccucaaaggacuuguugaauggcuugaaggacuuguugaaugauucucaauaaaagggacauagaaaaacagagugggcaugccuguaaucccagcuacuugggaggcugaggcaggagaauggcuugaacccgagagguggagguugcagugagcugagaucacaccacugcauuccagccugggcgacagagugagauucaucucaaaaacaaacaaacaaaaaacaggguggggagcagggugaggacugcaauguauucagcuuauuuuucuuuucuuuucuuuuuuuuuuuuuuuuuugagacagguucuugcucugucgcccaggauggagggcaguggcgcaaucucagcucccugcaaccucugccucccagguucagcaauucuccugccucagccucccaaauagcugggaucacaggugcacaccacaaugcguggcuaauuuuuuuuuuuuuuuaaguagagaugggguuucaccauguugguuaggcuggucuugaacuccuuaccucaagugauccauccaccucagccucccaaagugcugggauuacaggcgugagucaccacgcccggccucaguucaauuuuugaacaugcaaaguuuaaaauaucauggucuaucuaggaagaaacuuguaggaggccuagaauacagcuugggagauaaaucuggauuaaaagaaauacaucuggauuagaagucaccaacauacucucacacaaaaaaauuaaaauuaaaaauaaaaaauacuggccgggcgcgguggcucaugucuguaaucccagcauuuugggagggugaggcgggcagaucacgaggucaggagaucgagaccauccuggcuaacauggugaaaccccgucucuacuaaaaauacaaaaaauuagccgggcgugguggcgggugccuguugucccagcuacucgggaggcugaggcaggagaauggcgugaacccgggagguggagcuugcagugagcugagaucaugccacugcacuccaggcugggcgacagagcaagacuccaucucaaaaaaauaaaaauuaaaaauaaauaaaaaauaaaaagaauaaaacaaagaaguuaccaacauauauuaacagaaggcugaugggccaggcacggcggcucacgccuguaaucccagcacuuugggaggccgaggcgggcagaucacgaggucaggagaucgagaccauccuggccaacauggugaaaccccgucucuacuaaaaauacaaaaauuagcugggugugguggcaggcaccuguaaucccagcuacucaggagggugaggcaggagaauugcuugaacucgggagguggaggcugcagugagccaagaucacgccacugcacuccagccuugugacagagugagacuccaucucaaaaaaaaaaaaaaaaaaaagaagauugaugagucagagcucacccaugaagacaccaaauaagagaaguggaucuagaaaagaauauuggcugggugcaguggcucacgccuauaaucccagcacuuugggaggccagggcggguggaucuccugaggucaggaguucaagaccagccuaggcaacauggugaaaccccaucucuacuaaaaauacaaaaauuagccaggcgugguggugcaugccuguuaucccagcuacuggagaggcuaaggcagaagaaucagcugaauccggaagacagagguugcaacagucagccgagaucgcaccauugcacuccagccugggugacagagcaagacucaccucaaaaaaaaaaagaaucuugaagaacauuaauauuugagcuguaaguagaagaaaggagccuccaaagcaaacagaaaagaaguaaucuuagcaucuuaggaagagaauaagaugugcugucaaggaagcuaaggaaggagagaauuuuaaaaacaaaggaguugaggaacugacuuuccauuacuaaggaaagucaaggaagacaaauguccauuccauguggcaauguuaaguguacaaaaaagaguuaacacagcaggugugaaacugcuauccucagaaaggccuguuuucaagguuggcccuucacuggugucuagaaacuugguuuuuggaaggauuccuaccacccuaaccaaaagugucucacuacacaaacugugcaaacaaagugguuuaugcugaacaucugcucuuauuuugggagucuagaauuuugguacaugcugggcagagggugccuaugugaccaacccccaaugaaaaccuuaggcacugauccacuggugagcagcuugugccuagcuuucucaagacuucaauuccugcaccuucucccuuugcugauugugcuuuguauucuuuuguuauaaugaaacauagccaugaguacaaccaaaugcugaguucugugaguccuccuagggaaucgucaaaucugaggauggucuuaggaaccucugacauaguugagggaaggagcuaggguagaacauaaaguugccagaaaguuauguuuauguguaauuuauuuaagauagaugaggcuggaaucaguggcuugccuguaaucccagcacuuugaaaggccaaggcaggaggaucacuugaggccaggaguuugagaccagcccaggcaacauagugagacucucgugucuacaaaaacuuuuuaaaaauuagcugggcaugguggcacacagcuauaguccuagcuacugaggaggcuacggagggaggauugccugagcccagaguucgagacuguagugagcuaugaccgcaccacuacacuccagcuggggugacagagugagacccuaucucaaaaauaaauaauaaaaauaagaaaaaagaaucugaggcaaguuuaugugucaaagcaugaaaucaauggauaaaaauuaaaguuauaggaaagaaaaaagaauuuagaguaagaccuucacgaauuuuguuuuaccacaauaaucccccauaugauguuuuuacaauaauauucuuaagagaucaucauaagcaauacuccacauaaaugguaacacuguugagauuacauaaauaaauccuuuaaauaugauaaaagacaaaaauucuuccaauuuacacuuacucaaaacaaaacagacuuuaauagucuagucuccuaauaacaauaaaaauaguaucuauuuaaagaaucaugcaaaauccauaguauuuuuuuuaaaguaccagcagaaucauauccucuguacuccagucucugaaggccuuugauuagggucuccaggauuucucgucucguucgaggaacaugguaguuuaaguaagcaaauauaccugcaaauaaacaaauauuuaaugaaaaauucugauuuaaaaaaucaaaauuagcauaauuaugucaaguaugugaaaaaacgugaaguuagauucugucuuucaaacauuucaaaccguuuaaaggcaauggaacuuuuucaagggggaguuucucauaaguauaaaaaacuaaacaugucaaaauacacauuuauaauuuuuucuuuuuuuuuuuugagacagagucucacucugucacgcaggauggaguccagcagcacgaucucggcucacggcaagcuccgccucccggguucacaccauucuccugccucagccucccgaguagcugggacuacaggugccugccaccacgcccagcuaauuuuuuguauauuuaguagaaacgggguuuuacuauguuagccaggauggucucaaucuccugaccucgugaucugcccgccucggccucccaaagugcuaggauuacaggugugagccacugcaccuggcaaagaagcuuauaaagcuggcuacuuauuuuccaugacugccauuuuugucaagugaaauuuaauuuuuuuaaaaaccaauuaacaaauucaugguuuauguccuauauacagagcauuucguuucaagaaaaaaauuucuaaaguaauuuaagcaacauauauaggcccuaaaaucuguaccaaugagauuaauuuugcuuauuuccaauaaccaugcuaucagugacauuuaggaauaaaugauaugaaaaauacucaccccuuaaauaauuacguaaaauaguaaaaacugaccaaauauauaacuaucuuaaaagauaauugcuugaauuacuuguucaucacauuagcaaaugacaaccacauaacaacccuugaaaauucacagaaaaagagcaaucauuuggaaaaacaaaacuagaaaucaaagcaguaauacaaugugaacugaacgggauaagcaaagaaguaacaaaacacagguaaaggaaauccacacuuuuaggaauggcagcaugggcauuaucugagguuuuccauggcugugcuuuggccagaguggacacagcuuuaauguaucaaaacugaagacuaaauuauauaaaauauacaaaaauacaaguucaagcugcuuauuuuaaaacuuccuuuuuucuuaacuacauuucacuguaauucugauucauaagaaguuuaaauuaauucugugagauagaacucccaaaaaacuagucuucauuuccaucugaaaagagacauuuacuucuauagagugugauccuacugaaauauuucaguauacaaaaauggcacauuguugauacccaacaggaaagccauaacauacaugcugaucaccaugaucaauacauugcaauuuucucaaauaaauuauuaugcccuaaaaaagagaaacucacacauuaaaauccaaaauaaccugaaacaacgguuucaacucuccccaaagaagcaguuccaggccaaagacuuacagaaaucccauauuucauucagauuaaaaaaagauacacacacaccuuacauuuuuauuuuuuuaagcuuuccuguaauguacagucaucuuacuuucacagcaccaccacccuguaagggaggguagaacaucuaucuuacauaauucaaaaauagaaauugaguuaacugauaucccagagauacccacaaauagcauucccaaccucaaagcacagcaauuaagauaaggauaaacaacaugcugcuuaaggauauugcuaagguaagagugguagcggcacagcaaugugcagcuuccaacuuucaauggcuacucaugauauaaacacuagagggcagcagaagagucuccagaccaaucugcacccauuuaauucagaagaaugaguccgggguuuuuguugcuacugcuguuccuucaugaaguaucuguaauaugaauaaacgaauaacccaauuguaaaucaaacuuugcacucuucaccuaugggucacugaucuuugagaaagauuaaacacguacagauaacuaucaauuaaguauuuuaaccaggucauuaaaagacaauacacagcacacaaaucuuuucuaaaacaauacuuuaauacaaaugugggccaggugcaguggcucacgccuguaaucccaacuuugggaagcuaaggcaggcgcaucaccugaagccaggaaaucaagaccagccuggccaacauggcgaaacccauaguuacuacuaaaaauacaaaaauuggccgggcaugguggcgugcaccuguacuccagcuacuugguaggcugagacggggagaaucacuugaacccuugaacccaggaggcggagguugcagugagccgagaucgcacugcugcacuccagccugggagacagagcgagacuccaucucaaaagaaaaaaaaaaaagugugaaaaaaacugaaucugaacuaguucccaccacugugacugcaucagcuagaguccacuaaaggaggauacaaucuagcuuauuugaaaacagaagccugucgaggauuguuugcagauuguccagagcugccaaauucuaagcacauccagaaaaacucacuccuaaacucucucuuuuuuaagaaaucuaagucugauaguaaaaguaaaaauguaagccagaugauaaaaaugaaaguugguaaaaacauaaaaauguaagccggaugguaaaugauuuaaagauuaaagauguauaugaauguguuaaaacuauuuaaaugcuaaugauauaaaauuguuuuuaagacaauuuauagacucuacuuuuuuuuaaagauuaaugcggcagggcuggguggcucacgccuguaaucccagcaacuuggaggccaaggcgaguggaucacaugagguaaggaguucaagaccagccugggcaacacgcugaaacuccgucuccacaaaaauaccaaaauuagccaggcaugauggcaggugccugcaaucgcagcuacucaggcggcugaagcaggagaauugcuugaaccugggaggcagagguugcagugagcugagaucgugccacugcacucuagccugggcaacagagcaagacuccgucucaaaaaaaaaaaaaaaaaaaagauuaaguaaugcaauauuaaauucacuguuuuuaauaauguaacucaacaacagcauucaacuuuaauaauacuucuaacuccaaucuccuugguuuauaauggcucacuauaugaaucuugagagcuuaagaacauuuuggcugggcacaguggcucacaccuguaaucccgacacuuugggaggccgaggcgggcggaucacgaggucaggaguucaagaccagccuaaccaacauggugaaaccccgucucuacuaaaaauaaaaauaaaaaaaaaaaaauagccagcugugguggcacgugccuguagucucagcuacucgggaggcugaggcacgagaauagcuugaaccugggaggcagagguugcagugaaccuagacugcaccacugcacuccagccugggcaacagagcaagacuccgucucaaaaaaacaaacaaagaaacaaacaaaaaaguaacagagcuagaagaaggaaggggauuagccucagacauaccugaugaggaaaaugggagcuaagaaguugaaccugucaguuucauagcccugucccuugauagcacuacuagcccaagacauuccaccugcggggauaccggguuaacuguaaucuuggggugcccgagacaauacuggcagcaauucaucagguacacagggcauguucacaagggaggcauucacaacucacaaugaugcuuguuagagcagaaaucguuagucugaccucuauuuucaggucuuugacuugucuuaucaaaacucccaauaaacaguuuuuuguuuuuuguuuuuuugaaacagagucucgcuuugucgccaaggcuggcgccaucucagcucacugcaaccuccaccucccagguuccagcaauucuccugccucagccucccaaguagcuggaauuacaguggccgccgccaugcccggcuaauuuuuuguauuuuuaguagagaugggguuucgccauguuggcuaggcuggucucgaacuccugaccucaggugauccacucgccucagccucccaaagugcuaggauuacaggcauaagccacugcacccggccuaaacucccaauaaacaguucuuaaguaagguaaugacaaaagccuaauaucaacuuuccgccacucuucaguaauugcucuaagagcacacacaguagcuguauaagcauagauucucuacccccaaaucagcaugcacuucacaaguguaagcuuucuuacuaauggaauauacuuggaauaaaauaacuccauaacugaagcagaugcuugaaccuacaggcaucauucucaauaaauggcaacuuaaauucaaugacaaaaaagcaauuaugagcaccuugcuaacaaaauuucagaagcaaucuggaucacagacuagacacaccugguugaaagcaauguagcugcaaauacagacuguuaaaccuuacugaaaagaaaacugacucgucaaauuauuaaaauuccuaugucugguugcauuuauguccuuaugaauacuaaauuuuauuuuuauauauuuuaucauuugacagcugcaauauuuugggacccuaaacauuguaacuuaucagugauaaguguucaaauucauucucuaaacuuaaaacuucugaaucaaaaucuaccuacaaugucacuuaaacucuaaauuuuauuuuucuuauaaugcuagucacaaauuaauucaucaccaucauuaaaaauucaaaguaggccaggagcaguggcucacaucuguaaucccagcacugugggaagagaggcagagguuacuugagcucaggaguucgaaaccagccagggcaacauaccaagacccugucucuauuaaaauuugaaauaaauaaauaaauauuaaaacuauacagaugcuacagaauugugaaaaucucuccuuucugucuccacacagguuccaaccccuuucucagagauaacuacuguuauucccauacacacacucccaguccuucagcuauaaauuuuucuacaggccaggcacaguagcagauaccuguaaucccagcacuuucguaggccaaggcgggaggaucaugggcaggaguuugagaucagccugggcaauacagggagacccugccucuaccaaaaauaaaaaauuaggcaugguggugcaugccuguagucccagauacuuggaaggcugaggugagagaaucacuugagcccagggguucaagguugcagugaacuagucaauauuauaauuauggaaucacauucuacauuuaagauuucuuuaaaauuaaguauuauuugagauacauuuucuuuuuucuuuucaccaggggucugcucugucgcccaggcuggaguacaguggcacaaucccagcucauuaaaaccaccaccuccuggacucaagugauccccucaucucagccucccaaguagcugggaccacaggcacaugcuaaugugccuguaauuuauuuauuuauuuacuuauuuauuuuuaauuuuugagauggaguuuugcucuugucgccaaggcuggaguauagugaugcgaucuuggcucacugcaaccugucucccagguucaagcaauucuccugccucagccucuggaguagcugggauuacagacguaagcuaccacgcccaguuauuuuuuuauuucuuguagaaaugaggucuuacuacauugcccaggcuggucucgaacuccuggacucaagcgauccucuuguuucggccucccaaagugcugggauuacaggcaugagccaaugcauccagccaagguacaucuucuacaauccuaaaagcacauauaaaggccagaugccguggcucacgccuguaaucccagcaauuugggaggcugaggaggguggaucacuugaggucaggaguucgagaucagccuggccaacauggugaaaccccgucuccauuaaaaauacaaaauuccuagccaggcauggugacgcgugccugucccagcuacucaggaggcugaggcagaagaaucacuugagcccaggagguggggcagagggugaagugggccgagauugcgccacugcacuccaggcugggcgacacagugagacucugucucaaaaaaauaaaaaauguaaaaguaaaauaaaauaaaucacacauacaaaaauaacauauggagugaaacaauuaagacuuucaauuauuuguguguuuaauugguucaugucuccccuacuuuacuguaacuauugccacuagaaggggcuccaugacacgucucuugcacauuuaacauucuggagcucaaaucacuaguuaagucaugacaucucuauacauucccucacagucaaccuaugucaucaucuuucuugagaaaaaaaagcauguacuuccugcucacaaucuucaaauauuccaucucucucucuucugaccauucacaucagacuacaauuuuucaucauacugccaagucaaacccucuggguccacugugcucugacuccuagucucugagcaucucuacacugaacuaugacagccaaggagaacucaucuauccuauccauuucgguccacuuucggaugggcccuccgaacugcugaccaauccuauuaauucaucacuugcuuaacuuucaaacuucucccagauauuauuuuagagucuaagcuacauacuacucucaaauccucauuuucucuucccagcuucuuuuucauuuuugguagauucuuacuuuauagaauuaaagucuuuuuuuuuuuuagacagagucucguucugucacccaggcuggagggcaguggcgcuaucucagcucacugcaaccuccaccuccugaguucaagcgauucucccgccucagccucuugagcagcagcugggauuacaggcguguguuaccacgccuggcuaauuuuuguauuuuuagcagugacaggguuucaccacgcuggccaggcuggucucgaacuccugaccucaggugaucugcccgccucggccucccaaagugcugggauuauaggcgugagccacugcgccuggccagaauuaaagucuucauuuucuuuuuuuguuuuuaaaauauagagacaaggucucaauaugcuguccgggcugguaucaaacuccaagccucaagugauccucccaccucagccucccaaaaugcugaguucacaagcaugagucacugccccucacccaucuucuuuucaacaguuuaacaauauauaaauacuucucauccuuccuuguaaucucaagagagacauauuacacauacuacucucugaagcuagccucuccccuacuuguaacuuuuuuuuuuuuuuuuaacaguccugcucugucacccaguacccaggcuggagugcagcagcacaaucauagcucacugcagccucaaacuccuggacucaauccucccaccucagucuucuaaguagacuggacuacagguaugcaccaccaugccuggcuaauuuuuuuuuuuuuaauagagaugggaucucacuauguugcccgggcugaucuugaacuccuagcgucaagcaauccuccugccucagcuuccugaguggcugggauuacagguguaagccaaaacacuggcuacuuauaacucuuuuuuuuuuuuuuaauugagacagagugucacucagucacccaggcugggguacaguggcguguucucagcucacugcaaccuucaccucccagguccaagcacuucuccucccuuagccucccaaguagcugggauuacaggugcguaccacaacagcuggcuaauuuuuguauuuuuaguagagauggggcuucgcuauguuggccaggcuggucucaaacuccugaccucaagugauucgcccaccucagccucccaaaaugcugguauuaccagagggaaccccacacugggccuuacuccuaacucuugaugaguguuucuccaacuuuguaaauacagaacucuuuuguuaacaucaaaauauucugaggcuccuucacaacaauggguuaaauuuuuauuauucaaugaucuagaacaaucuuuauucaacuuacagacaaaguuauaagcauaugaauaagcaaugaacacccuguaacaacuucagggcuuguaggucaggaaccacagcucuagaauucaacuucucaacacucccaggggaccucaaucccaaaauccucuucuuuuucauauuacuugcagcccuccuccuaaacacaaacugagacccuucugccuugacauaugcaauuucucuaauaauuucuucauaaccauauccaauuaacuucucugcaguauuacauaugaaugaccuuuuucuacuuuuauagacucuguucaaggcaauauacuacuuuggaacucuucugccuuuaaccacuguuccuuggucuguuuuccuggcacuucuauuuccuccuucaucugguaguaguucucaaacuauuuccgccuccauucacugacgguuaacauaugccauuaaugauuaccucucacaguauacuaauacucuacaaguugaguaaaaguccugccccaucacccagaacauuccugaaccuaacacagaaacccaaaccccagagcucuccagucucuaaauuucuacucauucuacuuguggucuaugacauggcaaugaacaaggacuguguauuuucaccugaagcuguugcaugugcauucauuuucuuuccucugaucaggcagcaauuucuugaaggcaacucucuuauuuuagucaucucugcaaagggcagagugccaaguauaaagccaucauuucaaauaccugcaaguaucuucuaacacuuucuaggcaccugaaauauacggucaaaaaauucucaaaccacagaaacagaacacuauuucaccggaugcuaaaaaggaaugaaguaaagaaagguuucauaauuaaagguuuaagaacuaccugguuaaaguuagguauauauuuagaacuuucuggaaccuuuaaucuugcuaauugugaaucuccaagagcagaauuucccaaacuuguguuacaaaacccuuucccgccuucuacugcucauuaccagaaccuauuaaccuccauuuccaggggacaauugaagaaaugcuuauuaagcaauuauuuucucucacaacuucuucauauccaguauauguaaggauauguuaauaguacugguuuuaugaccaauccuagcagccaaucucagcaucccucaauuaucuccaaagccauuagacaguauaauuacaaaaaacuuuugaaaaauucauuuuaggauacuuuaaaauugcaaguuccuuuacugcuuuuaaaaaggaucucauuugcaaacauuccauuuauuuauuuauuuauuuacuuauuuauuuauuuauuuugagacagucucucacucuugucgcccaggcuggaguagaauggcacuaucucagcucacugcaaccuccaccuccuggguucaagagauucuccugccucgggcuuccgaguaacuaggauuacaggcaugcgccacuacgcccggcuaauuuuuuuggauuuuuaguagagacaggguuucaccauguuggucaggcuggucucaaacuccugaccucaggugauccacccaccucagccucccaaagugcugggauugcaggcgugagccaccgcgcccauccccaaaauuccauuuuauauacaccgucgaaucagaaggguauaacuucacauuuauaaaaacaauagcaaaaucuguuaaaagcuagggauagcuuaagugacuugacacucagcaaaaccaaaaauaaugcaaauaaaaaggacaaaguauauuccaaacuaccaagaaaaaggaagauaaaauaaauuuggaaaauagacacacuauucuucucugggagauucucaaugcuuauuauuaauacauuaaagauuccaagaaauccuccaaucaaaaaacaaaacaaaacauuaccacgcgauuuaauauguugcuucccaaauuuacuggaccagaggaucuuuuuuccuaacacuuauuaacaucccaauacaagcugguaaacauaucaauuuuaucaguauaucugauugaaaaaaagcacaucagaaucuucaauccucauucuucugcuucaacaaugcacaacguugaaauaaaauaaucuuuuaggcaaauuuaacuagggccggguaagguggcucacuccuguaaucccagcacuuugggaggcugugguagguggauuaccugaggucagcagaccagucuggucaacauggugaaaccccaccucuaccaaaaaugcaaaaauuagccagguguggugguacaccccuguaaucccagcuacucgggagguugaaccccggagacagaggcugcagugagccaagaucaugccgcugcacuccagccugggcgacagagagaggccccgucacaaaaaaaaaaaaaaaaaaagaaaaaagaaagaaagaaaagaaagaagagaaagaaagaaagagagagaaagaagaaagaaagaaaaagaaagaaagaaagaaaagaaaagaaagaaggaaagaaagagaaaaacuuaacuagauagcaaguaaucagaaaguaagcuuccagauuuucccaucuagucuaauuuucacuccauuucucugcucaggaauuuuaguucaaugacuaagaugugggaggaaaauaaugacacucaucuucuuaucuuucagaauuuacauuagagagaaaauaaauucugaacccuaucccuagaaucaggcaaaaccgugguaugacuuaaaagcaggaccucagaaaugccucaaauauucacuuuuuauuucuucaauaccuguuuccucagccguaaaacucuauggaauggagacacaaacuaugugaaaacucccaacauuuagucuccacccuaaagguaucucccuuaucugaaccugauuuccauaucugauuuauuuauuuauauuuauuuaucauuuuugagauggaguuuugcucuuuuuuacccaggcuggauuacaauggcgcgaucccggcucacugcaaccuccaccuccuggguucaagcaauucuccugccucagccucccgaguagcugggauuacaggcgcguaccaccacgcccagcuaauuuuguauuuuuaguagacauggaguuucaccacguuggccaggcuagucuugaacuccugagcucaggugauccaccugccucggccucccaaagugcugagauuauaggcgggagccaccacgcccagcgcugauuuauuuauuuauuuauuuuuuuuucaguaaguacuuugacuacguuuuuuucuuggaacaugaugaaaugaccugcaaccagaauguugaguacuugaugaggcacaccccucaucauucaggaacaguuaacuaccaaaugaagcacacuggagauugaccaguuugcaaauucacuacuucacagcuccaaacuaaaugcaaaaccauucuacuaaguagacacugcaaaagucugauucugaagucagcucuacucuaauaauuucaguaagcuauuuauagguguuucuguuuuuauguggguuuuuuuuuaaucuacucuaaauuuaaaccugcuccucauuuucagaagcugaaaugagcauaaaguuaaauacaggaaauauauacacuaacgaguacaauccaccuccuguucaguuccuucguguaaaaggcugcaaauaagaagucucccagagaguuuucaauucucuuacaaugguacuucccuuuaaaaaaaaaaaaaaaaaguguacuuucuuccagggauaaagucgguuguaaauuucaauaagaaagguaagaauacaauuauuuuuacuggcaauagccaaauuaacaccaauuuuagaagauaucagucaugucagacacgauucucaaagucucuuucacuaacacuuaggucauaauaaacgacucucaaaacauggaauaaaagggccuaaccuuaauuuuuuaaggcucuaggaaagauauuugcucaacuuuccauagcuaguauuuuuaauggaugcacaugcaagggauaaaugauauuuuucauaguugguauucuaaagggguauacauccaagguauaacugauauuuuucagagcuggcauuuuuaaugggugcacacgcaaaugauaaauuauguauaaccuaucgccacagacauuugaaggccucuuccaccagaggaucaggucuaagcccaugaaccaaguuauugauuagcaaugguuucuguugagacaagggauggcaggaaguaucacguuuaauggcacuaccguggcucuagcuagggucuguuuucuauugggccuccccagaaacaaguaaaauauuuuuuuaaagauuuuuagaaaaaugcaagguaaguucaagagaccucgcccgagguuccacagguuuccucacucaccuggugggcccuuuugaaggcaacccccuccacaccucaauucccucagcucucuccuccuuuuucaauaaaggcguuucucuccccuuucgguuccuucuccgcgccaaggcgcccgcuagcccccggcaaagggggcccgccuuccucucaggugccuuucucccggccgccacccccucucccgcccguggaugccggcccccgcccccgcagccaccacugggcgccccuugcccaucacccagacuucgcacccuccacacucccgcuuccgcccgucgccuugggccuuagcggcacccgcaccgcaccccagcgccacccggcaacacgccccccgcucccggcccccuuaccacacaugaugccggagacacggcccgcgaggccaggggcgaguggcuggcgggaucgggggugcacacacgagcuucggugggcaaucugcgggcucgggggccgggguggcgccgacacgacucccucggggaugcgacggccaaggcaacgacagccuucuccgccucccgggcuccgccagcaacc

SEQ ID NO: 191651 - RNA, 34582 nt, Homo sapiens
uggcuuguuauagaaaucuguuuaaugguuuaggaauguguacacucuggcucugccaaguuuccauaaaggcaacuuuuccauguuuuaaaaaauagauuugguauaaagauuuauauauucauaaauagguggcaugaaaaauuaccaaaugcaaauggaauacuugcgcugacugaagcccuguucaccccaaguccaggcccugcagggguccgagggucucugcuggaggaggccccaacuccggcagccucuuagggaagagaaacugaauuaaauguguauuaggaaccccuccagcuccuuaagccagcgucgcacuggccccaccgaggccucagcccaccucccucugcuuccccccgccaccuccaccauugcccccuccccugcacucuggccccugaccccaccuguucccacucuuuggcaauuuaucaacaaaggaagagaugacacuguucuccuuccgccccagagcccgggcugccgggagagcuuagccugccaaggggaggaaacaagccggcuuuguuuugucucacacacuuccccgucuucucucccagcccaguuuuaagggccggaagggcaguggggcccccuccuggugggauacagcagggcaggagccccugcaaccccagguacaggucuugagucccuggacaccggcuuuugugccugagagggggugggaacgcuucucuguaggaaauggcuucaguccaggauccagggguaggggaaccucgaccaugggguggguugcuccugccaggggguacuaggggcaaggccccaggguggagccaguucugggagcuguguccagcuaggcaucugugaccccaaauggcaugaauaaaagggcagguugcuaagagccaggggagggcauggggcagggagaccagguuggcccagacaggacagaggugcuccagggacagggugcuggagugaagccagguggagcgguggagcuguggagccuuugaaacauccugagggcccaggccugccacagggugaccugggcagaggagaagcccagaggacagcaaggugcccaaaugaggucagggcuucugggguggagggacggggggcacaguggcggcgggggaaggaacguugagucccaggugagccugccuuuccaggccaagcccuuggagugagggugcuccugccuggggggcgagaaguggaaguggcucacaguccaaggugacaaaugaacccaucaccggucagcuaccaucccugugaaggagccaggguggaaggcccuguccauguccucccucccucccuaagcccugaggaagguaacagccccaccugugaggccccagccuggaagcagaguaggagagccgggcuucuuagaggugggcagugggugguggugggcaguacugguaaguaugcuuggguggcugggacuugcccuggaacuggggcugaaauucaaacggggaggcccaggccuuuguucccaagacccugugaaugcucccuguucccccaaaaacagaggggcucugcaaggacaggcuucaugggauuucucuuucagagugggccugcagugaaagaccagcucagccccuucugaccaugugaccccagaaacuucagccccagcagaaagguugugaggcuggaggaaggcacugcccacggcacauccagucccagcggggucugggggcaccccucagugccaggcacugucugcccugcaaggggagcccaggcacugcaguggaggcgcaggggcagagcccagaccccacucagcuccacucucaccccugccacaagcaaagcugcugagaaagggagccaggcagccucgccucuggcgccccccaaucugaugcacccagacuccccucaaugcaggugcuagccccucagcuccuggcagccuuccuccccugcagaaccaggcucagccauuccacagguagccucccugcccaaaaggaagccuggcaggugagaugcuggcuccaccaccagcaucaagcccugcuugucucagucucagcagaggaaacccuguccaggccccaacccugccucuugggucaccguggcacugcuguaaggccugcucuugcccuauggccaggccugccuggaaagugcuuagugcagagggcagggaggcaugggggaggccucucacuggcccagggacugcacugagccaugccuggccugccccugggagcuagaccacaaaccgacgcagcccugcucguggguccaagagcugcuuacuucugggggcacccaugcugagggggcugcgaggcagagcugggcugacacagacggacugggauuggcuaaggaagaucaccuggccccuccagcccuagcccuggcucuuuugucacugugauaccucugagccacaugcccagaggacaaugcugcuucccacaucccccuaccccacuuuugccuucuaaccuuggugcccagcucagggugaggcaguuaaggguccagggaauaaaaugggccaggccaaggaccgccagggccucuccuuuuuugucugggagacucgauuccauagacugggacccacgcucggcuggcaggauuccugcuugugggguaaggcugggugccuugcggugcccucucaucccugagccucaaggaugcaagcuucuacuuggaccuuaaauguccacuuucucaucucauucccccaccugccagacuucugagugcuggcacugaaggauuagcuaauuuugcaaccugaguggcaaaacacugggcccugagccagcagacaguccccaccuagcugugggccgugaccccaccuagcugugggccgugaccccaugcugugcugaugaaaaugagaagcuacacagaaagucagaaaacucagagguccugauaaggcagugagccagaccccagggagaugucugugagugcugcgggggcagugaaggcaggaagcagguuccccgccuggaaggggcuggggcuucccuggagcugcgcucaggcaccaagucugugggucucauggcucuagcucugcugcucugugcagagccccaggaugaccgggaagaacccagggcacuggacacaucccuggaaagcagcaaccugcugccacagguaaagcaaacccaugagaggaaacggucagagccagcaggcaugggacagggaggacugcuggccccuccuacuguggcccacaccggcggguucaggccagucuuggaaugugaagaugguggagggccagcugcuggcuggcaggguggcccgccaggguauccugcuuccccuuccucaaggagagccuccaucccgcagccaggccacaggaugcagagcuccagagcuucacccggcugcuguaguugccgguacccaggagggcuggcucuggagggcugggcuuggcaggcuggggagagcaaggagguggggaacccccagucugccggcccggccccuggucagcacccgcagccccagccuucuccgauguccuugcuguucagcuggauguggucggggcucuucucgcugaacaaggggcccccgugccgcaugaugagcuccguggccacccucaggaaggccuccuccacguugcucgaguccuuggcagacgucucaauggcacacaggaugucauagugcucagccaggcucugugccucagccaaggagaccucccgaagcucgcugaggucugacuuguucccugcggaggaaagccggggcagcaugaggccaugggggcugggcaagcccagucccaccugggagggucacgcugacagccccaugccacucccuuccaccacuauaaauggacaccccuggcauggucaucugucuuucuuuaaaaaaccuuuuuuaggccgggugcaguggcucacgccuguaaucccaacacuuugggaagcuaaggcaggaagacugcuugagcccaggaauucaagaccagccugggcaacacagugagaccccgucucaauuuacccagauccuccuagaugguaugagaugacuucauuacauuccaaacaaucuguuaaauugcuccuugacccaauuucuagaauaauuuuuuaaaagucucuacaugguugacuuuuguaaugugguuauaaggaagacaaaaaaaaaaagagucugggccaagcgcaguggcucaugcuuguaaucccagcauuugggaaggccgagguggguggaucaccugagguuggaaguucaagaccagccuggccaacaugaugaaaccccgucucuacuuaaaaaaaauacaaaaaauuagcuaggcgugguggcgggggccuguaaucccagcuacucgggugccugaggcaggaguggcaagcggagguugcagugagccgagauugugccacuguacuccagccugggcaacaagagcgaaacuccgucauaaaaaaaaaaaaaaaaaaaaagucuguaaagaucuaaaauuuccuugguaaccuuaauugauguagcaaccaguuucaaagugugaaacuuauuuggauccugaucucaacaaacuggaaaaaauaaaacacauaugaauuuuaugggcaauuauaaaucugaauacagacuggcuauuuuauauuauuaaggaaaugucaguauuuuuagaugagaaaauaauauugcuguuuuuaaguguuuaaauauuuuguagguucaugcuggaauacugccaggugaaaugguuugaugugaauuugucucaauaauccgagggaggggaggugacaugguacagaugagaggagguuggacuucaguugcuaauugcugaagcaggguaauggguaccugggggcucauuauuauacuauucuaagccagauauaguggcucacaccuguaauuccaacuacuuggagguugaggcaggaggauugcuugaggccaggaguucaagaucagccugggcaacauagcaggacugcaucucuaaaaauauauguauguauauaaguaugcauaaauaaauagauaaaauacuauuuucauagcuguauaaaauguucuauaggccgggcgcgguggcucacgccuguaaucccagcacuuugggaggcugaggcggguggaucacgaggucaggaaaucgagaccauccuggcuaacauggugaaaccccgucucuacuaaaaauacaaaaaauuagccaggcaugguggcgggcgccuguggucccagcuacucgggaggcugaggcaggagaauggugugaacccaggaggcagagcuugccaugagccgagaucgcgccacugcacuccagucugggcgacagggugagacucugucucaaaaaaaaaaaaaaguucuauaauagaauguuuuuuaauuaauuauuuuuuggaagacagagucuuacucugucgcauaggcuggaggacaguggcacgaucucggcucacuacaaucuccgccucccagguucaagcgauucuccuaccuuggccuccgcaguagcugggauuacaggugugugccaccaugccuggcuaauuuuuguauuuuuaguagagaugggguuucaccauguugcccaggcuggucuugaacuccugaacucaggcaauccacccaccucagccucucaguguuaggauuacaggugugagccaccaugccaggcuggaauguuuuucagaaauguccuggauaaaugggaauugguggcugggugugguggcucacaccuguaaucccagcacuuuuagaggucgagacggguggaucacgaggucaggagaucgagaccauccuggccaacauggugaaacccagucucuacuaaaaauacaaaaguuagccaggugugguggugcgugccuguagucccagcuacucaggaggcugaggcaggagaauugcuugaacccgggaggcggagguugcaguaagccaagaucgugccacugcacuccagccuggcgacagagcgagacuccgucccccacccccagcaagaaaagguggggaaaugguuaggcuacgugaggaaagcucuguucaugccaagcacuccauguccuagucugaacaggcuguggaaggcaggccacauggaaccaggcaccacccucuuccuggcuggagucagguccaggcccugucuguacauuugagucagaagaaucaaccuguuggcccagcuacucgggaggcugaagcaggagaaucgcuugaaccagggagacagagguugcagugguuuugcagaucuugcagaaccaagaucacgccacggcacuccagccugggugacugaguaagacucugucucaaaaaaaagaaucaaccuguuggggugaggaccccagggauaacauaagagcuaaagagcuucuccaguccaggucugggaagguuauauagaaggaaaacaaagguaaacagcauccuuccacagcagcaguucucaaagugggauccuuggaccagcaaggugggugucacuugggaauuuguuagaaacgcacauucaugggccccacccagcccgccuggaucagaugcucuggagguugaggcccugcagcugcacuugaagaagacuucugugggauucugaggcacggaagccaucaagugucccugcucugugugcggcacaacagagaaagccacagacuugaggucagcagaagcaaacucaaagccuacauguguaugcucacaggccauguggacccggauaaaucacugcacuuuucugagccuagccccagccccugucaaaugaggagaagccgggguacaagagcuaaaucuugacacaugugaagaacagcagagcaaacuucagcucucuuucuucuuuccucuaauuccaauuuugaauauaacuuucuuuuuuuuuuuuuuuuuuuuuuuuuuuugagacgaaucuugcucugucacccagguuggagugcaguggcgugaucucagcucacugcaagcuccgccucccagguucaugccauucuccugccucagccuccccagcagcugggacuacaggcgccugccaccacaaccggcuaauuuuuuuuuauuuuuuuaguagagacgagguuucacuguguuagccaggaugaucucgaucuccugaccuugugauccgcccgccucagccucccaaagugcugggacuacaggcgugagccaccgugcccggccuugaauguaacuuucuaagugauuagcaggaucaggauuugcaaaaccauggcucaaacucuggcugggacucccucugaacucaggguuacacuguguuuaaaaagcagagggaggcauggacaggcagagugaugggauuuguggucccgaggaauccccaacucaccgaucagcagcugcacaauguuggagcccgcauacuuccucacauccucaauccagugaggcaccgacaggaaggagcuccucuuggugaugucguaggcaaggauggccccauuggcacugcgguaguagcucugggugauggugcggaaccgcuccuggccggccgugucccagaucugcagcuaaagaaauaagguuccucagugaacccaguggcacaggcugaacauggggacaggcagagugaccccacagacccacacccagagcugugguuccacugggcuaggaggccuucugaguccuuagaaagcaacucaauggcucaaccuuguuggaaaaauggggaagcaaagggaaggugagcagccccuguccuggcccucuaggguccccagggaaagauggaggaagggguacacucugagcugacccagguccuccgcgugccccuccgugugccccucuccccucaggacugggcccacugcugcgaaaacagaaccaccagugcucaagcggccggcggcuggaaagcuggcuccaggugcacugcacggccagcaguaggcacggccagguacccuccccuacaagagcaucacguacccagcugugugugaggcuccuccagcauuaggguucccucaggacucuacagcuuggugaugaggacugugggaagggugacuggugguggcaaugggcagaguccucccauggggccuuuaaguacaaggcaguuuccaccagcugacccagcuuggccaaagcaaggagcuuuggccacccaugucuucauuuaacaccuacucugccccaucucccaccagaugugggcuguggagaagaggugcccaugggugggaggagcuucccuagugucuuuuagaagcagagucuggcaggauggauaccaggccagguaggggcagaggucugugcggggccaggaggcugcccacucugggcagagaucaccagccaaggggcauaugccagggaucuuggugaccaaacaccuuggggaucgggugugccuucucugccccaccaaucacagguucucauggcucucugaagacugacacccagcuuguggcgugugccaagcugcagguccaucagcccccuuugcaggcacaaacacucggggugucucuuuaccuaguucucaagguaugugagaaaggucuuucucucaaggucugucugggguggggaaaagccacagaggcccagacaguuccugaaggcagggccucugccccuggcacuguggaggugaccaccauugccccagccccaacacagaagucugagagugaaagcucugggccacaaugugccaaauaagacuccucuuuccugaguugucccauuuacuccucagugaguggcucuaagaaaaccaggccuauguuccauaguucaugcgucuugcagcucaugcauggcagcauggggugaagugcaagguuuauguguguaccacacaagccugggauccagauaaccucugguguggagauaacucgucuccacacauaacacgaaagacaccggccaaacaacagcaaaaacacaacacagaagaaacaacacagaggcaaaguacucaaacaaucgucaauguuucagaaauagggaaagauucauggaacaaggaaagaauaguaucuuuuuuggugaggcgcauucagaaagaaaaaagagcucaauuaaaaauaugauuaacauacaugaaaaaugcaacaucaggguuggaagauaaaguugaagaaaucccuccaaaguagagaaaaaauacaaagaaauggaaaagagagaaaauaaaauugaaagccaggugcgguggcucaagccuguaauuccaguacuuugggaggccaaggcagaaggaucaccugagaucaagaguucgagaccaggcuggccaacauggugaaaccccaucucuacuaaaaauacaaaaauuaaccaggugugguggugcacgccuguaaucccagcuacugggaaggcugaggcaggagaaucgcuugaaccugggaggcagagguuccagugagccgagaucacgccacugcacuccagccuggacgacagagugagugagacugucucaaaaaaaaagaaaagaaaagaaaagaaaauuaagaagcagccuaggagagcaggauaaucagaguuucagaaaaagagaacaauacaaucaaggagaggaaaucaaguauuucaagaaaaguauccagaauugacugaggggcccaccaggcacacacacaauggagcagagcagaccacacugcauccaugggcagaaguuccagaacaacaggcaagaagaaagaacacaaaagacccauguggcauuagacagccaacaaaacaaugccuuaaaaugaggagaaaaauuauuuccaaccuagaauucucuacccaaccaaccaguagucaagugugaggguuuaauaaaggcacucccagacauacaguccucgaaaaauucaccuuccugcuacccuuccucagggagugacugaaaguuccucuaccuaaagaaaucaacaaaaaauaagaaaaugugggauccagaaaacagagaguucaacugaaaagggaggcaaagggagaugccaggaugauggaaagagagauaaaucccaggauaauaccugagcagcagccuagacaucagccaacuuggagccggucagagggcuccuggagcagcuuccagccauggcagcaucgcugguggcagaguagcccucccuccacacacaccacaggacuggagaaaauauaugaggcugucguuuuuggaauguagauaacaagcggccugagaccauaaccccuaaaaaaggaaaaacucaugaaaggcaccucaugaucauugugacacucuaccugggaguuuccugaccauggggcuagaauccaagcagagcacaguggucccacugagcuaaggaggcagagaucagggucuggagcagaugaugugaugaaaugagaagacauaaguagggggagcccaaaagucuaugugaggugucccagugagcucuugaccagagagugccccuuccagaguugagaacagaccagagauagagguucaggagugcuaggggaugcugaaguuccaagccagacacagugaacaggccucauuagugucucauuagcgacccguauaugagcuaucagaacgucacuaugggugaggaccaugccuaaagaauaggccuccauagaccugcccucaccaacauaagccuuggguuuggagguugaguucugccacauuagcgaggcucagaaacaccuuagucuuuccacauauccacccuaacaaaacauaaaaaacaagccuaaacgaauaacuucaaggugaucagccaguaacugaauugacuacuaggacaagaaucaacacucuucuaaagaagguaacagaauccagagucucguuaaguuaucaaccacaauuuccauauacuauugaaaauugcuaaacgugcaaagaaacaggaaaauaugaaccacagauaagggaaaaagcaaucuauugacacugaugccaaaauggcccagauauuguauuuaguagggagacuuuaaagcagcgauuuuaaauauguucagaaaauuacaaggaaaguauguucaaagaguuaaagaaaaacaucgccauaaugaguggacgaauaggggauuuaaggaaauaaaugaaaaauuauuucuuaaaacauaaauguuuuauuaaacuauuuauuauuauuaaaauuacgggcugggugcaguguuucaugcccauaaucccagcacuuugggaggccaaggcagguggaucacuugaggucaggaguugaagaccagccuggccaacaugguaaaaccccaucucuaccaaaaauacaaaaauuagccaggcaucgugguaugcuccuguaaucccaacuacucgggaggcugaggcaugagaaucccuugaaccucagaggcagagguugcagugagcccagaucacgcuacugcacuccagccuggacaacagagcaaaacugucucaaaaaauauauauauguuaaacuuaauuuuuuuuuuuuugagacggagucucacucugucacccaggcuggagugcaguggcgcggucucggcucacugcaaccuccgccucccggguucaugccauucuccugccucagucucccaagcagcugggacuauaggcguccaccaccaugcccagcuaauuuguuguauuuuuaauagagacaggguuucacuguguuagccaggauggucuugaucuccugaccuugugaucugcccaccucagccucccaaagugcugggauuacaggcgugagccaccgcgccuggccuuaauuuuuuuuuugagacggaguuucgcucuguuguccaggcuggagugcaauggcacgaucuucgcucaccgcaaccuccgccuccugaguucaagugauucuccugccucagucuccugaguagcuggaauuaugggcacgugccaucacacccggcuaauuuuguauuuuugguagagacaggguuucuccauguuggucagucuggucucgaacucccgaccucaggugauccacucgccucggccucccaaagugcugggauuacaggcgugagccacugcgcccagccuaaacuuaauuuuuaaauuaguggaaauucuagaacuaaaaauuauaguaaguggaaaauucacuggaugaacuuaauagcagauuauagauggcagaaaaaaaaaaucagugaaccugaagaaaaaucaauaaagaguuaauaugaggaaggggaaaaaagauugaagaaaaugaauaaaaucggaaggauaugugagauaauaccaaacugucucauacucacauaauugcaguuccaggaaaagauagugauaaugggggaagaauacucaaagaacuaaugacugaaaaaucuccaaaucugaugaaacauaccuggcuuaaagauccaagaagcucagcaaaccccaagcagaaaaaauacaaaauacacaaaagcagaucacagucaaaaugacagaaaacaagaauaaaggggaaauaugaaaagcagucugauaaaagacauauuccauacaugggaacaacaauacaaaugacaaccacuucucagaauaauggaagccagaagacaaugcugagaagugcuaaaaagaaaaaaacaagugcggaaagaaaaaacucucaaugcugaaguacuugucaaacaaaauuuucccucauaagacagggugaaaucaagacguuugcagauaaauggaaguagagagaagcuccuuggaaaaaagcugcccugcaagaaaugccagaugguaccacugcacuaaagccugagcaacagacugagacccuauuucaaaagaagagguggaaguggcugcucuagggcaggggguuggcaauauccuaagaccuucugcuaccaauccuuguagaaccaaaugacuccucaaaccacacacaaguuaaguuugcuuaaaauaaaaacuaaaugaaaaaccaacaaaauaacuacugauuaagguauguaggccaaccagcuggugaacugugggcaguaauggagaagauauuuugggaaaguagacccuucccauggcugguaguauucccauccuauucccccaaauuagaggaagggaaggauacaggguagcggugguacgcuggggccaacaagccugagcucaugaccugaugcucugucaccagcuuugugucucuaggcuaaaacuucauucuguuuuucuuuuuuuuugagacgagucucgcucugucgcccaggcuggagugcaguagcgugaucucugcucaccgcaaccucugucucccagguugaagcgauucuccugccucagccucccgaguagcugggauuacaggcgugugccaccacacccagcuaauuuuguauuuuuaguagaaacaggguuucgccauguuggccuggcuggucucgaacuucugaccucaggugauccacccgccauggccucccaaagugcugggauugcaggugugagccacugcgcccggccauucuguuuuucauccguacaaaaaggugcugucagagucaaaugaccaaacccaugugcccaagugcuagcauggagaaggugcugauaaaugcauccguuuaacaauauuuacugagcuauuauaauuuuguggcaaauguuuuuaauauacacaaaggaacuuaaaugcaaaagagaauacauauaguaccaaaagaaaaacauacuaggcuguguacaugagucguucauuuuucauucaacaugcgcugagcuccugccuugucccagccucugcucugguaacuggggauauagcagggaacggagcaaaaccagcuccauccuaguaagaggagacagaaugugccacagauccuuuuagaaggugaucaugagcacgcuacagaaugugaaagccaggcagacagcacaggggguggaugccagccuauuugaugaucugagcaagugucugagcugaggccugagugaugaagagccaaccacauggacgguguucaggcaggggaacaggacaaaggcucagaggcaggagaaugcuuaccguguuagagacauggaaagggcaguguggccagauggccgugaagaaggaaacugggaggagacacguucagagacaugggccagagccagagcauauaggaucuugcaggccaaaguuaagaguguggauuucauuuuucuugcaacguaaagccacuggagauugucucaggcagggaaauaugagccagucuccucuuuucucccacucacauaucuuaucagcgcacccugcacuccagccacugcugcagcaaccagcuuugcacacacacaaaggccugcccacaccgugccccucacucccugccugggagcaucucugagucuggccagggaggccugccggaaagcacugugugcucaugccuccaugacccagaagagagaggccuccgcacccuagggaucaccugugaccaacggggaacagggauaaagcucuucucucccaccucucagagggaccacugugagacacauuccucaugcaccuuguaaaguccucagggucaagaccacugcccauggcagcuaaaugaaagaugcagcucuaucuaagccuugccuccuucuccaggucagucuccaaaacaaaagcuaagcaugugagcccuucucucuggcucuguuuuccacgggaagccugggcuaagacaagaugugcucugguuuguuuuuaaaauaucacagccaggcaugguggcucacaccuguaaucccagcacuuuggaaggccgaggcgggcagaucacgaggucaggagaucgagaccguccuggcuaacauggugaaaccccgucucuacuaaaaauacaaaaaauuagcugggcgugguggcggucgccuguagucccagcuacucaggaggcugaggcaggagaauggugugaacccaggaggcagagcuugcagugagccgagauagugccacugcacuccaggccugggugacagagcgagacuccaucucaaaaaaaaaaaaaucacucaggucacuggguggagcagucuugucaugggaucacagagaggaauuaguguaacaggcagcuugaucacuucacccaugccuacuauauuccaaaagaggaggcggaagccaagccaggagagccccuuccccagaccagaccccuccccaccccaaccaagccagcuggcauuaggcagcacccaagggaggcuggaugagagcugaaugccucugaucugucacuuuaacuacguuacuuuugaaacaggcaggugacaagacacagcaaccagaaaccaucuuaccaucuauuggagaggccaggccuaggcucagugucucagaaggcaaguagacccacccuguggacuccugggggucccggccaucucacucguccuugccacugccugcaggcagagaccaggagccgacauuauagagaaaagagggaggcucugaggggcgcugggacucggccaaggcaucccaacgcagaguccuggacuccaggcuggcugucucucugccuugggagaggcugggaccagcagggacacuugggcuccaaguccccacugcaucugcccuagcugugcccuccuccuacccacuuauccccaccucccuaccgccacuccagccucuuaccagggucuacacaaacggccucaggccugucuccacaccuccaauucacccaguccauuuucugcacacagaacaaugcagcuucugaaacagugcuaggaucuuguaacuccucugccgucaacccuuagguggcaaccccaggaucugccucuagcugccugcuggccauuccuggaguacuccaaggccucugcaccgaggcccuuguccuugguguucccugccugaaaagcucucccagacgcccaugugacuggccuccucauucauucccaucuaugcuuuuuuuuuuuuuuagaugaagucucacucugucacucaggcuggagugcaguggcacgaucucugcucgcugcaaccuccgccucccagcuuaaagcaauucuccugccucagccucccaaguagcugggauuacaggugugugccaccacgcccggcuaauucuuuuauuuuuaguagagacaggguuucaccauguuugucaggcuggucucgaacuccugaccucaggugaucugcccgcuuuggccucccaaagugcugggauuacaggcacgagccaccgcaccuggccaagaggccuuucuuaaaagagcagucccauccugucccaaccccaauuuauuuuucuuuagugcacgucacugccugacaugcacacacacacacaugcacacacacuuuuuaaagguuuacuuucucugccucaugaguuccacaagggcacgggcugcaucaggcuaguuuucugcaaucugcauagcaccuagcacagugccuggcauguagaaggugcccgacagaaacauaaucuggaggagaguacugaggaccauuuugccccgugaaccuuuuacacugucagcugagcgagcuguacauuguuauggcuaagguguuuuucacugcccaggggacauaaacaaccuuaaacugcugaaaacaucugccaaguugagagcggaaaccgcacuuucucuaucccccacccccaagcucuccuccugcacacucaccugaccagccacuaaccugaccagccaacagggacuguaaacugugaaugagcuccaagcccucucaccuagcauaucaccagcuauuugaacuuuucccagcaggcuugucuuauaauugacuuucggggaaaggugaaguccagaagcaucuacuggacccagaggguauggguaaggccuaauuagggaggaaaagggcucccagaguguguaugcucagaaaagcagcacucccccuccucucccacucagcaaggguuggcagguaaguuucauaugggguggggauuucaaggcugcaaggguuucaguccugggcuucaggcccuucuuucaccuuggugacagaagggcucaguccugcccaucgcugccucagucgggaagcacauguugggugagggauaaggcuucuuuccucuucuaaucucuaaacauaacucccagcuuauacuacgcucugagucuccacacucaugacaaggcagugcuguucucgccguuaucuuuucugggauaaacugcauucaucuuaaccuuuuggugcacuccuaccuacccuucaggaccccaguucaaaagucucucauuuucccugacaccaugggccugugguccaacccugagcagaauuaacucuucuuuccuucauguucccauagcucuuuacucuugccccuacaacaacacacaucacagaauggguuauccaucuaagucaaaaugucccgcacuauugggcuuuggggccagacaagugacauaaaaggcaguaaggagacaggacuugugggacccgcuggcuaucagaaaaggauaugcuaucuaaaacaaguucaauaguaacaaaccagccaaccacccuucugccggccaaacaaaacaggcuuuaggccagggugggaggcugaggugggcagauuaccucaggccagcaguucaagaccagccuggccaacgugacgaaaccuugucucuacuaaaaauacaaaaauuagcugggcauggugguacaugucugucagccugguuacucaggaggcugaagcacgagaacugcuugaaccugggagauggagguugcagugagccgagaucgugccacugcacuccagccugggcaacagagugaaacuucaucucaaaaaacaaacaacaacaacaaaacaaaacaaaacaaaaaaaacagggccaggcgcaguggcucaugccuguaaucccagcacuuugggaggccaaggcaggcaaaucaccuaaggucaagauucgagaccagccuggccaacauagugaaacgcuguuucuacuaaaaauacaaaaauuagccgugcauggugguggaugccuauaaucccaucuacucaggaggcugaggcaggagaaucacuugaaccugggagguggagguugcagugagccgagaccaugccauugcacucuagccugggcaacaagagugaaacuccaucucaaaaaaaaaaaaaaaaguuaacauuaaaaaacaaacaaaaagcgggcuuuguaguggaaauugaccucgggcuaccacuuggcuccugguuccuaugucccucucuugccaucaggaauggguucccugaggagaaagacccugucuuauuccucuuggcaccaucaauacuugcacagugccugcacagagaagggccucaacacaucagcaguccacugugggcaggucccaguagucaggcccgugcagcagggcugaaagcugcuuuccagggauuccuaguucacguucccacugagugaguucagaugugccccagugggaaaucaauccugcuuacuagguuaaaagcaccacugaaguucggcucugggaccuguguccagcaucugucccucccaauggaaacagaggaagguuuuacuugacaagacuuucuccugaguaacgaagcaggcaguggaaaguuccuugcuucuucauauuagagagggaccuuggaaaaguuaguucucaggacaaacucugaaaacuggucagacugacccaaauacaaguuccugagcuauuuuucauugugucuugggaugugguaagucaaaccaggagguggaguuugugggccaugcgagcuccugacugccgcugucccuccucccaccaugcugugguccuccagggaaagguuuggcccugggcucacaagcaggccacaggccagggagugaagcacugugaagcaccaugguaagacagcaaaaccucuagcauauuaaccagcuaaggacacagccugccaccaucuggccagacagguggagagagaccaaagcaaggacaagaaagguaagaccaggcuggaccagcgacacaggcuggcggcaggcagagcagacugcaaugcaugcagucuggugucgggggcacaaauucuccucugcaauaggggaguagaggaccaggacagacucucaugcccaaaauuccucccaccucuuaaaaaugagugccugaaggcccagcaugagaaauggcuuucuuugucccuuguuacaaugcagcucuccuugggaggcuugguggcgaugcagagugaagaaaaauccaggaugugcguuccuguuccuguacuccaccagcacgugaugagggauggcccugucagcuucucgcaguucaaguuuccuccccagucacccaggaagcacaguaacccacgacguuuugcaggccuggugaaagcaaggggccagaggccaugaaagccaggaaggcagaguucugugggcaccuggcacugucugucagugcucccugugugucaggccacuucaucccgugacaacccuagaaggugggucucauuacuccuuaugucugaggggucacaggaaugaagcaucagcagaggucugucugacuccgaagccugguguccuuuaccauggacgcggcuccuccgcaagcacauagaaacugcuuccaagaaaucucacugccacuggcaccuccugcaggaaucaaacccguuccugaacagcuuggaugagaaaaaggugcacugugggaaacgacccuggccucuggccaacaaguccugccucaucugcuugccaagugccaccucuuccggguauuccucuuccucgcaggaagcuaagggcauccacgaccagccugcugccacccaaacaccuugcuugcuugcaggcuccuuucagcaccagggaaacauuugggguaaugaggaaaccaaggcagcgugcaggagcucgcggugggcaccgcucagcuggggggcccaucaggaaggguuuucagcaaacauugacagcauccucagagucagggcugcaagugccagugucccugguagacagccucuuggagcccucacagccuccacaagaauucccguaaaccccacaccucuuuuccccaaauuccuccgcugcaagggcccaggcacaagggauucagauguccuauggcccacacugaacaaccccaacccucaaaccaucccuccaguucccugcuacuuuggucaucaacgauggcccagacuggccucacgagucccucacccucacccuccaagccacucggucaccucuucaacucucuagagcaaacccuccuccccgggcucccaggcacagcuggcuguuucgcugccuauggcccccaggcccacagccugccagugccaccaggcuggcccucguauuugccaugcucucaucugcccccauucuccagcugcaugcagcuuagacaaacaucacacuccucccucccagggccacagcucugcacagaggcagccauggcguucaaagcccugcccaucucacuucccuaggaaucucucaugaaucuuccagggccucccuccccuucacgccucuguggcccugaggaguguggauuaaagccccccaccaagcuccacagaacucagcacaccucccuaggacagccacggcagccacauggcccugccuuccaggaacagcccugacuguccauguuuggcuggcuguugccacaauguguggaggugaaagaugaguacuugucaggccaugcaguccaacucuugguucagaagccucaguuaccacagccacagcauuaauagcauugcaugcuaauuaccugucuacauauauuuucuccaccagaggugaguccccagagacugccucuuacuuaccuuucucucucugguaccuagaacagugccugggagagagcagguaccuaaggaaucaaugaacaaauaaaccaugcacaaguugccaugcuauguaauuuacauacagggugucagauggguaauucucagccaacaaccauaacuaagcucgacagaguaccaccuuccagguuccaaggguucuucccuuuuagcccuauuucaacuggucuggugcuccaaauggaaggccguggcucuuaagcgaucaagaaauaaguccaaagaacaaagagaaaucuuuagaaaucaacagaaauggagaaagcugguaaacaccacccuaaccaggugaucaaacaggccccauuacuaguauggaacguggcaccgggggcugccuccugugcugcaggaugaagcccacaacauccccuaggacgcauucuugccagaaugguuuaacuuuaggcucaucgaguccccacauuucuagcuuacaggaaauacaaggaauaaagaaacaagugaaaagacaacauaaggaaaccaugagaaaaaacuacaaggugacuccuacaaaaaaaaaaaaaaaucauggcuuguacugaucuguaaauuaauuuaaaaaaucagugucauuuggcugggugcgguggcucacaccuguaaucccaacacuuugggaggccaaggcgggcggaucacgaggucaggagaucgagaccauccuggcuaacauggugaaaccccaucucuacuaaaaauacaaaaaauuagccgggcgugguggcgggugccuguacuuccagcuacucgggaggcugaggcaggagaauggcgugaaccuggcaggcggagcuugcagugagccgagguugcgccacuacacuccagccugggcgacagagcgagacuccgucucaaaaaaaaaaaaaaaaucaaugucauuuaaaaaaaaaggagguguugccggauguaguagcucaugccuguaaucccaacacuuugggaggcugaggcagguggaccaccugaagucaggaguucaagaccagccuggccaacagagugaaaccccgucucuacuaaaaauacaaaaaaaaauuagccaggcaugguggcgggcgccuguaaucccagcuccuugggaggcugaggcaaggaaaagugcuugaaccugggagguggagguugcagugagccgagaucgcaccacugcacuccagcccaggcgacagugagagacuccaucuaaaauaauaauaauaauaauaauaauauuaaaaguuagaauuaagucuaaguaacuugguacauaauguaaaaaaaauuuuggaaugggcaaugaggagaaaguaaaagugugcuugguuuugucuuuuccuuuuuuuuugugagacaggcucucacucugucacuuaggcuggagugcaguggugcgauccuggcucacugcagccucgaccuccugggcucaagugauccucccaccucagucuccugaguagcugggacuacagacaagcaacaccauaccuggcuaauuuuuuuauuuuuugcagagacagguucuccccauguugcccaggcuaaucucaaauuccugggcuguagcaauccgcccgcuucugccucccaaaguguugggauuauggugguucuugucuucuuuaggugaaaaaaacagauccugguagauaaauuuaaacaugaauuuaaaacuuaauaaaaucaauagaaacagcacuauauuuccaacuuacuagaaggcaacguggaagagaacugaucaauucaacaaaagcaagccaagagguagcuggauaaauggggaaagaguaugcuuccuucuugccugccuucauucauucaauaaccaaaagguaaaguacacugugccaagugcuuugauaccuaagacaaaguccaugcccagcagcgcugagugccugaggguggaaggaagcaaacaguaacaaacaagugaaguaugacuuggggcaaugcaaaguacuaggacaaaaaaacaaaacaaggcaaguaagggcauaauguugaaaacauucuguggcugggcgcgguggcucacgccuguaaucccagcacuuugggaggcugaggcgggcggaucacgaggucagaagaucaagacgauccugacuaacauggugaaaccccgucucuauuaaaaaugccagggguugguggggauugagaagugagaguggcugcuuauggugaugagguuucuuuugcggugaugaaaauauccuaaaaucaacuguggugaugacugcacaacucuuugaguauauuaaaaaacaaaaaacaaaaaacaaaaaaaacacugaaucacgcacuuuaagugggggaauuuuuaucauauguggauuauaucuccauaaagauuuuuuuuuuuuuuaaggaacuugggagagugcuacuuuagacaggauaguaagguaagauaauucagggaaagcaaaauaucaaucuguugauguaugcacuuguaccacaaaugcacagcaaacuggccccaagccuaucuggucacaccucaccuuccacccaucaccaugcgccuucccaaggguaggggacuccucgaauuccuagguggucuccuuuuuucacuucacaugcauuucucccuccguguguucuguuaaaauguggagggugcccuccagcccuuuccugaacucuucuaguagagcuucuaguagagcuucaagaguccauggcugggcgcaguggcucaugccuguaaucccaacacuuugggaggccgaggugggcagaucgcuuaaggucaggaguuugagaccagccuggccaacauggugaaaccucaucucuacuaaaaauauaaaaauuagccgggcguaguggugugcaccuguggucccagcuacucaggaggcugaggcagaagaaucacuugaaccugggaggccgaaguugcaaugagcugagauggcaccacugcacuccgccugggugauagagacucugucucaaaaaaaaaaaaaaaaaaaaaagagaccugugcugccagccaugggauccagcagcacccucccaucagauguugauccugcuccucacucucccacucaugcagccaacacauguugagggcuuauucugggaaagaaacccaaagaaaacuguagcgucagaguuuacacugaaguauuggccuugagauuucaauaauaaaacugauuuuuuucuaagagauuuuucuacauauuucauagaauuuucauguauuucauaaaauugauucuguucuauauaaacaugagaguccuauucuuauugggaauauugaaaaaaauauauaaacaugacagauauuaacaauuccuaacuagcaaacugaaguuuacucugacacuaagauccauuuuuuuggucacgaaaucacccacuauuuauggaccuacacacaguuaaaagccaagaguaaagccaggcacggcagcucacaccuguaauccuagcacuccugggaggcugaggcagguggauuucuugaguccaggaguucaagaucagccugggcaacaaugugaaaccccaucuaucucuacuaaaaauacaaaaaauuagccgggcgugguggcgcaugcccuguaguuccagcuacucaggaggcugaggugggagaaucaccugagcccaaggggcagagguugcaguaagcugagaucaugccacugcacuccauucugggcaaccagagugagaccuugagacccuguuuaaaaaaaaaaaaaaagucaagaauaaaaaacccccaaaaucaaaguuuuuaauuggaaaugguaaacagaauuuuuuaauuuuaaaaauauccaauuuuuauacuccauggccauaaaaauggugggcauggagguuaucuggcuugaaaugacaagggccuuuuuucaaagaauaacagagccuagagaggcuucugagaucacccagucucacuucaucacgcaacagugaggaaacugaugcaaggaggggaaaugacucccagcccucaugcuguuagcugaaggccaggcuuuuaggucucucaaaucaaaaugcaccuugcccccuuuaagagacgucaccucagaaggcaguacacuuacuccaacagcugccagugcccagcacauacaggaauugccuaacaugaaccagaauuauuuuauagccagaccucauuuuggacagaagaacugcuaacauuaugguaggcaggcugguuuuuguugcuuuuuuuuuuuugagacagggucucacucugucacccaggcuggagugcagugguauggucauaguuaccugcagacuugaucucugggacuuaagcaauccucccgccucagccuccucaguagcugggacuacagacaugcaucaccacaccuggcuaauuauuaauuuuuuuguagagaugaggucuuccuauguuguccaggcuucuuuugacuguuuuuauuuaucaaacccaccccuggaauacccaccaaagcaggugcagguucuagagaaguuucugaacacagcaucacagcggaugaaaccuucgggaaaugcauauacaauuacucaaagagaugacucugaaagggauagcacucauauacacguuugaguuuuagguuauuuuuauuauuauuauuauuauuuuuuuuuuuucgagauggagucuugcucugucgcccaggcuggagugcaguggcacgaucuuggcucacugcaaccuccgccucccagguucaagugguucuccugccucagccucccgaguagcuaggauuacaggcaugcgccaccaugcccaucuaauuuuuguauucuuaguagagaugggguuucaccauguuggccaggcuggucuugaacucuugaccacaugaucggcccgccucggccucccaaagugcugggauuacaggcaugagccacuacacucggcccuaggcuauuuuugaacaccagucacauuacucucuagccacacucuguuuuugggauuucagaguggucauucacgagcacaggugaaaaccucuaacaaguagugcucacacaccgcuucugggauuaaguuugccuucuuccaauccagaaaagggagauuugcgaggcaaacuggugcaaguagaggagagcugauuuuaaugguaucuggauaggagcuauuaauggcaaacgguccuuauucaugaacccaaagcagguuagaaaaaucugauauguggccaggcgcaguggcucacgccuguaaucccagcacuuugggaggcugaggcaggcagaucacgaggucaagggaucgagaccauccuggcuaacauggugacaccccgucucuacuaaaaauacaaaaauuagcuaggcgugguggugugugccuguagucccagcuacuugggaggcugaggcaggagaacugcuugaaccagggagguggagguugcagugagccgggaucacgccucgcgccacugcacuccaccuggugacagagcgagacuccgucucgaaagaaaaaaaaaagaaagaucugguauguaacagcauuugguuagcuucugcugccacaucaacaauaaaacagcauuucacaggccagucuagaaagugggauuuuucugucauucacacuggccauuccgaacacuacccccaguucaucugaauuaauaaacauuuauuuaauaaguacugggcauuaaaauguugacaugacacugcuaaucaauguguaaaaugcaagcaauacaagauggccuagauuuuaaaucagucccaacuuuuuucauuuguggguuuguguguguuugcgguaguaggagagggcacaagacagcaaugaggagaaaaguaccagacuaggagcugaaaagcuuggcucugguucagacuuugccacaaaugggccuucauuuccucuucuguaagauggggauagucucccacaggguggcuaugaggaucaaaugcaacaacucaugagaaaagcgauggaaacuuauaaaacgcaugcacauuugagggagaguugcuccucuuauuacugaacucugagaauuccucauacccaaagcacccaggaaaaccgccuagcaugaggucucagcaaaggccaaucacagcccgagcacuacacaaaggccagugcaagguaaagaaaccuacaagggcuaaacaacgaacaagaggaaagcaaggaaagcagacauguggauauccugagucacagcauggagacaaaaggugguaaaggccuugugugccucuacuucccacaaucccugaucaguuuggggucacuguauagcucuauuucuaguacgagcauagccacaggggccagucucuugccuuuauugucuucacuuuacugauaggacaacaggucaaugaagugacuuguuuacggucagcugggcaacuaggcugagaaaccaagcuuccugacccccaccccccgcaauccacucucucucaucaggugguuacacaccaacaucaguucccaucuguggaugauccacuaugggccagguccuuaaggguagggguuuugcagguaagacagauuugaagagguaaagucacaugccuaugguacaguaucccccacuuauccaugguuucacuuuccaagguuucagcuaccugccaucaacuuugcucuaaauguauuaaguagggccaggcgugguggcucaugccuguaauuccagcacuuugggaggccgagguggguagaucaccugaggucgggaguucgaaaccagccuggccaacauggugaaacguugucucuacuaaaaaaaaaacaaaaaacaaaaaacaaaaucagccaggcacagcggugcaugccuguaaucccagcuacuaaggaggcugaggcaggagaaucacuugagcccaggaggcggagguugcagugagcagaggucaugccauugcacuccagccugggcaacaagagcgaaaccccgucucaaaaaauaaaauaaaaaauaaaaauauuaaguaggccaggcgcgguggcucacaccuguaaucacagcacuuugggagacccagguggguggaucacuugaggucaggaguuugagaccagccuggccaacauggugaaaccccaucucuaccaaaaaauacaaaaauuagcugggugugguagugggcaccuguaaucccagcuacuugggaggcugaggcaggagaaucgcuugaaccugggagguggagguuccagugagccgagaucacaccacuccacucccuccuggacgacagagugagauucugucucaaaaaaacaaauaaaaauauuaaaugguagauucuagaaauaaugcauaagucgauugcacaucauucugaguagcaugaugaaaucucacgccauccugcuccgucccaccugggaugugaaucauaccuuuguccagcauguacuguaucacagugcuuguguucaaagaauccuuauuuuacuuaauaauggccccaaagcgcaggaauagcgaugcuggcauauuguuauaacuguucuauuuuguuauuaauuauuguuguuaauuucguacugugccuaauucauaaauuaaacuuuaucaugggcauguauguauaagacaaaacauagucuauauagcguucaguaccaucugaaguuucaggcauccacugggggucuuagaacauauccauugaggauaagauuuaaccuggugcugugcaguucuaaagcuggcccucuuuccacuaucucuccaccagacaugcugucucaggauucuaagaaaccucgagaggcaagguuuauuuugcaauuaggauggcugucccugguaucaagaacagauuucuucagaaaaucagcacgaccuagaacuucuuucuuaucuaacaguccuuuugcuauuucuaaugaaaacugaaaaagucaaacaaacuuuauccaaauaggaaaagaacagaugagcagaacuagacucuugauuggaaggacugugaaugcaaacuuuaaccagaaaccauuuccucuuaucccgcccugcccccucuuuuugaagugccaggagcagcuacaaaaacaaauuugacuccuagggcaaggggaagcuugagagucaaggccaaagguccugaaaucuggagguccaggcccaagggcacagacuuuaccucuaugaaggagagaucuggcagcaucccuagcgagcagacagugagccugagagagagcugaauagagggguacaguuccauaaggcugaccucugcgcuggacuugaggccggugugccuagugaucugcaaaaacgaguuuacauaacaggccuuuguguugucccagauaagagugaguagaggagcuucagaauguuuuaaggauuuagagccagcugagauuuccugaggacacugagguggggaggagggaggggugggggaggggcaaauucagaccuaaucugucucaucuagggaggaaaacaguaacugcagcaauaaaaaaauauauauuuauaaauccuuguuuuuaaauaagaaaugaguaacacugauggcuucuucuuagaggacacuggguggcuuacgggacaaacacggaagggagacuuuucacuauauauacccuuugaaguuuuuaaaauuuugaaauuugaaccaugugaaugguuuaucuauucaaaaguaagucauggaaacuuuauuuuaagcauguucaaaguuuucugacaacccuaagaaagaggcagagcaaagaccauuagucccauuucacagaugaggaagccugaggcuccaaggagaaaaaaaaugaauugcccaagucuguggcaggguugaagcaagacucagaacuucagacuccuaguccagugcucucugucagagacuccacaguaugcaagauaagcagcacucagauucacuuuauaaguccaguucucauagcuacagucaaaugcauccacaagaacacuggaaaugaucaccauauacaaagccuuacugacucguacagcagugucucugagccguuuggguauaucuacacguuuugguuaauaauaaaccaaacacccuaaaacucuuuaacugucaaccccaaucuuucuaaaaugccccauuccacauucuucucucagugaaugcaauggccacaacugcauuuuuauuagauccauucacuuucagaaucucacggucaucuuuaugaacucagagcaaaucagaaggguggucaaguaaaaaugaagacugggcuuaggagccagccaaacccuugguuuugccacagaguuguaagugaccuuggccucagcuuucucucuauaaaggaaccaauuaacaggcacauauuggacaccauguguuugacacuggcccacuggaucccugugucuucaaggagcuuaccuucuauaggggcagacagaaaaaaacaguuaauuugaagcugugguaaguguuaugaccagauacaauagaguuacagaauagaggaccugggagaucaggcaaggccucucugaagauguggcauuugcguugggaccugaaugaugaaguagcaguuacguggggaucuagaggcagaguaugaugggcacgggaagagaugcaaagguccugaggcagggguaagcccaccauguugaagggcuagugaagcuggagagcaggcagugaaggguagagaugggccucugucugccucuccaacuuugucuccuuccagagguccaucucuuuggggaagguguuuggagguuauucugguuguaaugggaaguggcuacagaaauaaaguaauuugauuaaaucugugauucucaaauguuucgguuuuuuuagcaggagaauucuuuagucaaauaacaagaauuucaaccuacaacuagauaaagguauugcucugacugguugggaagcuaguuaaagcccuucugacccucucucugaccucuuggcuuuucuccuuaccuuucaguaccuccaagcucacaggagcuagaaaaccaccaggugauccaucucuaagcuuccugaagcucuaauaaaacccagcaucauuguaaagaaucacagggaaagcuuuaggauauaagacuggaugcuugcuggacaagcaucucgggcuucccaagacaggcccugagaagguuuauuuuauuuuauucuaaauagauaccacgucucacuaugcuggccaggcucaucucgaacucuugacauccagcaaucuuccugccucggccucccaaagugcugggauugcaggcaugagccacugcacccggccccuggaaagguuuuacacugaaucccugaugugcacuugcuuuccacagaaaaaacaacaauaagcucugguucaucaaggcuuucaguuaaaaucacacugcugaaacuacagagacaaaaaacagaucggggguugccacaggaugaggugaaaggaacugacuacagaagaacaaaagaacuuucuggguugguggaaaaauucuccaucuugauagugauguggcugcuugucuguguaaguuugagaaguucauagaccuguaacaccucaaguggugaagguuuaccguguguaaauuagaccucaaaaaacuugacuuaaaaucacauugccaaaagacuacucagaggcacuuuacagauggaggagggaaaauggcuugcuccugcugcggcagcggaccccaggaagccugacucgaaggacaguguucccucaaguucacggcugcccagcuuuaauuuggagccucugcagugaguuagacuucagguuuuccugccggcaaaaugaggugguaaacaauugccagaggcuuccccaccacagacaacgggauucugaaaagcuguccacuaugggggagaaaucugcuuuggagucagaaaaacugggaaaaauauucccaccucuaucacuucuuagcugugugcccaggcuccauccugugugagcggggguaagaauucccuccagucagcagagaaugcaccuguaacccagcugauucccaacagccucucaagaaggucagcggcuauaacuuggagagguguuuaccacagcuacacagcucuucugcucccugggccccgggcugcuuccuaggaaggacaaucuggaggcaaccauaaggaaagaaaauaacgaacugccuggcccugcauugcauaacccgugcgcaguaaaccaggagcucugcugggacacagucuguuaucucaacagguaaacaggaacccugcccccucccugaccaccgucagcacugggccaccacagacacuccagacacagaccgauagcacaugaggaggacaccacugcucuuuagccuguauuuucacacucccauuucccugcagcugcuggcaucaucacugggcacacucaauaacggacacuccacccacuccagcccuucccuggcuaccugcuccaaaaggguggucccgagugacucaaagcugccuucugcaccuugcucuuuuccauccacggagaccaaaacacagaccccagaagacgauuaaaauauaauaauaauaaaaccccucaggcaggaguuucugcuuccccgucacaucuacugagaggcacuguggacacauaaagacuguugacuuacuuuuuucuccaccuuggggcaggagggaggcaacacccagaaauuaucccaauuuuauagaaacaaagacaaagagcuacauauccuagccaaaggcaacaaggagcaggccuagagccacccggagaggcagagcccagcagcagcaaggcuccagugacucccaucucccuggcagagaucgucccagcccugugcccugaggguguccugaagaucaugggggcucgaaaccaugaaagcaagcaaagauuucuguacagugcgguucagaaaaguuacugagugccuucagcccaggaucuccugguugauuagggaguacuaacaccuagguuaagaaacucugauuucauucaucacaaauauuuaucaaaccacugccaggacauuguggcaaccacauccugcuguuuuuauucggagccauugccaaagcuugguucucucccccaccuuccgguaucugugaaguuuucaguuucuaucaaacuccagcugggggagggaaccggggcuggcccuagucgaguaaaguuccaccaccagguccacaaagagacugcagggaggcguggccaggccggaaauucugacaaaaaguuuuggcccucugguccuaaaagcaacuacuuccugaucgcuccuaguccugggguggggaugcaguucucuggcugagugccccgccggugggcugagcugggggcugccaucgcgguggauggagguggggggucugaucuccgcacuccaaggcgcuccgcuaguaccuggaacaggggagucuaacccccugccuuccaauggcuaaaguuauuuuggagcacaguccccuccuagggugugagcuccggagggcagggccgccuccuccacacucccucgccccccccccccccagcaacccacggccggcgcuuugaggacuugaacccggcccagaccccggggcccaggccugcuccgacccgaggaaggaaaaaggggaagccaaaggaaacuucagauggacgcggggugcgcucgccgcggccaggggcuccgcugcccccgccccacccuccgagggagcgccuuccaggggcccuggccggccucccaccuugacccgcuugcccuggaucuccagcgucuucauggugaagucgacgccgauggugcuucccuggcgcuccgagaaggcgccggucuugaagcgcugcaccacgcacgucuugcccacgcuugcgucgcccaccagcaccagcuugaacaggaaaucguacugcucguccgggucccccgggccugggcccggcccugccauggccuagaagaagccgaagggccggcgcucuggacgcugggaccggccugagcucacgcaagccgcgggccgagcuccgcccgcuccagcccacgggccgccuggcuacguggagccgccgcaacaccugaacccccagcacugccgaccgccugccucggccucggccccgccccaccccggcuggcucccgccccggcccggcucggccccgcccggacccggugccccgcggguucggcucccccccggacccgccaagccgggcccuccgcaaagcuccggccgguccucagcuccgugccacaccagucuggccuguaggcccgccccagcccgcccccgcccgcccccggcuccgcccucaggcuggcacccacuccgcccccagcccaacccucgggcccaccucagcccgacccggguuccgccuacguccccgcccccgacuccgcccucagcuccgaccucgacuccgcccccaggcccaccucagcgcgccccgacuccgacccgacucugcccucagcccgaccucgacuccgcccacaggaccaccucagcccgccccgacuccgcccucagcccgaacucgacuccguccccagcuccgaccucgacucugccuucaggcccaccucagcccuccccgacuccgccu

SEQ ID NO: 191652 - RNA, 28164 nt, Homo sapiens
ggggcccggaaguggucccuguagaaccacuguggcaccgcuacuccgugccgcgcccgucgagcauugcguugcugcauugcgccccaccgacuccacuauguugaagaaauucgacaagaaggaugaggagucaggugagggggccaggccugggucugagggaggccggacccccacccgccgagcuuuccuucugguucucuguccugacccggaggcugaggcccagugaggggcaggggcuugugccaggguccacagcuagucaguggcaggccucggagagcccgagcaugcgcggcugucucacucuuguaagcucggacugcaauuuucugggugaccuugggcgcgacaaacacccccccccccaggccucaauuuacccaucugucaaaggaggggaccaugccgaauguucucuuguuacuuucuucguccaaccucuugggauucgcuggggcuacguuggugcuggccaaacugggguguaaccugcggagccagcguccugugacugggaacucugaccccaucauucauuuauucagcaaaguauauugagcaguuacuguaugccagguacuguacgguguccuggauacugcaacagagcaagugggacacucagugccugagcuaggaauauuagaaugguugcacccacgauggaggaggcagacaucaaccagauaaucacacguguaauuauuugcaaaugugucaucugcuaugaaggaacuaguuacaacgagaugguggucccuggcacauagggacuuaguuaauuacaaguuauauaaaugaacacaagacauggcaccaugagaagcacaggacuguaccagggcugcugggagauugugagugguuugggguagaguggagcccaccugcuugcaggagacuaguaggaucccuagacagauuguagaggcuugauugccauuccugaggaguuugaacuuuacuagauuuccuaggaagggacaucuucccuuuaccuaugucugggagaguuuugaaguucagagucacaaccuaccuucuccauuguccuugaccguagguggaggcuccaacccauuccagcaccuugagaagagugcgguacuccaggaggcaagugacauuugcuccccucuagcuuccaucauaaauauucaccaccaaugcaacugaaauaccaacacauucaaaguguuguuuuaaagagcaacacgggagaaaacuugugccuggaaguuuucuggaagacaggaaaacuuuguuucuggagagaguuaguuaugcuuacuucuuuuuuuuuuuuuuuuuuuuuuuuuuucugagacagagucuugcucugucgcucaggcuggagugcaguggcgugaucucggcucacugcaagcuccgccuuccagguucacgccauucuccugccucagccucccaaguagcugggacuacagacgcccgccaccacacccggcuaauuuuuuguauuuuuaguagagacgggguuucaccgcguuagccaggacggucuugaucuccugaccucgugauccacccgccucggccucccaaagugcugggauuacaggcuugagccaccgcgccuggccucucuauuuaaacauuuaaaaaauuucucuauuuaaaguuaauuccaaagcuaaggaaacugguuuaaaacuaucaccuaagcuagacuguggccauuaugcagguagagauuuugcaugacuuguuuauuuuuauuauauauauuuuuuauauauauauauauauguauuuuuuuuuagaaggcgucucacucuguugcucaggcuggagugcaguggcacgaucucggcucaacugcaaccucugccuccuggguucaagcaauuuuucugucucagccucccaaguagccgggacuacaggcgcacgccacuaugccuggcugauuuuuauauuuuuaguagagaugagguuucacgauguuggccaggcaggagaauggugugaauccugaccucuugauccucccgccucggccucccaaagugcugggauuauaagcgugagccaccgcgcccggccacuucucuuuuuuuuuuugagauggagacuugcuggugucagccugggguggagugcaauggcaugaucuuggcuugcugcaaccuccgccuccuggguuccagcaauucuccugccucggccucccgaguagcugagauuacaggugcccaccaccaugccuggcuaaguuuuguauuuuuaguacagacgggguuucaccauguuggccaggcuggucucgaacugaccucaggugauccacccgccucggccucccaaagugcuaggauuacaggugugagcuacugcguccagccgcuucuuucuuuauuguugucguucauuguuucuguuuccaguuagcagaugguugcuaaguaucugcuagucaauagguuagcacaucccuaacuaauauuuacacgagagucuaagaauaauuaguaguugauuaaagaaaaacaaacccuuuccuuaugaaaauaagcuuguugcauacccagaaagcccuguuuagacaagucaguuuacccugagacuucucagacauugaauauacuugaagggaaaugaacuaggcuagaagguaacaucuuuggucauuucuucuuaggcccguguauuuaaugaaacucccaucaacccucggaaaugugcccacauccucaccaagauucuuuaucucauaaaccagguaacagggugaagcuugcggguagggagaauggugcugggggauuggaggggaguggacaaaucaugaucacucuuaggcuauuggacagccucuguguggcuguagacaacagcucagcucuggguccccucagcauccaagucucauauguugcccuugagccucuuuagggucuggggaucuggugugggcugauccugaaagaacugcugucugacccucugucccaagcugagacuucuuucuugauuaacacagggggagcaccuggggaccacggaagcgaccgaggccuucuuugccaugaccaagcucuuucaguccaaugauguaagugccucaacccagcuuuccuugagagguggcagcuguaacaagguggugggagggccaaagagagcuggccccaccagucagugugggcugccuuuguggagacaggagguaucuucucccaacucuggcccuuggugagcccgggcugauagggcuuuucccaccuaucucccagcccacacuccgucggaugugcuacuugaccaucaaggagaugucuugcauugcagaggaugucaucauugucaccagcaggcaagucaugggguuguggguggcucuucugauggguuccauugacagaccauuuuuuucuuguguguaccagacagugagacuugguugcauauugccagcugcccaccccguggcagcuucccuguuaccacugcccaccccauggcagccuccaggugugcuguuucuauuuuaauucucugaccuugacuuggacacaaaugcuuccuuuucuugauuucucuuagucaaccaaaccagcuuagaacuuucccaaagacuuucuugaguauaaagagagaacacaagaaaaauaaacaagagaguacaagcgguauacugcuuacuaagugacuggugucugcuuuaagcuaagcaauucagggacagaugugacuaaaguguaaucacugcccuuaagaacuggggcucaguucucuuauuucuuccugccacaguuuaagguugugggggucauacauugauuuguagguucaguuagaaaauauugucugucagucccuguguguagcucuggggauauagcaacaaaaaagauagacauggccucuguagccccagaauuuacagagaaauaaccaggcaucaggccauuaagguaggguguaauauaguuuaucacggaaguauuaugggcuaugagagcagaccagaagagcauccagcuugauuagaauuacgaaaguccucccagaggaaugaucuaaguggaguccugaaggaugaguaagaaauaguaggacaggacaggcgcaguggcucaugccuguaaucccagcacuguauccacaauguaauccacagacugcgauggguggaucacuugaggucaggaguuugagaccauccuggccaacauggugaaaccccguuucuacuaaaaauacaaaaauuagccaggugugguggcgcacaccuauaaucccagcuacuggggaggcugaggcaggagaauugcuugaacuggggagguggagguugcagugagcugagaucaugccacuuacacuccagccugggugacagaacgagacugcgucucaaaaaaaaaaaaaaaaagccaggagugauggcucaugccuguaaucccagcaguuugggaggccgaggcggguggaucacaaggucgggaguucaagaccagccuggccaacauagugaaacccccucucuacuaaaaauacaaaaauuagccggguaugguggcaugugccuguagucccagcugcuggggaggcugaggcaguagagcuugagcucgggauguagagguugcaaugagccaagaucgcaccccauugcgcuccagccugggcgacaaagcgagacucugucucaaaaaaaaaaagaguaggacagaguggaggugaggggugaggaaugcuacaggcugaggaaacagcacaugcaaaggcuggagaggagugagcauagccaguuagggaaguucaaggaguuacauucaggucacuggcaguaggaagcuauggaaacuuuuuagcaaaagcagggggaugaccuguuugguuuugagucuuaugaaacucccuccagcagcuguguggaguuaggcuuggaggggcaggaauagagggagagcacugguuaggaggcucguguaguaaucugggcaagggugguguugggagcuggagaggaguaaacaggcccaggcucucugcaugcugacaaugccuucuucccugcagccuaacaaaagacaugacugggaaagaagacaacuaccggggcccggccgugcgagcccucugccagaucacugaugugagucgugccgguuccucccugcuuccuggccucuugauugaggccucggcaucaucuuuugcauucuuugggguguccccuaucacugagccaggugaugugggguggaggcagugugcaggagcacaugagaaacgcuuacuuccuccucauacucaucucugcccccauuccugcacuccugagagcugccaaggacugacuggaucuccuuccacccugcuccuuuugcccacagagcaccaugcugcaggcuauugagcgcuacaugaaacaagccauuguggacaaggugcccagugucuccagcucugcccucgugucuuccuugguguguaguugcugcuggagcccugcugggggugggguagaaaauugaagaaaauuuaagagucacauuccaguaggaaaaaagaaaguguuucuuucuuucuuuuuuuuuuuuugauugagacggagucucacucugucacccaggcuagagugcagcgccacgaucucggcucacugcaaccucugccgccgggguucaagugauuuucuugccucagccucuugaguagcugggauuacaggcgucugccacugugcccagcuaauuuuuguguuuuuaguagagacaggguuucaucaucuuggccaggcuggucuugaacuacagaccucaugaucuacccgccucggccucccaaagugcugggauugcaggcgugagccacugugccuggccucucuuucuucuuuuuuuuuuuuugagacagagucucacucuguugcccaggcuggagugcaauggcucgauuucagcucacugcaaccucugccucccuggcucaagcgauucacaugccucagccaccugaguagcugagauugcaggugugcaccaccacgcccaacugauuuuuguauuuuugguagagacguaguuucaccauguuggucaggcuggucuugagcuccugacuucaagugauccacccgccucggccucccaaagugcugggauuacaaagcgugagccaccgcaccuggccaaaauaaaguauuucuguaucuguaagccugagagucccacccuucucagugaagacagccaagaaacucuggggugauugaagagagucguggguggaugguguugacccaugccuuggggagggacauugagggugggagcauccugaguuuguccauggucucugaggaccaggacaguggcgagccccugagcugugucugagggaagaccagaacugggcccagaaugugugauggggacacuuccuaccugccccuuaauguguccuguugcccacagcaccugcugaagugcagcuuugacguggucaagcgcugggugaaugaggcucaggaggcagcauccagugauaacaucaugguccaggugagaugugagcaagggagugauauuuaaaacacucaggcaggugguaaggcacuggccaguuggcauggacacuugccaccgagauccuugugaccccuggccauagcaggcuuuaauccuuucgucauuggaucaugggaggaauuaggagguccuggguuagagaauccaggguaccacuuggggcgcuuggguuacagacugcuuaccagcuggugcugaaauauucaaguauuuugauaaccagcugaguauuguuuuggagcauaugauguggcaaacuuggccaaggcaggcagagggccgccuaaauuuaggccuuugccagccuggcuuuguuaugauguguggaauuaucuugaugaggcuuucauccacuuuacucuuccucagugaccuaggacagccguuccuuuuaucucucuggcucuugguuuccuugucuguaaaauacgaaugaagguuacugccucacaaagcagcaaggacgagcugagaucaugcauguaacaugugacccaucugggucaugagugccuaucggcgcucccuguguguuuauguauucccuuuaucucucaucugucuucucauccuuugcacgauucuugucuucagggccagcuguggccccucaaaacacuuaugagggccagauaagcuucccacauagaaggcuuccacagcugccauaucuuugcccccaaaugucgcuccuuuaggaaacaaaagagaguaucgaggacaggaaauaacuaugagaccucacaucuuuagaaagggagucucugggcuucuggcccuccaggccuagcuuugucaguaccagccaggagucuuugggcaagucagcaaagauuaaacugucuaccuucaggguuguuguggguaaugcaagauuucauggcuaaggugucccacacagugacuuacaaaacaugacaaugcucagggucuggcucccaccuucucucucucauugucugauugaaagcaccaggucucccacauugcuuucaucuuugugcuguuuguugucccuuuccauaucuguauuuaugcuaccuguuagggcucuugccgaagcaggggugggaacaagaaccacagauauacuucugugguuugugaagcauuguguggagggcuguguacacagaguaccuggggcaguugucacagccacucugugugguagcugcuacugugcccaucuuagaaaugagaaggcugaaggacccacccagggccacacagccaguauacccaaaagucauacauuuguacucuguugcugucuccuguccuauaguaccacgcacuagggcuccuguaccaugugcguaagaaugaccgccuagccgucaauaagaugaucagcaaggucacacggcauggccuuaagucucccuuugccuacugcaugaugauccggguggccagcaagcagcuggaagaggaggauggcagguaacggcucucaucucucaccagcuagaugaugccucacucauccuaccaugcugggccacccccaacguuuucuugccacccuauguucuuuuguagccgugacagcccacuguuugacuucaucgagagcugcuugcgcaacaagcacgagauggugguguaugaagccgccucggccaucgucaaucugccaggcugcagugccaaagagcuggccccggcugugucaggucacugggcauuccuucacccagccucacauguuuaugcuugcugggaacuaggccuggguucccgggcuaggagaaagaaagaaaaugcucuuaacaaguguuaaggagucuguaccuaggaagcaccugccccagacacuaugcugaguccccacuuguaucacguuuugguggugggcugcuguuaguuccaucugacugcugaagaggcugagguaaggcucggguccacucuggagccugucagguuggcuggccacaggaggaggccugguggaggaacccaggaucugugaaacuggugcaugugaaguggggcugcacuuuuccaggugaaggagagaacaguauagagggucguucugagccuccagcuccagcacuggagcagggcagccuggguuagagcccuggcucugccccuuaccaacugggcaagccuggcaaggccgcccauccucuccaugccuuccuuuucuuuucucagauguggaugauagaucaugccuauuacauaggguuauauagccagaaaaugugugaucuagacaaauugcuuagaaggcaacauguuuguuguuugccguuugcuguuuuuuguuuuugcuuuuugagacggagucucacuaugucgcccaggcuggagugcaguggugcgaucucagcucacugcaaccucugccucccagguucaagcgauucuccugccugagccucccgaguagcugggacuacaggcgcccaccaccacgccuggcuaauuuuuguauuuuuaguugagaugggguuucaccauauuggccaggcuguucucgaacuccugaccucaugauccgcccgccucggccucccaaagugcugggauuacaggcgugagccacugcgcccagccguuguuugcuguuauuaaggggaauccagcagccuugaguccuggagucuuuggugucuccucugugcagggcccugcucugggugugggaauacccugucagggaggagaaagccuaugaagaggugcaaagugguugguacuggaaaguggauauguugagaggcuagaaaaggagaggugcuuagggugagaaaccuggauucaaaguggaagagaagaggggaguguuuuagaacaggcccauggaaagcaaagauguuguggcaggagaguuagauuugcagguuuugagaaaugauugggccucuuguuuuucuauuauucucuacuauaacaguguaaacuuggucaggcaaacagauggaguucauguuuggagagagaagucuccuuuccuccuuagaaaugaagaaagaaugaacugcugggcacgguggcucacgccuguaaucccagcgcuuugggaggccgaggcagggggaucaccaggucaggaguccgaggccagccugaccaacauggugaaaccccaucucuacuaaaaauacaaaaauuagccgggcgugguggugcgcaucuguaaucgcagcuacucaugaggcugaggcaggagaaucacuugaaccugggagguggagguugcagugagccgagaucgcgccacugcccuccagccugggcgacagagggagacucuaucucaaaaaaaaaaaaaaaaaaaagaaauggaaaaagaacuaaugaauucagucacugauuuggguauucauucauucuuauuauaucccccauauuuccagaauaaugaaagauguaaauaaaguagggucuucaaaauaagcauuaagaaaaauuuuuuuugaguauuagagaauaaaagccaaguuaugaagaaaggaacauagauauuccagaaaacaguagucaucuucgcuccuaugauugagugccaaauuuagcucugagcuuccgggcagccagggcaagggagggauaugguacccgaauggcucucaucuaguuaaaggaaauaaaccauuuguuuaagagaggacuuuguucuucagcacuuggugccaagggggaaguucuguuggauccuguagacacaguaggagagaggaguggaauauuacuucacagagguuaagggcuuaggcugcaggugcaggcagucuuggaauuuaaucuugguucugccacuuacuggcugccaaccuaaaguuuguuugcuuuccccuuugugccucagucuccuuaucuguaaagugggcuagugguggcugcaagcuauagaagugaggcauguccacuguauagcacagcaccuggcacacagcagaugcccagugaauaacagcccucacuggaaccccugggugcucacagacauuauggccucuguccauggcucaggugcgcagggugaggggagcucugugucuuggguugggaugggggugucagcagggaaaugagcugagcagaggguuugagucagaacaguagcccccgguuuucccagcugcccagcagugaaggcaaccugacauguggcauccaucuccccacagugcuccagcuuuucugcagcucacccaaggcugcucuccgcuaugcugcuguucguacccucaauaagguaagaguccagcuuggggguuggaggaagcugucugauccaacuggagguguguccuagccucugaccuggcugggaaggauaauagcccuggucacaguuaguuucuucuagauggugagaugaucucauccaaaggacuucugacugggccaaaccaucaaauguagugacagcauuggguuccugcccucucugucacuguccucccaaaacagguugccaugaagcauccgucagcugugacagcuuguaaucuggaucuggagaaccuggucacagauucaaaccgcagcauugccacgcuggccaucaccacccuccuuaagacgggcagcgagagcagcaucgaccgccucaugaagcagaucuccuccuucaugucagaaaucucggaugaauucaagguaccugcuacccccaggacacccacggcccccagaggaaggagcucugucccugcucucuguggccacagccuuccugccaggacugaccugaggggcuggucagccuugaggacucagaggaggccagcaguuugcucugcagagacuuggccuuccgagaaaugugcguaguccugccuccaggccuccauccauaucguccccuuguacugaaagaacaguaguuuccaggccaguuaaggguucauugauuuguuguccaaguauuucuugagcacuugcugucugcuauguagagugacaaaaggggaacauagcagugaacaaagcaggugacugcccuccuggagcuuccuuucuagggaugggagaggaacaguaaacagguaaagaaaggaguagacgagaucaucucaggcauggguacugcagucaagaguguagaaauacagcagggaugauccuaggaagagcacagucugggaaggcccuucuggagggugacauuugagcucaaaccugaaucagugcaaagaaccaggaggaaaggcaggagcaagucaaggagagagaaggccaguggguggaagagcuguggggccagugcaggugacaaagucagaauagacagggcucaaucauguaaggcccauggucagguaaagaguuuuaauugcaaggaagacauuggaaagguguucuuuuggggcaggaggaaggaugugaauauuuuuugagcuuauauuuugaaauaauucauaggaaguuacaaagaaauauacugagaaguccuaugcaccccuccaucaacccucuccuacagugccagcauccuacacuagcacaggacaaugucaaccaggaaagugacacuggcaugacccauagagcucauucagauuucaccagcuacacaggcaacuccuguguguauauaugugaaguucuaugcaagaugucauguggagacuuucaaaauugccaccacagugaagacacucaacuauccaucuccacaagacucuuguuaccucuucauagucaggcccauuccuaccucucuauucccuaaccccuggcagccauuaauuuguucucaauuucuguaauucuguuauuucacaauuguuaauugauagaacaaugaaguaugucaccggagaguuuuaaucagagcaaacaauaauaugaauaauauauugugguaaauucuauaguguggauuaugcaaaguaggcagcagucuacucugccuguggguuacaagaaugcuuugcaggcugaaaugacacagugagauuugcauauuagauccuucugggucugggcacgguggcucaugcuuguagucucagugcuuugggaggccaaggagggaggaucacuugaggccugaauuuugagaccagucugggcaauguagcaagaccucaucucuacaaauuuuuuuuuuuuuuuuugaguuggagucucgcucuguugcucaggcuggagugcaguggugugaccucagcucacugcaagcuccgccuccuggguucacgccauucuucugccucagccuccugaguagcugagacuagaggcacccgccaccaugcccagcuaauuuuuuguauuuuuuaguagagacgguguuucaccauguuagccaggauggucucgaucuccugaccucaugaucaacccgccuuggccucccaaagugcugggauuacagacgugagccaccgcacucggccuacagaaaauuuuuuuaaaaauuagccauguguggugaugcgcaccuguagucccagcuacucuggaggcugaggugugaggaucacuugaacccaggaguucgaggcugcagugagccaugaucaugccacugcacuccagccugggugacagagugagaccuugucugaaaaaaaaaaaaauuggcugggcgcgguggcuuaugccuguaaucacagcacuugggaggcugaggucggcagaucacuugagaucagcaguuugagaucagccuggccaacauggugaaacccugucucuacuaaaaaaauuaaaaaauuagcugguguaguggcucacaccuguagucccagccacuccggaggcugagguaggagagucgcuugaccuggccuggagguggagguugcaguaagccgagaucgugccacugcacuccagacagagcgagacuccgucucaaaaaaaaaaaaaaaaaaaaagaguccuucuggagcagaguggaggggugacuggguaaagagacuguuggaguaauucagaaggagaggauggugccugaaccggcgggaguaggagaggugggacagugcaagagcuuuuugagggauaaugccuguuggcaggguuggugugaggguugagggguggaugucaacagagaugaugccauuuucuacuuugagcugacaguggugcucuugacuaguuugcaggggaggaaaagaugggguauuggaugagggagggggaaggagauggagauguuugugguugcagacauguggaguuugaagugcugugggcgccagguggaguugucugacaggcaguuggaaaaggcaggucuuaagcucagacaggagauaaauauugggagucaguggcauauaagaggcgguuaaagccaugggaggggauaagauugcugaagagacugugagaagagaagcggccaaggacagaauaccccagagacaggcuuaaccaaaaaggagccagaggagaugaugggugggaaccaucagugggagccagugguagggagagaagcaggacagguuggguggaggggacucggagacuuaagaagccugaguagaagagcagaguuuggggaacccagagucugagagucugacacuggggcuguuggcacugccuugggugggcucagggauugugcccuucaagcuucaagcguggaguugaguuccucuggucuccuugcccuugugucaugcccaaggccuggccuuaccuaaggaaggacucagugggcacucagggaacugagucaccccaucuugguggcagggccugcugcucaugcacgucuauuucauuuagguggugguuguccaggccaucagugcccugugucagaaauauccucgcaaacacgccguccuuaugaacuuccuguucaccaugcugcgggaagagguaagagucaggggcauucgggggaugccaggucuccuggugcagggagugaccugaccacuggcuccaugcucagcuuugugcgugugcuuauguuagccuguuaaccaacugguuuucauggugccugcaacccuuuaaacuccuuguggacauguaaacacguaccaauugcuaguaauuacaguaauaacuaugacucaccagccugacuuuaaaaacuggauguccugaggugaugcuugugcagaagaugggaaaaugcauguucuuuucugguggacucuagugcagaaauauucuagaccauuccaggagcucuaggagugguuucuugugaaaccggugcuaauaauacgacauugguucuauuucuguucccgacgugaauuacugauucacuuaugccaccuuucuuggacgucucaacaaaauggguuaauucuuaggagcaauagcagauguucauggaguagauuuguuccucagauacaugguaccccuuucacccagccccagaguggcccauggacuaggcaguagaggagccauugccuugagugucuuugcguuucccaagaauguuguuguagaagggcacuaauguuuagugaguugucagcuaaugggcccagcacuuuggugauuguguuuguuuuuuuuaaguagagauggggucuugcuggguugcccaggcuggucucaaacuccuggcuauaagugaucuucccaccuuagccacccaaguucugggauuacaggugugagccaucaugccuggccaggccuagcacuuuggagacacuguaugcaugauagcaguuuuuuuuuuuuucuguugaguaggagucucguucugcugcccaggcuggagugcaguggugaggucuuggcucacugcaaccuccaccuccuggguucaagugauucuccugccucagccucccgaguaccuaggacuacaggugccccccaccacgcccggcuaauuuuuuauauuuaguagagacaggguuuuaccauguuggucaggcuggucucaaacucuugaccucaggugauccacccaccuuggccucccaaagugcugggauuacagacgugagccacugcgcccggccuccaucugucacccaggcuggagugugguggugugaucacggcucacugcagccucaaccuccugggaucaagcaaucgucucaccucagacccccaagcagcuggaauuauaggcaugcaccaccaugcccaacuaauuuuucuauuuuuuguagugauggggucucuccaugaugcccaggcugauuucgaauuccugagcucaagugguccacccaccucagccucucaaagugcugggauuauaggugugagccacugcaccugaccagccuuuuguuugacaggaaagagugauagaggcccagagaaccaagugcccugucuccaaguucuguguuuggacaacuguccuugguccagcucaggucuucaacucuuuucuggagagagcaggcuccuugcuuagcucagcuucucucugcaggguggcuuugaguauaagcgcgcuaucguggacugcaucaucagcaucauugaagagaacucagagagcaaggagacagggcugucacaucugugcgaguucaucgaggacugcgaguucacagugcuggccacccguauucuacaucuccugggccaggaggggcccaagaccaccaaucccucaaaguacauccgcuucaucuauaaccgaguggucuuggagcaugaggagguccgggcagguaggucugagccagggcugaacuuggaaacuuagcuuacccuugaauaaaugucccagcaaagggaccugagccuccaguggggauuugugcacucaguguucuugcugcacaagcuguuuuucauaauauuguaggcaggaccuuacaugucaucuaguugaacaguucuuuguuuuuuguuuuguuuuuuuuuuugagauggaaucucgcucugucaccaggcuggaaugcaguggcgcaaucucagcucacugcaaccuccgccucccggguucaagcgauucuccugccucagccucccgaguaggugggacuacaggugugugccaucaugcccagcuaauuuuuguauuuuuaguagagaugggauuucaccauguaggccaggauugucucgaucucuugaccucaucaucugcccgccucggccucccaaaagugcugggauuacaggcgugagccaccgugcucggccaugguucuuaaccccuauaauuuuuuaaguauuuuuuuaauugagacggggucuugcuauguuguccaggcuggucacgaacuccugggcucaagcuauccuccugccucagucucugaaagugcugggauuacagagccacugugccuugccuuaagugauuuuuuuuuuaacuuucacuguauguugauguuuagcuaaaaaacaaaaagcuuuguugagauauaauucacaugccauaaaauucacccauuuauauaaaguuuacaauucagugagcaaccuuccuauucuuuauuuuuaauuucuuuucaugcccccacuggacagauuuucuucuuucagcaauaaaugaucuuuaaguaauuguucccuuucucauuuuuauuauucugagccuuaacugcaaauugacgccauuuggauauggaaggugaggagcuuuacauuauagccagcuucugugaccucaucaugguuaauuugaaauuagcuccuggaaccuuagaaugggagcuacuaaucccaucuggcgcccuucuccauuaaauagauaaggaaguugaggccugggauggugccaagauccacccaaagccacucacucuguugguagugacuuugggccuccuggcuugagacuucuugccucuggggcucuucugccugaagacccauucugagugcuggaagugcccaaacagugaguugucagggugcauuggguaaaucacauucgcuuccuaaacacaggugcugugagugcucuggcgaaguuuggagcccagaaugaagagauguuacccaguaucuugguguugcugaagaggugagucuaggcccaggggcccuaauggggacaguguucccuuggacccaagcagcuuuccuuugucuuuauuuuuuuuuaacugaaaagggagagaaaaguuauacagcuacugauuguagaaaaaaaagagaaagcauagaaaagcaugaaaaacaaugcugugcaaauugcaccaaccagaugugacaauugguaacuugaauuauuuuguccauuuuuuaaaaauagcucuauugaagccgggcauaguggcucccgccuguaaucccagcacuuugggaggccaaggcgggcggaucacaaggucaggagauugagaccguccuggcuaacacgcugaaaccccgucucuacuacaaauauaaaaaauuagccaggugugguggcgggugccuguagucccagcuacuugggaggcugaggcaggagaauggugugaaccugggagauggagcuugcagugagccgagaucaugccccgcauuccagccugggugacagagcgagacuccagcucaaaaaaaaaauagcucuauugagauauaauucacauaccauacaauuuacccauuuaagauguguaguuugauggguuuuagcauauucacagagugauggaaccaucaccacaaccugaguuuaaaacauuucaucaccccaaagggaacucaguguucaugaguguggccucuccucacucccuccacccuccgccuggggccaccacuagucuacuuguuaucccuauggacuuaccucuaaugaagccaugcaggaucccuccugccaucccugcugggucccagucaggaccaccuuguguccuggcugcaggugugugauggaugaugacaaugaaguaagggaccgagccaccuucuaccuaaauguccuggagcagaagcagaaggcccuuaaugcaggcuauauccuaaauggugagucauucccuggcuaucuuggacucagcaccuuacuggagcugugguucucaucacucccugggcaggggaaaucagaggcaagaugcucuuggcuggacuugccuggcaaccucauggcaucauggugaccucaggaggucccgggucauucaggucacaccugaauuggguggaaauuguccagugaauugaaacgcucaucauuaauaaaaacuuuauuuuuacaguacuuuacccuuuacaagucacuuuguauauauguuuauuccccacaccuacccuguaagggaggaugugucugagaaugcagaggcuuagagaauaaagugauuuucucagggucauacuacuuaggacuuguaacuucgggaccccagggccuccaugguggucccuggugcacauuuugcucuaucugccaggcauggugaccucucuucaccuccaggucugacuguguccaucccuggucuggagagggcucugcagcaguacacucuagaaccaucagaaaaaccuuuugaccucaagucugugccccuggccacggcgcccauggcagagcagagaacagguaacacuuauacuccucccagaggccaucaaggccaggccucuguuggagggucugcauuggcugcaaagccacuaaccuaacuaggguggguggcaguuaugcugggaggaggaaaugaucuuuuccaccucuggcuccagaaaauagagacacacauacacacagacgugggcucucucacaugucuucugcuucccacucucaggaggguuaguauuuauaaucccugaguaauagcacuggggucaccaccacacugccccgugacuccagcuguuggucaucacguguauaauuugcuccugcagaaaguacccccaucacagcagucaaacagccugagaaaguggcagcuaccaggcaggagaucuuccagggugagucacagugguugggggaugcuugggaccugggcuuaguuuccucaggggguucaagaguaagaacugucauauauuggucucuccugagugcuaggcccuugagaugcuuuagaccuacuaucacauuugacccucagguggugguuguuggguuccuucaauaucugaggaauuggaaguucagagagagaaaguaguaggaggggcuggaauuaaggucccgaucaaacuggcucagugcuguuacugggccucaauuuggagggcucgggucccuggagcccaggccaguucagaaugucugagagagcagugcugggauucaaagacacugguacuuuuugucggguuccacguguguucuguccacauugucuuguaagguuuucuucagguauccaucuguccucugguguugcauuuuuaaggggagaggcugugugucuaauugcagauuguuuuauccacugaauucaguagauaaaagcauagaccccucuuccuucaugggcccucacuuccauccuagcucuucugucuucucuuaaacagcccucugugcuaaauaguucuucacauguucugucuuuuauuuucugcgucuaucacagcacugagcccagugccuuccuuccucacaguaggcucccaauuaauguugaauuaaaugaaauccccccuuccccauuacacucagaaucaugucuuauaucaauauagcauggauccugagcuaauugggaucgcuauaacaugaaacuuuccauuuauaucaguuuucuauugcugcuguaacacguuaccacaaacuuaguggcuuaacacauuuauaaccuuauagcucugcggucagaaguccaaaguggguuucauuuguuagcagugcugaguucuuucaggaggcuccagguauugcccccuugccuuuuccagcuacuagagguggcccguauccuuggcucguggccccuuccaccgucuuuaagggcccuucuagggcagaaggucagaguagagugauuugaagaggccacacuccuggccuuuucaaaucucucuacucugaccuucugcccuagaagggcccuuaugauuacacuggcccccccuggauaauccaggauaaccccuagcucaagauccuuaauuuaaucacaucuacaaagucccuuuuaccaugcaagguaacauagcugcagguucugggaauuagcaugugggcaucuuggagucauuauucugccacaccuuccaaggaagucuccuaagccgcuuaaaggguaacaauuccauuuuuaaacaaucauccaaaagccucacauuuacuaaucacauacauguucaguuccaagaacuuuccuagaucuugaauuuauugccucauuugucuuuacaacaacgcugugaucaagauaaugauaucaguuuuauugaugaagagucugaaacccuaccaacagaaucccccagggaguaaguaucaggcccaaaacucugagucccaagaaaauaaauaucaauagaaaagcacucuagugguugauggucaugguggcccaaaaguuccuccuaauaucuagccuggauuguucugggcuuuuuauugccugcauauucauuagauucagucuucaggcugcagagggcugaaguggucacauaggcugacuuuuuguggaggaaaaaagcaaaauaauaaaaauaaggccuaccuuucucuaugucugaaacgugaauugaguaccuucuaaguaaagggaaaaauaucagauccauggccucaaagcacaaucccuguucucauggaguucaauuaauugggaagacaaguugaaaaucuuagagcaguggucuuuaaauaucaguauauauuggaauaaucugaggaaacauguuagaaaugcaaauuccuugauccugaaaccagagauucugauguaguagauuugggauggagucugaguuuuuagcaagcucugccgccaaccccuaguaauucugauacaguugauccauggucauagugcgaggaauccugccauagaauagguacaagaguggcagcuguagccauuauagguggacaccaugugcacacaucugccagaugccucauucacuuggguuauucccuuuaguuugcaaggaaugccaggaccagccaggguggggucccaugggccugugcuugaauccagugcuugaaccugggcauaggguguagggauaggucuuaccagacacaaacaauucuaaguuagguuuucugcaacacucucauucugaaauaucucuuuauuggccauuugucuuaacugauaaauauauaggaccaguuuguuauuuugucugauuuuguagcuauagcaguaucgaucuuauuuuccuaauugucaccuucuuuuaagaauccuugcugcgguagggggcggaaauccuugcuaagcuucuauagcugggggauucuccaauuaggucuaggauuuuguggucucauaucaguuuuuugcuucugaggucuuucaugguacagagauggggagaguauuugugggggguugugccacaugagcgaagucagggagaugagaaaaugcauggauauauucaggaaauaaugaguagccaguuggguaaacauaucuauccaucuaagguaggguggaacaccuugagaauggucaugggaauuuauuagaaaccaucaacaaguuggucuggggaucgagaagcugagugaauguggccuguggauuucagagcaguuggcagcagugccagaguuccgcggucuugggccccucuucaaguccucgccugagcccguggcccucaccgagucagagacggaguaugucauccgcugcaccaaacacaccuucaccaaccacaugguuuuucaggugagcaaggugggcugaggcccugcuggggcaugcgcccagggaguugucccaggucuggcagguccuguagggucauggguccccacacugcauugguugggagcccaacuugaugacagaaucuguccccaacaggucggucucucauaucucuugacucgggacauccauggcucccgauugucagcaugaagacagggaaccuggggcagggggacugggaugggaaucaccuuggucaauaggaaagaggugggaccuccuggcuuuuccucugcagcauggcucggaccuagugcaauguuuaagcuccccucucuuuccuguucaguuugacugcacaaacacacucaaugaccagaccuuggagaaugucacagugcagauggagcccacugaggccuaugaggugcucuguuacgugccugcccggagccugcccuacaaccagcccgggaccugcuacacacugguggcacugcccaaagaagaccccacagcuggugagccccucuccagauaccacccuauccuccugggagcucauggggucaggaggaggugggcggcugggcaccagcuguuugccuucuauuagagcuucagcuccuugauuucagucccaagaagaagaauagcugagucccaagugcucuucuuuaaaaauuuuuuuuuuuaaagagacaggaucucacuagaacucaugacuuuccuguccuacaagguggcacccucuguccagcuuugugggauuggauggcuuguugcugcuacuaauaacauagcaggggccuagaaagcaggcugugaccccugccugcuuguccccugcaggaggagcccauccccugcaggcuggggacauccuaacuacccagccucucuuccccacaguggccugcacauucagcugcaugaugaaguucacugucaaggacugugaucccaccacuggggagacugaugacgaaggcuaugaggaugaguaugugguaagauccuggugucaggaagcucaguuuugugcugaggcugcaaagcaacucccuucaggaacugacagugagacuggagcuguuuuuggcuuuuuagcucuuuaaaauuuuauuuuuuuauuuuuauuuuuugagaugaaguuucucuuuuguuacccaggcuggagugcaguggcgcgaucucggcucacugcaaccucugucucccugguccaagcgauucucuugccucagccucccaaguagcugggauuacaggcgcccaccaccaugccugccaaauuuuuuguauuuuugguagagauaggguuucaccauguuggcuaggcuggucgcgaucuccucaccucaggugauccaccuaccuuggccucccaaaguguugggauuacaggcgugagccaccgcgcccggccuaaaauaacuuuuuaaacuuauggaaauacauguucauguguaaaaagaaaacuugggaaauacaaaaacaaaauucaaaacaaaguaugaacaacaggaaaacauuacucauaauccuuagaguuauuuuuggggggaagugguauaauugaaaucauucuuacaguguagaccuugcuauuuuaaaaccauaguguauuuuccaguaucauuacaaauacuucauaaacacaauuuuuuuaguggauuuaaaauacuguuauauacuaugucaaaacuugauugacuuuucacuccuuuaauguugggcauuuggguuuccauauuuucacuauuuauauugcugcauuaaauaucccuuuagauacaaauuuuuaucugcauuuuagauuauuucuuuaggauagauuccuagaaggagaauaguugggucaaaggguaagcaugauuuuaagacauuuugauuccucuugucaaaugcuuucuggauaaauuugaccuguuugcugugcugggcaguccuuucaugcacuggaauagcccuucuaaauucuccuaucuuagcucgguggaacuaaguacaggauccuucugaggucugacuuuggggcaguggcucagggccaucugagugcagaccauuaugcucagccuguggauggggacuguuagaacuccuccugacuagagggacagucacaguggaauacaacugacauucgccauugugucauccuagagucacaguugaggauggauggaccuuccuugagcuggaaaugaccccgaggcaggagcugcucuaagaccaagugagcuccuugagagagcugggucuguuugagcccauccagagaugaagaaaaaaaaaaaagagagagagagcugggucuaaguuguauuuauauacacuguaaacauccacaggaguagggccucagugaaaaucugaugggagaaugaauggggaaccuucauguagacucagugggaguauuaugugucaaguucagggaagacacagcugaaauggagauagagauucaggaucugucaaauccagaggacacagcugggguaggagguuucugcuaguuucugcugaacuagaaacagcugcugguccugaagagcucaucauccccuaggagggacaggcauaggaagcagaccucugagaaugcuauguaauucccugcaugccagguccuggaagcacugacacuaggcaggcuuagaagagaugugaucucacagcaggcggcucuaggcugaauuaguagauugguacuugggauuagggcguuuucuguugaagggauaccauuugccuuugggcaccucaaggauagguaccuggucaaguugcucuauguccccagagucuagcacaguccucagugccgagcaagcaccuguggaaagaguugcaggaagggauguguggaugaguucagagcagaggcccguagguguguagaugggugccugauuucuaccuccaucucuccagcuggaagaucuggaaguuacuguagcugaucacauucaaaaggucaugaaacugaacuucgaagcagccugggaugagguaggggaugaauuugagaaggaggaaacguucaccuugucuaccaucaagacacuugaagguaaaauccugggaaugccaucucuggccuaauuacuguucaagaucuuuggcuacuauugaagugcucaucccuuuucucuccaaggauccagggccaugucuggagcacauaugucaaaugccacuucauuaaaagcccuucagaacaugggggaguggugguggcacaaagggcagauaagauggcuuaacaauauugggauuucucauuacagaggcuguggguaauauugugaaguucuugggaaugcacccuugugagaggucagacaaagugccggauaacaagaacacccacacguugcuccuggcugguaaguggcauuucuagauggggagggccuggauagcuuacagccuggaugccacuggauccugggcuaaggacuccacuguaaauauggggagucaaaauucacagcauuuaaaauucacaaaguauaaaauaaucugcagcgaaauguuuccucccuaccuuggcugccagccauucagauucccuuccgagaagcgaccaguguuacuauuacaaacaauacuuguauaaccuugcgguuauuuuauggcuauaaaagcuaauaggaacgcauuuccuuuuuuuaacucaaauguuuauguacaaaugguauauauauuguccuccgauuugcuuuucacuuuacauugcaucuuagagaucuuccccgucaauauguagagcuuccucauucuuuuucuuuuaauugugguaaaauauacauaaaauucaccauuucgaccauuuucaaguguaugguucagcggcauuaaguacauucacacuauuguaaaacuaugaccaccauccaucuccagaacuuuuuucaucccaaacugaauccucauuuuuuuuauaguugcuuaguauuccauuguguggaugcaccacauauucuauggaacagccacuacugaugaacauuuaguuugauuucaaucucuugcuauuacagauguuacaguaaauaaucguguacacacacacacacacacacacacacaguuuacuuugcauguguacacugagaauaucuguaggauaaauuuuccaaggcaucaccaguucaaagugauuuguguuucucaucuugauaaauaacuccaaguugccuuccauagaauuguauaccuuucuuccuacacuguggacaacauaauauguuaccacacuuuaugaucuuuuccagucuguguggacaaugauaucuuaguguaguuuuuguauuuucaaugaaguuaaguaucuucuuaaauguugaggcauuuguauuuccuuuucugaucauugucuucauauccuuugucuuauuuucuacaggguuggcugaguguacccacacucauucuccuucccagauuauuuacuagcaaacuccagaaauagcauuuuauauguaaauccuguaucuguauguuucucuaagagagaaugaccccuucccuuuuuuaaaggacaauacaauuaucauaccuaaaacaguuaacaaaaggaaaugggaugauuuuuuuuggcugaguguuuauaaacaggguugaaaggaggcucugcuucaguacccugccuacagcugacaguuuguagccacauugaaacaaccuaguccccugggucuugcagacaccugcccugugguuuucucgugguggggcuguccccuucauuugugcucucagauucagucaacgugcaagagccucugugacaugagauauaagccuuuuauguccaucaguucauuugaacuuagcagaagccugaaauaugguauuaucaucccugccacuuuguaguugaggauacugaaguccugagagacagugacuuucuuuuuuuuuuuuuuuuuugagacggagucuagcucugucacccaggcuggcaugcaguggcacaaucucugcucgcugcaaccuccgccucccggguucaagcgauucuccugcuucagccucccgaguagcugggauuacaggcguccaccaccaugcccagcuaauuuucguauuuuuaguagagaugggguuucacuguguuggccaggcuggucucgaauuccugaccucaugaucugcccaccucagccucccaaagugcuggaauuacaagcgugagccaccgcgccuggcugagagacagugacuuucacagugaaaucccucacucagggauuucagcccagcucuccugcccguuucacuacaccagagcugccuucauggguugcugcaaaugccauccuuagccugcccuguacagucccuucugcuguauauaucuguacuucucucuucccuucuagguguguuccgggguggucaugacauccuggugcgcucccggcugcugcuuuuggacacagugacaaugcaggugacagccagaaguuuggaggagcugccaguagacaucaucuuggcaucugugggauaagaggccagccugcauaggaccucauacccuuccccaacacuaccuggaaguugugccuuccucaugaaacuggcagaaaccccuucccaagcuucuguauugaaaaacaauuaggaaucauugcagauuuuuuuuuauucugcucccaccucccacccgggacuacuugcuggugacuuuuuuuuuuuuuuuuuuuaaauaggggaugauuuuagcuuguccuaaaucuugcuguccacccuuccaggaaagggacauuguaaaugaauaaaacauucucaacuccucuugaaucuaucccccaagaaaccaucuuaucccuguaauaaaucagcauguauuuauugaa

SEQ ID NO: 191653 - RNA, 28164 nt, Homo sapiens
uucaauaaauacaugcugauuuauuacagggauaagaugguuucuugggggauagauucaagaggaguugagaauguuuuauucauuuacaaugucccuuuccuggaaggguggacagcaagauuuaggacaagcuaaaaucauccccuauuuaaaaaaaaaaaaaaaaaaagucaccagcaaguagucccgggugggaggugggagcagaauaaaaaaaaaucugcaaugauuccuaauuguuuuucaauacagaagcuugggaagggguuucugccaguuucaugaggaaggcacaacuuccagguaguguuggggaaggguaugagguccuaugcaggcuggccucuuaucccacagaugccaagaugaugucuacuggcagcuccuccaaacuucuggcugucaccugcauugucacuguguccaaaagcagcagccgggagcgcaccaggaugucaugaccaccccggaacacaccuagaagggaagagagaaguacagauauauacagcagaagggacuguacagggcaggcuaaggauggcauuugcagcaacccaugaaggcagcucugguguagugaaacgggcaggagagcugggcugaaaucccugagugagggauuucacugugaaagucacugucucucagccaggcgcgguggcucacgcuuguaauuccagcacuuugggaggcugaggugggcagaucaugaggucaggaauucgagaccagccuggccaacacagugaaaccccaucucuacuaaaaauacgaaaauuagcugggcauggugguggacgccuguaaucccagcuacucgggaggcugaagcaggagaaucgcuugaacccgggaggcggagguugcagcgagcagagauugugccacugcaugccagccugggugacagagcuagacuccgucucaaaaaaaaaaaaaaaaaagaaagucacugucucucaggacuucaguauccucaacuacaaaguggcagggaugauaauaccauauuucaggcuucugcuaaguucaaaugaacugauggacauaaaaggcuuauaucucaugucacagaggcucuugcacguugacugaaucugagagcacaaaugaaggggacagccccaccacgagaaaaccacagggcaggugucugcaagacccaggggacuagguuguuucaauguggcuacaaacugucagcuguaggcaggguacugaagcagagccuccuuucaacccuguuuauaaacacucagccaaaaaaaaucaucccauuuccuuuuguuaacuguuuuagguaugauaauuguauuguccuuuaaaaaagggaaggggucauucucucuuagagaaacauacagauacaggauuuacauauaaaaugcuauuucuggaguuugcuaguaaauaaucugggaaggagaaugaguguggguacacucagccaacccuguagaaaauaagacaaaggauaugaagacaaugaucagaaaaggaaauacaaaugccucaacauuuaagaagauacuuaacuucauugaaaauacaaaaacuacacuaagauaucauuguccacacagacuggaaaagaucauaaagugugguaacauauuauguuguccacaguguaggaagaaagguauacaauucuauggaaggcaacuuggaguuauuuaucaagaugagaaacacaaaucacuuugaacuggugaugccuuggaaaauuuauccuacagauauucucaguguacacaugcaaaguaaacuguguguguguguguguguguguguguacacgauuauuuacuguaacaucuguaauagcaagagauugaaaucaaacuaaauguucaucaguaguggcuguuccauagaauauguggugcauccacacaauggaauacuaagcaacuauaaaaaaaaugaggauucaguuugggaugaaaaaaguucuggagauggaugguggucauaguuuuacaauagugugaauguacuuaaugccgcugaaccauacacuugaaaauggucgaaauggugaauuuuauguauauuuuaccacaauuaaaagaaaaagaaugaggaagcucuacauauugacggggaagaucucuaagaugcaauguaaagugaaaagcaaaucggaggacaauauauauaccauuuguacauaaacauuugaguuaaaaaaaggaaaugcguuccuauuagcuuuuauagccauaaaauaaccgcaagguuauacaaguauuguuuguaauaguaacacuggucgcuucucggaagggaaucugaauggcuggcagccaagguagggaggaaacauuucgcugcagauuauuuuauacuuugugaauuuuaaaugcugugaauuuugacuccccauauuuacaguggaguccuuagcccaggauccaguggcauccaggcuguaagcuauccaggcccuccccaucuagaaaugccacuuaccagccaggagcaacguguggguguucuuguuauccggcacuuugucugaccucucacaagggugcauucccaagaacuucacaauauuacccacagccucuguaaugagaaaucccaauauuguuaagccaucuuaucugcccuuugugccaccaccacucccccauguucugaagggcuuuuaaugaaguggcauuugacauaugugcuccagacauggcccuggauccuuggagagaaaagggaugagcacuucaauaguagccaaagaucuugaacaguaauuaggccagagauggcauucccaggauuuuaccuucaagugucuugaugguagacaaggugaacguuuccuccuucucaaauucauccccuaccucaucccaggcugcuucgaaguucaguuucaugaccuuuugaaugugaucagcuacaguaacuuccagaucuuccagcuggagagauggagguagaaaucaggcacccaucuacacaccuacgggccucugcucugaacucauccacacaucccuuccugcaacucuuuccacaggugcuugcucggcacugaggacugugcuagacucuggggacauagagcaacuugaccagguaccuauccuugaggugcccaaaggcaaaugguaucccuucaacagaaaacgcccuaaucccaaguaccaaucuacuaauucagccuagagccgccugcugugagaucacaucucuucuaagccugccuagugucagugcuuccaggaccuggcaugcagggaauuacauagcauucucagaggucugcuuccuaugccugucccuccuaggggaugaugagcucuucaggaccagcagcuguuucuaguucagcagaaacuagcagaaaccuccuaccccagcuguguccucuggauuugacagauccugaaucucuaucuccauuucagcugugucuucccugaacuugacacauaauacucccacugagucuacaugaagguuccccauucauucucccaucagauuuucacugaggcccuacuccuguggauguuuacaguguauauaaauacaacuuagacccagcucucucucucuuuuuuuuuuuucuucaucucuggaugggcucaaacagacccagcucucucaaggagcucacuuggucuuagagcagcuccugccucggggucauuuccagcucaaggaagguccauccauccucaacugugacucuaggaugacacaauggcgaaugucaguuguauuccacugugacugucccucuagucaggaggaguucuaacaguccccauccacaggcugagcauaauggucugcacucagauggcccugagccacugccccaaagucagaccucagaaggauccuguacuuaguuccaccgagcuaagauaggagaauuuagaagggcuauuccagugcaugaaaggacugcccagcacagcaaacaggucaaauuuauccagaaagcauuugacaagaggaaucaaaaugucuuaaaaucaugcuuacccuuugacccaacuauucuccuucuaggaaucuauccuaaagaaauaaucuaaaaugcagauaaaaauuuguaucuaaagggauauuuaaugcagcaauauaaauagugaaaauauggaaacccaaaugcccaacauuaaaggagugaaaagucaaucaaguuuugacauaguauauaacaguauuuuaaauccacuaaaaaaauuguguuuaugaaguauuuguaaugauacuggaaaauacacuaugguuuuaaaauagcaaggucuacacuguaagaaugauuucaauuauaccacuuccccccaaaaauaacucuaaggauuaugaguaauguuuuccuguuguucauacuuuguuuugaauuuuguuuuuguauuucccaaguuuucuuuuuacacaugaacauguauuuccauaaguuuaaaaaguuauuuuaggccgggcgcgguggcucacgccuguaaucccaacacuuugggaggccaagguagguggaucaccugaggugaggagaucgcgaccagccuagccaacauggugaaacccuaucucuaccaaaaauacaaaaaauuuggcaggcaugguggugggcgccuguaaucccagcuacuugggaggcugaggcaagagaaucgcuuggaccagggagacagagguugcagugagccgagaucgcgccacugcacuccagccuggguaacaaaagagaaacuucaucucaaaaaauaaaaauaaaaaaauaaaauuuuaaagagcuaaaaagccaaaaacagcuccagucucacugucaguuccugaagggaguugcuuugcagccucagcacaaaacugagcuuccugacaccaggaucuuaccacauacucauccucauagccuucgucaucagucuccccaguggugggaucacaguccuugacagugaacuucaucaugcagcugaaugugcaggccacuguggggaagagaggcuggguaguuaggauguccccagccugcaggggaugggcuccuccugcaggggacaagcaggcaggggucacagccugcuuucuaggccccugcuauguuauuaguagcagcaacaagccauccaaucccacaaagcuggacagagggugccaccuuguaggacaggaaagucaugaguucuagugagauccugucucuuuaaaaaaaaaaauuuuuaaagaagagcacuugggacucagcuauucuucuucuugggacugaaaucaaggagcugaagcucuaauagaaggcaaacagcuggugcccagccgcccaccuccuccugaccccaugagcucccaggaggauagggugguaucuggagaggggcucaccagcuguggggucuucuuugggcagugccaccaguguguagcaggucccgggcugguuguagggcaggcuccgggcaggcacguaacagagcaccucauaggccucagugggcuccaucugcacugugacauucuccaaggucuggucauugaguguguuugugcagucaaacugaacaggaaagagaggggagcuuaaacauugcacuagguccgagccaugcugcagaggaaaagccaggaggucccaccucuuuccuauugaccaaggugauucccaucccagucccccugccccagguucccugucuucaugcugacaaucgggagccauggaugucccgagucaagagauaugagagaccgaccuguuggggacagauucugucaucaaguugggcucccaaccaaugcaguguggggacccaugacccuacaggaccugccagaccugggacaacucccugggcgcaugccccagcagggccucagcccaccuugcucaccugaaaaaccaugugguuggugaagguguguuuggugcagcggaugacauacuccgucucugacucggugagggccacgggcucaggcgaggacuugaagaggggcccaagaccgcggaacucuggcacugcugccaacugcucugaaauccacaggccacauucacucagcuucucgauccccagaccaacuuguugaugguuucuaauaaauucccaugaccauucucaagguguuccacccuaccuuagauggauagauauguuuacccaacuggcuacucauuauuuccugaauauauccaugcauuuucucaucucccugacuucgcucauguggcacaaccccccacaaauacucuccccaucucuguaccaugaaagaccucagaagcaaaaaacugauaugagaccacaaaauccuagaccuaauuggagaaucccccagcuauagaagcuuagcaaggauuuccgcccccuaccgcagcaaggauucuuaaaagaaggugacaauuaggaaaauaagaucgauacugcuauagcuacaaaaucagacaaaauaacaaacugguccuauauauuuaucaguuaagacaaauggccaauaaagagauauuucagaaugagaguguugcagaaaaccuaacuuagaauuguuugugucugguaagaccuaucccuacacccuaugcccagguucaagcacuggauucaagcacaggcccaugggaccccacccuggcugguccuggcauuccuugcaaacuaaagggaauaacccaagugaaugaggcaucuggcagaugugugcacaugguguccaccuauaauggcuacagcugccacucuuguaccuauucuauggcaggauuccucgcacuaugaccauggaucaacuguaucagaauuacuagggguuggcggcagagcuugcuaaaaacucagacuccaucccaaaucuacuacaucagaaucucugguuucaggaucaaggaauuugcauuucuaacauguuuccucagauuauuccaauauauacugauauuuaaagaccacugcucuaagauuuucaacuugucuucccaauuaauugaacuccaugagaacagggauugugcuuugaggccauggaucugauauuuuucccuuuacuuagaagguacucaauucacguuucagacauagagaaagguaggccuuauuuuuauuauuuugcuuuuuuccuccacaaaaagucagccuaugugaccacuucagcccucugcagccugaagacugaaucuaaugaauaugcaggcaauaaaaagcccagaacaauccaggcuagauauuaggaggaacuuuugggccaccaugaccaucaaccacuagagugcuuuucuauugauauuuauuuucuugggacucagaguuuugggccugauacuuacucccugggggauucuguugguaggguuucagacucuucaucaauaaaacugauaucauuaucuugaucacagcguuguuguaaagacaaaugaggcaauaaauucaagaucuaggaaaguucuuggaacugaacauguaugugauuaguaaaugugaggcuuuuggaugauuguuuaaaaauggaauuguuacccuuuaagcggcuuaggagacuuccuuggaagguguggcagaauaaugacuccaagaugcccacaugcuaauucccagaaccugcagcuauguuaccuugcaugguaaaagggacuuuguagaugugauuaaauuaaggaucuugagcuagggguuauccuggauuauccagggggggccaguguaaucauaagggcccuucuagggcagaaggucagaguagagagauuugaaaaggccaggaguguggccucuucaaaucacucuacucugaccuucugcccuagaagggcccuuaaagacgguggaaggggccacgagccaaggauacgggccaccucuaguagcuggaaaaggcaagggggcaauaccuggagccuccugaaagaacucagcacugcuaacaaaugaaacccacuuuggacuucugaccgcagagcuauaagguuauaaauguguuaagccacuaaguuugugguaacguguuacagcagcaauagaaaacugauauaaauggaaaguuucauguuauagcgaucccaauuagcucaggauccaugcuauauugauauaagacaugauucugaguguaauggggaaggggggauuucauuuaauucaacauuaauugggagccuacugugaggaaggaaggcacugggcucagugcugugauagacgcagaaaauaaaagacagaacaugugaagaacuauuuagcacagagggcuguuuaagagaagacagaagagcuaggauggaagugagggcccaugaaggaagaggggucuaugcuuuuaucuacugaauucaguggauaaaacaaucugcaauuagacacacagccucuccccuuaaaaaugcaacaccagaggacagauggauaccugaagaaaaccuuacaagacaauguggacagaacacacguggaacccgacaaaaaguaccagugucuuugaaucccagcacugcucucucagacauucugaacuggccugggcuccagggacccgagcccuccaaauugaggcccaguaacagcacugagccaguuugaucgggaccuuaauuccagccccuccuacuacuuucucucucugaacuuccaauuccucagauauugaaggaacccaacaaccaccaccugagggucaaaugugauaguaggucuaaagcaucucaagggccuagcacucaggagagaccaauauaugacaguucuuacucuugaacccccugaggaaacuaagcccaggucccaagcaucccccaaccacugugacucacccuggaagaucuccugccugguagcugccacuuucucaggcuguuugacugcugugauggggguacuuucugcaggagcaaauuauacacgugaugaccaacagcuggagucacggggcagugugguggugaccccagugcuauuacucagggauuauaaauacuaacccuccugagagugggaagcagaagacaugugagagagcccacgucuguguguaugugugucucuauuuucuggagccagagguggaaaagaucauuuccuccucccagcauaacugccacccacccuaguuagguuaguggcuuugcagccaaugcagacccuccaacagaggccuggccuugauggccucugggaggaguauaaguguuaccuguucucugcucugccaugggcgccguggccaggggcacagacuugaggucaaaagguuuuucugaugguucuagaguguacugcugcagagcccucuccagaccagggauggacacagucagaccuggaggugaagagaggucaccaugccuggcagauagagcaaaaugugcaccagggaccaccauggaggcccuggggucccgaaguuacaaguccuaaguaguaugacccugagaaaaucacuuuauucucuaagccucugcauucucagacacauccucccuuacaggguagguguggggaauaaacauauauacaaagugacuuguaaaggguaaaguacuguaaaaauaaaguuuuuauuaaugaugagcguuucaauucacuggacaauuuccacccaauucaggugugaccugaaugacccgggaccuccugaggucaccaugaugccaugagguugccaggcaaguccagccaagagcaucuugccucugauuuccccugcccagggagugaugagaaccacagcuccaguaaggugcugaguccaagauagccagggaaugacucaccauuuaggauauagccugcauuaagggccuucugcuucugcuccaggacauuuagguagaagguggcucggucccuuacuucauugucaucauccaucacacaccugcagccaggacacaaggugguccugacugggacccagcagggauggcaggagggauccugcauggcuucauuagagguaaguccauagggauaacaaguagacuagugguggccccaggcggaggguggagggagugaggagaggccacacucaugaacacugaguucccuuuggggugaugaaauguuuuaaacucagguuguggugaugguuccaucacucugugaauaugcuaaaacccaucaaacuacacaucuuaaauggguaaauuguaugguaugugaauuauaucucaauagagcuauuuuuuuuuugagcuggagucucgcucugucacccaggcuggaaugcggggcaugaucucggcucacugcaagcuccaucucccagguucacaccauucuccugccucagccucccaaguagcugggacuacaggcacccgccaccacaccuggcuaauuuuuuauauuuguaguagagacgggguuucagcguguuagccaggacggucucaaucuccugaccuugugauccgcccgccuuggccucccaaagugcugggauuacaggcgggagccacuaugcccggcuucaauagagcuauuuuuaaaaaauggacaaaauaauucaaguuaccaauugucacaucugguuggugcaauuugcacagcauuguuuuucaugcuuuucuaugcuuucucuuuuuuuucuacaaucaguagcuguauaacuuuucucucccuuuucaguuaaaaaaaaauaaagacaaaggaaagcugcuuggguccaagggaacacuguccccauuagggccccugggccuagacucaccucuucagcaacaccaagauacuggguaacaucucuucauucugggcuccaaacuucgccagagcacucacagcaccuguguuuaggaagcgaaugugauuuacccaaugcacccugacaacucacuguuugggcacuuccagcacucagaaugggucuucaggcagaagagccccagaggcaagaagucucaagccaggaggcccaaagucacuaccaacagagugaguggcuuuggguggaucuuggcaccaucccaggccucaacuuccuuaucuauuuaauggagaagggcgccagaugggauuaguagcucccauucuaagguuccaggagcuaauuucaaauuaaccaugaugaggucacagaagcuggcuauaauguaaagcuccucaccuuccauauccaaauggcgucaauuugcaguuaaggcucagaauaauaaaaaugagaaagggaacaauuacuuaaagaucauuuauugcugaaagaagaaaaucuguccagugggggcaugaaaagaaauuaaaaauaaagaauaggaagguugcucacugaauuguaaacuuuauauaaaugggugaauuuuauggcaugugaauuauaucucaacaaagcuuuuuguuuuuuagcuaaacaucaacauacagugaaaguuaaaaaaaaaaucacuuaaggcaaggcacaguggcucuguaaucccagcacuuucagagacugaggcaggaggauagcuugagcccaggaguucgugaccagccuggacaacauagcaagaccccgucucaauuaaaaaaauacuuaaaaaauuauagggguuaagaaccauggccgagcacgguggcucacgccuguaaucccagcacuuuugggaggccgaggcgggcagaugaugaggucaagagaucgagacaauccuggccuacauggugaaaucccaucucuacuaaaaauacaaaaauuagcugggcaugauggcacacaccuguagucccaccuacucgggaggcugaggcaggagaaucgcuugaacccgggaggcggagguugcagugagcugagauugcgccacugcauuccagccuggugacagagcgagauuccaucucaaaaaaaaaaacaaaacaaaaaacaaagaacuguucaacuagaugacauguaagguccugccuacaauauuaugaaaaacagcuugugcagcaagaacacugagugcacaaauccccacuggaggcucaggucccuuugcugggacauuuauucaaggguaagcuaaguuuccaaguucagcccuggcucagaccuaccugcccggaccuccucaugcuccaagaccacucgguuauagaugaagcggauguacuuugagggauugguggucuugggccccuccuggcccaggagauguagaauacggguggccagcacugugaacucgcaguccucgaugaacucgcacagaugugacagcccugucuccuugcucucugaguucucuucaaugaugcugaugaugcaguccacgauagcgcgcuuauacucaaagccacccugcagagagaagcugagcuaagcaaggagccugcucucuccagaaaagaguugaagaccugagcuggaccaaggacaguuguccaaacacagaacuuggagacagggcacuugguucucugggccucuaucacucuuuccugucaaacaaaaggcuggucaggugcaguggcucacaccuauaaucccagcacuuugagaggcugagguggguggaccacuugagcucaggaauucgaaaucagccugggcaucauggagagaccccaucacuacaaaaaauagaaaaauuaguugggcaugguggugcaugccuauaauuccagcugcuugggggucugaggugagacgauugcuugaucccaggagguugaggcugcagugagccgugaucacaccaccacacuccagccugggugacagauggaggccgggcgcaguggcucacgucuguaaucccagcacuuugggaggccaagguggguggaucaccugaggucaagaguuugagaccagccugaccaacaugguaaaacccugucucuacuaaauauaaaaaauuagccgggcgugguggggggcaccuguaguccuagguacucgggaggcugaggcaggagaaucacuugaacccaggagguggagguugcagugagccaagaccucaccacugcacuccagccugggcagcagaacgagacuccuacucaacagaaaaaaaaaaaaacugcuaucaugcauacagugucuccaaagugcuaggccuggccaggcaugauggcucacaccuguaaucccagaacuuggguggcuaaggugggaagaucacuuauagccaggaguuugagaccagccugggcaacccagcaagaccccaucucuacuuaaaaaaaacaaacacaaucaccaaagugcugggcccauuagcugacaacucacuaaacauuagugcccuucuacaacaacauucuugggaaacgcaaagacacucaaggcaauggcuccucuacugccuaguccaugggccacucuggggcugggugaaagggguaccauguaucugaggaacaaaucuacuccaugaacaucugcuauugcuccuaagaauuaacccauuuuguugagacguccaagaaagguggcauaagugaaucaguaauucacgucgggaacagaaauagaaccaaugucguauuauuagcaccgguuucacaagaaaccacuccuagagcuccuggaauggucuagaauauuucugcacuagaguccaccagaaaagaacaugcauuuucccaucuucugcacaagcaucaccucaggacauccaguuuuuaaagucaggcuggugagucauaguuauuacuguaauuacuagcaauugguacguguuuacauguccacaaggaguuuaaaggguugcaggcaccaugaaaaccaguugguuaacaggcuaacauaagcacacgcacaaagcugagcauggagccaguggucaggucacucccugcaccaggagaccuggcaucccccgaaugccccugacucuuaccucuucccgcagcauggugaacaggaaguucauaaggacggcguguuugcgaggauauuucugacacagggcacugauggccuggacaaccaccaccuaaaugaaauagacgugcaugagcagcaggcccugccaccaagauggggugacucaguucccugagugcccacugaguccuuccuuagguaaggccaggccuugggcaugacacaagggcaaggagaccagaggaacucaacuccacgcuugaagcuugaagggcacaaucccugagcccacccaaggcagugccaacagccccagugucagacucucagacucuggguuccccaaacucugcucuucuacucaggcuucuuaagucuccgaguccccuccacccaaccuguccugcuucucucccuaccacuggcucccacugaugguucccacccaucaucuccucuggcuccuuuuugguuaagccugucucugggguauucuguccuuggccgcuucucuucucacagucucuucagcaaucuuauccccucccauggcuuuaaccgccucuuauaugccacugacucccaauauuuaucuccugucugagcuuaagaccugccuuuuccaacugccugucagacaacuccaccuggcgcccacagcacuucaaacuccacaugucugcaaccacaaacaucuccaucuccuucccccucccucauccaauaccccaucuuuuccuccccugcaaacuagucaagagcaccacugucagcucaaaguagaaaauggcaucaucucuguugacauccaccccucaacccucacaccaacccugccaacaggcauuaucccucaaaaagcucuugcacugucccaccucuccuacucccgccgguucaggcaccauccucuccuucugaauuacuccaacagucucuuuacccagucaccccuccacucugcuccagaaggacucuuuuuuuuuuuuuuuuuuuuugagacggagucucgcucugucuggagugcaguggcacgaucucggcuuacugcaaccuccaccuccaggccaggucaagcgacucuccuaccucagccuccggaguggcugggacuacaggugugagccacuacaccagcuaauuuuuuaauuuuuuuaguagagacaggguuucaccauguuggccaggcugaucucaaacugcugaucucaagugaucugccgaccucagccucccaagugcugugauuacaggcauaagccaccgcgcccagccaauuuuuuuuuuuuucagacaaggucucacucugucacccaggcuggagugcaguggcaugaucauggcucacugcagccucgaacuccuggguucaagugauccucacaccucagccuccagaguagcugggacuacaggugcgcaucaccacacauggcuaauuuuuaaaaaaauuuucuguaggccgagugcgguggcucacgucuguaaucccagcacuuugggaggccaaggcggguugaucaugaggucaggagaucgagaccauccuggcuaacauggugaaacaccgucucuacuaaaaaauacaaaaaauuagcugggcaugguggcgggugccucuagucucagcuacucaggaggcugaggcagaagaauggcgugaacccaggaggcggagcuugcagugagcugaggucacaccacugcacuccagccugagcaacagagcgagacuccaacucaaaaaaaaaaaaaaaaauuuguagagaugaggucuugcuacauugcccagacuggucucaaaauucaggccucaagugauccucccuccuuggccucccaaagcacugagacuacaagcaugagccaccgugcccagacccagaaggaucuaauaugcaaaucucacugugucauuucagccugcaaagcauucuuguaacccacaggcagaguagacugcugccuacuuugcauaauccacacuauagaauuuaccacaauauauuauucauauuauuguuugcucugauuaaaacucuccggugacauacuucauuguucuaucaauuaacaauugugaaauaacagaauuacagaaauugagaacaaauuaauggcugccagggguuagggaauagagagguaggaaugggccugacuaugaagagguaacaagagucuuguggagauggauaguugagugucuucacugugguggcaauuuugaaagucuccacaugacaucuugcauagaacuucacauauauacacacaggaguugccuguguagcuggugaaaucugaaugagcucuaugggucaugccagugucacuuuccugguugacauuguccugugcuaguguaggaugcuggcacuguaggagaggguugauggaggggugcauaggacuucucaguauauuucuuuguaacuuccuaugaauuauuucaaaauauaagcucaaaaaauauucacauccuuccuccugccccaaaagaacaccuuuccaaugucuuccuugcaauuaaaacucuuuaccugaccaugggccuuacaugauugagcccugucuauucugacuuugucaccugcacuggccccacagcucuuccacccacuggccuucucucuccuugacuugcuccugccuuuccuccugguucuuugcacugauucagguuugagcucaaaugucacccuccagaagggccuucccagacugugcucuuccuaggaucaucccugcuguauuucuacacucuugacugcaguacccaugccugagaugaucucgucuacuccuuucuuuaccuguuuacuguuccucucccaucccuagaaaggaagcuccaggagggcagucaccugcuuuguucacugcuauguuccccuuuugucacucuacauagcagacagcaagugcucaagaaauacuuggacaacaaaucaaugaacccuuaacuggccuggaaacuacuguucuuucaguacaaggggacgauauggauggaggccuggaggcaggacuacgcacauuucucggaaggccaagucucugcagagcaaacugcuggccuccucugaguccucaaggcugaccagccccucaggucaguccuggcaggaaggcuguggccacagagagcagggacagagcuccuuccucugggggccguggguguccuggggguagcagguaccuugaauucauccgagauuucugacaugaaggaggagaucugcuucaugaggcggucgaugcugcucucgcugcccgucuuaaggaggguggugauggccagcguggcaaugcugcgguuugaaucugugaccagguucuccagauccagauuacaagcugucacagcugacggaugcuucauggcaaccuguuuugggaggacagugacagagagggcaggaacccaaugcugucacuacauuugaugguuuggcccagucagaaguccuuuggaugagaucaucucaccaucuagaagaaacuaacugugaccagggcuauuauccuucccagccaggucagaggcuaggacacaccuccaguuggaucagacagcuuccuccaacccccaagcuggacucuuaccuuauugaggguacgaacagcagcauagcggagagcagccuugggugagcugcagaaaagcuggagcacuguggggagauggaugccacaugucagguugccuucacugcugggcagcugggaaaaccgggggcuacuguucugacucaaacccucugcucagcucauuucccugcugacacccccaucccaacccaagacacagagcuccccucacccugcgcaccugagccauggacagaggccauaaugucugugagcacccagggguuccagugagggcuguuauucacugggcaucugcugugugccaggugcugugcuauacaguggacaugccucacuucuauagcuugcagccaccacuagcccacuuuacagauaaggagacugaggcacaaaggggaaagcaaacaaacuuuagguuggcagccaguaaguggcagaaccaagauuaaauuccaagacugccugcaccugcagccuaagcccuuaaccucugugaaguaauauuccacuccucucuccuacugugucuacaggauccaacagaacuucccccuuggcaccaagugcugaagaacaaaguccucucuuaaacaaaugguuuauuuccuuuaacuagaugagagccauucggguaccauaucccucccuugcccuggcugcccggaagcucagagcuaaauuuggcacucaaucauaggagcgaagaugacuacuguuuucuggaauaucuauguuccuuucuucauaacuuggcuuuuauucucuaauacucaaaaaaaauuuuucuuaaugcuuauuuugaagacccuacuuuauuuacaucuuucauuauucuggaaauaugggggauauaauaagaaugaaugaauacccaaaucagugacugaauucauuaguucuuuuuccauuucuuuuuuuuuuuuuuuuuuuugagauagagucucccucugucgcccaggcuggagggcaguggcgcgaucucggcucacugcaaccuccaccucccagguucaagugauucuccugccucagccucaugaguagcugcgauuacagaugcgcaccaccacgcccggcuaauuuuuguauuuuuaguagagaugggguuucaccauguuggucaggcuggccucggacuccugaccuggugaucccccugccucggccucccaaagcgcugggauuacaggcgugagccaccgugcccagcaguucauucuuucuucauuucuaaggaggaaaggagacuucucucuccaaacaugaacuccaucuguuugccugaccaaguuuacacuguuauaguagagaauaauagaaaaacaagaggcccaaucauuucucaaaaccugcaaaucuaacucuccugccacaacaucuuugcuuuccaugggccuguucuaaaacacuccccucuucucuuccacuuugaauccagguuucucacccuaagcaccucuccuuuucuagccucucaacauauccacuuuccaguaccaaccacuuugcaccucuucauaggcuuucuccucccugacaggguauucccacacccagagcagggcccugcacagaggagacaccaaagacuccaggacucaaggcugcuggauuccccuuaauaacagcaaacaacggcugggcgcaguggcucacgccuguaaucccagcacuuugggaggccgaggcgggcggaucaugaggucaggaguucgagaacagccuggccaauauggugaaaccccaucucaacuaaaaauacaaaaauuagccaggcgugguggugggcgccuguagucccagcuacucgggaggcucaggcaggagaaucgcuugaaccugggaggcagagguugcagugagcugagaucgcaccacugcacuccagccugggcgacauagugagacuccgucucaaaaagcaaaaacaaaaaacagcaaacggcaaacaacaaacauguugccuucuaagcaauuugucuagaucacacauuuucuggcuauauaacccuauguaauaggcaugaucuaucauccacaucugagaaaagaaaaggaaggcauggagaggaugggcggccuugccaggcuugcccaguugguaaggggcagagccagggcucuaacccaggcugcccugcuccagugcuggagcuggaggcucagaacgacccucuauacuguucucuccuucaccuggaaaagugcagccccacuucacaugcaccaguuucacagauccuggguuccuccaccaggccuccuccuguggccagccaaccugacaggcuccagaguggacccgagccuuaccucagccucuucagcagucagauggaacuaacagcagcccaccaccaaaacgugauacaaguggggacucagcauagugucuggggcaggugcuuccuagguacagacuccuuaacacuuguuaagagcauuuucuuucuuucuccuagcccgggaacccaggccuaguucccagcaagcauaaacaugugaggcugggugaaggaaugcccagugaccugacacagccggggccagcucuuuggcacugcagccuggcagauugacgauggccgaggcggcuucauacaccaccaucucgugcuuguugcgcaagcagcucucgaugaagucaaacagugggcugucacggcuacaaaagaacauaggguggcaagaaaacguuggggguggcccagcaugguaggaugagugaggcaucaucuagcuggugagagaugagagccguuaccugccauccuccucuuccagcugcuugcuggccacccggaucaucaugcaguaggcaaagggagacuuaaggccaugccgugugaccuugcugaucaucuuauugacggcuaggcggucauucuuacgcacaugguacaggagcccuagugcgugguacuauaggacaggagacagcaacagaguacaaauguaugacuuuuggguauacuggcuguguggcccuggguggguccuucagccuucucauuucuaagaugggcacaguagcagcuaccacacagaguggcugugacaacugccccagguacucuguguacacagcccuccacacaaugcuucacaaaccacagaaguauaucugugguucuuguucccaccccugcuucggcaagagcccuaacagguagcauaaauacagauauggaaagggacaacaaacagcacaaagaugaaagcaaugugggagaccuggugcuuucaaucagacaaugagagagagaaggugggagccagacccugagcauugucauguuuuguaagucacugugugggacaccuuagccaugaaaucuugcauuacccacaacaacccugaagguagacaguuuaaucuuugcugacuugcccaaagacuccuggcugguacugacaaagcuaggccuggagggccagaagcccagagacucccuuucuaaagaugugaggucucauaguuauuuccuguccucgauacucucuuuuguuuccuaaaggagcgacauuugggggcaaagauauggcagcuguggaagccuucuaugugggaagcuuaucuggcccucauaaguguuuugaggggccacagcuggcccugaagacaagaaucgugcaaaggaugagaagacagaugagagauaaagggaauacauaaacacacagggagcgccgauaggcacucaugacccagaugggucacauguuacaugcaugaucucagcucguccuugcugcuuugugaggcaguaaccuucauucguauuuuacagacaaggaaaccaagagccagagagauaaaaggaacggcuguccuaggucacugaggaagaguaaaguggaugaaagccucaucaagauaauuccacacaucauaacaaagccaggcuggcaaaggccuaaauuuaggcggcccucugccugccuuggccaaguuugccacaucauaugcuccaaaacaauacucagcugguuaucaaaauacuugaauauuucagcaccagcugguaagcagucuguaacccaagcgccccaagugguacccuggauucucuaacccaggaccuccuaauuccucccaugauccaaugacgaaaggauuaaagccugcuauggccaggggucacaaggaucucgguggcaaguguccaugccaacuggccagugccuuaccaccugccugaguguuuuaaauaucacucccuugcucacaucucaccuggaccaugauguuaucacuggaugcugccuccugagccucauucacccagcgcuugaccacgucaaagcugcacuucagcaggugcugugggcaacaggacacauuaaggggcagguaggaaguguccccaucacacauucugggcccaguucuggucuucccucagacacagcucaggggcucgccacuguccugguccucagagaccauggacaaacucaggaugcucccacccucaaugucccuccccaaggcaugggucaacaccauccacccacgacucucuucaaucaccccagaguuucuuggcugucuucacugagaagggugggacucucaggcuuacagauacagaaauacuuuauuuuggccaggugcgguggcucacgcuuuguaaucccagcacuuugggaggccgaggcggguggaucacuugaagucaggagcucaagaccagccugaccaacauggugaaacuacgucucuaccaaaaauacaaaaaucaguugggcgugguggugcacaccugcaaucucagcuacucagguggcugaggcaugugaaucgcuugagccagggaggcagagguugcagugagcugaaaucgagccauugcacuccagccugggcaacagagugagacucugucucaaaaaaaaaaaaagaagaaagagaggccaggcacaguggcucacgccugcaaucccagcacuuugggaggccgaggcggguagaucaugaggucuguaguucaagaccagccuggccaagaugaugaaacccugucucuacuaaaaacacaaaaauuagcugggcacaguggcagacgccuguaaucccagcuacucaagaggcugaggcaagaaaaucacuugaaccccggcggcagagguugcagugagccgagaucguggcgcugcacucuagccugggugacagagugagacuccgucucaaucaaaaaaaaaaaaagaaagaaagaaacacuuucuuuuuuccuacuggaaugugacucuuaaauuuucuucaauuuucuaccccacccccagcagggcuccagcagcaacuacacaccaaggaagacacgagggcagagcuggagacacugggcaccuuguccacaauggcuuguuucauguagcgcucaauagccugcagcauggugcucugugggcaaaaggagcaggguggaaggagauccagucaguccuuggcagcucucaggagugcaggaaugggggcagagaugaguaugaggaggaaguaagcguuucucaugugcuccugcacacugccuccaccccacaucaccuggcucagugauaggggacaccccaaagaaugcaaaagaugaugccgaggccucaaucaagaggccaggaagcagggaggaaccggcacgacucacaucagugaucuggcagagggcucgcacggccgggccccgguaguugucuucuuucccagucaugucuuuuguuaggcugcagggaagaaggcauugucagcaugcagagagccugggccuguuuacuccucuccagcucccaacaccacccuugcccagauuacuacacgagccuccuaaccagugcucucccucuauuccugccccuccaagccuaacuccacacagcugcuggagggaguuucauaagacucaaaaccaaacaggucaucccccugcuuuugcuaaaaaguuuccauagcuuccuacugccagugaccugaauguaacuccuugaacuucccuaacuggcuaugcucacuccucuccagccuuugcaugugcuguuuccucagccuguagcauuccucaccccucaccuccacucuguccuacucuuuuuuuuuuugagacagagucucgcuuugucgcccaggcuggagcgcaauggggugcgaucuuggcucauugcaaccucuacaucccgagcucaagcucuacugccucagccuccccagcagcugggacuacaggcacaugccaccauacccggcuaauuuuuguauuuuuaguagagaggggguuucacuauguuggccaggcuggucuugaacucccgaccuugugauccacccgccucggccucccaaacugcugggauuacaggcaugagccaucacuccuggcuuuuuuuuuuuuuuuuugagacgcagucucguucugucacccaggcuggaguguaaguggcaugaucucagcucacugcaaccuccaccuccccaguucaagcaauucuccugccucagccuccccaguagcugggauuauaggugugcgccaccacaccuggcuaauuuuuguauuuuuaguagaaacgggguuucaccauguuggccaggauggucucaaacuccugaccucaagugauccacccaucgcagucuguggauuacauuguggauacagugcugggauuacaggcaugagccacugcgccuguccuguccuacuauuucuuacucauccuucaggacuccacuuagaucauuccucugggaggacuuucguaauucuaaucaagcuggaugcucuucuggucugcucucauagcccauaauacuuccgugauaaacuauauuacacccuaccuuaauggccugaugccugguuauuucucuguaaauucuggggcuacagaggccaugucuaucuuuuuuguugcuauauccccagagcuacacacagggacugacagacaauauuuucuaacugaaccuacaaaucaauguaugacccccacaaccuuaaacuguggcaggaagaaauaagagaacugagccccaguucuuaagggcagugauuacacuuuagucacaucugucccugaauugcuuagcuuaaagcagacaccagucacuuaguaagcaguauaccgcuuguacucucuuguuuauuuuucuuguguucucucuuuauacucaagaaagucuuugggaaaguucuaagcugguuugguugacuaagagaaaucaagaaaaggaagcauuuguguccaagucaaggucagagaauuaaaauagaaacagcacaccuggaggcugccauggggugggcagugguaacagggaagcugccacggggugggcagcuggcaauaugcaaccaagucucacugucugguacacacaagaaaaaaauggucugucaauggaacccaucagaagagccacccacaaccccaugacuugccugcuggugacaaugaugacauccucugcaaugcaagacaucuccuugauggucaaguagcacauccgacggagugugggcugggagauaggugggaaaagcccuaucagcccgggcucaccaagggccagaguugggagaagauaccuccugucuccacaaaggcagcccacacugacugguggggccagcucucuuuggcccucccaccaccuuguuacagcugccaccucucaaggaaagcuggguugaggcacuuacaucauuggacugaaagagcuuggucauggcaaagaaggccucggucgcuuccgugguccccaggugcucccccuguguuaaucaagaaagaagucucagcuugggacagagggucagacagcaguucuuucaggaucagcccacaccagauccccagacccuaaagaggcucaagggcaacauaugagacuuggaugcugaggggacccagagcugagcuguugucuacagccacacagaggcuguccaauagccuaagagugaucaugauuuguccacuccccuccaaucccccagcaccauucucccuacccgcaagcuucacccuguuaccugguuuaugagauaaagaaucuuggugaggaugugggcacauuuccgaggguugaugggaguuucauuaaauacacgggccuaagaagaaaugaccaaagauguuaccuucuagccuaguucauuucccuucaaguauauucaaugucugagaagucucaggguaaacugacuugucuaaacagggcuuucuggguaugcaacaagcuuauuuucauaaggaaaggguuuguuuuucuuuaaucaacuacuaauuauucuuagacucucguguaaauauuaguuagggaugugcuaaccuauugacuagcagauacuuagcaaccaucugcuaacuggaaacagaaacaaugaacgacaacaauaaagaaagaagcggcuggacgcaguagcucacaccuguaauccuagcacuuugggaggccgaggcggguggaucaccugaggucaguucgagaccagccuggccaacauggugaaaccccgucuguacuaaaaauacaaaacuuagccaggcaugguggugggcaccuguaaucucagcuacucgggaggccgaggcaggagaauugcuggaacccaggaggcggagguugcagcaagccaagaucaugccauugcacuccaccccaggcugacaccagcaagucuccaucucaaaaaaaaaaagagaaguggccgggcgcgguggcucacgcuuauaaucccagcacuuugggaggccgaggcgggaggaucaagaggucaggauucacaccauucuccugccuggccaacaucgugaaaccucaucucuacuaaaaauauaaaaaucagccaggcauaguggcgugcgccuguagucccggcuacuugggaggcugagacagaaaaauugcuugaacccaggaggcagagguugcaguugagccgagaucgugccacugcacuccagccugagcaacagagugagacgccuucuaaaaaaaaauacauauauauauauauauaaaaaauauauauaauaaaaauaaacaagucaugcaaaaucucuaccugcauaauggccacagucuagcuuaggugauaguuuuaaaccaguuuccuuagcuuuggaauuaacuuuaaauagagaaauuuuuuaaauguuuaaauagagaggccaggcgcgguggcucaagccuguaaucccagcacuuugggaggccgaggcggguggaucacgaggucaggagaucaagaccguccuggcuaacgcggugaaaccccgucucuacuaaaaauacaaaaaauuagccgggugugguggcgggcgucuguagucccagcuacuugggaggcugaggcaggagaauggcgugaaccuggaaggcggagcuugcagugagccgagaucacgccacugcacuccagccugagcgacagagcaagacucugucucagaaaaaaaaaaaaaaaaaaaaaaaaaaagaaguaagcauaacuaacucucuccagaaacaaaguuuuccugucuuccagaaaacuuccaggcacaaguuuucucccguguugcucuuuaaaacaacacuuugaauguguugguauuucaguugcauugguggugaauauuuaugauggaagcuagaggggagcaaaugucacuugccuccuggaguaccgcacucuucucaaggugcuggaauggguuggagccuccaccuacggucaaggacaauggagaagguagguugugacucugaacuucaaaacucucccagacauagguaaagggaagaugucccuuccuaggaaaucuaguaaaguucaaacuccucaggaauggcaaucaagccucuacaaucugucuagggauccuacuagucuccugcaagcaggugggcuccacucuaccccaaaccacucacaaucucccagcagcccugguacaguccugugcuucucauggugccaugucuuguguucauuuauauaacuuguaauuaacuaagucccuaugugccagggaccaccaucucguuguaacuaguuccuucauagcagaugacacauuugcaaauaauuacacgugugauuaucugguugaugucugccuccuccaucgugggugcaaccauucuaauauuccuagcucaggcacugagugucccacuugcucuguugcaguauccaggacaccguacaguaccuggcauacaguaacugcucaauauacuuugcugaauaaaugaaugauggggucagaguucccagucacaggacgcuggcuccgcagguuacaccccaguuuggccagcaccaacguagccccagcgaaucccaagagguuggacgaagaaaguaacaagagaacauucggcaugguccccuccuuugacagauggguaaauugaggccuggggggggggguguuugucgcgcccaaggucacccagaaaauugcaguccgagcuuacaagagugagacagccgcgcaugcucgggcucuccgaggccugccacugacuagcuguggacccuggcacaagccccugccccucacugggccucagccuccgggucaggacagagaaccagaaggaaagcucggcggguggggguccggccucccucagacccaggccuggcccccucaccugacuccucauccuucuugucgaauuucuucaacauaguggagucgguggggcgcaaugcagcaacgcaaugcucgacgggcgcggcacggaguagcggugccacagugguucuacagggaccacuuccgggcccc

SEQ ID NO: 191654 - RNA, 1507 nt, Homo sapiens
cgcgcacgcccagcgaguuccagaggcgccaguggaagcugcggcggcggugucucgcguucggcgggauuucucuucgcuccggcucggccuaggucuacguccccagcuccagccgccggcucggacucggucucugacccccaacucgguccccuaguccggccccggcuccgggccccccaacccucgcuccggcccggcccggcccccaccccagcccugccgcccggccccaggcccggccgcggccgcucccgccuggagccgccgcgcgcccccagccccccugcacccccucggccccucgccuuccucuucccggcgcggccccccggcuuccgcgcgccgcccgccaccaauccucuugcuaccauguccguggagcucgaggaggcccugccagugacgaccgccgagggaauggccaagaaggugaccaaggcuggcggcucggcggcguuguccccaucuaagaagaggaagaauagcaagaagaagaaccagccgggcaaguacagccagcuggugguggagaccauccguaggcugggcgagcgcaacggcucgucgcuggccaagaucuacaccgaggccaagaagguuccgugguucgaccagcagaaugggcgcaccuaccucaaguacucgaucaaggcgcuggugcagaacgacacgcuucugcaggugaagggcaccggcgccaacgguuccuucaagcucaaccgcaagaagcuggagggcggcggggagcggcgcggagccccggcggccgccaccgccccggcccccaccgcgcacaaagcgaagaaggcagccccgggcgcggccggcucccggcgcgcggacaagaagcccgccaggggccagaagccggagcagcgcucgcacaagaagggcgcuggcgccaagaaggacaaaggcggcaaggccaagaagacggcggccgccgggggcaagaaggugaagaaggcggccaagcccagcguccccaaagugcccaagggccgcaagugagcgugucggccggucagagcggccggcgugggcuuuucgguguuuuuguuuuucuaccccaagugacguagauuuuguacggcucacgccggccggggccgcgaggccuggucugagccucagggaggggccccggguccucucagucuuuccccucccccaacgauguagcguuuuucguuguuugcuuuagguuuuugaaacagccccggcgacgccucuauuggcucucggccuuggcaacggccgucgucaugguuacuggccccuaggcgccgauggccgaggccgcgccugcccaccgggcggggucgcugguuggccgggcccaggcgcgcggggacgcggaggccgcgcauccuuucccagcuccccacccuccuugccuuugggugcgcgacaaacaaucgcuccgggcucagggcugcgcggcucuucccuucauuccaugggccuuuuuuugggcacaauaaagcguuuaaaccuuuca

SEQ ID NO: 191655 - RNA, 88663 nt, Homo sapiens
acuuccgcucggggcggcggcgguggcggaagugggagcgggccuggagucuuggccauaaagccugaggcggcggcagcggcggaguuggcggcuuggagagcucgggagaguucccuggaaccagaacuuggaccuucucgcuucuguccuccguuuagucuccuccucggcgggagcccucgcgacgcgcccggcccggagcccccagcgcagcggccgcgguaagcagcgggcccagcccggccggcggccuggccccauccccccccucagccccucggucgccagggccucgcguccucccuguccuccugggcaggcuccagucccagcccuggccacgcgggcacacccggcaucgcucaggcccccggagcaggccaagaccccacccggcuuggagaggucggaggucgucgggcgugaccucuggccggguugcccgccccggccacccgucucggacgcucuguuuacuguuggccuggaucucagagacccgagaggguuccuugacuugggcggcccugcgccgcggcaggacgcgcuggccaguggaguuccuuagcgcggcgagcaggagggugucagagcccacgccgcccgccgccgugcccacccggcgggcaugggucacaggcgcugggggccgagccgcguucccauccgguucuucaguugaacagccugacccuguuagugggaguucccugacggcaacugagucaaggcagugagucaggucacgugcgcugggcucgccucgacacuuguguacauugaggcgccucuggcgcugggagacagggagcuuuuuguccuaggcauguuacgguaaauccugagagaaguuuuucaacuuaaucgaggaaagaugguaguuggauguagaguuguguuuccauuccgaccguguuuggggccucuuucugcauucauuuuaggcuugauaccuaauggggucauaaggggaauauugagaauauugacagcaaauauuugagcguuuauuguaugcuaggcagcguggcaagaccuuuuaacagaucauuauguuuaguucuuugaacaacccucugaaguaccacuguugugcccacuuaacacagugggaaguugaacagagaggcuaagccauuuggccaaggucacacagcuaauaaguuacgaagcagagaugcaagcccaggcagucagacuccagagcacuguauuaaauuucuagguuguacugcuuucacguaccccugaagcuugcugguuuaucuuuugcuaccugguaucuguaccucagugccucccaccaccuccuuucuuucuauugaugucauuugaaagucuuucugguagcaucaguucucccuuaaagccauaagaaaugccguuugcgacuuaucacacauauugugguguagugucaccgaauuaggagcucuugaauaccggcaggguacuuaacugagguuugaaaaauuuugcagguaggccuggcaaaccugccuagugaaccuuucuuacaaccuuaguugauggcuguccagccggcugguucuucccuauucaaaauacugcaucuuugguuuccuaaagaacggacucuugucucuuucuugugacuuaagcagcugaugaagcacaugauuucucauccauggaugaauaaagucuccucuuaguguguuucucucuucaaacuugggaagguuuguucagauuugaguuuaaggacuggaaggugaguuaggaguacuucuucugaagaagggaccggcuaaguuaaagcuuagcguucacaauccuguuguauucauauuugucuuuuuuuuuuuuaacuuugcuaccuagccuaaaauauuuaagugaguaauaaguacuguggcuuuauauaauguuugaguuuagaguaaugauaggcaccuuuuuauucauucauuaaguauuuugaguauccauugaguaucagcaauguaucaggcauugugggacauugacucagggagauaggcgugguuccuguccucaaggaauuuuuaaaaggugaaugaucuuggccagaaauucuguuguggaauaauuuggcgguagaacuugaggcuuuuuggaaagaguuauuucucaucucugcuggugaaucaguaguaacccaaaggaugguguucuucuggcuaacuuuaaggcuuuguuaauuuuaacaacagcauuuguaugguuugcucuucagagaguguagaagauaauauuacaguuucuaauuaaucacaucuuuuaaagaguaaccuucaacacucaacuuguuucuccuuuugcucuaguggcauuuauuuuauuuuauuuauauuuugagacggaguuucccucuuguugcccaggcuagagugcaauagcgcgaugucggcucacugcaaccucugccucccggguucaagccauucuccugccucagccucccgaguggcuggaauuacaggcaugcgccaccaugcccagcuaaucuuguauuuuuaguagagacagguuuucuccauguuggucaggcuggucucgaacugccuaccucaggugauccgccugucucggccuccgaaaagugcugggauuacaggcaugagccacugcgcccggccgacucugguagcauuuuuuuguucacucaagagguaguccaugucacuacuguaauuaccuugcacugccaugucuuugagcaaagguacauuuggcaugcuggauuuuuuucuucagcuggcaagaaaguuuaauguagcacugauaguguacuggccauaguuucaguaccauucuacauagaaaagcuguguuacccuaucucccacaacuuucuagauucccuucuuuaagggaagauuuggauuuuacauuugugguagaacugcauaaguaaacagaggguggaauguagaagauagucuaaaaauaguuuuauuaguauauccuucuagguaguuagcaaccacuuggggcaauuuuuuuuaaaauuuuuuuuuagugccaacugugucuaagcucaccaacccuguaaucagagaacaacucuuuauaguaaaguguggcuuugaaucaguuuucugaccccacugccaagugaagccaaaaaauuuugguuauuugauuagcuuuuaauaugucuucagcugggcacgguggcucacgccuguaaucccagcacuuugggaggccgaggcagguggaucaugaggucaggagaucgagaccauccuggcuaacacagugaaaccccaucucuacuaaaaauacaaaaaauuagccgggcgugguggcgggcgccuguagucccagcuacucgugaggcugaggcaggagaauggcgugaacccaggaggcagggcuugcagugagcagagaucaugccgcugcacuccagccugggcgacagagcgagacuucuucucaaaaaaaaaaaaaaaaaaagucuucaaagggaucuucacuaauaacguuuuugcucuuacuuuggcauuagacuuuguaaacaaagauguagcaaacacagaccacgcaaauaugacaguugucuuaugcacauuccucucuggcauuugacacaaauauuuuaguuuuuccuaugauaaaguauuuaucuccccauucauuuaauucaacaaauacagcugagauagauuugaccagauguuggacuuggagcuguaggcaggcuuuuccuggggagguaaggauuagaaguccuccugaauaaggcuaaacagagguuccccuuggcauuaaaugucuucuucugaaggcgacugaaacucgagaaaugaacuccccgccuccccccuuauuuuuuggcuauuggcuugcuguugaugauucuuaccucucauguaaggaaggcuaccauuguauucucaggcauccauuccuuuguguuaccacaugcuuaucuguuaauauuaucuaauaguucucuaugcuucucugucugcaguuugcugcagaaacauuuuugcaauaugcugaucuuuucaguuauuugcucuuaaaucuucuauucuguuuuuccccacacuccauauggcauuaaagacagaaaaauaguuuguguuuuaaaacuuuuuuuuuuuuuuuagacggaaucuugcuuuguagcccaggcuggagugcaguggugccaucucagcucacugcaagcuccaccuuccagauucaugccauucuccugccucagccucccgaguagcugggacuacaggcacccaccaccacgcccggcuaauuuuuguauuuuuaguagagacgggguuucaccguguuagccagauuggucuugaucuccugaccucgugauccacccgccucggccucccaaagugcuggaauuacaggcgugagccaccaugcccagccuaaaacuuauuuuuaaaacauuucuuaauggugguggucacugcgauuugugaaucagagguaaaagugauguggcgagugaaaucaaaacaaguuuuuuagcagugucuguuaccaguuucaauuuuaguaucccaggcugugauuacaaaaacauauuuaagaauagcuacuugcaaaauaucuccuugugggaggaagaaagcuugggaguugguuccaaugcugaccuacagcauuggccuuguucauuugcuugaagaugcaguacuuaacucauggggccuggagucucuguuuuggugauggcaucacugcugagaaauuuaaguuugccugauucuguuguccacuucugguguccugggacugucuacaguugggaccaagcaaauccaagggagccuauuuaaggggagccugggacaagggcaguuuaggaauucuccagccuugcuugucucuuaguugguccuucuuguguggcugcugccagauaaaggaaaggaaguucucucuucucccucagccuuuccuuuccagcuuugcuucauacugcugggcauuaaccaucucagaucaggaguccuuuaaaaguuacuuagugaaguaaauaguuacaucauugauuuccaauauugguauguaaguguaauaaaaaguugguuuccauugaauaagcuuuguaguuugaguuauuugagagugcauaauuacaaagcugcuaugaauuaaccuuaaauaaccaagcauagacuuuaugaaaaauagugucccuuauaugugguauucagucagccuaccaacaguucuucuguucacuuacagauaugaggaucccugagauaacugcgggucauuuaaaacccacucuuaaauccucugaccugcaccauguuaaugguuguuaaaaaagcgauaacauuuuguagaaaccuuccuacacauuugccuuuaaaugcuuuuuaauguuucugugguauuuguaguuuacaugugauuucauuuggugcucacaacuguuguguguaucugccugaaauagcugaggcuguaugcucagguggcucagcuggaaugucagucuaggucugcuaacucaguucagugcucuuucugauguaccauccugccuuuccauuauaugcuagugcccuaaagaccacgacauuucaccccuuguaaaaguguaucuuucggccgggggcgauggcucacaccuguaaucccagcacuuugggaggccgaggaggguggaucacagggucaagagauagagaccauccuggccaacguggugaaaccccgucuauacuaaaaauauaaaaauuagcugggcauaguggcaugcacuguagucccagcuauucaggaggcugagguaguagaaucgcuugaacuggggaggcggagcuugcagugagccgggaucgugccauugcacuccagccuggcgacagagcaagauuccaucucaaaaaaaaaaaaaagugucucuuucuuccacuaccuuuuuuuuuuuucucucucugagacagagucaagcucugucgccaggcuggagugcaguagcaugaucucggcucacugcaaccuccgccucucggguucaagcaauucuccugccucagccuccugaguagcuggggcuacaggugcacgucaccaugcccagcuaauuuuuguauuuuuaguauagaugggguuucaccauguuggccaggauggucucaaucccuugacccugugauccgcccgccuuggccucccaaggugcugggauuacaggcgugaaccaccacgccuggcccacuaccuuuuauuuaaaaugauacgucuuuuuugcugauuauuaaacuauucaguuaaaaaaaaaaagcuaggaaaauucagaaauauaaagaaggaaaauuugugauucacuaccccgaggaagaccaaaguguuaacugguuauuuucuuccuuugaauguauacuuucauaccuuccuuuaaugagauugaacucuuggccaggcaugguggucaguacuuugggaggaguaaucccagcacuuugggaggguaaggcaggaggauugcuugagcccaggaguucaagaccaccuucagcaacaaaguaagacuccaucucuacaaagaaaagaaaaaauuagguggguguggugguacacuugugguuccagauggugggaggcugagacgggaggaucacuugauuccaggaguuuaaggcugcagugguuuguguucguggcacugcacuccagccuggguggcagagcaagacccugucucaagaaaaaagaaauugaacucuccccaaaaaugaugugagaauuuaacuguggaggagaccagauacucuugggugaugugaccugugauacuucuccuaguagacacugaaugaugagaagcuggggaucauaggaauagcuguauuuuucaaauguuuguugguaacgagugaggaaccugaugcauccagcuccagaguaagguuuauuugccaugguaacacuggauaaguacauuguugccuguauuuccaaguaauuuaucauuucuguauuuuaguaaacauacauauauacagaaaagugcacaaauaaguggacggcuuagagaauuuuuauaaacccagaggcccucuuagucuccuuuaagucauuaucaucgaugcccugaugcuugcguagugagucuucugauuucuagaacuguagacuaauuuugccugauuuggauuuuguguaaauggaaucauacacuguguauucuugcguaucugguuucuuugacucaguguuguuugugagacuuuguguuguuguguacaguuguaacuggaguuuccauugcucaguaguauuaugugauauaucauaauguauuuaaguaaaaagacugaguuuuaggguaugugucuguauucauuugcuagggcugccguaacaaguaucacagauagaguggcuuaaacagaaauuuauuuucucaauucugaagguuagaaaucugaggucaagcugucgggaggauuaguuucuucugaagccucuccuugguuuguaaaugacugucuucucuucccuguaucuucacaggaucuuuccucuguauuggcuguguccuauucuccuuuucuuuuaggacaccagucguauuggauugaggcccacccuuaugaccucacuuaaccucaguuacuucuuuaaaggcccugucugcaaauaagucacauucugauauauuggggauuagaauuucaacuuaaaaauuuuagguggacacaguucacuucauaagaguaucuauucugcucuaguagauauggccaguuuucaaaaguuguaccagcguauucuuccaccagcaguauauaagaaguccaaauauuccacauccuugcuagcacuuguaacuuuuucucucuaauuuuaguucccucugguagaaagccauuucuuuauggcaccaugguacagcuuguuuacucaccaguguaggggaaccucaagggacuggggaagguuauccuggaguaaaacgugucaguuugagacuaccucuuguaaaugcuacuuaaauccauugggguuaaaagcagagguucggccaggcacaguggcucaugccuguaaucccagcacuuugggagaccgaggugggcggaucacuugaggccaggaguucaagaccagccuggccaacauagcgaaacccugugucuacugaaaauacaaaaaauuagccaggcgugguggugggcacuuguaauuccagcuacuugggaggcugagacaugacaaucgcucgaaccugggagguggauguugcaugagaaucgcuugaaccugggagguggagcugagauuucaccacugcacucuagccugggcgacagaaugagacccuaccucaaaaaaaaaaaaaaaaaaaaaaaggaaagaaaagaaagaaaggaaaacaccgcuucaguccagugaaugagcaguuagucuuccauaguugcccauagcuuacuuuuauagucuggacuccauuccuggugguggaauuggccugugaaagaguaaucugugggguguagaucuaaccauaguagauggugcuuucauuccaacucucuuuuuuggucagacacuugagcccuuagaauaucacauucuaucguacauaugcuagaaauaggucuguuuugcauauucugacugacccuucagauauuagugggccuuucaccaccagccuuuuggcugcgugaucuucagcuuuguguauccauuauagaccuuaguuugauugaaauaauauuacaugacuuugccugucuuccaacucuaagccacuugaggacaaggaugaaucauuauucuagaauggaucuugaaauauuacuaagcuuuuguuuaaauuuuuuccaguucuagcuuuucagaguaaguuaccguuuauagcauguaaguuaugcuucugggucagugguuaauauauguggguuuccugaaugaugaacuauguguucuguguucauuuaacagguuuuucuucucuacuauaagaaaacacuguuggccccuguggagaauuauucaggaauaauuguaaauacagggcagaugagaguuacuuaguuuagaguuguucaaugccugggguggugaggggcauguugaguggauuuuuaaauaaauugguaggcaggugagaguugggaaaccauuauaguuggaaagaauggcauaagucaaugaauggauguagggauugcaguagcucuaauuugggaaugacuguauguauggaaaccagauccugguagggagggcaggcacugcaaucccuuguuagaggauuuaaguucaaccaaguggcacuucacucuguaaugcuggaauagacacagcauaauccugucacuugaaccucacaauuaagucagauaguaccccaguuaugggugaggaauggcuuugauguuguaauuugucuaaagaaaccauacauuaagagcuuagugggcuaggauugaaauacuacaagaguugugcuuaaacuuucagagaguugcuucuucagaaguggcuuuaaugaaaaguuaaacaugggagcugguuaggggaggugggauagaggaagagagcaguuaguuugguuuuccucuuuagccagcccauugugggcuccucuuagcaauuuaugggcagucuguuuuacugguuaaaugccugagauaaucuaggguugauaucaaacuaucgaagauaguucuuauguaacuguuuuacuagcuaucugcuuuccaguuugccuuaccaaaaagaaaaaaaggcaggaaucauccuggucucucguuagagacuaaacuuuuggcuuaguaccuggguucagaaagcuugaugacaguggugcaucguauugaagaaucuauugauccaggagugaaguccucuucacaagaauugccuuccaagacacucuucuuuguguaaguugccuuugccuuuucccucccagcaggaaugcaguacucagagcaaaguacauaaacaaugucuuuacauuucauagagguuguuaccuuguuuaaacuucacaauuuaagcagcauuugauuugucucuuuuuuuuuuuuuagaugaggaaauggacuaaaaggucaugcucaguaucuuggagccacuguguguuagugggacugggacuagcauccaguauuccaaguugacagauaauucuuuaauaauggcagaagaauaauagcaucuucugcggaagaacagccuuuguacauuuuaucauucaguuuuauuuaaauguuuuuaaaagagggauuucagacuagucuguuucuuuugaaacauagauuuucagguggugaaucuucaagcacuaucagacagaauaagcuagguuaugcuguaguaaccaauaaccucaaaguggucaaaaagagcauggguuuucuagaggcucugcaucauucuuacuccaaccaaaggagcagccgugauaggaguauugauggcugucuuggcaaagggaaaaagaacuguuggaggcaguuaaauuccagcacguacaguuuaaauccagcacauacagauaaauuuaaauacuguuaaauaaaguuauuuaacaguauuuaaauuuaaaaaaauuuaaauacaguugaauacaguuaaauuccagcacaggaaugacacauuauuucaugucacuucugcuuaggguucauuggccaaaaugagucacaccacacaaggaaucaagugugauccuacauguguggacuuggaaggcacggaguuggaaauauuugggaaauagcacuaguaucauacuuggcuuauaauauguaauagcuauugggggaaauagcucucauuugcagaaucucuuucuacaaaucagcugguaauuuaaaugcuaaaaagagcuuaguuauagauacuguguugcccgucuuuacucacuaaucaccuuccgauccuaagaaauuuauuuauuuauuauuuuuugagaugaagucucccucugucacccaggcuggagugcaguggcgcgaucuuggcucacugcaagcuccaccuuccggguucacgcccuucuccugccucagcuucccgaguagcuaggacuacaggcgcccgccaccacacaccuggcuaauuuuuuguauauuuaguagagacggggugucacuguguuagccaggauggucucgaucuccugaccuugugauccgccucccucagccucccaaagugcugagauuacaggcgugagccaccgcucccggccuuuuuuuuuuuuuuuuuuuugagauggagucucgcucugucacccaggcuggaguacagugacagugcaaccccagcucacugcagccucugccucccaggcucaagcgauccucccaccucagccucccaaguagcugggacuacaggugugcaccaccaugccccagcuaauuuuuuauauuuuugauagagaugggauuucaccauguugcccaggcuggucucgaacuccugagcuccagcaaucugcuugccucagccucccaaggugcugggauuacaugugugagccaccuaucuuucugucucucuuuuuuuuuuuuuugagacagggucucacucugucacucaggcuacaguacaguggugccaucauggcucaccgcagccacgcccuccccaggcuuaggugauccucucaucucaacuuccccaguagcugggacuacaggcacaugccaccacaucuggcuauuuuuuuguaguuuuuuuuuuuuuuuuuuuuuuuuuuuuuuuuaagagauagaguuucaccguguugccuaggcuugucucaaacucuaggccucaagugauccuccuauuuuggccucccaaagugcuaggauuacaggaaugaaucaccaugcccagcucugcccugucuuuagaaaccccacuccccuuuuuuuuaaggauuuguucuuguuuuuauuuuauauuuuaauguuuugagacaaggucucacuguugcccaggcuggaguauaguggccugaacacagcucacugcagccuugaccucuugagcucaagucauccuccuaccucagccuccugaguagcugggcuuacaguugugugccacuacgcccaguuaauuuuguuuuuuugauagugacagggucuuggccauauugcccagcuggucccaaacuucugggcucaaguagcucgcccacccuggcuucccaaggugcuaggauuacagaugugagccacuacucgucaagaacccuauguuuuuccauuauucuuguuugaggcucuccacaaauggucuccagcuugccuuccuggcuuuguuuuuuuugauaaagacacauauuccucugaguugcuuuauucaccuuuuccuuaccacacuuuguucccuacuuccuuuaucuugauuccugucaauuccccuucaucucuguuuucuagcuccaguacucuguuggcauccugccugacucagguaccaguccacuuuuaaagcuuuucuugaccacuuacgucuauaguguucuuuuuacugaaucccuggggcuugccacagauuaucuuauaguuguggauuuuguauauguaucuuuccuaccuuaggagggggccuuaaggguaagucccagacugauuuaccuguuuuuccccaaauguuaaccauuugaaagaaagaacuaaauggauauuucucaaauggcuuuugauagauacauguacaauacaucuguugucauaccugguuggaaaaaaaaaugccuguaaauucuucacauuguuugaaaucagugugucagaagcuguaggauuguagaagcuuucuuaagcaaggccauaguauggcugucaaaucuguuacuaagcuuuagucuccauuucugaaaaacgagaguaauguguaauccuuaagauccuuucguauuuugacauucucugacucuuggacauacugcuguggcuuuugcaacauccuaacugguuaguugacaccaucagaaacuuuaaggacccuguuagccauugaguauauggagcuuugcccauucguuucugagaggcaagaggcacugguaggcaguuagauuuuucuuuaaaauguguacucguuucuaaauuacagaagcaguauaaaagucuuaaagcgggccgggagugguggcucacgccuguaaucucagcaguuuggaaggcugaggugggcggaucaccugaggucaggaguucaagaccaccagccugacuaacauggugaaaccccgucuccaccaaaaauacaaaaaguagcugggugugguggugcgcuccuguaaucccagcuacucaggaggguaaggcaggagaauugcuugaaccugagaggcagagguugcagugagccaagaucgcgccacugcacuccagccuugccaacagagcaagacuucaucucaaaaaaaaaaaaaagucuuaaagugaacaguuuuuuucugucauucuggauaauuugauggcuauaauucaaaacguuuauuuuuuauaaaauuuaaaugagaucauaaaauacauacucuucugcuauuagcuuuuuaaaaauuuaaccauauagucagcuuuucuuauaaguacauacuauuuuuaaugacuguauaauauugaucauaauuuaacaauccucuaaaugaacauuucaguuauuuccagcucuuuaagaaaaguauuuaauagggccgggcgcagugguucacgccuguaaucccagcacuuugggaggccaaggcggguggaucacuugaggucaguugaagaccagcgugaccaacaugguaaaacccugucucuacuaaaaauacaaaauuagccgggcaugguggcacaugccuguaaucccagcuacuugggaggcugaggcaggagaauugcuugaaccugguaggcagagguugcagugagccgagauugugccauugcacuccagccuagacaacaagagcgaaacuccaucucaaaaaaaacaaaaacaaagaaaagggcugggcacgguggcucccgccugcaaucaaucccaucacuuugggaggccgccgagauggguggaucacgaggucaggagaucaagaccauccugaccaacauggugaaaucccgucucuacuaaaacaaauacaacaauuagcugggugugguggcgugcacuuguaaucccagcuacucuggaggcugaggcaggagaaucgcuugaaccugggaggcagagauggccgugagccgagauggcgccacugcacuccagccuggcaacagagaaagaaaaguauuuaauauuuauauuuuccuacuuaucuaaucauuuccuuaagauuuagugaguauacauacuuaaaauuugguuuucauugccauauagccuucaggaagguuguauacuuuacauuuuguaguuugagaauuucauuuauauacuugucaauugucaguuuucuuaauccuugccaguuuaaugaaugggaaaaauuuaaaugaugucucauuguugagggcuuguguuuuggccaggccuggugggucacucaugccuguaaugccagcauuuuaggaggccaaggugggaggaucgguugagcccaggaguucaagaccagccuaggcaacaugguaagacccugucuuuacaaaaaguuaaaaaaaaaaaaaauagcugggugugguggcacauacuuguagucacaccuacuugggagauucaggggaggaucacuugagcccaggagguugaggcuacaggaagccaugauaauuccacuguacuccagccuaggugacagagggagaugucucaaaaaaaaaaaaaaaaaaaaaaaaaagacuuguguuucuuuguuugauagauuaaacuagaaaaauacuaacuacuuuuuuauauucacuuaaauuuuguagaaauuuaaguauauauaauuguauaauaaauguagaaaaaauauuaacuacauuuuuuuauauauacuuaaaauuuuuuuuaacuuucacuuucugcuuuuguauauuuauagucuuuugugaauuggcuuuuguucucuaaagcccaugugagguucuuguaccucaccucucucccaguuuauaaacuuuauauggcaagaauuuugauccuuuucguguugcaaacauuauuccuggcuuguaucucuuggucuuguuuggcugauggcauguuuuuguaacauagagacuuuucuguagucacaucugucaauucauuuucuguguuucauauuaugcuuaggccuuucccacccccaggacaauaaaaacaauguuuucuucuaguaauucuagcacuuagccagguauaauaugucggaaucuuuucccaaauguauaguuuucccaguauuuuauuguauuaucuuuucucuuugacuagaaauuuuuuuuaucacacaguauauuuccuacuuccaugucuuuuuuuauuuuuauuuuaaauagauuuauuuacgaaauagagauggugucucacuauguugccuaggcuggucucgaacuccugcacucaagcaauccucccaccuccacuucccaaagugcugggauuacaggcaugagccaccaugccuggcugugucuuuuguuuuuuaacucuucuguuucauucuuugucugugggacaguacugcugucuuauuugcgucuguuuuguuuuauacguauauacacagauacauacacgcauacauauacauacacacaaacauuuuuuuuuuccuuggagacagggcauugcucugucacccaggcuggaguauaguagugcgaucaugacucaucgacucauugcagccuuggccucccaggcucaggcgauccucccaccucagccuucugaguagcuaguauguccggaauugguggguucuuggucucacugacuucaagaaugaagccgcagacccuagcggugaguguuacaguucuuaaagauagcguguccagaguuucuuccuucugauguucggacauguucagaguuuauuccuucugguggguucguggucucgcuggcuucaggagugaagcugcagaccuccacggugaguguuacagcucuuaagguggcacgucuggaguuguucguuccucccgucuagaguuguuuauuccccccgguggguucgugaucucgcuggcuucaggagugaagcugcagaccuucucagugaguguuauagcucauaaaggcagugcagacccaaagagugagcagcagcaagauuuacugcaaagagcgaaagaacaaagcuuccacaguguggaaggggacccgagcggguugcccaugcuggcucgggcagccugcuuuuauucccuuaucugaucccagccacauccugcugauuggcccauuuuacagagagcugauuggucuguuuugacaggaugcugauugguguguuuauaaucccugaucuagacacagagugcugauugguguguuuacaauccucuagcuagacguaaaaguucuccaaguccccacuagauuagcuagacacagagcacugauuggugcauuuagaaaccuugagcuagacacagagugcugauuggugcguuuacaaaccuugagcuagauacagagugcugauugguguauuuacaauccuuuagcuagacauaaagguucuccaaguccccacuagauuagcuagacacagagugcugauugguguauuuacaauccucuagcuagacauaaaaguucuucaaguccccacucgacucaggagcccagcuggcuucgccuagcggaucccgugccagggccacgggcggagcugcccagcagucccaugcugcgcaccugcacuccucagcccuugggcugccgaugggaccaggcgcugcagagcagggggcggugcccgucggggaggcucgggcuucacgggagcccaccgcaggagggcucgggcauggcgggcugcagguccagagcccugccccacggggaggcagcugaggccuggugagaauucgaauguggcacaggugggcuggcggugcugggggacccggugcccccuccacaucugcuggccugggugcuaagccccucacugccccaggccgguggcgccagccggccacuccgaguguggggcccuccaagcccacacccacccggaacucccgcugguccgcgagugccgcgcgcagccccaguuucccgcccaugccucucccuccacaacucccugcaagcagagggagccggcuccagccuuggccagcccagagaggggcucccacaguacagcagcaggcugaagggguccucaagcauggccagagcagacgccgaggccgaggaggugcugagagcgagcaagggccaccagcauguugucaccucucacugggaccacagguguguaccaccaugccugacuaauuuuuuuuguagagauggggucucagcuuggacauuggaauugcuagccaaagacauuagagcaacugucagcaauaugcucaguggacuaaaggaaccacagaugaagaacugaaggagagcagaaauacagucucugaacaaaaucaagaaagaggcugggugcaguggcucaugccuguaacgccagcacuuugggaggccaagaugggaggauugcuugagccuauacguucaauaucagccuauucaacaugacaaaauaauuucucucucucuuuuuuuuuuuuuuucugagacagucucgcucugucucccaggcuggaguguaguggcaugauuucggcucacugcaaccuccaucuccuggguucaagcgauucuccuccucagccucccgaguagcuggguuuauaggcgcccaccaccacacccagcuaacuuguguauuuuuaguaaagacgggguuucaccauguuggccaggcugguauugaauuccugaccucagaugauccaccugccuugaccucccaaaguguugggauuacaggugugagccaccgcaccuggccaaauucuugcucuuaaaaaaaaaaaaaaauuggcacaugccuguaguccagcuacuugggaggcuagagugggaggaucacuugagcccugcgguuggaggcugcauugaguuauggucacaucacugcacuccacugggugacagagugagacccagucucaaaaagauagaaacuauaaaaaggaacuauacagaaauucuggagcauaaaaguacaauaacugagaugaaaacuuuauuagagggguucaccaauagauuugggcagacagaaaggcccauaccugggucagcccucuuagagggacugauccauuugggagacauuugaaauuuauucucuuagauauuuugaaauaugauacauuauuauuugaaauaugaugcauuauuaucgacuacauuccacuguaauaaaaagaaaacaucacaguggaaaggccacacuccuucauuauccaguugggaaccucagcagcacagccaagugaucugcuaagcugcuuuggggaccacaccugugccacuuguauagcucccagcacagccugguucacaagaauuccuuauccuauuguggaccuuuuggcccaauuaacacaggcccacaggauuuaaaguugccauugguccuugugaaaagcuaaccagguaaugucagugugaggucacauacaauguguguguuucugcccugcauuuggcucagagccacuuguaauaauuuuuugcuguugagguuuccuugauacuucucugaagucacuuuuucuuuuuuucuuuuucuuuuuuuuuuuuuuugagacagauucucgcucuguugcccaggcuggaguuuaguggugcgaucucggcucacugcaagcucugccuccuggguucacaccauucuccugccucagcaucccgaguagcugggacuacaggcauccgccaccacaccuggcuaauuuuuuuguauuuuuaguagagacaggguuucacuguguuagccaggauggucucaaucuccugaccucaugauccacccgucucggccucccaaagugcugggauuauaggcgugagcugccgcgcccggcugaagucacuuuuucauuaaauuuuucugguuaacuucaaguacugcgugucuaccuguugccuaaacuaggguaugcacugccccaauucugcagggagggugcaaaacagcaaaauuagaugugacccaucuuucuggaguuucaguuguacuguaaaauuuggaagaaacaguaguuuauuaagaaucaucuuuuuuuuuguuuuggagacagaguuuugcuuuguugcccaggcuggagugcaguggcaugaucucagcucacugcagccucugccucccugguucaagcaguucucccaccgcagccuccugaguagcugggauuacaggugcgcgcaccaccaugcccaacuaauuuuuguauuuuuaguagagacgggguuucgccauguuggccaggcuggucucgaauuccugaccucaagugauccacaugccucagccucccaaagugcugggauuaccggccugagccaccaggcccgggugagcaccaucuuauuaagaaaagacacagaagagcagggaaggggagaaguguuccaggaaacacaguccaggcucugacauugcuccaggugggauggagggacucaccccuuacuuugaauaggaugcuuuugaaggccacaggggugccaguuguccucuugacuugaaucccaugcagagacuuuguuggcaguuugcacacauccauccucugcugguugaguccucugagcugagugugcuggucacacagcaaugugggcuucuugaccagcgcccccuggcaccuauuuaaguccaugcuuggcugaccugccaugcuguauugucaggauccauggagcucgggaucuuguugcuuucuauucuaaaugcaaggagacauuugaaauagacucggauauucugaaauguccaaauauuuauuauugacuguagucacccugcugugcaguagauuagaaaguuauuccuccuguccgaaacauuguacccuuugauaaacaacccuccauuauuucucucucccaccaccccagccucuguucaccaucagucuacucucuacuucuguggguucaacuguuuauuuuuagcuuuuaaauuuuucuuugauuuuuagagacagagucuugcuguguuacccaggcuagagugcaguggcucaaucauagcucacugcagccuuggacuccuggguucaagugauccuucugccucagccucucaaugagcugggacaauaggccuacacugucacaccuguuuacuuuuauuuuuuguagagaugcggucucacuguauugaccggguugggguucaacauuuuuauuuauuuuuuuuauuuuuuuauuuuuuauuuuuuauuuuguuuuuggagauggagucucgcucugucucccaggcuggagugcaguggcgcaaucuuggcucacugcaagcuccgccucccagguucaugccauacuccugccucagccucccgaguagcugggacuacaggcacaugccaccacgcccagcuaauuuuuuguauuuuuuaguagagacgggguuucaccauguuagccaggguggucucgaucucuuaaccucgugauccacccgccuuggccucccgaagugcugggauuacaggugugagccacccggcccggccgggguucaacuuuuuaagauucaacacauuggugauaucacgugguaauuguuuuucugaggugauagauauauguuaguuagcuuaacuuaaucauuccauauuguauacauauaucuaaacaucacaugguacccauaaauguauacaauuaugauuugguaauuaaaaaucauauuaacugaaacauaauaggcugggugcggugguucacauaccuguaaucccagcacuuugggaggccgaagggcaaagaucacugaggccaggaguuuaaucagccugagcaacauagcaauacucuaucucuacaaaaaaauaggcuuguugguguauaucuguagcccuagcuacuugugaggaucaggcaagaguauugcuugagcccagaaguuugagauuacagugagcuaugauccugccacuguacuccagccugggugacagaacaagacccugucucuuaaaaaauaaucggccgggcgcaguggcucacgccuguaaucccagcacuuugggaggccgaggugggcagaugaccuaaggucaggaguucaagaccagccugaccaacauggagaaacuccaucucuacuaaaaauacaaaauuagcugggcaugguggcacaugccuguaauaccagcuacuugggaggcugaggcaggagaauugcuugaacccaggaggcggagguugcagugagccgagaucacgccauugcacuccagccugggcaagaagagcaaaacuccaugaaauaaugaaaugaaaugaaauaaagaaaugaaaugaaaugaaaagaaaaugaaucucagccaccccacauacuugguuuauuucuuggccucagcuguccauuggugccacuuuauuucuagcuguguggugggucuuugggccugcaggaagcaaaggauucuuuuucauuuuguuuuguuuuguuuuguuuuguuuuuugagacgagucucacucugucucccaggcuagagugcaguggugugaucuuggcucacugcaaccuccgccucaugggcucaagcaauucuccugccucagccucccaaguaguugggauugcaggcacgugccaccacgcccagcuaauuuuuguauuuuuaguagagacgagguuucaccauguuggccaggcugguuuugaacuccugaccucaaaugauccacccaccucugccucccaaagugcugggauuacaggcaugagccacugugcccggccagcaaaguguucuuaagaugaaguuugacaaacauccuagaggcccccuacuggcccuggcacuugccauagggaugaggcucaggucacaucaucuggucgcucagcauggagggauuugguuccuaagauuaucguuggggacaggugacuccuucuggguuuccuccacugcugcugguacauugaguggaggggguuauguuaauauuggucucauuuucaggucgaguaagggacuggcaggcaugguggcuuuucugguggucuucugcccuaacacuuguucuucucagcuggcugacuuuuagaaguaaccaagguaaaggugggaaaggcaggcuagcuuagacuccuccucuuugaguagacagggaagguggaauauacuuuggggaauggggaagaauuggugggacccccagaaggcaggggcugcacucucuugauggagccuuccuccaguuuccuauacaccaggacuagguauguggccaugguguagucauauuuguuuucccaacaaggacuccuggauguggucugccuugaaccccauggacaccaugagcugugucuuuccguggacuugguaaugagggaguggcuccugguguggccuuaguauccccuggucguuauugacucauggaugccccauaaucuagccuauuguguuccucuuccugggguugaggguaagcaguuuguucaugaggcuuucuaguucugaggaaaugaagaaugggauuuuguaauucccguaacauaucucgucuugcaguuccacaaaggucagucugacaaauggcaagaccuugucaccaugguguagagaaggucucccaggcuccacaaauccacuggggcagggagaaggguggucauaauuuugucccuggaagauuucugaggcagcauaagggggacucccacaaaaugugcccagauucuggcuaacagugaaccugcugccaaagccagagucugcuguuuuuauguuguaauugguauccagaaggaaguucucuggcuucaggucccuguggacaauuuucuucugguggcaauacugcacaguagauacuguuugcaggaacuggccucaggucucuuucuccuuucuguggccauacucuaggauguagucaaauagcucugcucugcuggcacauuccaggacuaaauauaauguuucuguugucuugguugcuugagagaguuugcugauauuggagugauucaggaccuucauuauacugaauauauauauacuuugguauagucucuggaggcuggaggagcucugcugagcuuuguggaugaccuucauggcuaucugggucucagucagaauaugccaggccagcuucaccuuagcgaagcuaccccggccgauggucuugaggacccuguaauuguaaauaagugucuccucaccagacaaggugagacccugcuacauggugacugauaugguuuggcuguguccccacccagaucucaucuugaauuccuauuuguugugggagggacccggugggagguaauugaaucaugggggcaggucuuuccugugcuguucucaugauaguggauaaaucucaugagaucugauggcuauugagaguuucccugcacaagcgcuccucucuuugccugccgccauccaugugagaugugacuugcuccuccuugccuucugccgugauugugaggcuuccccagccacguggaacuauaaauccaguuaaaccucuugguuuuguaaauugcccagucauggguaugucuuuaucagcagcaugaaaaaggacuaauaugguaaauggguaccaguagaguggggugcugcugaaaagauaaccaauaauguggaagccacuuuggaacuggguaacaggcagagauuugaaggguuuggaggguucagaagaggacaggaaaaugugggaaaguuuggaacuuccuagagacuuguugaauggcucugaccaaaagccugauagcaauauggacaauaaggcccaggcugagguggucucagauggagaugaagaacuuguugggaacuagagcaaagguggcucuuguuauguuuuagcaaaaagacugguggcauuuugccccugaccuagaaauuuguagaacuuuuaacuugagagagaugauuuaggguaucuggaggaagaaauuucuuuuucuuuuuuugagacagagucucacuguuguugcccaggcuggagugccaugaugcgaugucagcucacugcagccucugccucccggguucaagugauuguccugcuucagccuccugaguagcugggauuacaggugcccgccaccacgcccagcuaauuuuuguauuuuuaguagagacggguuuucaccauguuggccaggcuggucucgaacuccugacuucaggugauucaccugccucagccucccaaagugcugggguuacaggugugagccaccgagccuggccagccaaagaaauuucuaagcagcaaagcauucaagaggugauuuggguacuauuaaaggcauucaguuuuauaagggaagcagagcauaaaaguuaggaaaauuugcagccugacauugaaauagaaaguaaaaacuuauuuucugaggagaaauucaagcccuuacagaaauuacaaguagcugaauguuaacucccaagacaauggggaaaaugucuccagggcaugucagagguccucauggcagcccuucccaucacaggccuggaggccuaggagaagaugguuucaugggccgggccuaggguccccgugguuugugcaaacuggggacuuggugcccugcgucucagcagcuccagccguggcugaaaggagccaauguagagcucaggcuguggcuucagaggaugcaagccccaagcuguggcagcuuccacguggugcugagucugcgagugcacagaagucaagaauugagguuugggaaccucugccuagauuucagaggaugcauugaaaugccuggauguccaggcagaaguuuacugcaggggcaggacucucauggagaaccucugcuagggcauuguggaagggaaauguugggauggagcccccacacagagcucuccacagggagacugccuaguggagcugugagaagagggccaccauccuucagaccccagaauaguagaugcaccaacagcuugcaccauccacuuggaaaagcuacagauacucaacaccagccugugaaagcagccaggagggaggcuguacccugcaaagccucagggguggagcugcccaagaccaugggaacccaccucuugcuucagugugacguggaugugagacauggagucaaaggagaucauuuuggagauuuaagauuuaaaugcccugcuggauuuuggacuuggauggggccuguagccucuuuguuuugaccaauuucuaccauucagaacagcuguauuuacccaaugccuuuaccuccauuguagcuuagaaguaacuaacuugcuuuugguuuuacaggcuuauaagcagaagggacuugccuugucucagaugagacauuggacuguggaccuuuguguuaaugcugaaaugagcuaagacuuugggggacuguugggaaggcaagauugguuuugaaaugugaggacauuagauuugggaauggccaggggcagaaugauaugguuugacuauguccccauccauaucucaucuugaauucccaucgguuaugggagggacccagugggagguaauugaaucaugggugcaggucuuuuccaugcuguucucgaguuagggaauaagucuuacgagaucugaugguuacaaaaaggggagcuucccugcacaagcauuccucucuuugccugccaccauacauaagaugugacuugcuccuccuugcccucugccaugauugugaggcuuccccagccauguagaauuguaaguccaguuaaaccucuuucuuuuguaaauugcccagucuuggguaugucuuuaucaucagcaugaaaacagauuaauacagugugaccuccuagcuacacuaacuacaaauccuaagaaugcuaaccaguaauacuggugcuacaaacuaugcuaacuaacuaaugaacauaauacuaacaauaccaacuguauacugacuacacuaacagugauaaccaacaauacuaauaaugcuaaccagcaacauuaacuaaauaaaaaaugaaaaaaugagaaaaacaacaaaggaaguggaagaaaaaugggaagaagauauaagaauuuaaaaagugggacaaaagaguaaaggaggaugagaaaauaaaaagaaaaaauaauaagaaaaaggaaauaaaaaaaugacaaaaagaaaaaugaggacaaagacaaaguagagaaaaaagaaauaaaauagaaaaaaacacuacacaugaggaaacaacauaauuguggucucuguuugucaggucaccaaaaaucagcuuacugggcugugcagaccaaaaaccuacauccagccaagugcuuauuuagguguuuguaauuccagaacaauggcuccuuauaauauccagagcaagaaaugggccaguuguagcuaggaauaauccauagugguuuucucacuuuuggucucaagaagcuuuuccucuuuuuuuuuuuuuuuuuaaaguguuuauucuuuagguggguuauagagguugauauuuauuuuuuuugaaaccugaaguaugcuacaacagccuuuuuuauuuccagguucaaaaucucuaacaccuuuuggcuuuuaaacaugucauaauguguacacucaaaauauucaauaccuuuuucugaauuaaacucugaauguuuggucucaaaaugaugcuacaaauuaacugacaucaugauacccuaaggaaauguucuguugcauaagacacaauuggguacauuauuaacaucuguagaauggagaggaggauaucuauuauuauaauuuccccagaagaucaucaucggauuucucuucagaaccuucaggaacacaaguuaguggguggauguauucaguuauugauggaagaaaacugucaguuaugaauucuagauccagcaaaacugaaauauugucauaugcagcaacauggaugaaacuggaggccauuauguuaagugaaguuagccaagcacagaaaaacaaauauugcauguucucacucacaugucagagcuagaaaaguagauuuuaugaaaauagagcauauauugguggggaagcagauagaggaugaaggggggggaaaaagaauguaaauauauuuauuacccugaacuguauacuuaaaaaugauaaagauaguaaauuucguaugcguguguguguuuaaccucaauaaaaaauauuuuaaaaaaugaggguggaauuaaaacauccucagaugucuuagucuuuuugugcugcuauaacaaaauaccuuaagacuggauaauuuaugaagaacagaaauuuguuucccacaguucugaagguugggggaaguccaaaaucaaggcuccagcagauacaguguuugauaaguugcccucugcuuucaagauggucccuuguuucuguguccucacuuggcagaaggaaugaacuugcucccuugaguccuuauauaaagucauuaauccuauccauaaggguggagcuaguauggccuaaucaucucaugaaagccccaccucuuuauuuuuuauuuuugguagagauggagucucacuguguugcccaggcuggugucaaauuccuaggcucaagugauccuucugcuugggccucaaaagugcugugguuacaggugugagccacaccucuuaauccuguugcauuggggauuaaguuucaaaaugaauuuuggaggaacacaaacacuaaaacuacagcaccagaugauucaaaagcuuaacgaguuuguuaccacuagaucucccuucaugaaggaagucaugaagguugaaauaaaaggacauuagacaggaaaucaaaucuguaugaagauauaaucaugucugauaaagguaaauacaugaaaaauuauaaaagcuaguaguguuucuguuuucuacaugauuuaagagacuuauguaucaagaaguuauuagucuguguuuuggacacacaacacauugagauguaguuuuguggcauuaauggcugaaaggugaugggguuggagcuguauaggagcaguuuuuauauguuauugaaguuaacuugguauacauucacaucagaguaguauaacuucaggguguuaaauaucagccccaugguaaccaaaaagaaaauaacuguaggauauacacaaaaggaaaugaaaaggggauuaaaauguuuuucuacaaagaucaacuaaacacaaaauaagauaauaaugcaggaaauaggggacaaaacaacugugaggcauauauacaaaacaaacagcaaaaugacaaaaguucugccuuaucaguguuuaaauguaaauagcuuaaacccugcaguccaaagacagauuggcagaauggauagaaaaacauccagcuucuagccauaagagacccacuuuagaugaaagacaaaaaaauuuaaugugacaggauggaaaaagauacucucuucauauaguaaccaaaagagaucgggguugcuacacuaauaucagacaaaauauacuuuaaaucaaaaaaguuuacgagacaaagcaggacauuauauauuaauaaaagguuuaauacggcaaaaagacaaaacacacuaauaacagaccacucaaauaugugaaacaugacugauaauggaagggagaaauaguucuacagcaguaguuggggacuuuaauggguagaagaaccaggcagaagguaaguagggaaauagaauauaguacuugaacaauauaagaaaccaaguagaucuuacagacauacacggggcauucuacucaacaacagaaugcaucuucuucuuaaguggacuuaggaccuucuuuaggauagaccauacauuaggccagaaauuaagauucaagagauuuuuaaaaauacgauaccaaguauuuucuuugacaaaaugggaugaagugagaaaucaguaacagaaggaaaacuggagacuuuauguaaauuaaguaacacccucuucaagaaccaguggucaaaggagaaaucacaagggcaauuagaaaaaaaaggauuagaaacaauuuaacagacagaaaauaaaacauugcaaaacuuaugauaugccacaaaagcaguguuaaaggaggaaauuuacagcuauaaaugccuucauuaaaaaaaggaugaagaucucaaaucaccaaucuaacuuuuuacaccuuaacaaaguagaaaacaacaaacucaaagcuagcagaaagaaggaacuaauacaguagagauaaauaaaauagaaaaauucagcaaauccaaaaguuaguucuuggaaaagacuaacaaaauugacaaucccuuaccuagauugacuaggcccgagaugagaaucucaaauucauaaccaccuuucuuugcucaguuccugggacuguacucuuuccaccuuggacgaugccaucuccucaaccuggaaagugauaugauuuuauuuuauuuuauuuuauuuuuaacuuuuggaagauuuuuuaauuucaugaauaaugguaaugauuuuuuuuaaauuauacuuuaaguuuuaggguacaugugcacaacgugcagguuaguuacauauguauacaugugccaugcuggugugcugcacccauuaacucgucauuuagcauuagguauaucuccuaaugcuaucccuccccccuaaagugauaugauuuuauauguagggaacuguaaaaauuucucacacauaaaacccuuuuggaucugauaaacucauucagcaaaauugcagguuacagaaucaacaaaaguucuguuucuauaacauuaacaacgggccgggcacaguggcucaugccuguaaucccagcacuuugggaggcugaggcggguggaucacaaggucagaaguucgauaccagccugaccaacauggugaaaccccgucucuacuaaaaauacaaaaauuaccugggugugguggcacaugccuguaaucccagcuacuugggaggugggaggcugaggcaggagaaucgcuuggaggcaggagaaucgcuugaacccaggaggcggagguugcagugagccgagauugugccacugcacuccagccugggcaacagagcaagacuuugucucaaaaaaaaaaaaauuaacaaugaacaaucugaaaaggaaauuaagaaagcaguuauauuuacaauaucauggaaaagaauaaaauaguaaauuagguaggagaaagacauguauagaaagcuacaaaacauugcaaaaagaaauuaaagacuuuaauaaauggaaagguaacucauguucauggauuuaaaaacuuacuauuguuaggaucacaguacuccccaaaguaagaaaugcaaugcaguucuuacuaaaaucucaaugaugguuuugcagaaaauagaaaaauccauccuaacauggauacagaaaaucaugggaucuccaguagccaaaauaaucuugaaaacacacaaccaaguuggaggucucacacuuccugauuucaaaauguacugcaaagcuacaccaaugaaaacagugugguaauggccgagguucauauuuggacuguugggguuuuucaccuuaguauucgcuaucuuuuuuuuuuuuuuuuugagacggaguugcgcucugucacccacgcuggagugcaguggcaugaucucagcucacugcaaacuccaccucguggguucaagcgauucuccugcuucagcuucccaaguagcugggacuacaggcgcgcaccaccacgcccggcucauuuuuguauuuuuuaguagagacgggguuuugccauauugcccaggcugggcuugaaucccuggccucaggugauccacucaccuccaccucccaaagugcugggauugcaggugugagccaccacaccuggcccagucccacucuuguacauacaucaccaccaccuauuuccagaaccuuuccucaugccaaccagagacuaugcaaauuaagcaguuauucuccauuuuuuucucucccagccauacuugauagaacaugaauaucagauaagugcuauggagaacaguaacacagggugaagugaaagugugccauuuuauguaggaugguuggggaaagauggcauuugagccacugauggugcaggagagggaacaagugugauauugaggccaggugugcuuagcaguuugaaagcaaagcuagaaguacaggcgaggcagaggcacaagaugaauguuuuauauuuuauuuuuuaaauaaaauauuuuuauuuauuuuaaaaacaauuuuuuuuuuuuugagaccaagucuugcuguguuacccaggcuggaguauaguggcaugaucucagcucacugcaaccucugccuccuggguuacaagugauuucuccugccucauucuccuaacugggacuacaggugcccaccaccacgcccagcuaauuuuuguauuuuuaguagaggugggguuuuaccaugcuggccaggcuggucuugaacuccugaccucaagugauccaccugccucagccucccagagugcugggauuauaggcaugagccacugugccuggccuaagaaaaauauuuuuaagaaaacagagacaaggucuugcuguguugcccaggcuggucuccaacuccugggcuuaagcagucuuccugccucagccucccaaagugcuggaguuacacuugugagccacugcgcccagccuauuuuauuuuuuuuauuuuuagagucagggucuugcucugucacccaggcuggaguacaguggugcgauuguagcucacucuaacuucaaaguucugggcucaagcagucuucuguccuuggcuucgcaaaucacugggauuacaggugugagccaccacaccuggcuaauuuuuaaauuuuuuuguagaggcagccucucacuauauugguuaggcuggauuugaauuuccggccucaaaugaucuuccugcccuagccugucaaauugcugggguuacaggugugagccaccaccccaguguuuguuuuuuuguuuuuuuuuuuuuuuugagacagagucuggcucugucgcccaggcuggagugcaguggcgcuaucucggcucacugcaagcuccgccuuccagguucacgccauucuccagcgucagacucccgaguaggugggacuacaggcgcccgccacuacgcccagcuaauuuuuuuuuguauuuuuaguagagacgggguuucaucguguuagccaggauggucucggucuccugaccucgugauccgcccgccucggccucccaaagugcugggaauuacaggcgugagccacuggcccagccuccugcguuugguuuuuuaauucugcuuguuuguagugacauucaucaagaaugaaugacuuuaaaacaacaacgaaaaaucuuuagggauuuuuacucuugggcaagcaugcuucugucucugagcauuaguuuucucauauaucagauaaaaggguuuggaguauaucaaugauauucugguuguggacagaacucuugaggguuccuugaacaugauccuuugguagcauuggauugcucucggccaucccacgaauagcuguguuuuaucuguuuuuugcuuaagauuuaacauaugaguucauuugaaauguuucuguugccacaaagaaacaaaaucccuggcucagaguuuuaaggggacuuacuguucuaaugcuacucacucaggcuuugguugaguaguaaacagacuacagcuuguuuuuaaguucagugaucuucaacuuacagccccuguguuuuacaaaugaguuaaauuaagaucaguaucuucuguucaaauucuuuuuccaaagaaauccaaaugugccauaagcugauaggucucuggccaugaaauaugguuucauaguuacauugagauuguugaguagcuacagggaaacugagaauuuacauucugaggcaaaugguuuaaccuaagaggaauaagauuaaguaaacuguguauuagcuccucauaauguggcaggaauucaguguuagcgguggaaaagccacaggagcuuaaugugguagguaaggaagguuuauguuaguuccuuuccccgauuaucccaguugcugugcauugccaucucggaucaguuucuagccaugacuaccuaaaaguugucugagggaggcugugcacugggugaucuugugaggcagguggacgucuauucugccaagaucuugugggcccaguuugagaauggguuuuaaguuuuaguccuuuuacacuuccuuugcaggaauguagcuuuugaaauagaagcaaaguguugugaaaccuuugacauucuguucuuuaacacuuccuccucagccugaagaucucagcuuuugcuugggcguuacaacaccccaugguaccugaaccucaaguaagcucuguuagguuuucauaucugcccguguaugauggugacuuuuuuuuuuucugagacggaguuucgcucuuguuacccaggcuggagugcaguggcgcaaucuuggcucacugcaaccuccgcuuccuggguucuagcgacuucuccugucucagccucccaaguagcuggaauuacaggcaugcaccaccacgcccggcuaauuuuguauuuuuaguagagacgggguuucuccauauuggucaggcuggucucuaacucccgaccucaggugaucugccugccucggccucccaaagugcugggauuauaggcgugaaccaccaugcccagccucgaugaugacuuaugagucaauuugacugguccucaggugcccagauauguggcuaaacauuauucugggugugccugugaggguguuucuggaugagauuugguggacugagugaagguggcugcccuccccagcgugggugagcuucauccacgggaggcugcuuagagaaggaggcugagcaggaaagucuucuuucuccgccugaccgugcuugagaugggacauagguguucuuugcccucuggacuccaggcugcaacuagagcuuaacucugucagcucucccgauucucagaccucccaacugcaggucaugggacuucucagccuacauaauccugugagccaauuccuuguaauaacugucuuuauguguaaucuauugguucuguuuaucucuggagagcccaaauacuccagcaauaauggagucacuuuuucccagagauagguuuuaucuuggaggauucuuauauugauccuucccauaucucuguuucagaaacacuuccuacaauguagagugcuaauagcugguuugugaguaccccuuagauauacugggaugagcaauaaggucaaugcugucaccuaaccgucuguugauugucaagccuuuguguggaagcaaggaaauucaucuagcaaucauaacaaaggcaaagccuggaguguaaggugguuagguuuuuggcuagcaagagcugcagaaaaacagccucuagcuuaaacugaguuauaaacauauggaacuaguguaggccuugaaaucuuuuguggucgaauccucuuuguaggggaaccuaggcaaaaucaugucauuuccacugccggucccauagcgacuucaguuaagguauagaccuauauaaaguguuuuaucccuuaaaaagcuucaucucccauuugccuguggaauccucccuacaacccuaagagguggagaggaagccuuucuuacagauaaggauggaaauuguacagaugcacgaauuuguuucuaaagcuaaguagaaacaagaguaccaagaggucagauuuuuccagcccccaaauccuuggcguaaguguauaaaaaguaagcacagcuguucuugagguuucucagccuguugccuccuccccauguuaaaauucuggccuguauucuucuaagauaaucucuguacccaguugaggauucaacaucuagguauccucuuugggaagcguucuuaaagcccucauauaauggguuagauuccugaucaccucuaaccccuuuuguguugagaguuucuuuugauuacgaagucauacauagucauuguuuuaaaacuuaaaauauggcaaaccauagucaaaguccucuauacccccccaucccacucggaggaagaagucuugacuauucuuaugacaucauacauuuauugccauuuuccugucugcuuauccagggucuccuuaaaccaagcuugagguagggagacuaucuuggucaucuuugcaucucuagcaguugggcuggugcaggugcuugggaaaugaaucuguguuaagaucaccagccucugaacaggccuuauguaccaaggucuguguccagauuggcaugaccucugaguuaacaguccuuuauuuagaucuuuaagacugaguucucugccacagauuugcccucuggaaaaaggcaccucuccucuagagcagcagcugucaaccuauaaauccuguuuugaaaauuggaauuuuaguuaaauuacagggacagagugugauuguauacaauuuaauuaacauauugaaauagggaugugaauaagacuacuuuaggcauuacugaaaagcaaccgagcauuuaauguuuucauuuauauuuaugccugccaaacuguggcaccagccccaucaagaugucuguggugcacuuaacugugcagaagguguggagccuuuacauuuccucucccuggacuugguaccauguuugcauguuuugccaguuaucuuaaagugggauuuuaaaucuauuguaaaacaaaaauaaacuucaugguacuuaaugccacugaaauauacacuuaaaaauggugaaaaugguaauuguuuuaauauuuuaccacaguaauuuauguaggaauacuuucuauaacuuugugcuaauaaauuugaaaacccggaggggaaauugugcuggcaguguugaacuaugggucaguuuguucuaggcuacagauagacuuuccugugugaagauuaaagaugaaaaaggcuaaggaggagggacaagggaaaagaaaaguggaaauuuuaaggguuccugcuaacucuucccaaggaauuggaaggaguguuuacuaaguguuccauucccguuuaagcucucuucucccaacacaguuaaccaagcaaacuguuacuuauucuuuauaauaaaauuccuccccgucacaguuuuucuuaaccuccucaagucuuaucaccccccuacuucccaccgugacccucaaaauggaagugauuauaugaagaccugaaggauuacuuaaaucucagugaguauugagugccuucugggaguggggagugagauggggugagaguuacuggucagacaaacuuggaguacuuuggaagguuugcuuuggggcauuucuuauuguugaaguuaccuggaccccacuucagugggagagccugaggguggagauuagaagcagaaucuguuuagcuagauuaggauccagugagagcuucugccucaacuguccuguucagaaagccacuccuccucuaauguggaauagcuucacaguuuauuaugaaaaaaugucagacauauacaaagcaaagagacucaguguaaaagauacacucuccuaccuacuuucaacaguuagcauuuucuguauuugcuuuaucuguucuuucaguugagcuacuacaaaguaaauuagaccucaugauacuucaccuguaaaugcucucaaguccuuuaaucuagaauguggucccuccuucccuuuuucugucauuaucuuuaguuuuggaaagaucaagccaguuguccuaacagagugucccacauucuagguuugucugggugcaucuuuugauguuuaauguauuucucuauccccacucuuucuugugaaguggaaguugggucuaaaggcuugaguacauuuagcuuauauauauauauauauauauuuuuuuuuuuuuuuuuuuuuuuugagacggagucucgcucugucgcccaggcuggaguguaguggcgcgaucucagcucacugcaagcuccgccuccuggguucaggccauucugcugccucagccucccgaguagcugggacuacaggcacccgccaccacgccuggcuaauuuuuuuuuguauuuuuaguagagacgggguuucacccuguuagccaggauggucucgaucuccugauuuugugauccgccugucuuggccucccaaagugcugggauuacaggcgugagccaccaagcccggccuagcuuauauauuuuugacaagaauacuucauuaggaaccuuuuaaugucugauuguuccacuauuagagacaguaaguuuaaucaugguauuaagguagucacagccauaucacugcauuguaaagauacuuuuccuuccccuacccccauuccugugugauuaggaagugcucugugggguaauacuuuggugccauguggaucuuuuaguuucccauccaccuuucaccuaugguaucacuggugauguuuaccugaaucccuucauuaaagauugcaaaauuauuuuuuauuucaaucauuuuaaauacauuccuucuacuggcauucaccuguuagauucccgcccccccccccgccccugcuuuucaacuaauauaguuccuacuuaaaagacaggauacauuguuuuccucuaccuacuuauuuucagagugaggaguuauuguuagaaguauucacucaucuuuaaugaaauuguuuuguucaucagauuauuucaggagagcaagcaacaagugagcaaaauaaucugggccuggcaggacuacagaggucaaaagggaggacaugagaagccacaagcugucccacagagauggcagccuucucccucccauuuagcggggcuggaaaugagcucccugugacuccuuucuguccuuccccggcuccucccagucaccucagugugagugaugaguagugcagugacagccucgaccacauaccacauuucuguccuguaauagcuuugcuaccgacaacuuucuuucuuuuuuuuuuugguaccaaauuucuuuauuugaaggaaugguacaaaucgaagaacuuaaguggauguuuuggcacaacuuauagaaaagguaaaggaaaucccaacaugcaugcacugccuuagugaccagggaauucgccccauggcuauggggaaauuagccugaggcuuaguuuucauuaucacugucucccaggguguucuuguuaaagauauauucugccaagccagauucgggggcucccaucuugugcaaguuggucacguggucacccaauucuuugauggcuuucaccugcucauucagguaacaugucucaaugaagucacacaaaugggggucauuuuugucaguggcuaguuugugcaguuccaauagugacugauucacauuuuuuuccaaaugugaugcacacuccauugcauucagcccacucucccagucaucacagacugguuucuugauauccugaaggaagauuuggccaccacgauaguuuugcagcuucaucaguuucucggcauguucccucuccucaugagauuggugaagaaaguauguggcaaaguuccucaaagccacaucaucgcggucaaaguuguaagacacggacagguaaacguaggaggcguagagcuccagguugaucuggccguugauggcggccucugaguccuggugguaguucuggcgcaccugcgagguggacgcaguugucauggcagcaacuaaggagagguggcggcgguggcugcgcggcgcuggagcggcggcgggggccuugggaugguccgagggugcagugaagaggggacagagggcuggcuacgggcggccggccggggugggggacgagcgcuggguuccguccaagcacuguugaagcaggaaaccccgacgacucucggcgaagaaugucucugcuacccacaacuuucucacugugccaaaaucagugccuguccaguacccucgccuuuucuaccucuccucugcuagcgauacuguguuuaagucgagugaccuuccucuccuuccucaccaucccugcuucucacacuuacccauacucuuacuaaaucagcuuaccauuacucuugcuaauucaacucaaguaauacaauuaaacaccuccuaaaaugaagaaaucccuuacaucuucaguuaaccucugucuuaguuccuuugggcuauuguugcaagauaucuuagacuggauaauuuauaaacaacagaaguuuauugcccacaguuuggaggcugaggaaguccauuaucagggcuccaauagauucacugucuagugagggucacacuucuggauggugucuuuuauguguccucacaugguggaaggggcgagguggcucgcugcagccacuuuccuaagggcccuagucccauucacaaggucccugcccuuccugacuuaaucacucccccaaaggcucuaccucuacuuuuuuuuuuuuuuuuuucccgagacagaguuucucucuugucgcccaaguuggaguacaauggcucagucucggcucacugcaaccuccgccucccagguucaagugauuuuccuaccucagccucccaaguagcugggauuacaggugcaugccaccacucugggcuaauuuuuauauuuuuaguagagacggaguuucaccauguuggccaggcuggucuugaacuccugaccucaggugauccacccaccucagccucccagagugcugugauuacaggcaugagccaccacacccagccaggccccacgucuuaauacugucacuuugggccuuaggcuccaacauacaaauuuugcaggggcauuaacauucagaccagagcagccccucuacuuagauguacaccaauguaaaaauuaacaugaacucugauaugcuccacugaauacagagacucaaacauggcacccucaauauauaaaaucaguauguuugcaaaauugcaucucuccagaggacagaaucugaaccaguuguuuaaccaguaaguuucaaacagugaaaccaaguaaauaacaguuauucaacaauaaauuaggacacccaagaaguccuggguaaccaccgucaugggaaacagaagacaggucuuucacuaggacagaaggcauaaaauuggacuaaauuuauuguaugguucuuuucugggaucaugauuuuaaaaucaacuaccaagaagguuugaaaauaaaaaucaaaagucgaccaugauuuucuugggggaagagaaaacagcuccugaaccaaagaucacugucgacacuggcagagcagaucccauaggaauggucauacauuuugguugguugguuuguuuguuuauuuuuuguagagauggcagagcagaucccauaggaauggucauguguguguguuugguuuuuuucuuuauuuuuuauagagaugggguuuuaccauguuaaccaggcugguuuugaacuccugaacucaagcaauccacccaccucagccucccaaagugcugggauuacaggcaugagccaucgugccuggccugggucauauguuuaacucuuugaggaacugccagacuguuuuccaaaauggcugcaccacuuuacauucccaccagcgguguagaagaguucuaauuucuccacaugcucgucaaaacucguuuucuguuuuuuuuuuuaauucuagugguccuaguugguaugaaguggauucuucuuucuuuugaccaucacuggggucugauuugcccugauaccaucucuugcugcagccuucaugccuagugccugauccugccucacccugcugcgcguuggcauucagauuugacuuaaaauccgaguggcucagccucugcucugaauugucccuucagucagguguuugcaacuagucuccugaggaguugcuggguuugagucacagaauacaagagggaugccccuuccaggaucuggggguugggaaaguguggcaaggcagguuuaagauagaagaggaagucagcuguagcaagcaaacacauagaccugggcugugggacccucggaagggauauggagccaagcucuuggagugccugaggaauuagcccaaggagcuuuggcuuucaguagcugcuccuguguguagcaaagcaggcuggaguagagugaagggagccugggguaaggaaauaaauuaggagucaagaaguaaugaugcaacuaggauuguggaaauguaaagagguuagggaaagauuuguauggcuggggcuaaaccagaugugaugguugggguaaagggacauaggaagugguuuuggguaugagaacaagagaaaguguuccucuugggaaggacagacggggugaguggaaaguuucugucuaaugugacuuuaggugcuaacacaacacaaggcagacguuugcagcagagaauuaagaaaagcugaagcuggaauccagauucagcaaucgugaaugcagugagaacugaggcaaugcagaguggcugcugcuuccaugucauccccucagauagauaucugcagccuccuggccucugacuauaccuuuuauuuauuuauuuuuuaaagaacagcuucauuggaauauaauugccauacauguugaaacuauacacuuugaguuuugacauacauauguaucuaugaauacauaccauucaaagaugguauguauugugugaaaccaucaccauagucaagagaaugaacaaauccauuacccugaaguaucccaguauuucuucguaauucacccuccugccuacugcccuuccuuaccccucuccagguaaccacugaucugcuuucuaguucgcauuuucugguauuuuguauaaaugggaucuguauauauacuuuaaguauacuguguauuuauuugggggggaguaucuggccucauucgacauuauuauuuuauuugugcuguauguaucuauaguucauuccuuuuuguagcucagugguauuucauuguauagcuauaucacaguuugauuagccuuucuguugauggacauuuggguugauucacguuucuggcuguuacaacaaaagcugcugugaacacuggugcacaagucucugucuagaucuguguuuucauuuccuuuggguagguagcuguuucggaggggaaugguuggggcauaugguaggcauaugcuuuaacuuuguuuaaaaaguugaaauacuuaauacaucauaaaauuugccuauguaaagugugcguguuuuguuuuguuuuguuuuguuuuuggagacagggucucauucuguugcgcaggcuggaguguaauaguuugaucacagcucacugcaccuucauccucccaggcucaggugauccuuccaccucagccccacgaguagcuggaacuaagggcacaugccaccacaccuggcuaauuuuuuuuuuuuuuuuugguagagacaaugucucacuuuguugucuaggcugcucucaaacucccagcuucagccuuuccaccuuagcuucccaaaguacugggauuacaggcgugagacacugcgcccagccuaaagugugugcaguucaaauauucacaagguuguacaaccgucaccaucuaauuacagaaccguuucuuuucucuuuuccuuuccuuuccuuuuuucuuucuuucuuuccuuuuuuuuuuuuuuuuuuuuuuuuuuaaggaaacagggucucacucucauggagcugggaccacagguguacaccaccacacccagcugauuuuuguaauuuuuuguagagacagggucuugccauguugcccaggauuucuucaaacuccugggcucaagugauuugccugucucugcuucccagagugcugggauuacaggcaugagccaccacacccggcccagaacauuuucaucaccccaaaguauauaucuaacuuuuaaaaugguuuuucccuuucacauucuuaccagcaguguacaggaguuccaucugcuccauauccuugccaacacagcauggucauuuaaaaaauuuuuagccuuucuaauagguaugugauggugucucauuauguuuuuaauuuguauuucccuaaagauuagcaguguugaacagacauguuuucaccugcuuauucuuuggugaagcaucuauuagaucuuuugcccacuuauuuuauuggguugguuuuuuucuuacuguguuugagaguucuuuguauauucugauuacaagucuuuuugucagauaugugauuuccaaauauuuucucucagucugugucuuuccauucuauuaauaguguuuuuggaagagcagaagcucuuaguguugaugaaguccaauuugucaauccuucuagggauugugcuuuugaugugcuaucuguuaaaagacaaaauuacaacacauuuaaagaucuuaguuggcuuuuauuugcaauucgugaaugagggcagcuuccauucuacaaaauaggaugaaaacucccaaugggcaguagcagaagaaugggcuuuguaaggugggaacagugaaacaguaauugaaagauaacugauugguuaacaucagguuacuuuuuuguaaggauuaaagcagaggguaguuccuuaucaugccugcuaaaacuggcuuguuuggguauucugucucucuugauuuuuuagaaggucagauaaacaacuuacuuuucuuuuuuccuuuuuucuuuuuuuuuuuuuuugagacggagucucgcucugucacccaggcuggagugcaguggcgcgaucucggcuuacugcaaccuuugccuucuggguucaagcuguucuccugccucagccuccugaguagcugggacuacaggcgccugccaccacacccagcuaauuuuuguauuuuuaguagagaccaguuuucaccacguuggccaggcugguuucgaacuccugaccuugugauccucccaccuuggccucccaaagugcugggauuacagcacuggcgugagccaccacacccagcccacaacuuacuuuucguuuggugacguggaacuuuagcuagagugacucuguuuuguuugaucuagucucuugaggccuaguacaggagcucaguccaaaucaguggccuccugucauuuuuguuuaacauaucuaggaaauccuugccuaacccaagaucugacagucuuuugaaaugggacuggauuuuaaacuaagcuaggaucucagguauccagaaggcauuuaaguuuauaacgugucucaccggauacgcuggagagucaugggggaggagaagaaagccaguuacaaaaguacaucaucaguuguucagucaucugucaguuuaugugugaaugccccucaugagccaggucuguaauccagugggcaguccccaucuccugcauugucucugugacuuauaguuucguucuuucugcugucaaaugaauauauaaagaaaauauccaaaaacuuaauaaauuguaauuaagaaggcaaaucucccaucuuucucuuccugaaaaaauccaaguguaaaugauuuuuuuuuuaacauaaagcaaaucguuauacuacucuuuuccauaaagcauuugggaacugauugcuuguuaggguaaccugaaagcucugccacuauuuccccuaauauuuaaauguuaagaaagggaaugugacuuuuuuuuuuuuuuugagucagggucucacucugucacccaggcuggagugcagugguacaaucucagcucacuguaacccccacuucccggguucaagcgauuuucccaccucagccuccugaguaacuggcacuacagacaugcaccaccaugcccagcuaauuuuuguauuucugguagagacgggguuuucaucauguuagccagggaggucucaaauuucugaccucaagugauccggccgccucagccucccaaagugcugggauuacaggcgugagccacugggcccagccuacaauuuuaaguucuauaauugguagaaaauuuccucaguuuggggggcucaucuucaagaguggagacuaaaguagguucuguaauugcgcuggcuaaagaacaaagaauucuauagcacugugagcuggagaauguuguagcagguuaauaaggggcuuacuccauuuugucaguaaccagcauugguuccaggaauucaagagguggugagauauuaugcuuaaugguaauaagauaccacuuauugguaauguaccaggcauuggucucuggcaucuuaccaucuuuguacucauaucuucacaggagcacaagaaaauuaaaccauccaccuuuuacagauuuagggauuuaguagaaggcugaaggaggccagauaacugaacuuuuacuuguacagcuaauauuaagucggugcaauaguaauugcgguuuuugcaauuacuuuuaaaguuucagaacccugauuugaagcagagcgucugggagucucuucguucuguuauaccagaguuguucuuguaugugaauaaggagcguaucugaaugccuuggcuucagcccuggaagccauugcauucugaccaaccuuuguguaaccauuuuguagacugugaggacucuugucacuccuuaaauucucuccuaaacauauuauauuuugcuucugaagaugauccaaauacccucaaaacucagguggagauacuguuaaaagauaguuuucaaaaaggguaagaucauaacucauuuuaaauauaaaaugaacacauguuaaaaauuuuaacucauaagacaagcaguuacaaccaguucagggagaguaggacaacaaagagcagacauacauguaguaaugucaguaaugucgaaaugaacacaacuggcuuuuccacagggaaggauuaucaagacaguucauuuacuuauccauggacaagagugauuugcauuucccucaguucuacacaacuuagaguugcugaagggcagugaaaggcuagaaucauauaaccuagaaggauguguuccaaagcuuagaguauaaaucuaaauauugcaguuucccauuggaaacaucccauggucuuuuuuaaaauuuguuuacagaaugugagaguuuauaauacuauugucucguuuuuuuuucuuccauaacauauuuaaaauucuugcuuaaaaauguuuuugauggggauaggggguugugaauuaaauuccuaacauguccuaauaguuacauguuaugccuaaucuguuaguguacuugggugauaugacacuuauuuuaagccugaugcacuuagaagcauguucuacuuuggauaucuguucugaggaugguagcuacaaaaugaacuugugcccuuucgcaaauuguuggacuuguggugguugucuugugucccuaguaucugauuuggaagacucaauuaaggguuuaaaagccugcagaaggcgcgggccgccacgccuaacugguuuucauauuuuuuugguggagacgggguuucgcuguguuggccgggcuggucuccagcuccuaaccgcgagugaucugccagccucggccccccgaggugccaggauugcagacggagucucguucacucagugcucaguguugcccaggcuggagugcaguggcgugaucucggcucgcuacaaccuccaccucccagccgccugccuuggccucccaaagugccgagauugcagccucugcccggccaccaccccgucugggaagugaggagcgucucugccuggcugcccaucgucugggaugcgaggagccccucugcccggcugcccagucugggaagugaggagcgccucuucccggccgccaucccaucuaggaaguaaggagcgucucugcccggcugcccauugucugagauguggggagcgccucugcccggccgcgaccccgucugggauaugaggagccccuccgcccggcagccgccccaucugagaagugaggagccccuccacccagcagccgccccaucugagaagugaggagccccuccgcccggcagccgccccaucugagaagugaggagccccuccacccggcagccgccccgucugagaagugaggcgccccucugcccggcagccaccccguccgggagggagguggggggcagcccccgcccggccagccgccccguccgggagggaggugggggucagcccccgcccagcaagccgacccguccgggagguggggggcaccucugcccggccgccccuucugggaagugaggagccccucugcccggccaccaccccgucugggagguguacccaacagcucauugagaacaggccaugaugacgauggcgguuuugcagaauagaaaagggggaaagguggggaaaagauagcgaaaucagauuguugcugugucuguguagaaagaaguagacaucacuuuguucuguacuaagaaaaauucuucugccuugggaugcuguugaucuaugaccuuaccuccaaccaugugcucucugaaacaugugcuguguccacucaggguuaaauggauuaagggcggugcaagaugugcuuuguuaaacagaugcuugaaggcagcaugcuccuuaagagucaucaccacucccuaaucucaaguacccagggacacaaacacugcggaaggccucaggguccucugccuaggaaaaccggagaccuuuguucacuuguuuaugugcugaccuucccugcacuauuguccuaugacccugccaaaucccccucugcgagaaacacccaagaaugaucaauuaaaaaaaaaaaaaaaaagaaaaaaaauuuuuuuaaauauaagguaaucuacaucuucugauauggaaagaggucuaucuauauauuccccuaauauauguauuaacuaaaaaaaaaaaaaauuaaaaaaaaaaaaagccugcagaaacuuacgcuguuagguaagaguuggcagucugacuccccuaggagugacuucccccuucucccuuucuaaugucagcaagagauaaaugcuauauggccaaaauuuuugauuccuuugaucuuaacucuuugugguguuggguggagagugguugggagaggguggcaaaaaaguucaccuuucaaccagucuuccagucaguuggaucaucuuuugaacugaaaggcucuuggaucuuuuuuuuuuuucucccagaaacagaguuuugcucuguugcccaggcuggagugcaauggagcaaucucggcucacuguaaccucugccuccuggguucaagugauucuuuuauuuauuuauuuauuuuugagacggagucucgcucuguugcccaggcuggagugcaguggcacggucuuggcucacugcaagcuccgcucccggguucacgccauucuccugccucagccucccgaguagcugggaccacaggcgcccgccaccacgcccagcuaauuuuuuguauuuuuaguagagacaggguuucaccguguuagccaggauggucucgaucuccugcccucgugauccgcccaccucggccucccaaagugcugggauuacaggcuugagccaccgcaccuggccuuggguucaagugauucuugugccucagccucccguauggcugggauuacaggugugagucacuacaccuggcuaauuuuuguauuuuuaguagagacgggguuucaccguuguuggccagguuggucucaaacucccaaccucagaugauccacccaccuuggccucccaaaguguugggauuacaggcgugagccacugcgcccggccgacaucccuucuuaauguccuuuucuuaaauguaugaggagugggccacugagcagggagagcccugguugggguccuuugauuggagaauagcaguaauaauggggaggagagguagaaaugcaaccuggacauuuguaggucuuuggccacagcuuguguucagaugggaacugguaggccaccuggcuuuuagugagacuguucaccuugccuucuguugagccccauugucuuggucaacuguaguucagucugucuuccguuagucuccacccuuccuccacuagcagagaagaggacacauuugccuuucaccugguguaacaucccucgccucuuccccuucucucuuuucuuaguagcagugccguaccacauucugugggcuuccugauuugagaacucuggggcuuguaucccauggauggugguagagguuaaguuuaaguuuucuccauuuguccugagcaggcauaauguuaugcuuugcauuauuuacuacacuuguuuuggagcauuaaaaaauuccaaguguggagacagauuauccuuuaccuaaaugaauuuguuuuacuuugggauguuguuggaaguggucauaaggaaauuguugaggaauauaaaucuagccccaugaaaugccuguuaaguagaauucuuuuuuuuuaacuugacaaguaauuuuuaauugauaaauaaaaaugguauauguuugugguguacaauaugauguuuugaaauauauauacacacauuguagaauggcuguaucaggcuauuuaacauuugcauuaccucacauacuuuuuuuuuguggugugaauguuuaaaaucuagucucagcaauuuucaaguauacaguacacuguuauuaaucauagucaccaugauguacaacagaucuccuauuucuccuguuuaacugaaauuuuguguccuuuggccauugucuccccagucacccuacccucagguucugguaacuaccauuuuacucucuguuucuaugaguuuguuuucuuuagauuccacagauaagugagguuaugcucuauuugucuuuccugugccaggcuuauuucacuaaauguaauguucuccagguucauccucguuguggcaaaugacauaauuucuuuguuuuaaaaggcugacuaguauuccauugugcauauaugccacgguuuuuuuuuucuuuuuuuacaggcagggucucacuguguugcccaggcuggaguacaguggugcgaacacagcucacuacagccugggucucccaggcucaagugauccugaucccuuagggcccagcugccucauccucccaaguaguugggaccacaggugcacaauaccacacccagcuacuguauuaauuuuuuuagagaugggguuucaccauguugcuuaggcuggucucaaacucuugggcucaagcaauccuucugucuuggccucccaaaguugcaggauuacaggugugugccacuaugccugaccaacuacguuuucuugauccauucguccauggauggauacuuaaguugauuccauauuucaguuacugugaauaauacugcagugaacaugugagugcagaucucuuccacguacugauuccauauccuuuggcuauaucauuggaucaaaugggaguucuauuuuuaauacuuucagcagccuccauacuguuuuccauaauggcuguacugauuuacauucccaccaacagugugcaagggugccauugcuccacauccuaacaccaaucuuugucuuuuugguaguagccauucuaacgggugugaggugguaucucaguguggcuuuaguuugcauuucccugaugauuaguugagcuacacacacacacacacacacacacacacacacacacacacaccccuauuagucauuugucuauuuucuucugagaaaugucuuuuuagguccuuugcccauuuuaaaaauuagauuauuuguuuucuugcaauugaguugcuugaguuccuuauauguuuaggguauuaagcccuuaucagauauauguuuugcaaauauauucucccauuucguagauuaucucugcacucuguuguuucucaguaugauucuuuuuuucuuugagacagggucucacucugucacccagccgcuggaguacaguuauaugaucacugcucgcuacagccuugacauccugggcucaagugaucuucccacuucagccucccaaguagcugggacuacaggcgcaugccaccacacuuggcuaagguuuucuuucuuuuguuuucuguagagauggggucucccuauguggcccaggcuguucuuaaacuccuggguucaagcaguccucgcaauguauugggauuacaggcaagagccacugcacccagccucuauuguucuuauaauacuugauaauaaaacacaugugacugccuugcaaaacuccuuagaacuccucaggaggacugucuccaaucugaugaaacuaaacuaucacuagcagauuuucacaccuaaucagagaaaacuuuguguuacacagaauuguaaaaauuugcauugaaguuuuaaaacuuuacccugcucagccaaggacucuauaaaagcugcuccagucaaucauugugaucaauuucuguuuaguuuuugagauggagucuuacucugucuccugugcaguggcgcgaucuuggcucauugcaaccucugccucccggguucaagcgauucucccacuucauccucccaaguagcugggauuacaggugugcaccuggcuaauuuuuguauuuuuaguagagacaggguuucaccaugcuggccaggcuggucuugaacuccugaccucaagugaucugcccgccucggccucccaaagugcugggauuacaggcaugaaccaccgcgccuggccaaagagccaguauuuuuauugugugucaggagggaaagaagaugguguagauaucaaguagugaaaugaguaagggcuauaaauugagucuugagauguuugaagaguauauauuaauccuaguaaaaugccuuagaauuguuuagaccaacacuguauaguagaacuguccaauauaguagcuauggcugagagacuguauuugagaucaugcaauuuccuuuaaauagccaccgguggcuaguaacuguuacauuggacaguucagguuuaaacuaguuuucucaauuuuuuucauuauuguaccucucuuuuaccccuaagccuuuuuagaccuuuuuuuccuaaugucuccccugcuucaaugaaauuuuaauaccguggauaugcugugcauacauuguggcuccuagagggcugcagauccauguuaauuaucaccucuguuaggaauguguggucuagacuaaucagggauuggcaucauagugaagccuaaccaacuguuguuauauuucuugggcaguuaaaaucacuaaaggcuaaucauacuuacgaugaguauuauucagaacuucagaacugagaaaguuuuuggaguuuuggaaguuuauaaaaugcucagucauccuguuuuucuucauaugugacauucuuaaagcaucaacuuguuuuaguaauggauaguacuuguacaaagauacagacauuuaaagaaauaaaaggagccuaauccagccagagguaggcaaccaagaaguuaaggcaucuagaagccauguugcuugcagaagaguugagagaaccagagauguacaguuuuggugaucgauagacugggugucucaaauaauaagggauaucacaugggaaaaggauuagauugguacuuugcugccucacagaacaaggcagggagaagaacuacacagagacagaaucuaguucacugcaugauuuugcagcuagaauaguuugaagauggaacacugcauaggaggaaguuaaucauuauugaaaguguuugggcagaaaccaggugauguuucaguauuguggaccaaguauaucgacuaauauagagcugaaauaaaaugacuuuuaaggauucauuguggggcuggguacgguggcucacgccuauaaucccagcacuuugggaggcugaggcgggcagauuaccugaggucgggaguuugagaccagccuggccaacauggugaaaccccgucucuacuaaaaauacaaaaauuugccgggugugguggugggcaucuguaaucccagcuacucaggaggcugaagaguugcuugagcccaggagacaaagguugcagugagccgagaucacgccacugcacuccagccuggguagcagaggaagacugugucucaaaaaaaaaaaaaagagagauucauuguggcugaguuucaggugcuuugguuuuguucuacagcuggccucaccauuucuaaauacauagaauuguaaccauaagagguccauuaccugaugcaugcagcaaugcugagacacuggguuguagcagagaaagaguuguguguguguugggguggggugggggggugguguuggagacaggaucuugcucuguuacccagacuggaguacaguggcaagaucauaguucacugcagccuugaacuccuaggcucaggagauucuccugccucagccuccugaguagcugggaguaggcacgauaccaugcuuggcuaauuucuuauuuuuuguaaagacgaggucuugcuguguugcccaggcuggucucgaaacuccuggucucccaaauuguugggauuacaggugugccaccgugcccagcugagaaagagguuuaaucauagggccaccucaugaggagauaggagagaacugcacauccauuucccuagggaguuuggggcugggauuucuaaggguuuuaagugggcugaaguguggagauuguugauuggucaaagagugcagagugaagucaugggacagggagagaagcuguauucucaugcugaucauguuccuccaugggggucuucaaacugguugcuggaauuggggucugauauacaucuuaagcaauccuuaaauaaaagccuuaugauucuaaugucagagaugcugucuauaggaacaguggggacacaaaucaauuuucacacaauuuuaugacccugauguuagaaauccuaucucuaggaacaguggggaugcaaaaagucagacuuguagcaacaaggaaaggggccaaaguacagucugauuaaugcuuuguuguaacuauauuucuauccagaaccagcaggccauuuuuuucaacucuguggaggcgguuucagaauuguguagaugcccuuguccaggaaggaguugugaaguagcuaguugaauauagccacugagguuuccaguuuaacacuuacaaagcuacaggacacaaucuuguacuuaccagcuuauagagaacugagauggccccuuuuugaaguaagaaaguguuuacaguuuugucugcaggucauccccagcaccuagcucaguaauggacacuucauggcacucagcaaguguuugaacuggauuugguguguuuacccccuagcucauggucagugacuacugcuucugaauuaaaaauagcaacacaugaucagauuuaaguggggccagaaagaggcuguuagggcauaggauauuuuagcaugaaguggauaggaucaugagugguaacccauguucuuagggcccaugugccuauguggucacugcaaaacaauaaaaguggaggcaagaauucaaauuaguauaugggagugagccacuuagugacccagugcccauguuucagugcugcuuuguuuuucuucuaacaaagggcauuuuugcccuauguaaaaauugguauuggccaauuaggacuucacaaaggucuccauaucuuccucaaaugacaagggucuuaugcuaaaugugacucucuacugcccuguuuguuaacauaugaugcaguacaccaaugcagaucacacugcaguuuuagguaguauauagcugaaugcauaauuuguauuagaaauacaacaaggacauuagacucaugucugcauugacauggauacagcaaaaaucuugaaguuagugugagagauuacaguagugagauuuggaagauggaauaauacuuguugauuaagugcauauuuuucauuuaaguuagaaaagcccucauaacaaagccacccauauuucaugugucaaauggaaugcuaggagcuuucugugcauuaucucauuuguggaggauucucauuuuucacauggaagcagaggggcauuuaaguucacacagcugccacuugggguagcuuaucccuguaaucccagcacuuugggaggccaaggugggaaagaaugugugaacccaggaguuugagaccagccugggcaauguagagagaccucaucucuaccaaaaaauuuuucaaaaaagaaaagcugggcaugguggcgugugccuguagucccaucuguucaagaggccaagggugggaggaucucuugagccccggcggucgaggcugcagugaucaugcucuacugcacuccagucugggaaggagggagagaccuugucugaaaaaacaaaaaacaguucacacagcugaauguaucugaggugagauugaaacccaugguuguggccgggcacgguggcuuacuguaaucccagcacuuugggaggccgaggcgcugaauuaccugaggccaggaguucgagaccaaccugggcaacauggugaaacccugucucuaccaaaaauacaaaaaucaguugggugcgguggcacgugccuguaaucccagcuccucagguggcugagacaggagaaucccuugaacuugggaggcagaaguugcagugagccaagaucgcgccacugcacuccagccugggcgacagagcgagacuccaucucaaaaacaaaacccaugguugugauccuaaaaccggaagguuggcuuuccauugucuuguuuuggcaauuucuagccaucuuucuuuccccaguguucaguauaauuagcagucuuccugagaauuugggagcauuuccuucugguuaccuacaauagggacugugaucucaaguuccuuaagcaucuuugaaugggacaaaauagaaccuggccugcuaccuugcacaugacuagcuauggagccuuagacaaguuguguaaaucucgaauucucaggaagaaaaugccauuugagcucuagcugaauggagaaacacugcacaugccagaaccguucucccucaugguccauccaggcugaugcccgcauggguggagaugcuugcugucuuccucccugugcccuuuucccagccucacaagcagcgugugaggucaccuuugauggugccacauaagcuccaugggcuggcucuaagggacagcacuguguucauggcacaaaggccugcugugaccaguaguaacagcaaaagugacuguaccuucugauacuuagccaccccuucuugugacacacaucagcaugccucuguuguccauaguaggcucuaguaggaugcagggcugucagcagaauuuauugaaaccuggaaauggcgggguggggggugggggaagugcccaggcauucuuuaugucuuguauaaucucucuagauuuuguuuacucucuucaacuauuuauuaccaaaggaucacaggucaccaagcaugaggaaguacugucuauacguuuuaaguaagaguccagguaacacuuauuguuguugcugcuucagagaauucuccuuggccagaauugucagcccaccuuuucuugcuuagugguauauaugaggugucauaaugggcaagagguucaaagucuucauuugaguaagagagugucuugugcuaagcaucugcagcccucaggggaaccuaaaagaaggcacucucacagaggcagugacccaaaaauguauaucuaaacaaagacagauuggcauucuccaucaucucuuacuuggccucugggcauguccacugucccugcacaauuguuuaccaagcccuugcaccacaggcacuacugggauuaggaauuuggggaugaaggagagaauaccuucaaggagaauuuaucccccgcccccccgccccccacaaacacacaccucccaccugcucuauccuccuccugcccuacccccacuuagaugagaggcagagacccagguagucaugauucaaguaugcuuuucaaaaaggugucugggccccaggugcucuugcguuugagggaguaguauccaggaagacaggcucucaacacugccuagaccucaccugcccccuccagaugagcaggcuccugggcagaaagggcauuacauuagggggugaggugggacccugugggaggaauggcaagcccauuugagacaagccgugugguggcugggaacgagguguauucuggagaaggacuguaaggguagacuagauaucucccucaccuggcugcuuuuaugugcccgcucaggccucuagccuugguggaucuaugccuucgggccuuguuccugaaucccaacugucucauuggccugccaggauaacuuacugcgccaccccccugaugcuuagcugcucucuguaccugaaccaucaaucuugcucuuucucauuccagucauuuaacauuuuccagcaugcuuucugggaacuucucugaagcuuguuaagggauugauaaccaguaaaauguuuugaccaguuauuuuuaacaugcugaacacuucuuuuuaggcauugcacguucagcuguuuagucuugccuuugaaaacauucaguauuucugcugguagugcucucuccuuugcuguacuuugccaugauuaugucaucugggccaccagacagcagaccucuagauggcagguccagccaucucuucucuuuugcuuuccgugucuggugaaugcacguaacauucccaauuuagcacaggcgucuagauagacuucagccauaaaauccuagcacaaacuaguauucccucaguuaacagugaagcuuaaauauaacuaaauaccacuguaucuuuaaaaauagauuugguugagaaucaccucaaacuuagcaugucuaaaaucaaacacaauuccuccccaagaaacacguuacuguuuuucagacuucccugaucuaagaaauccucuuggucccaugagacauaaacacaggugacuuccuuggcguuuucccucauuucccauacccaucccaauccaauccaucacuagaugccauccaccuuuacuuucuccccauucucuucugcuuucacacuggucuagugcaguccucucuugccugaagguggcgcagcauccucacuguccaccgcagggucuccuacccuccccacugcaggcaggcagggcgcuggcucugcaggaugaacacugcugcuuagaaaucuccacaagucaggcuucucauuacucugugguuuugggaccuuaguacggcccacuguguccugcgugaucaggcccaggcaccucauuuucauaucccccuccaaguaaggccuugcaugugcguucuuuaaggaaaacuguuuguucccuuuucccccuucauauccagguucaguucuucccagaggaauccuucccuaauucucccaaccaagguaauuacccuuaaaguaaacuuaacacgucuugaucacaguaguauuuuacuuuuugcauuugguaugauuucuccuuauagucucguaucuacuuuugcccuugguauauguuugauuaauauaguaagauuaauaacacaaugauuaguaguccuggggcuuaagaguucuauucauggcaugauuuuuuuuuuuuuuuuuuggagacagucucgcucugucgcccaggcuggagugcagugaugcaaucccagcucacugaaacuucuaccccccagguucuagugagucuccugccucagccucccugguagcugggauuaccaaauauuggaguagagcuucuuaacucuguagaagagagaacagaauuacauuuuugcaucugggcacaguggugcauaccuauagucccagccacucaggaggcugaggcaggaggucacuugagccacaggaguucuggguuuuagggcauuauaccaauugggugucugcauuaacuucggcaucaguagagugaccccucagaagcaggugaccaccagguugcccagggagggugaaccggcccagguugcgaauagagcagaugaaacaucucuccuaugcugaucaguagugggauugcaccuguaaaaagccacugcacuccaaccuggacaacacagugaaacccgucucuugaaaauaaaaaauuaaaagaauuuuuuaggcugggcacaguggcuuaugccugcaaucccagcacuuugggaggcugagccaggcagaucaguugaauucaggaguuugagaccagccuggccaaaauggugaaaccccaucucuacuaaaaauacaaaaaggcgugguggcucgcaccugcaguccuagcuauucgggaggcugagacagaguugccugaacccuggagggggaaguugcagugaacagagaucgcgccacuguacuccaaccugggcgacagagcaagacugucucaaaaaaaaaaaaaaaaaaaauucuuuaagguauuuggucagcuccuugaugugcuucucucacuagauauuuucauuguaaugaaaguguuuauccugccccccuagauccuuaauguuucuuuucaaaggcuucugucuuuuccuacugaguuucuuccuagaggugguaauucuaaauggaacaacagacugacggccuacuucccgagugcccccaaaugacuucauaauuccacaaaaguggcuuggccagagccauccacucauccccuuccuucuuccuugucagacuacuggucuuucuauucuugcccccuccccagaaugaauauuuuuagaaaccaagugacuccugaugagcuucuuuuucuucaucuguuaaaugggaauucucauuguaucccuauaggcuugguuuguuggaggaguaaacaaauugccccaggaaagucuguaguacaguccccggcacaaagugcauucuguaagugguagugaugucuugcuguuucagggggucuucacuauucaggcccuaauuagauuccucaguuugggaaguugagaagagucugccuacaacagacacugcuguucugcuugaugcccagugcaguaguauuaugugacuuucgaugccuuucuggucucuccucaugaccuucuccaaaacuuuaugagcaaauauugcuugccuacuucacucugagccuugaagucaaucaguuuugagggcaagaugacugcugggucuucucuaauggucauauacagagcaugaagucuuggaagaaaaugagauggacagagagacauuuacccauguuccgugcuggugaaaguguggaauguuacuuuggaaucugcucagaagccugcuacuuccgaacucuguaucccuaugaugcuuccuucccagugcuauauuuagaucauaugugcaauaagucacauucuaguaggcaggguaggcaaagaccaucagcagaaugagagacacauggaugaaauguauucuacuaauccaagaaaugccgagugauuaaaacauuugugagucugaucagauuaugcugacagaguguauauguagguucaucucaucauaauugaaaacaaugcauacuuagcagcaagggaaauuuugagauuauccaugugcugaauaucaugcaaccuuaauguuaauaacaugggaagauauuuaauauagaaaaagcaagaugcaaaguuauacaugguauauaaccucaaccauuugaaggaaaacuagaaagacauauacucuaauacuaauagugauugcuucugggagauggaauugucaguagcuuuuugucuucauucuuucguaccuuccugaguuuucuacaauuugauaccauaguuagggugggaacagugcaggggagcagaaaagccaacugugauuaggacccaguuguugcagacaggcaacuuggaaacaccaaccaacuaaaaauguuaacaaacuauagaacauuaauugguuuaacugucauggcuuuguugaaccuuuagcauuuguucaaauaucuagugcuaucauuacgguuuuggaucgggcacaacauguaaaucagaacaguaguuguagacucuucacaucagugguuuccaaacuugguguguaugccugaauugccauaaaagacuuguuaaaagucccagcccucacaagccagaauccuccuuugggugagagcugguacugcaaaauggcaugguaggaccugggcugacacuccugguaauuccagcucugccacuucguugcugucugacuguggaugugaugaacaccugguucaauuucaucuccugcauuuuacacuguuguuuugauggcuuugcagauauaguaauccucuuuaucugcagucaaucguggucugaaaauauuaaacgggaaacuauagaaauacuauucuuaaguuucuuuuuguuugucugcuuuuugagacagaggguuguucugucacccaggcuggagggcaguggagcgaucauagcucacuggagccuuaaacuccugggcucaagccaucuucccaccucggccugccgaguaacugggacuuacaggaguguaccaccaugcccagguaauguauuaaauauuuuguagcgacuggguuucaacauguugcccagguuggucucaaaacuccuggccuuaagcagucuuccugccucagccucccagaguucugggauuacaggcaugagccacugcacccugccauaaguuuuaaauugcgugcuguuuggauuagcuugaugaagcuugugcuaucccacccaggaagugaaucaucgcuuuguccaggguuucuacaccauagaugcuaccugcccguuagucacuuaguagcugucuugguuaucacaucaauguugcaaugcuuguguucaaguaacucauaauugacuuaauaauggucccaaagcacaagaugcuggcaauuugguuaugccacagagaagcucuugaagugaaaagguaaaaauuguugacuuaauaaggaaagugaaaaaauuguaugccgagguugcuaaaauuugugagaacauauuuucuaucuuugaaauugugaagaaggaaaaagaaaaucaugcuaauuuugcugugacaccucauacugcaaaagguaaaagccacaguauaugaugagugguuaguuacaauggaaaaagcauuaaauuuguagguggaaaacaugaacaucaucaauguguccugacggaugacaaguuugguacuugcuguguuucaggcauucacugggggucuuggggccuaccccccauggauaaguggguacuacuauacuuugcuuucaauuccugcaacaccauaaagccuucaccuccacgugagcuguuauccuaccugcaagaauucagacuuucgaauugcuaacugacccccaacuuccuagcccuucccugcuguccucauuuucaccauagcaguccuuugcccuuccccuagguaccccuguguauuccugguuaaccucuuucugaccaccgaccucugcccacccaagcccuugaacaauauuuuucuugaucuuuuuaccugcucauguuuccuuauuuugucugcuuauguggccauuuggcuuuucuguggcauagaugaagaaggugaugacugcaggcgaauaaaggaagaugccagcuuuugauuuguuaugagaaacauuguacuugaaagaaagaauuguuucaucguucaaauacugguaccaauacugguaguuucgcucugaggagcuucuuccgaugcacacuggugagguuugguuugguggcagaaggaaagaaauguguuaugaauauaccuuauucuagaaaauuuuuagaggauauuaauauauacauggauuaauggauguuaucuaaaaugcuuuccuugaaggaccaggucucagagaucuuauguaacucuuucuuccuuucuacucugcuggcugcagauucuccugugagaggaaguggucggugcuuuagagaacuguuuuccaguuagaaauuucaaacuuuguagccuuuuuuuuuuuuuuuuuuuuaaaucuuugacuucauuucgcucuguugcccaggcuggagcgcagugaugcgaucucggcucacugcaaccucugccuccuggguucaagugauucuccugccucagccucccgaguaguuauuacagguguguuucaccacacccagcuaauuuuuguauuuucaguagagauggguuuuuaccauguuggccaggcuggucucgaacucuugaccucaagugaucugcccgccucagccucucagagugcugggauuacaggcaugagucacccaugccuggccauaggcuuuuaaaaaauaauuucagucuucagaaauccaugaagauggaaauagaaauugauaacaaaagcagaaauugcuuuuggacauuuugaagcuaacucugcuugggcagcuucuuguagcaaaaguugcauuuaguguguuuuguuccuggcuuuuuuuuuuuuuuuugagauggaguuucacucuuguugcccaugcuagagugcaguggugugaucucggcucacugcagccuccaccuuccagguucaagcgauucuccugccucagccucccaaguagcugagauuacaagcgcgugccaccacgcgcagcuuaauuuuuguauuuuuaguauagcugguguuucaccauguuggccaggauggauuugucagucucuugaccucgugauccaccuaccucagccucccaaaaugcugggauuacaggcaugagccaccacgccuggccccuggcucuuuucuagaaacaagugucccauucuugaucugggagaacauuaaguacaaaaauauaccuuuuaacuuuugccaguuuaaagccaucaauguccuggugaaagaagauguggaauucuuaguaucagcuguuuaguaccauuugcaacaacucugaaaugcuuagccagcccugagugaagaugaaaaucugcauuuaaauguaauuugucuuacaugaugaguggagauuuuugucaucagaaauugauuugaaaaaaucaacagauuaacauuuuucuccaaaguggagguggcuguuugaguguaaagguaaugugcuccucuaagagucacaguuaaguauaaggaaacaaaaacaucuguaaucccaccacauggaacaacuugcuaauauuuguguauauuccuuucugcuucauguguaaccauuuuuacauuuaaaucuuuacuccuuugggaaucucuuggaagaggagauguagagaucuuaauucucaccaaaauuuuucuggcucuuaccauuuagugaauuguucaucuuuuugccacugaauuuuauaaugccauauuugucaaaauuguucauuucuggugucuguuucauugaucgguuuaguccuauuccagcaccccacuguuaauacuguauuuuuauaacaugcuuuucaagacuguaaaggcaagucucuugucauuuguguuuuaggggaagggacauuucuuguguauuuauuuauuuuuaugaauaaaaacgggauuguuuauauuaaaugcuccccagccuccccuucccaccucaaaaacaacaacaacaacaacaacccuggacuuguuuaaauaggagagaaugcaugaaugcaagucuuuacauuaaggcucccauagacuguuuauucaaauucuuuuuuucucuguaaaauuauuuuucucauuuagguccuguacucgugcuaaccacuguaauagugauuguuguauaaaugggaaaaaucuuucaggaaagugaauuagcaaaaaucaugaaaacuucuucauguuuuguuuguuuuuuuuuuuaaagacaauuuugcucuuguugcccaggcuggagugcgguggugugaucucagcucacugaaaccuccgccuccugaguucaagcgauucuccugcuucagccuuuuugguagcugggauuaguugcccaccaccacgaccagcuaauuuuuuguauuuuugguagagacagaguuuucccauguuggccaggcuggucucgaacuccuggccucaggugauucaccuuccuuggccucccaaagugcugggauuauaggcgugagccaccgcgccuggccaaaacuuugcucuggacucagaaaucccaucccuaaacagaaucugugaguuacaguugacaaaauccuuuccuugcaugagaauuugacuuuuguuuaacuuucuagcucuguuucccugggagcuagauaaggcagaacauaacauuuguuucugggcaugguccuugugguaaaauguccccugguugguaaauuacauuuggaugggaaagagccauggauaagugaugggccacccaggcuuuuguuucauggaacacagugacucugcugggcauguccuuauggggagccuaaggagcugucaaaagagauacuugcacccccaggauugagcauucugagucaagguauugagucggcacagucucccugugccugagccaucuucuguauggacucuugcaagaacugcugcugcugaugaccugccacugcccugccugccagcuuugucugucccagucuuucucagugggcuugugccacauguggccugugauaaucuuacgagucagaaucuagaaagaucuacccacccaucaacccucacacagguguugcuguaucucaaggaaguaaucccauagauuacagcauuuuuuccaaauuuuuguuauauuaaauaaagagcgggaauggcuauuuaaaugcuuaauucacucagaggaauauuagacauuaagacguaagguggucucacggucacugcuuugugacacguguggguagagacucaaagggaaggaaacaaacaugaauucuaucauguaggagucuggagguugaaguguauuuccuguuuuuuuucuuuuuaauauuauuaaacagcauugguacaccagugaaaccuauuaacaaagcaaguuaugcaaaucccuuuucccauucuuaaaaucagucacuuucauaaauauucuccaaauaucuuugcauauccuuuuaucaucuuuuuaucuauuuucuuuuuuuuuccuuuuugaaaaagagucuugcucugucgcccaggcuggagugcaguggugugaucucagcucacugcaaccucugccuccuggauuuaaucgauucuccugccuccgccucccgaguagcugggacuacaggugcgcaccaccacacccagcuauuuuuuuguguauuuaguagagauggaguuucacuauguuggccaggguggucuugaacugcugaccucaagugauccaccugccucggccucccaaagugcuggcauuacaggugugagccaccacacccagccuuuuuuucccuuccccaccacucacugcaaccucugccuccuggguucaagcgauucuccugccucagucucccgaauagcuggaauuacaggcacccaccgagcuaauuuuuauuuauuuauuuauuuauuuauuuauuuauuuauuuauuuauucauuugagacagugccucgcacugucacccaggcuggagugcaguggcgugaucucggcucacugcaaccuccgccucccggguucaaacgauucuccugccucagccuccugaguagcugggauuacaggcgcgugccaccaugcccagcuaauuuuguuuuguuuuuuguuuuuuugagacggagucucgcucugucgccuaggcuggagugcaguggcgcaaucucggcucacugcaaccuccaccucccggguucaagccauucuccagccucagccuccugaguagcugggacuacaggcacaugccaccacgcccagcuaauuuuucauauuuaguagagacgggguuucaccguguuagccaggcuggucucgaucuccugaucucaugauccgcccgccuuggccucccaaagugcuaggauuacagguaugagccacugugcccagcaauuuuuguauuuuuaguagagacaggguuucaucauguuagccaggcuggucuugaacuccugaccuugugauccacccaccucgggccucccaaagugccguuauuacaagcaugagccaccgugcccagccuuuucuauuuuuaguagagacgggguuucaccauguuggccaggcuggucucgaacuccugaccucaugauuugccuaccuuggccuccccuucuuucuauuugaaacuugcccccauuaucaucaucugaucucuaucuugaaauaugauaccagaccuuagagugugacauuuaaacuuugaccagucaaagcggucccuggggagaaagguaggggaauaguggggcuccacauauaauggauaguuugggguauaccucucagugcugauuaugauggaagacagaacuccaagucaucuuauacugccccuaacuagcacuaguaagaacuuucuagaugaaugcuggugggcugagauaccgugucuucacaguccagccaugggcaugaggcuuuuggcagagaaacagcuugacccucugcauaggucaugggaccuggggugugugccuagcaaaccauccucuagucuggcuccuauucccauacuguucuuguagccagaaacagacucugaagccaucgaggaugguuacuuucaagagcguaggccuucuuagcaaauccugcccuuuaggacaguagucaggucugauauuuccuuuuaguuaguggucuuggguguaauaccaccucuugagaaagagaacaauugacagccaagcaucuggaaagagagggauagcuggauuaccuugccuaggagcuguaaccugcugcuucucucacugucuucuggacucuguguucuguuacucaucucuguauuuggcauaccuuaagaugguagcggccaguauuuacuagucaucugcuguauucuaguuacuguccugagcauuuuauuuauucagucuucacagcauucuuaggacauaagagcugucaucucuauauucccuauuccaacagagaaauuaaaugacuggcucaaggucauauagcuaaauuaauaagcggcaaaaccagaauagaaaucccuguggccuggguucauaucugcugcuuaagucacucccacuauaggcacugcugucagccuugccuucaaaagguaggugguuaaagaggaaacuaacaaguaguucuucugagucccauucauuuucuggaagucacugagucauacccuggcaaaugagaggcaauuacagcaggagcccugucuugaugaguagauagaccaugcuguggcaaguccuggaagacaguugagcagagaucaggcauuuuucacaucuucugguuaugaguagacaaggcugccugaaagauuuucuggaaaagaguagucacuagagcugcagagucaaguauucagacgguacccaacauuuaauaaauuucuacuuggcauugaguauacaguggggaguaaaacugucuucauggagauuguuagaaaagggauagacuagauuaauauaguacauaaaaaugucaauuagugguaagugcucugaaggaaaagcaagcagaguaacgggauagagagcaaaugagggguuaugcugcuuuaaauaaagcggucacuucuuugagaaagugauacugaagcagcgaccugaaugaagcaaggaccaagcuguugaguaaguuggagcauuaguucaaauugccaauccauucaauugauccaccacccaagugagagaauacauucucuccaacagcuugcaggggcaggauggcccugcugugcuguucugccucgcucuuggguccagaguuuuggugagugauacuguuuuuuaucagugcccccugguggaaggaagauaccuagcaggaagguucagggcccugcacuguuggggcugcucagacauuugugcaagggagguguuuuguuuugguguuuccaucacacucacagugauuucuccuuuucccccuuuaguuugaaggaugaccucuaggaagaaaguguugcugaagguuaucauccugggagauucuggguaaguuacucaugaauuugagcuaacagauuggcuuagagcuaagccucucugcuguggagcccacacuguccgugcugccacuucuugcuuucauagugaggcuuagggccuuacauguuucccuccacggcagaaauuuagaugaucccuuguuauauaaccuuuuguucucuaguuuuuagcaugauuuuuuauggggaacggauggcuauuugaacucaacuaaggauaggcauuuucauggaaucccuuuucuccaagcuggccaggcuggggagucuuccuuacguagauguauugccauuggcaucuggcguagcagaugugcuuuuuuuuuuuuuuuuuggagacagagucucgcucugucgcccaggcuggagugcaguggcgcgaucucggcucacugcaagcuccgccucccggauucacgccauucuccugccucagccucccgaggagcugggacuacaggcgcccgccaccacgcccggcuaguuuuuuguauuuuugguagagaugggguuucaccguguuagccaggauggucuugaucuccugaccucgugauccgccugccucggccucccaaagugcugggauuacaggcgugagccaccgcgcccgacccagaugugcguucuuagugcaccauacaguauccuccugcugcugugccugcuucagaucuaucugcaaaagagccugggacggcagaacuggguucugauucuagaugugccacuaaccauguagcuaacucuaauggcucuuaagauucugugguagguugggugagguggcuuaugcccauaaucccagugcuuuggaggcugaggggaggauugcuugagcccaggaguuggagaccugucucuacaaaaaaaauuuagccaggugccguaccuguaguuccagcugcuggggaggccgaggcgagaggauggcuugagcccaggaguuugaggcuguagcaagcuaugaucaugccguugcacugcagcccgagugacagagcaagaccccaacucuuaaaauaaaaagauucugugguaggcuuuucagacuuggcaucugaagggacccaugaaagcuuugacucauuggaagcuuauguauuuuuaaaaauaacaacaauagcaaaugcagguaugcuucuuuauuccaaaguccccugcccuuccuuugaaaagccagagguuuuucugucuugacuggcuuauuugaaucaccugcagaaccuuuuuuuguaugugugugagagacagggucucgcucuguugcccagacuaaagugaauggugcaaucacagcucacugcagccucaaccuccuggucuuaagccauccucccaccucagccuccagaguagcugggaccaccagugugugcuaccacuccugguuaaauuuuuguauuuuuuauagagacaggguucuaccauguugcccaggcuggucucaaacuccugggcucaagcaguccacucgucucgaccucccaaagugcugagauuacaggcuugagccaccaugcccagccuuugaagaaccuuuuguucgcuagcauuugcccagccccagaccagugggcuagggccuagauuugugcucucucuccuaccccgcaacuccauccccgucgggauggaaagauagugcuuuuaggccugccuuccccaaacuugugcaaaaagucucaccaagcccuuguucgauuccagguuuugccaccucucaccuuguagauucuggcuuagauggucuggguuggaaaacacugccuucggcugucuagguaccuccagguucuuuaacacaaauaugaacauguuccuuuguggccaagaaaggugauaucacuggcuaugggggggaagguuuuuguauuagcuuuagguuaccuuaaccuuaucacacaaaaaucacacauugucucuugcugaguuuucuuacuagaaaacauauuuggaggagcauucuuugagguggauuuguuuuggugauauauuggugcuuuuucugcuucagauuuuaaacuuuaaagcagcaaauugucugaguggugugugucugcugaaagccaaggucuuccuccugguguuacuucaucaagcuaaauagcagccacuaaauggagaaacaucuaagauagcagggauacuguuggaauagcagaacagucuuaauagugaagcuucuuuuagaaagcaguauauuugcuggcauccuucuagaauggaaaaaauaauacuaggcucuaccauuugaccuggcugugccaaaacauguaagcagcuuuuccacaucugccccacaucuguacccuauauuuuuacccagagagaaaacacaaaacuucaaaaguguaaugcucggaaggcuacuggcauugcccuuugcugugagggcaguuucuuguccuucaggucaggcagauucuuuuaaaugcuucaaguaauucgugucaguuucaggacccuccuauuugacuuauacuuaugguuuuucuccaauuucagagucgggaagacaucacucaugaaccaguaugugaauaagaaauucagcaaucaguacaaagccacaauaggagcugacuuucugaccaaggaggugaugguggaugacaggcuagucacaaugcagguaagcacaugucuuggcugugcugaccaggccuugauaguucauuuagucuuaaucuuuccucaugcauagacauuuuccuucccuguucuucaaaucuuauuaucuuauuuguagauaauuggcugauacucaguuaaauuugaauuucagaucaauagugaauacuuuuuuaguauacuucuaguguaucucagauacgacuugcuaagacacacuaaaaaauucuucuuaaaaaaaaacucagauuuauccuuucuuguuuuuuguuguuuuugguuuuguuguuugcuaaauuuggcaaccugcaggucucugucuugugccucucuugacauccuugcccagugcuuuagguaaacaucuuugucucaccucaguagugagacauaaacuuuauuuuucugacuuccuauuucauacguaacuucaagaguugugugucuauugagccaaucuuuuuuuuauguaucagcuuauuaaucuuucaaggguucccuuucaacaguuaggauaagauacagauucuuucauaugacuuguugaaaagccuucacauucuggcuauaaacuauuauucccuuuuuuucccccauugagucauuuuguuuguauacauguauuaacaucccuagaaaagaaaccccugaaggauggauaccuugagcccaggaguuugagccugcagugagcugugacugcuccauuauacuccagccugggugauggagugagacccugucucuaaauuuaaaaaaaaaaaaaaaaaaaaaaaagaaucccaggauuuucccuccuguauuuucaucucuuucuucaugguccaugaugccagcugagguugucaguacaaccucacuuugaaaccaaacuauugggauaggaguagauuauccugucauuuuucuagaucuuugaguugcacaucacaucuggggccaaucauuccaggggcaguuuuaaccugccugugagguuuacaguaauuuucccagcucugugaugaccagugauuucaaauuuucaaugugaucauguuucaucuucacacuuagaaccagaccaugacuugggagcacagccuaauaagaaccugguguuugcccuugagagcaucagccaagacguucaugcauuacggaggcaagaaaagaugguggaaauagcuguuacucacuuuuuuuuuuuuugucucguuccagucauuccgaaucaugugcugcucuuacagacuuguguugguggauaugucucugcuuccagcagggccuguauacccaccugaagucuccaacuuuuagcucagaucuuuggaaacuucuaucuccauggcaguuguucuuuccuaugugcuucuagaggcaaauacaauucuaaucccauuauaguccuagaaaguaccuggcaaauagugggggcuugcugaaaugugugaaugauguagguuaaagguagaaauuugugcacguguugaccucgagccauggcaugcuccuagaggaucaggacucuuaauugacucacacuucuaggacagagcugguaugaaucucucauccucaccucaccuacacacauacaccuagagaucuucaaaauguaacuacaguuuaagcaagucaagcuugagaguagaacuggaaaaccuuggcccaagaaauuggcaaagcuugugucugcaguuguuggagauucucagucccacucuccacauguacagaaaucuuugucucaaaggauuuaacauaaaucccugucauuccuggcaaaaacaaggguaagaccacucuguagggacauuuaguaccgcaggagagaagaugaguucauaaccacaugaggaaauaauguaccacaagagauguucacaaugacuagagauguucuaaaaagaaauagaaaccauaauggaaagggauacuauaaaaaaaugaggauauggaaaacuuagaacuucaagaagugaaaacauaguauugaaauaagcuaaaggaacaguuaaacuguagauuaaauggagcugaaaaaagcaguaagccguaagagcugagcaaauuuucuaaaagaagacuuaaaauuguagaagaccgaaaagcaaaaucuuaagagcaacuauagaaaaaaaagacaugacuuauaaaggaacaacagacugacaaauucucaacagaaggcagaagggaguagaauuacuucagggagcugggguaaaggcccaucugaagauucuccaugugucacagcaagacucagacugccuuuugcugagggaaaauagaacuucuccagcugagcugugguuuugguagccaugugggccagcgaauucagaaaucagaguucggccccugcugggucggggguugucauaacagucccgucuguacuacuaagcugggaccuuggggcgcugcacucuugaaguaaaccccaucaggagauccacagcgcacugugggcuucucaagaagcccaaauuccaggaaggauaaauaaaaagaauucuguguaagucauaaugaaacuaaaaaagaaaaaggcuuaaaaauagacugaggaaaaccugacaagcacagcacugaggcugucaggugacucuuggcaguagcagcagagcccagcaggcagugggguauguugggaaagagacgggcagcacaguguucugucucugcugaaauaacccuccugaaugaaagaguacaucuuuaagggcuaguggcagaaguucuaaaggauaacuccaggcagaaagugauuucauguagaugaggaaagaguggaaaaagauaacaaguucccaagagauugaagcaaaaggaugacccuugugcucuugcagccagcuucagauacuagaaguaaaugaaaaucauugucucugcacaaaggcgucauuauccugaucuugaggaauccucauguguuuuucgagggcuuuuagcagcuugcaguaaaacauaaucaaaauaaaacaaggcaccacaagaaagaaccaguggaaacuucccugguaauuccagaguguuuuuuguauuuaaagaaauaaggaggauacagaguuucaguuauaugagaugaauaaauccuagagauguguacagcauagugccuguaguuaacaauacuguauuguacacuuaaaaauuugcaugcuggaugcgguggcucaugccuguaauccuagugcuuugggaggccaagagaggaguuugagacuagccugggcaaaauagcacauuucaucucuacaaaaaaauuuuuugaaagaauuuacuaagaggaucuuauuuuaaguguucuuaucacaaaaaguaauaauaagaggauggggggaaccuuuugaugaguagguuuguggccuacauuguagugaugguuugugugcagccuuuguaugucagccauaccucacuaaaggggcuuugguuaaagauaagauaaucguuuaucugcagggaagaaacgaaacaguuaacauugauagggggagaaaaugaagcacaaucaaugaaauuuggaaauucagagaaugcugcuaaaucauagcagauuggccacaccagaaaagggcuggaagaaugaaagaaaaauggcaggaaauaugaaagaaauaagugaaagugagaagguuggaccuacuuuuaaucagucucagaagguguaaagagagaauaauagaucaaagaugauauuugcugagaauuuucgagaauugguguggcaccaauccacugacucaagaagcccaaauuccaggaaggauaaauaaaaagaauucuguguaagucauaaugaaauuaaaaaaaaaagacuuaaaaauagacugaggaaaaccugacaagcacagcacugaggcugccaggugacucuuggcaguagcagcagagcccagcaggcagugggguauguugagaaagagaugggcagcacaguguucugucucugcugaaauaacccuccugaaugaaagaguacaucuuuaagggcuaguggcagaaguucuaaaggauaacuccaggcagaaagugauuucaugaagauaggucugaaggaagaacacuucaauaguauacuuguaucuauuuuuggaaucgugaguauguaacuuccaaaguaauaugaggaaacaaagaucagaacuguguaaucuaauguguagggaaagauuagugacugcuguguuucuuguuuuuuaaaguucucuauacuguucagaaagaaucugaaauugauuaguaucuuagauggaaucaaauaggcaugacaaauuuccagggaacaguuuauugugaguuugugguaguuuaaacagugauauuaguauaguaauacacagagcacaggaacagagggcacagggugcaccucucugguaauacauggagagaaggguguuguaggguacauauuuuauuuuauuuuauuuauguauguauguauuuauuuauuuauuuuugagauggagucucacucugucgcccaggcuggagugcaguggcgugaucuuggcucacugcaaccuccgccuccuggguucaagcaauucugccucagccucccgaguagcugggacuacaggugugugccaccacgcccagcuaauuuuuuguauucuuaguagagaugggguuucaccauguuagccaggauggucuugaucucuugaccucaugaucuggccgccucagccucccacggcgcugggauuacaggcgugagcuaccacacccagccuauuuuuuauuuuuuuugagacaggagucucacugucgcccaggcuggagugcaguggccugaucucagcucacugcaaccucugccuccccgauucaggcaauucuccugccucggccucccaaguagcugggauuacaggcgccugccaccacgcuuggcuaauuuuuuguauuuauuuuuaguagaaacgggguuucaccauguuggccaggcuggucucgaacugccgaccucaggugauccaccuaccuuggccucccaaaguccugggauuacaggcaugagccacugcgcucagccaguaggguaaauaagugggaccaggacagggcuuuacauucuagcuugggggaaccagaggauucaagaccugaagguggaaaaaauacaaagugaaaacuuaaaaaaugaaaauagugaauacuuuucaccuuuggcauuugaaaauacagaaaguacaaaucauaaaauguugaagauugauuaauagauuacauuaaacauguaaauaacaagauucccagacuaacaagaacaaaccacacaagcaggugacaaagaugauaaugccuaauaguauccaagcaguagguaaccugguggaugcuagaauauagggaguggaacagccucugguugaugguaggaguguaguaaugaguacaaccuuuucaguagaaacugccacucugcuccccaguguugaacauagacauaugcagcaauccagaguucugagucugaguguauggccuagagaaacuuaucucuggacauuaugagagaguuguaaugagaguuaucauugcagccuugcauggggagugaaaaacugcaaauaacucaaaugaucuggggaacuaagugagucuauuaaagcaguggaauauuauauaacuguuaacuuuugggaaugaaaaaagacaaguugcaaaaagcuguacaggaugauaauguuuauguaaggcaucucuucaggagcauuuacuuguggugaagaaggaagaaaaugcaaugagggaaggguuaacucuuggaaaaaacggauaaaaauaacaguguuaauuuuugucacaucagaauauuggguagacaguuauaaggguauaauuuuaaauggagaaaacaaaacauuuugaaacaagcaggcuggcugguuuccuguuuugauguggucuagagaaaaagaauaaaagccccuuacucaagcuguagcuuaccuaacuuccaaacaaucagcaacaaaaaaccccgagaaacuguuaucacaaguuccugcuucauggggcuagggaccucccugggcccccccccgcccccagcaugugcaguuagacuucaacuucaacuuauaguuaccuuuuccucauuuuaaugccaaaagucacacccaggauggagauuuaaccugcuagugcuacacgcaauuucugaagaagcauguuuagccacugugcaugcacuagaaaaaccccuccuauauacauauccugacaucaccccuccccacaggaaagcccuuuaaaguuaacucccacacugcuuucagagaacagcugccccuuuccuuuugcagugcuagcucacuaugcauaagcuaauacacuuucacuuucucuuugcuauugugucuggugaucucucuugauuucuaucauggaagauuccaagaacccaggucgcuguuaacaauuucaauuaaaauauuaaaaaauuuaaaaaucacagucagccauaggacuguacuuguugauguuuugauaaauauggccuuuacuuuuguaaauucaaaguuaaauuaauuuugguaacuuucuaggaacccgucaacuuguugacuucuuuuugauguauuacuuugccuucucuguguaucugaguuccagaugaugaauugguuccaccuaacaguaacagaguucuuauguaauuuugcuuguaggagucuaucugaaaaaagccauuugacauacagagaaagcucucuaugcuaauguucauugcugaguuguuuauaaugauaggaaauugucagcaauauuuucuuaaaaauaggaaucgaugguucacuaaaucuguugggcagcaguaaaguccagugaaccugcucucccaugucaccccaucugcuguugccagagugcccuagugcgugacgggguagaggggaggaacuugggagaauguggagaguaucacaugugcagucuaggagugcagucuaggauuucagcuacagaaaaccuccgcgcauaugacuagaacaagacaugaacuccuuccugugugggaggaugccaaguguucuuuuguuuguuuguuuguuuguuuguuugagaauggggucacuucuccacugacagagaugcauacauauuccauguagaacauuggagaaccaggagagcacagggaugaguaccaccagcagucccgauccuguuuagucuacauguguggacuuuguuuauuguaucugggcaagggagcauuuagugcccuagccugccgagaggcaguggagucauuagaaauaaauuugucuuuuuugcccuucauccuuauaucugaguuguuaucauguucguccggcucuguuugagugccuguuacggaucuagggcaguaaguauacccagccuugcucuuaaaucuagcauggcagugaaugaggugaccagcuuagagcugggcgguaguaccugguuuaaucuuuacucugguguguguucucauugucuuucucuugaucucuuuuugucaagaguuuuucauuuguuuuguuuuuugagguauaauacaaaugaaauauaacaugcuaaucuuuuuuguuguuuaggcaaacuuuucucuuuuuuuugagacagaguuucgcucuuaucacccaggcuggagggcaauggcacgaucuuggcucaccgcaaccugcgccucccagguucaagcaauucuccugccucagccucccaaguagcuaggauuacaggcaugcaccaccaugccuggcuaauuuuguauuuauaguagagacaggguuucuccauguuggucaggcuggucucaaacuccugaccuccggugauccacugugccuggcuaggcaaacuuuucauacaguaaaaugcauagauugaacuauaucacucgugagucaucaccucacuucccuauugaacuguaucauucgugagucaucaccucacuucccuauauuuccauugcucucagaaaguucccagaguaccuaaguuuuauuuauaguucaaauuuuacacacuuaccuacaugugaccacuacuuggaucaagauauaagaaauuucuagcacccuggagauuggacucaaugucacucgcuuauagacagacacauacuuaaucacaauauuugugaggauuguuucagauacucuggugcugaaauuugcuuccugaagucuggugucauuugucuuuguggguggccccacaaucuagccuauuucuucuggcaccccuugcauacaugcuccuggugcucugccuagcauucucccaaggaaugaauguuuugucucucacagauaugggacacagcaggacaggaacgguuccagucucucgguguggccuucuacagaggugcagacugcugcguucugguauuugaugugacugcccccaacacauucaaaacccuagauagcuggagagaugaguuucucauccaggccaguccccgagauccugaaaacuucccauuuguuguguugggaaacaagauugaccucgaaaacagacaaguaaguaccaacgaugauagauauugucacagacaccugcuccccaggggccuugugaauuuggaggguucucugcuaagcucacauggcucuaggaggugcuggugggagucuucauuaccauaugccagcccuucaggccaacugccuuuaaggaccgggacccaggugaccuggguuaaguccccauccugcccccagcuggcugugacuuugggccauugucuuggcugucucagcuucacuucccuuucugcacuuugaaggagggaauucgguuuugucauucucaguagugcccucccaguaccuccaggccaugccuggaucuccaugugugcagaauauugcuuugggcuuugaguaaaauugcuguacuguaguuucaaauaccauuucuguuggaaacauagacucuuugauuaauuacaacuagguuuauuucugaccacagaucuuuucuuaagugacuuaguccuuaucucuuggcugaaaaugggcuagggguuggggaaggaaugagaaugugugaguggcauaggugacaucacacuagcaguaauggugaagggacuauaaaccuuaagaccaagcugcugggcauuuccuguccugggaucucugaggucccaguaaacacucuucauuucuucccggacuggcuucuuacuccauucacaaauggcuuuuaaguauaacugagggucagaagguaugagcuguagaccgagacaggcuuugagcucucuagcugaauccuagcuauccugagcauagcuagcaggacaaguuuggacgggucugcaggucuccuccaacacccucuuuccccaugucuguguccucaccuguacuaccuguagacgaggggccaugacacuuccuggggaggauggagucagugcuggcugcuucugucaugagccuaugugcacccugcuucuucuuucagguggccacaaagcgggcacaggccuggugcuacagcaaaaacaacauucccuacuuugagaccagugccaaggaggccaucaacguggagcaggcguuccagacgauugcacggaaugcacuuaagcaggugggucucccacagcugaccagcccacucuggugaugccugaccacugacccagucccugccuggccuccugcccuuaaucuucuucccuaacccacucuuuucuguauagccagaauacccuauguguucaucugggaagguuaugacauguucugcuuaagcuuccagaaaucccacuuuggggggaauaauauaaaagaugcagaggcugugaagucugaggcugcccuucuuuuacuaggcuuguucuuauuuucuuugcugugauuaggagaucaggucacugggagaccccgaacagauugcugcuucuauuuaaggaggaaauaaacuugaauaugaaucccagcucugcugcguaccaaucguuauaucuaguuugggcuuaaaaaaaaauuauggccgggcacuguggcucaugccuguaauccuagcacuuugggaggccaaggcgggcugaucacuugaggucaggaguucgagaccagccuggccaacauggugaaacccccucuccacuaaaaaauacaaaaaaauuagccagaccuggugguggucgccaguaaucccagcuacucgggaggcugaggcaggagaauugcuugaacccaggcggcagagguugcagugagccaagaucgugccacuguacuccauccugggugacagagugggacucugucuaaaaaaaauuaaaaauuaaaauaaaaaaaauuauaucugaacuucuacccccucaccugaaaaaugggaauaccugcuuuugcagggugauuaugaagauuaaaugagacagacucuuccagcucucacauacugacugguaacuuuuuuccuuaggaacaguuaaguaaacaacacaaagaaggaagaagauguaggaaaacuauucaaggaauauaauaccuagaauuucuuauuuacuguuucugugauuagauacaaccacucaugcgaguugaaagucuguuuugauguacagcucuguuaggggcaguggugauuaaggcaggucacgaggccucaucagacagugucuggggguggucagagguguggcagguuugggaggaugcauagaacacuugaagcacaugguggcugugaagggcaaggcagauucugcugacuccaggaagccggcugaaugaagguaauggcuuucagcaggacaaagaguuguuuguaaugguugcuccaaggaccagggaaauucuggcauggguggggucugcacuaaguguuccagaaugaaagggacagaucuacucaaugaggaaauuguuccacccagaaugccaggagagcccucaagugguaaggagcagaccaagaugcagacuuggccacgcuuacccccaaauaauaauguuuguguuuuucuuaauguucauauaagggaauggaaauccaaauauguguaggaaaguguuucccaccuguucccuguugccuggcaucacugucugaguuuuucucuuccaucacuacugucccuguugucuuuaugcuuuuauuuuuagagcuagcccuuaagaaguuagauuguuaaaucggaggguguaucuuauuguaagucagggugccagguugcuuuccccaaggggaauaacauuucagcaaugugggcuugcuuucuucuaccuccuugccagcaagcaauaggugucaccugucacugcugacauugccgaucuuuggguguguaaauugccaccaucgugacuacuggucccucugaguuccccucccuggggcuuagccauuuggauuuucucugcugcacacagccggcacacagcacaugguugggccucucucaguucucaugagcuguuggugaauugaaguuaacucuacuugcaucuuaagugacuuuuccaacucuguggucuuuuuaaguccuuugaacauagggaaaaaguaauuuuuuauuugguuaugucauuuuaaguuucuauguuuccugugucuaccucagauuuuucuguaauucagcuggaauuuguuuuggcuuauggcagaaaagagagacuugccuuuccucucaagagagcucagccaguuguuugaaaucauucagcuauguuacacaagccguuucccucccugaauagaccguggccugugcuaaaugcucguaugugcugggaucuguuucuggucucuccagucuguucuggugauguccaugccauguucccuuaucuggacuguguugauuugacugccugaugaggcaaguuuccucuugccacagucuuuuuuuuuuuuuuuuuuuuuuuuuuuuuugagacggagucuugcucuguuccccaggcuggaaugcaauggcgugaucucggcucacugcaaccuccgccucccagguucaagcgguucuccugccucagccuccugaguagcugggauuacaggcauccgccaccaugcccagcuaauuuugguaauuuuuuaguaaagauaggguuucaccauguuggccaggcuggucuggaacucacauugugaaccgcccgccucagccucccaaagugcugggguuacaggcaugagccaccgcacccggccugccacauuucuuuuuuaauaauuuuguuuccaccauuuuccucucuuaccuuccacaccccaaauaaaacucuguugagauuuugauuggaauuuuuuucuucaagcccacuguuuuuuccucauugauugcaguuuuguuguggcuguugcauuagucugcucaggcugcguuaacaaaaccccacagccugggaggguccaacaacagacauuuuguuuucucacaguucuggaggcuggaaguccaugagcaaggugcuggcacauguuucuggugagggugcuuuucugggcuaucuucucacugugucccucccaugcccuuucugcugugugcacagagagaggacacaugagcaaggugucucuggugucaccucuucuuauaaggacacgaauucucagaucagguccccauccugcaaccucauuuaaccuucauuccuuccuuacuccaaauacagccaccugaaggguuagugcuucaacacaggaauuuuggaggaacacaaacauucugcccagccgagugcgguggcucaugccuguaaucccagcacuucgggaggcugaggcggguggaucaccuuaggucaggaguucaagaccagccuggccaacauugugaaaccccaucucuacuaaaaauacaaaaaauuagcuggcgugguggugggcaccuguaaucccagcuacuuaggaugcugaggcaggagaauugcuugaaccugggagguggagguugcagugagccgagauugcaccauugcacuccagccugggcaacaagagcgaaacuccaucucaaaaaaaaaaacaaaacauuccacccaugauacuauuuuaggucuuguuucuguuccuucaguaagauugauugauucuuuuuuuuuuuagagacagggucuugcucugucagucaggcugauacgcaguggugcaaucaucacucgcuauaaccuccaacuucugggcuccagcagucuucccaccauagccuccuaaguagguaggacuacaggcacacccaugcuauaauugauuuauaauaugauccuuugccuuucacaguaaacauauuccuagguacuggugggaauauaaaaugucacuauuuguaauagccaaaaaguaagaacaacucaaauguccaucaacugguaagugaauaaacagggcagcuuauccaugcauucuaauauuauucagcuauaagaaggaaugaaguagugacacaugcugccacaugggugcuaagugaaggaagccaguugcaaaaagaccauauguuguacgauuccauuucagugaaauguccagcccggaugcaguggcucaugccuaaaaucacagcacuuugggaggcugaggccggaggaucacuugaaaccaggaguuugagaccaucuugggcaacauagcaaggccucaucucuacuaaaaauuaaaaauuagcuaggugugguggcaugagcuuauaguuccagcuacuugggaggcugagacuggaggauugugugagcccaggaguuagaggcugcagugagcugugaucaugccauugcacuccagccugggcgacagagcaagacucugccucaaaaaaaaaaaaagaaagaaaucacaguccacuagaagaaauggggaaaauuaaaauaaauaaauaauguuuaaaaauuaaguguccagaauaauaggcaacucuauugagacagaaaguagaugagugguugcuggguccaggaugguauagaaugggggugggaaggaacuacuaaugggcauaggguuuuuuggggggugaugagaguauuuuaaacuuaauguugauggcugcccaacuuucugaauauacuaaaaaccauugaauuguacacuucauggcaugugaguuaaaacccagcaaagcuauuaggagugcaauggcaccaucuuggcucacugcaaccuugaccucccggguucaagcaauucuccugccucagccuccugaguagcugggauuauaggugcuugucaccaugccuggcuaauuucuguauuuuuaguagagacgggguuucaccauguucgccaggcuggucuugaacuccugacuucagguggucgaccugcuucagccucccaaagugcugggauuacaggcgugagccaccaugcucagccaaagcuguuauuuuuuuaaguauguauuccuagauguuuuauacuuuuauaguuauugugaauggaaugauuuuuuuccuagauaacuuuuaaugaauagaaacaguuccugcuuuaucuccaaauucuagaacagucacuggcacacaagugcucaguguuuaagugacauuguuuuccugcacccaaaaguagaaugcugcuccucauuggaagcauguuacuuuagcaaagugccacuaaaaugaccauaguccaugugcucugaucacuugucacagauggugauaaaauucauucacagcuuccuuucuaggccugcagcauuugggagacaaaacucugcuaaaccuuuggaagaaaaaagagaccagaggccauuggucccgaaaaguggauggaagauagggagguagaaggaauguuacaggcugagagggcagcucacacucagcuccagccacuucaccucgugcacacacuggcugaggguugccagauguuugagaaaagcuagaaauccagaccauuguuaaccauuggcaacuauagggaacauacagaaagcaucugaacuggaugugguagagcucccagaucaugaucugauugagaauguccaugaacuucuguccugauugcucagugcagacugcugcuucuucuggcaagacuccucucuucacauugaccuggaguugucacaaaaucuguuuuucucuugcuacuccccugagcauggcaccuucugccagagcgcucccuuaacugugugggcaggcucugcuucacagcuccccgcccacucugcccaagcagaagugagccccuccugggcagaaagugcccgcaaugagggcugaaauguuucuauucccugaguaaccaaccuuucucuguuuccuuguccaggaaacggagguggagcuguacaacgaauuuccugaaccuaucaaacuggacaagaaugaccgggccaaggccucggcagaaagcugcaguugcugagggggcagugagaguugagcacagaguccuucacaaaccaagaacacacguaggccuucaacacaauuccccucuccucuuccaaacaaaacauacauugaucucucacauccagcugccaaaagaaaaccccaucaaacacaguuacaccccacauaucucucacacacacacacacacgcacacacacacacacagaucugacguaaucaaacuccagcccuugcccgugauggcuccuuggggucugccugcccacccacaugagcccgcgaguauggcagcaggacaagccagcgguggaagucauucugauauggaguuggcauuggaagcuuauucuuuuuguucacuggagagagagagaacuguuuacaguuaaucugugucuaauuaucugauuuuuuuuauuggucuuguggucuuuuuacccccccuuuccccucccuccuugaaggcuaccccuugggaaggcuggugccccaugccccauuacaggcucacacccagucugaucaggcugaguuuuguauguaucuaucuguuaaugcuuguuacuuuuaacuaaucagaucuuuuuacaguauccauuuauuauguaaugcuucuuagaaaagaaucuuauaguacauguuaauauaugcaaccaauuaaaauguauaaauuaguguaagaaauucuuggauuauguguuuaaguccuguaaugcaggccuguaagguggaggguugaacccuguuuggauugcagaguguuacucagaauugggaaauccagcuagcggcaguauucuguacaguagacacaagaauuauguacgccuuuuaucaaagacuuaagagccaaaaagcuuuucaucucuccagggggaaaacugucuaguucccuucugugucuaaauuuuccaaaacguugauuugcauaauacagugguaugugcaauggauaaauugccguuauuucaaaaauuaaaauucucauuuucuuucuuuuuuuuccccccugcuccacacuucaaaacucccguuagaucagcauucuacuacaagagugaaaggaaaacccuaacagaucuguccuagugauuuuaccuuuguucuagaaggcgcuccuuucaggguugugguauucuuagguuagcggagcuuuuuccucuuuuccccacccaucuccccaauauugcccauuauuaauuaaccucuuucuuugguuggaacccuggcaguucugcucccuuccuaggaucugccccugcauuguagcuugcuuaacggagcacuucuccuuuuuccaaaggucuacauucuagggugugggcugaguucuucuguaaagagaugaacgcaaugccaauaaaauugaacaagaacaaugau

SEQ ID NO: 191656 - RNA, 255177 nt, Homo sapiens
gggcgggccgggcggguguccgaggcggcggcggcggcauggcagggcggcgggugaacgugaacgugggcgugcugggccacaucgacagcggcaagacggcgcuggcgcgggcgcuaagcaccacagccuccaccgccgccuuugacaagcagccgcagagccgcgagcgcggcaucacgcucgaucugggcuucucgugcuucucggugccgcugcccgcgcgccugcggucgucuuugcccgaguuccaggcagcgcccgaggccgagcccgagcccggcgagccacugcuucaggucacgcuggucgacugccccgggcacgccucccucauccggaccaucaucggcggugagcgcgggccggggcgggagccgggcucagggacgcgggcggagcgaccgggccccguguccgaauucgcucgagccuuugccgggacgggaaaucgccccaccucauugguggggcuccugacgccccaagaggcggacgugacuugccuagggcuccgcagcaagugagcggaggcuuugagauucagcuuuucccauccagcagaaccgagcugcaaggcgccuuccuuaaaaaaaaaaaaaaaaaaaaaucaaaaaaucccuaccaaauguguuuauaauacauggucaaguaaagaaaacucaaaauaagaaaacucacaagcuacaaaaaggguauacauacaaaggcugucuucauucaccugucauuuggucugauucccguuccuagagccaaccgcugcuaccaguuuuuguauaucauuucagaaaggcuccacgucaauacaagcauaucuguguguauguauaaaucccucuuucccucauccuuuuagacacgauuucacucaacauugugucuggagagugccccauaucuguacacaaagcuacaucauucuuuuuaaagcucacauagaauucaacugcacccuuguaccaacauuuucuuuuucuuuuuuuuuuuuucuuuuugagacagagucuuguucugucgcccagccuggagugcaguggcacgaucucggcucacugcaacuuccgccuccuggguucaagcgauuguccugccucagucuccugaguagcugggauuacaggcgcgcgccaccacgcccggcuaauuuuuuuguauuuucaguagagacggguuucaccauguuggucaggcuggucucaaacuccugacuucaugacccgcccgcccuggccucccaaaguccugggauuacaggcgugagccaccacguccggccuguaccaacauuuucugaacaaaucuuuuaaugauggacguuuaugcuguuuccaguauuuacaaaccauuuugcagugaauauucuagaacagaacucuuugguauguucgcauauauguaggauaauagauaauaacuggcuggggcaaggggcauguguguuuucggucgugguggguacugccaaaaugccccacaaagagguaccauuaauuuuuaauuauacauguaauacaugaauacaugcuacuugugaagaaauagaacaucacaaauaagacaaacauucccuuacccacuccucuguccuaaauucuguaccccuccuaucucugcaaaugaaaagacccguuuuuuguuuuuuuguuuuuuuguuuuuuucugagauggagucucgcucuguuaccaggcuggagugcaguggugcaaucuuggcucacugcaaccucuuucuccccgguucaagcgauucuccugccucagccucccaaguagcugggacuacaggugcacaucaccacaccuggcuaauuuuuauauuuuuaguagacaugggguuucaccauauuggccaggauggucuugaucucgaccucgugauccccaugccucggccucccaaagugcugggauuacaggugugagccacugugccuggcugaaaagaccauuauuauaccuuuguggauuacuuuuccagacccauuuaacuccacuuaaauauauggauagaguuuuaaaacauguuuuguuuuuagaaaaaaugauacaauaauauaaacacaugguauaaaaggguauauagcuaaagaaguauacuucucacugcugaccccaguaccugauuaccuuucuguucccauuuucuuguguuuccuuccagcaauauucuguaugccacacaugggaauauauauugggcagaugauaauuggcuugguggcagauggccucauuggucacugggcauucugggucccagcuauaauggugagcuuguuaaguacaguacuucaucuuuguuaccucccaacuguuucauguuacaggcagucugagaucauuuccccauuuuacaguagaggaaauagaaguuugaagaagugaagggacuugcucagggucacacuaucuaaagucuucuccucaauccauguuucagucaggugaauuucaaggggcacacaauucucuacccauuccucccugcccccuuauaacugaauucuguuuggucacaucaaaguacauuuuagaacauggacucugagccaguccagacuggagguggaaggcagagguuaaaaaaugagauggcgaguuuuuaguguugucuaguaaauaggguagaugaguggugaaggacauacuuuuggagucagacaaaacugggcuugaagccuagcuugcuuucuuccuuagcuguaugacguuugaaccuaauucuggaccuugcuccaacuggaagauagugguaaccacacaacuauuuauuggcuugacuuuucuuguguauuugcugcuuaccaggcaaacccugcaaggagcguggugguuaccauuuaauaguugagaaaauugggacuuagggaggcagguaguuagugaaacaguccaggucugccugacuccaaagcuggaguccuuugcaugcuuccccagguuacccuauaguucccucauccgcuuccaacauacgugcauaccucauguuauugugcuucacuugauuguacuuugcagauagugguuuuuacaaaucgaagguucaaggcaacccauccaacagcauugcuuacuuugugucucuaugccacauuuggguuauucuuaacaauauuucaaacuuuucaucaaauauuaagcaucaaacauuucacuucauuucaaacacaugucaucuguuaauggugaucugggaucagugaucuuugauguuacuauuguaauuuugaaaugucacaaacaaugcuuauguaaggcagcaaacuuaauaaauguuguguguuuucugacuguucuaccuacuggcuuuuucccugucugucucccucuccucaggccucccuauucccugagacacaacaauauuaaaauucauccagcuaauagccuuuaugcguucaagggaaaggaagaguugcaagucucucacuuuaaaucaaaaguuagaaaugauuaagcuuagugaugaaggcaauguugaagacugagauaggcugaaagcaaggccucuuacaccacaccaaacagcaaaguuuuggacgcaaaggaaaaguuccugaaggaaauuaaaagugcuacuguagugaacacacagaugauaagaaagcaagacagcuuuauugcuuuauagagaaaguuuuaguggucuggauagaaaaucaaaccagcuaccacauucccuuaaguggaagccuaauccagagcaaggcccuaacucuucaauucuaugaaggcugagagagguaaggaagcugcagaagaaaaguuugaagcuagcagaaguugguucaugagguuugaggaaagaggccaucuccagaacauaaauguacaagaugaaacaacaaauggugauagagaagcugcagcaaguuauccaggagaucuagcuaagaucauugaugaaggugaguacacuaaacagauuuucacuguagauggaacagccuuauauggagaagaugcuauguaggacuuucauagcuacagagaagucaaugacuggguacaaagcuucaaaggacaggcugacucuuguuaggggcuaaugcagcugaagccauugcucauugaccauuccaaaaauccuagggcccuuaagaauuaugcuaaaucuauucagccugugcucuugaaauggcacaacgcagccuggaugacagcacaucuguuuauagcaugguuuacugaauauuuuaagcccacuguugagaccuacugcuuagaaaaaauacuccuuucaaaauauuacugauuguugauaaugcaccuggucaccuaauggcucugauggagauguacaaagagauuaauuuguuaucaugcuugcuaacacagcauccauucugcaguguaugggucaaggaguaauuuugacuuucaggucuuauuauuuaagaaauauauuucauaaggccauagcugcccaagauaauaauuccucugauggaucuggacaaaguaaauugaaaaccuucuggaaaggauuuaucauucuagaugccauaaagaacauuugugauucaugggaggagguaaaaauaucaacaguaacaauaauuuggaagagguugauuccaacccucauggaugacugagggguucaagacuucaguggagcaagucacugcagaugugguagaaauagcaagagaguuagaaugagaaguggugccugaggauaugacugaauugcuacaaucucaugaucaaucuugaguggaugaggaguugcuucuugugcaugagcaaagaaaguaguuucuugagauggaaccuacuccuggugaagaugcuguaaacauuguugaaaugacaacaaaggauuuagaauauuacauaaacuuaguugauaaagcaguggcaagauuugagaggacugacuccaguuuugaaagcaauucugugaguaaaaugccaucaaacagcuucacaugcuacagauaaauuuuuguaaaaggaagagucaccugauguggcaaacuucauugucuuauuucauuagauugccacagucaccccaaccuucaucaaccaccacccugaucagucggcaaccaucaccauugaggcaagacccuccaccagcaaaaagauuaugacuugcugaagguucaguaaucauuagcauuuuuuagcaaugaauuauuuuaaaauuaaggaauguuuauuguuuuuugagacauacuacuauugcacacuuaauugacgacaugucauguaaacauaacuuuuauacacauugggaaaccaaaaaauuugacuugcuuuauugugauauucacugugcugcaguggucuggaacugaaugcacaauaucuuugagguaagccucauuuguagagaagcucuucauauugcaaaaaaguuucagcacuugccugguccuauauaaccaauuguaaugcccugaagaauuuggcaaguuuuuuauuuagacuaaaacuguagaagaacuuauuuuuguauguacauuguugcuuaucuuuugucucaucucuggaguagggagauuuaucuucuuaaaauauggccugaguggaauggaaugcugagaccaaggcugcuaccauucuuccuugaauacaucagagacccaccuuccuuuucagggaauugagaaaaaacaauguuuuucuuguaaagagaagguguuccccauugagugccugcucgggcccaggccuguugccaggaacuugcaucuaugcaauaccacccuguguggugggaguguuaguuagccuuauuucucagaugaggaaacccaagcaaagugccuugggcuaguguuggaaccuaacuccgccaccccuaaccuggaucugguuaauaccuucauuucaccucaugguccacaaacuugugggcaucuuugccuucuugaaauggcccccaaggccauccuggcuuauggcaccuggacuucuacaguucugcccccugccugcuuauucuccuccucccucugauucauucucugcacagugggcauugcucuccuuuuacaaguguucaucagaucaugucagcccuacacuugacaagacuuuccagugaguucucauugugcuuggaguaaaauccagccacuuuguggcccauaggacaauggucuggcucugcuuuccucugaucccaucaacgaucccaucaacgacugcuccccacucugaccuucagucacgguggccucauuucucuuccuccagugggcccaccagcugcuucccucaggacauuugcaccuguuguugccucuguuugguacaucuggcuccuuaagucucugcuuuaauggcaccuccucagcagccucuccugccccaccuaucuaaaguugucucuucaacccucacccccucauacuuucucaugucccuguuucauugccccagcagcccuuuucacuaccugacguucuucauguguuuacuuguugaguaucuguccucugcuagaaugugagcuccaugagaccagagcaggaaccuuguuugucucauucaccaguguucucagcacuugggccagagccuggcauaggauagauauuuaguaaguucuggaugaaugaagccuguguaccagcuccugggcuagccaguuuuagugagcagagaaccuucuuuguggguuaguggacagaaggcaacuagcuuagggccuggccuguagugaauuaugcagguugguucuuuguccuccccuuuaggagcuuacaucagaacccggaagacacugcuguguacaaagugaucuucuggaguucuuugcacaagggcaaaagcaggaguaacucacuuuuucuuuccuaggcaagggcaaggcucugagccuuaaacaugccauugugucucaacaucagagaugacugccagcauuuaggcauggcuggaaaucggcguggugugugggaggugugcuaaagaugaagcuagaaggguuggcagggccagacccuagagaauggcccuuaguguagauuuuuccuaaggguccuggagcuccuuggaaggcuguuaaagcaggugugugauaugauugggcugagcuuuugauagaaaguugcaggauugcugggcagggauucccacuggcagcaggugugguuuucucuagcugcaccugcaccuggcaucccugggagaucgggcucuuguuagaguuccuugcuacugugaaagauuuagacccccuguggaauauguuauucccaggagaaggaaauuauaacaguugucugaguucugugaugauaucucugaaguuuaauauaucuuaaauuaaagcuggcucuaauuccacugugugcgcacacacacgcgcgcacacacacacacacacacgaauccuaucuuaacuuagagaaaauuggguuuuaucucccuugaugcauguggccacagauaaaacuaaguggugcugugggguuaacagugauaauuguacuuaccauuauuuagugcuugucuguaugcuguuuuuuugauuuguuuguuuaaucuucacacuauuccuaggagguaagaguugcuauucccauuuuacagauaaaaaaccauggcucagaggucagggaacccaguuaguaagugucagaacuagguuugaacccauauugaucugacugcacagcccauacgcuggcauucucagugugaaugaaaaaguguacccguccauuccagcccccuguagugguucagagcaguauuuuucuugaauccauuuuagaguauaaaucuuucaggguuacaacuucaaaaagauucaguaauguauguuuuaaagacuugggugggugugagggacuuagacucauccucaaucuaacucuggcaggaaagaggagggcugaaaaaugcugguaucuuggcuuggcaauuuauaguccucugguggcugugaggauuaacaguguauugucucccagucuuuuguuucgguuguuaaugaacagcacugcuacuugucgccuggaccucuugccuucuguacacacuauuuuagcggugccuccugcgugggucugacccucucugagcccucccugccaagagcugaggagggcugcaaaagacuucuaagucugacucagguuacucuccuugaaggagagaaacauccaagagccuacaagauuuuugucucugcagccuggagagaacauucuuuguaaaacuuaagcgacuuugccuuuuccuuuuuuccagccuucuguguucuuggcgcccauguggagaaggcucuuccccuuucaucuguuuuauugaggugugugcccuucauucuuucugcagaugcccucucuugacucguaaaugaaacaagggguucuugugugugaaugaauuucaaccagauuuuuuugugauacccguuaggcaucugcacauauccccggaaagcagccugcuccaggcagaaauaacauacugggggcuugaccagguaggccuugguguccuugaggaauuuggguguuacucuaaugcaaaagcaaacaaaccaaacaccacuuuugguuuucuuuaccccuagucuuuucaggagaaucuguguaggaauauauuaugugaaauugugguaauuauguauguuuguccuaaaauacugaggcauauuugaaggaguucuaaguggaaaugcuuucuucagcuuuacuucuuuaguuccuaguauccaucaggccuuaguucccuguuucuuugugcccauccagugagagcuguuucuuucucuucuucacugaaagguacacaccauaacuagaagauucuacucuccaguacugcuucuucgacguccucuaccaccaacuaaagcugaggcugacacuggaguugcuugccuucacuugcuucaaagacucuuauguucaauagagucugccucacucagcacuaaaguguaccacuauucaaguacaaguuuucuuguuuugccugguaccuuauugcucucugaccccaccugaucuccccauacacuggagugccuuuaacucucuccaggagacucaaguugagcuuugucugcggcaccuucucuuggcgcuggacagcgggugauuuugcuuuagcuugggugacagugugggaguagcgcaacaucagagacacagccuugaguuuaaauuaaugcagaauauuugagcaggaaccaacaggaaagaaaaauggaagcagguagucauauuucauucuguugggguacauuuuucuucucauggggcuugcccuugagaacaaaacauaucaaaaguuaaaucaaagaauauuuuuguagucgugcuaggaauagaaaauaaugcaaagacucuggcuucuugaggcaaauauuuugcuggaagguuauaaucaaagucagaaggaaaucauagccacagcuuucgguaaagcuguaaucauuuaaaauuaauugcuuuuaaacuuuucacugagcauccccuuuguuuucuaucagcaugucucuuggguuuuucuucggaaucauuccauccagguuggaauaggauucgggcaggcaucccaggaaacaacccauaaauuaagcccuaagacauauuccccuuucugucauucuuuuguuugauggagccucaaccaggcuggggaugagauacucuuaccuuaagagcucaauucuguguccccuuuaccaguaaaggcuuugaugugcggaaaaugaugguaucuauagcucugguacucuggguaucuuggaggcccagucuugguggggguagagccuggcacuucugaggcagccucaugguaggauagggagcuggagugaguccucguucuucuaggcucuggacuugguugcacagcaugcaucccucuuggugugaacacuucacuccaauggcugguuuccaugucuccucuuuccauuagccuggaagcuugaugggguagagacaauaucugaaucaucucuguaggucuagggccaacccagagccuggcauacagcagauaauaauuuuaaaaacauuuuuaauuuuauauaguguuuauauaauuuuuuaaaauaauuuuaugguauguaaauuacauaccauaaaauucacccauuucacugaguguacacuaagugaacacucagugguuuucacuguacucauacaguuguguagcugucaucacacaaucucaguuuagaccauuuucgucaccccauaaagaaaccacaucccuaccaggagucauuccccauucgccccucucccaggccuaggcaaccacgaaucuacuuaaugucucuggauugaccgguccuggacauuucauauaaguagaucacacaauauguggccuuuuugucuggcgacuuuugcuuggccuccuauguugcccaggcuggucuugaacuccugaaguuaagcaguccucuugccucagccucccaaagcgagcauaugcuuugggaaccaguauugcauuuuuuugugaaaaaaaaaaaaaacaaaacuauuucuauugauuucuacuugugguaaaguauaaauaauguacaauuugccaucuuagccaucuuaaguguacaguguguggcaugugcuccucaggcugccuccucuuucugugaugugccuggcccauggagacauuugggcugguaggccuuguuuuaagggcuuucggcagcuuguguggugggaaaggaccacauggagcugcauuugguguuuuucuccacucacucagagauucuacacauacacguugcauggcuuuguuuuggacgugagggcagauacacagucgugccuguguucaaggggcucacagucccgaguagggaggaggaagccaggcagugccagcagccaguuuaagauguggagugguaagggcuuugaucgagaugggcauagaaaugugaguaccugccugggguggcagauagggaauccugcuggaggagacacacggcugggccuggaaggaugaccuguggauuuccaggcugagagauccaggaaacagccuuagcagaguccagaggcauggaagcagcccuggcuaaagaaggggaguggucaggguggcuggcacuugcacacaggggggugugaaaggaggugcggccagguuggcugggucacaggccaguccaacuggcuugugggaauugugaaggaugguugagauauuacauuuuagaagaugggaggcauuccagcuagaggacucagaguaaacaaggaccuagagacaaagggagggcuggagugugacugggguaucaggccaagcuuccagaggguagcccggaccagaucucaggagccgggagagucucuucugggaggaaggcugguagguuuuaagcuucugguggcuuuuagugagcucccugagucugaggagaggacugugacaagugguccuagggccugucauuccucucaucauuccagcuucagcuuucugacccagcuggaugaaggagaagaggaaggacaccucaggcaggcaaggcggaugccaucagcagggaaaguggggcucugggguugcagacauggcagugcugagcaguggccaagggauaguucugccucuuggagggagaugaaagaauggacuuuuggagaacgcuugcugucugcuggacacuguucuagacccguggcucuugcugcauccucccagccagucuccuagggaggcguuuccaucuacauugcucagcuacuagaaaugaggcucugagcaguaggcaguuugcugcagggcgcacaaguagccagugccaggcucuguuucagaggcccuggcuuugcccagaagcugcucucagaccuuagcacaugccugcuuccauagaaaauuguggcuccugaggaacacuuuauauauaaaucaaauugucaaaaauagagauuucugcuucuauucuccccucgauuauuugaguuuuugucuuuuguuaauugggucuuuuauuuucuugugcugugugauuaggcuccugcugcuuugaaguggccuuuguuggguggguagggaggacuuaguuaaugugggugauccucucuuggcaggagaaaaaacaacuuuugcuguugagagagaaguugacuuucccucuuuccauaucucuuguguugugaugauuccucucuugucuugaggccuucaggaagacuaaaauaauuuccuuugucucuaaccuacuuccugaggauauuuauuuggugccaugcacaggugcugcuuaaagauaaaccugacuuuuuucuuucaaaauuagugcuugaaauuugcuagcauugcccugucuggcagcaggaacuugccuugcuuggccugguggcuacaucccuuaccauagauuuauuuggguugcuuagagcuccagagggucaguggcuuguccuuggucauuugacauuggcacuagagcucagucuucccagauacaugacgguguggcacuugaggaaaaaauggcccuguuuguggucauuuccaggugaguuucaggaucuuucgccaugaacaguaaaggcccucggguuuguguucucagcauucucuauuuucuaaaaagaugauccaggggacauucagagaugaucuucagaacuuacgcucuagagaggaaagacuuuacauaagaaggacuccauuucuucggcacuugcugucugaccucacagacaaguagaccacaggaagacuggaagggagcccugaggugcuuacagcacagccguguuucccaucagcacccagcccuugcagagagggcugacagacacuuuggcuggaaaaaacaguguuuuaaaaaaucucugcaguggcuugaucaguacuuuccagcagaacuuucugugaugauaggaauguucuacaguggcacgguccaacauggcagccacgagccucauggcuguuggagcacuugcacuguggcuaguguaacuaaagacugaaauuuuaguuuuauuuaauuuuaauuaauuuaaauuuauauaggcacagguggcuaguggcugcuguauuugacagcgcagggcuggauggacugaggaaugacuagguucugugucccuauuguagaguuggguuugagcuguccccuacaugugauuugguuauaagaacugucaucuuccugagauguccuggccuggggugacuaccacaggcccuuagauuccacccucucagcuucuucaccuuccuagugaaggacaccuccacucucccaaggugcggcccuugaacugcuccucaguguguccuccuccuucaccugccucuggauccaucaccacgccuucucccuccugcuugcucucugucuuugcauuucccaucaccacagcugcgaccugaagacaggcuucugcuaguuccuggccggaugaguacagcauucccucacauagucuccuugauuccaaccccccgcagaagguauagggauagaagagaguuuaaaaacuacuucccuguguagaagucuuuguuugcucucugcuggcauaaaggcuuaacuaagucuuagcuggcugacgaggccccuccugagggguugagaucucaggacuccaggccgaaugaaccacaugcaggucuguggacagacagacugugcucucucaugcugcauauucuggcuacgugcacuuuucugggaagggucauuguccacccuccucaggcuagauuaggucacccucauuugagggccuguaacauccuacacauuccccuaugaucucauuuucuccccaucuuaugccuuuucuguuuacuggauuauguuuuccacuggacuugaucucuuugaggguaggggccuguuagcauucaacuguauguccgagggcccaggacaggccuugguacagaguaaauauuuggugcaugcauaucggaaugaaugaaugaaugaagaggucauuucccacugccugcaccaauuacccaugcucuuauggugcuuuaaacaacuggccaaauagaguucaacaguggaggaagcuugccuugagguuagacaaguuaaucuuucaauggaaauucaauccucauauuucauuuucaggccacuuugcguagcaaaguaguuuaacucauagcagauuucugccaugcugaugguuaauuucguggcccacagagggucagcacacuaaugccgggaacacggcgaccucagugcagcucaccgcacacagugagggcccagcggcccuguuguuuuagagaagcaguucucaaacauccuucugauuuugaguuaacaggggugacccuuucaagaacauuuuuaaaagcuauaacauagaucccucccagaucguauauuuuccuuucuccaugcaguucaaaggggcugaguugucucauagguuuuugccggcaaucuucagcuugacccugguuguuuaaaucugccggaggaaauuugaacaaaguuguacuuugguaauucuucugccucugugaaccuuuaaccuugggguuucuuuucgagccagggcugcauugucaccagucgucccugcuggggcuuucaaagagcauugucuagggcgucuguuuucacuuugcuacuggaguucuuuugaggaaggguauuaauucagaccugacucugagacaggacgagcacuuuuaaacuugccccagagcuuggggauggggaaaugagcguaaugcaagccuguggcugaugccaguaauuguucugcaaauagucugugagggugaagggagaagaggcccuccagaggcagaggaaugugccagcuguccagugggaggccacagcuuugcccaggguuuguugacuacaugacaaaaagaggucacugucucugaucacuaguucuggguccagaguuccuccugaauguaaaauuccuggagugccagguugcuaagaaccugggaggccagaggugaaccuggggcuccauauaccauuaccaagugcuugcaugguaaaaaaaacuuucuggggagagagaggaaggcucccugaggcaagaggguagagauuugcucugcugcuguccuggugcuggccugagccuuucugagugaguaucccucuguagaccaggucacucaccuccaucagcuagccaguuucacccuuuaguucuucuugugucuuuucacaggaagcccaagacacccauaaaugugaaaugucacagucauaggcccccuggggcuucgaggcuguugucaugggugugcaguguuugaaacuggacccuaagaggggaggcccucugguaccuccccaggcaucuccuugcugguucugucacuuacucuuugcgacagguugagaguuguuugaacaucuggcuuguuccguggcuuucuuugauuuauuuucccaggauucuuaguguccugaagauuugguuaggcgaccuuauuccuuaagcucagaugguauagaaggaaagguggaucaugacauuaauucauucaacaaacuccgagcaacuacugcuugccagggguugaguuucuaguggucaacaaagcagaaguggcuucugcuuucauguagcuuccugucuaguuggggaggcagaugguacagaaguaaauaaaacaugcggaauuauaaauuauguaagugcuaagcaggacaagacaggaugcccagauagggacuaauggauguggggcaucuacuuuaguuuggaggccagggaaggccuuucugaagcaauaaagcugaagcuaaacuguggcacaaaagcccgucccuggaauguugggagguguuccagaccaaagguguagcacacaugaggguccugaggcuggacaucuccuggggcuagcuacgagugagaggguaucagcugguuuucacacagcagaccugguguugcagguauauuuggacagaugcauauaucuggacucucuggaagucccaguuuugcugaaagauaagcguggcacauccuaucauucugaaauaggacacggugagacagaagaaggcaggccagccuucuggauaugccuggucucacuauggcuauccuauuggccuuuauccauccuuagucuuauuucugguacuguaaccccuuauuuccaugguagagggaugggcugauguggaaucagcguuggcaggcaauccuggcagaaagugaauuagacauuuuucacaacucugugauuguguuuggucauuaaacauuggcccacuggcugcuuaugacuugaaugccacauggagguuaaggacacauuccugaaccacuaacucaagaauuagacaucagagauacuaaguaucuaacaucauagaauuguaaauaaaauuccccugacaccuagaccucgucucacuccuggucagugcuccuuucccugcauagccucacagagcacaggcccuucaugcuucccuccauccccuuuccugcggggcugccucuugggcugaaggcaaugcauggcgguggggcaggcggcauauuuugccuuuucuuuuuccuccagaaacaaguuuggcaugggacuuggucagucuugaucugugccuggaagugugaaggcgugggugcagauguugggauaauuuuuguaccucagaaccagaacuggacacucacuguagggaagaccagcuccucaccccccgccccgccucccccgccuggcccgagguuccuguugagcaggcauggccuagccucagacuugcaugcauauuuuucugcuguugauuuucucaaauucuuucacaagggaacaguaguuuacauccuuuaaagcuuucuugaggcugggcacgguggcucacgccuguaaucccagcacuuugggaggcggagguggguggaucaccugaagcaggaguucgagaccagccuagccaacaugacgaaaccccgucucuacuaaaacuacaaaaauuagccaugcguguguaaucccagcuacuugagaggcugaggcaugagacugcacuccagccuggguggcagagugagaccacgucuaaaaaaaaaaaaagcuuucuugggauaccaguuuggucuucuggugacagaaccuugcccauagguuagaggaaauaauacuuucagcaacacccccagcuugggggaucucagaaagaagggcauguugccaacuuuugaggauuugucugagaaacagcaaccuggcaucccccuaacucccugcuuuuuuucccucuagaaucaaauagaaucucuuuuccuggcaaagauuuccuagauaaaaagagguacuacuuagucauuuuuguagguucguuaauaguuucuaaaaguuuuuaaaaguacauaauaagaaaacuuguuauggcaaccaauaaaguuucuuuucgaggaaugaauauuuucuaggaaagauaagagucaguuauguuuggucugauuucuucagcugaaucuuucccucuuccucuuaucuugaaaucuaucucauaaggcaaucuggggacacuuuagcaagcacucugguaacagauguguguccuccucuuccugacacaucucccagcccuggagacccagcuguacaaucgcaaacuguccacagggcggugggguggaaaucaucuccaugccgacuccgaacuauuuggugcacaagagggcaguauuugcuuacagucuuggaucgggaugaucaauguguaguuucacaggucagcauaguuaaaaugaccucugacuuuuucaagacaaaauaaacuguaggccacagccaugauggcuucccauagaugccuuuaagugucugaucccuucagaaaaauugcugcuugcuaucuuuuuuccuuaaaaagaaaaauauuguuucuuucaagguuuauuuuuaauuuuuuuuuaaucaaugaaaauaugguuugcaggcuuguaccuacaauggcagagguuaaaaaguguugcaaaagcaaaacaacugcuuucuaauuaaaaaccagaugggaagauuuuuguuugaagcaaggggucaaauguauuuucucccccuuucauaucaguguaaagauuaucugacuuaacuuuuaaagcauuugaagaugugggcuucagucaucaacccuucuauacucaguuuuguuuuucugcaaguucacaguauuaaccaaagcaaggacuuuccaggagaaaaaaaggagaucucccugccuuccagaggcacaauguucuaucugaaccauaggccaugucugcuuuuguauaaugauuugccuuuuuaaguucuuccaugguguuuuucuauagagacuuuuaagccagaaagacauagcuggcccuccaaaucuguggauucaaccaauugaagauugaaaauauuaaaaaaaaaaaaaaugaaaacaacaaaaauaacaauucaacaacaaaaaaaugauauguuuaaaaacacaauaaaguauagcaacuauuuacauagcauuuuuauuuuauuaguuacaagugaucuagagaugauuuaaauauaugggaggauaugcauaaguuauaugaaaauacucugucauuuuauaucagggccuuaagcauccucagauuuugguccuucagggguccucaaaucaaucccccacagauaacaaaggacaguggcauugguuuacaacuccugucccaccagauuccagccuaugcaagaauugggaucucauaucuuucugcucucucuuccucaaaccuggaacuucugauuugaggugccuccauaacuuuagcacccaagagaguuuaacugaaaacagcagugguagcaaggcccagcacauuaaggacauagugauggucaggccgaaggaacccaugcauagggguggccugggucuagcggaaaugccaccuggccucucugagccugucugugcaccucaaaugcagaugauuaucucacagggugguugcaucaaagauguccauaaauaaagcuucaggcacauaguagggagcaguuauuguuuuguuuguuuauuuuuuguagagccaagcgcuugcuguguugcgcagguuggucucaaacuccugggcucaagugauccuccugcuuugacugcccaaagugcugggauuacaggugugaaccacugugacuggcugggagcaguuacugugccaaugaucucucugaccccugacgaauuauaagcauauggaggugguggggcacuguuggacaugaggauggagacacagacacugauucuugauugcagacaaaccaguucuuucuggauuauucauuuauuugauucauugagcauguccauugcuuggucccuuggagcaucugcagcaaagugaaaugcaaucuagaugggaggugccaugcugccgccucgauccucugauagcaaucgaggagaaaagcuggguuccgaggcuuagcccuguaugaaaucagaugucuucuuuuacucuuuuguaaucgcaacauaaaucuuccaaagggaguaugucuauaagauagaugccacauaagcuguggaauguauuaguaugugugacaucccuguggucuuuuaauugaucaguggcauuuaaugcaaaauuugaaucugaccacacaaaguagggagaacccuggguggccuucauguuugcuuccccgugaagcuccuguccuggcuuuuauuagaagggucuggguaggaaaagaaggguuuugagcugaaggcuuucaaaagaggcccaugccauguuuuuccgggaacauaguuucuaaaaaaaugcuggaaccaucaguuuccaaaggagccugguuugugaggggaaugaaaaguuguuccugcguguggauucuggguuguuuuccaucuucacucccuaaggcagggcuggcaagcggggaaugggacagauguuuugugguaguaauuuccagucagauucuugaaugccuuguauacucugggucaccgucagcucauaauggagcaaaauugagugagaauuccugcaaugaacgacgugaauggcgcaccggagagauaugaugguggagauagagugcauucugcaagaaaauauuuccagugcuaucuguaaaauucagauugaauaaccauucugaagugcuccccuuuuaaaagaguuuccuuccacaagcauugcaggcugaguaaauaccaauaauuuuuauuucccuucuccuuaucgguuccccuacugaaauguuccugcacagccuaucuggucuuuucaagugaacaucaaaugauuagugucagcuuccaguuugaauuaugaucauauuucaaaacacaaacuucuucacuuuugcguuuggagguaauuaucaauauuuaccaauacuggggaagaguugaaaauggaggaaauacugcugagagaauggugccccaagugaagauagcagggagggguuguguguggccuuguguguacaguggcagagugcuucaggggcuuggccugccacguggauggccugcucucuuccagcccuauccgcauucucgcacagauaagugagaggaaugguggggacccaacugcaaggcgaucucuuaggguugggcacuaugacaaggcuagaaaagcuauuucugccaccuggaggaggaaacauugcucuggccgcugcucucagaggcccuccccucuguuuccacagauccugcucucugacugccauggccugguacgaaugcccuuuggugaaaaaggccagugaaacccagggcugguuuaaggccugcgcugcagccuggaaagcagacuaacacaaauagacugugcugccaucacacagaaaauacaguuuacaauaccuacaucagaguugaaucccaguguacuagguggcguucucuugcauuguaguaggcauuuaauugaacuuugaguaauuucaguuuuugcaguuuucuuuuuguauuuuggagccaguaaguuuuuuuauguuugcaaacacucuguaagcuuuggugcuuugcuuauugugccuaauuaauaguugccucuggaaaacgcagaggagguuucagacugccucaaagaacuucccagagaguggagaagcugcagcacaacaggccugggcucuggagucaggaagauugaaauuggaaucuuggcccuucugcuggcuuuuuguauuacuguggacguguagcuuuucugagccuucauuucuucaccuguuuaaaacaggagagaaagggaauaaugccuaccuucggguuugcuguuagaguuagcaguaacugugauacaguuagcaucauucugggugcaagguagacacuugguaaauggaagcaggccuuacuguaggguuagugcacugcaggcuuggcaccagaauguagccacuucugaaguccuuggggcagucaaaaguccucuucccucagcauugcagacagcaggaaagagcauugcaauuaugcaagagcuauguuucaaagaaggaaaugaaauucuugaauuuuuuuaaggcaaagaagagggaaaaauagauuuauuguuuuaguuggcuauucaauaggaugcaggauaaagcuggccucucuccugucuaaugucaucaucggcauucucucuuuuucucuccuucucuuccucccucuccucccccucugcucuacuccuccucccuucucuucccacgccuccccccgcuccuccuuccccuccucuucuuacuaguacugcugcaaacccccccuuuucuccaagucaaccccagguccugagccugggauuaaaucucaugcucuggagauacucuaaugcuaggaauuauuuccucuuuuguggucuuuggucuuuccuucagguuuccuguugcuuucuaagggaggugccaggugcuggcccuguggcuaguuuuggcuagugaggaaugcuguaaagcagcugugacaccagcgugcagcaguccuacugcugugcagccugggcaguggguggugacaggguggcauuggagugaacaagguguggggaagacgagcguagguggaaaaaauguagaccgaccuucucgguaaaacuggccugggaucccaggcaacaugaaggcuggcagaugcugagggaguucucuaggggaggcugauaaaauucgacaucaccuuaccauuuaaugagucccagauacaugggcuaugccagcccaacagagugcaggcuuuggaaagcccaaaugaaaacgacauggucccugcuguugggggaacucauagugcugggagaagccugcugggccucuuuuucagaaggagggagaacauggguuuaguagugagcccucuaauuaggccugcagguaggccucagcguggggccuggauuugcacccuguccuucgguuagagguuugugacacccauagcugugcucaguuaaguggagcaguggaaagagcugaggcucagcaugcugguccacguuugaauccugauggaccagcuugugagaaugcacagcucugagccucaguuuucucaucuucaaaauggggagaauaaacuuacaaguguuuucgugugugugagaauccaaugagauaagcuaaauguaguauuuaucucaguguauggaaccuauacucuguaagugguguuagcuauugugaucauaauuuaauaugacuuaaguuuuaaucuuuauacgacuucauauaaaaauaaaccauuugucagaaaucuuauuuuccuuuuuuuuuugguugggaaggcaggcuagauggauggucucugauaccacguguaacauaugauuuuugucucuguuuuuaaauuggugauaauccgauuggagagaaacuaaauuaauauacuugaaguaaucagaguaugggagcuuaacugcguugaucggcuguaaaauugugagugcaguuagaguuaagacaaagaaggccacgaagggaaaagacccaaccagaagacacacaccagaagagaaauguggguggaguguuagcaagccacacgccuugucugccgggagagaccagucugcuggaagcaguggcuuguuuuauguuugcacacugauagguaccaaucacugcuacaugcaaauguacccaaaaauaugugaugacaggaacuucucuugaaauaauuuaugcauuaauacuaaaggaaaaaaaugcauagaacagcauaaauugcaaacaugguauaauugaaaaagcuugagguuuagagucugagaaacugaauuugaauccuggcuucaacauuuguuagcuauauggucuuggguagauuaccuucucugggccucaacuuccuuguuugcaagaucagaaagaacuauuuuaaggauuagaauauauaucuaguacaugauaagcuuuuaauaaacaucauuacuauuaugaccacuauuuuacuacugauaauaaagacucccggccucacaugacacuccauugccagcuauaaauguggucuucccugagaugcuguaauuuuuuucuguaguuuaaaugaacauacuggauuauuauuauuauuauuauuauuauuauuuuugagacagagucucgcucugucacccaggcuggagugcgguagcaugaucucagcucacugcaaccuccgcuucccagguucaagugauucuccugccucagccuccuagguagcugggauuacaggccguacuggauuauugauucaauguuguggggaggcuuauaagugaauuuauaugauuaaguuuuggaaagcuuuuuuuuguugauuccuuaucuuaaaaccaagauaaaaaaagccuuaauagcuuaauauuuuuagggucugagccaggccuauguguuggccuggggaagaaagggaaacauucagaaagcuuuagauuuuuuaaagacuuguuggggguguccuccuuucaauuggagaaauagugacaccacccccacccccacccgcaucucuggauuuuacuguuuauuuuuuggcacacguuuccaaauacaucaaauauaaaugaugcauuuugaaguuuuuaaacuaucaauaaagcauuagaccuucacagggguuuuaaaaaggucuugcugacuuuucguuuccccagauuuguaggucucugaaauuucuggaagcuuucucugcaucucuagcugagccaaaacgcaccucuguuuagagaugguaaagaacuccauuugaggaguucauuaaacuccaaagaaucuccccccguucauucuuuuuguguuuuguugcggcauagauugcuuaaaccaagugagaaauagcugugaguuuuuuugaaacuuggagauacucauuuuugucaaauuugucuugaaggagcaggcucaaguuugcuuuuauaaauaggaaaauugauuugcaaagagaugaaggcagaguaucagacaggagaugacguguggcacauuuagaauuuggagaaaccauagccauaaagaaugaguagacacacauucuuuauauaaauggguaggccaucugguucucaaaaaaaugcuuguugacaaacaugauagaccucaaggugaauuucagacuuuuggauuaguuuaugugcauguugguacaugugcagaagcucauggcaaaauaauguaccauaauaaaugcaaguucagcaaauaaaacauaguucagagucgaguuaugugguaaaaaugcaugaacuaaguaauuuucagugaagguuuuauuauuuuauaaaugaggucuuuuuaauugccuuaaaagacucucuuuuaggaaaauuugaaauaugaaagucaucuuauuuucauguaaaaugaaacauuuaaauaccuuuuuucucaugaaaauuucuagcauauaaagugaaacuggaaguaguuuuguuaaguaacuuguauuuugggggcugaggaaaagcacuagaaaauucagcuccuaaagaucauucuucaugagaugucaauagccuccagacaaauuaucaugugaauauuuucuaaaccauaaacaaauuuugcuaccauuguguuuagacucaaaguuaguuuaaaagagaaauuucuaaaugaaacuuccuaacggucauucuuucgggggcaggcagauugguagaaguaauauauaaaacccaaggacaaaauggcacuuuguuuuuuuucuauuaaacucuuuugcuguuugcuguuucaaaaauucauacugaaucuuuacaaugaaacauuugugaguccaggagcccagaacccuaaaugaauucagauugacuucuuuuucuguacggucuaucaaaaccuuuucacuuuaccacagaccagaaauuauuucucacuguuuucugugccuuacuccuuuaaucuccaaauaccuguuacuacuauuguaauuguuauuuuauuguaacaguuauuguuguuacugcuauugaacaagcuuuggauguuugguuugaaaagauucaaucaaguauuuugauuaugaugacuagugccuguguauagcuaagcagugaagcaaugcagagauuuuauaaauauuuuuagggcauuuuuuuacugugauuguagggaguaagauauuuguuuuuacaggcuggaaagauugcugugaauuuuaacacuugggagucacagcuuuaauucugauuuagucuacuaaaauaaauaaaaauuagccguugauacucuuuuaaaugaauggaaccuauuucugauucugauuuuucugaagcagucucuacauuucccaaagugccacuucccaagguggacaaaacauguucugugcaggcgaaaugugagaugcuggcugcauaggggaggaagggggagaggaagcuguuugcaaaacuacuuaaaauaaauuugaagggucaaacauggaacacaguugcaaaagagaaaggaaaaaaugccuuaggucaguucagcuagaaucguguaggcauucgcauuggcuagaggguuaguuguguauuucuugcuaaucagauacaauuggagcagauaauauuugaguaucugaggcuagaucucauugccucuauaucagggaaaugaaccaaaaggggcaaguuuuaaaaguuugauuuggggaaacagauaccauuuaggagagagaugguaggcuguguuuaccucguuguccgaaggcugcucagacuuuagucagcucuccaacuugcagcuugucccucagagaugcaguaguggcuugggccggcagacgggcuugcguuagcauuucauuuaaaagcgaucgguacuuuuaaauuaaacaugcaaaguuaucuuggugagguauugaaugggagguugcuggauuauugaauuuggcccaaaauuuagccaguucagcagggauuuuggggucugaagcaauuaauaugcaaguacauuugagucagcaagguaggagauuacugucuuaucagaguaaaaaaaaaaauucuuuuuccaagauccauacuuuuuuggagguagauaaaaacuccauuguuugagauucauguuugugagugaccaccucaaauugccagguuuuaaccacuaaaacacagaggagggaauaauugcauuuaaaaucucugaucuguuauuugcauuaugcuuagcauagaggagaccccaauuuccuuccucauguuuuugguuuuuuuuugccauuuuguuaacauagauugagaggaaacuuaauuuucuuucuugaaaaaaucauucacugaacugcucaaaacacaugaaguuguuuuugucucaucagaucgaguacuuaagacaaaacuacgaaggacuucaauauaugguuaaccucucaugugcucugugaaucuagacacacuccauccgaguugcuguaugauuuccugaccauaaugaccuggccaggggaacagcuauuccuuugacaacaccguuuuucuucuucuacacagccagaacccuuacaccuguuuucccaccuggcaggcagcauucagaggcaugagguguauuuuuauuguguggcacucagccacacaaguggcugugcagucuuggggagaagagguuacuuaacacaauuuccuugacuuuaaaauggggaaaguaagaauguaagaccuuaaagaguugugaggaugguguggaacaacagcuggagggagccaaaggcagugaauuacagaugugcagugccauugaguugcagcuuccucugcccuugacucagugcaagagacuccaggcccugcaucgaugggaccaggcaggccugugaaaggagcagagcagcagguccagagccagcagaaccugcgagcuagugugccauugaggccugggaauugcugcuuuacuccagaagacagggaaccuggugguacagcaggaaggcauagucuuugaaaaucagaugugacuuaaaaaugaauuuaaaaaaagggggcuaaugaaguccugaaggccuuuauuucuguauuuauuguggagaucuuuuucuucugaaagcuuugauuugaccaucugccucauuucaggaguuuggagaccucggaaauuugagagaucacuccuggguagcaaguugcccuuuugccagggccuccuugucccuuagaagcaucuagccuuggcugcuucagggggcacuucaggacauggauggggacugaccauguccuuuggcaggugacgcagggagucagccugggcgugaguggguguguggcuggcucccuggcaaagagcugccacaguuuccuaaggggccccaucuuuuccauccagugggacagccuuucuauuucagaugaaggauaaaauacuugguagaauaacuuucauuguucccauucccaaauccuuuucuguguguggagagcauucugaguuugucuguuuguuuacuguccucccaucaagaccuacagccuaugccgacauucuucuaagcagaucacaugugcuuggcccacaagugggcauucugaacacuuuuuuguguuuucagccaugguccucuuuucucaagggauacugccagucuccauccugauccagauuuagaaacacaacaaaaacaaaagagaagcggugauauaaaauggaaguagaacuuggcguuggcuaguggagacggcgauaaggaguuuugaagugucucuccuuugaaaggucuuucuuguuggaucacugcucccccaguaugucugauccuuaugcacagcccaccugggcugguggggggcgguccucaucacacugaggcuggguuucuuuaacuucagaaauguccugaggaauaagaaaugaaacaugagcaauacaggguuaauguugucaagccauguuuguuuuuguuuuuguuuuucuuuguuucuuuuuguuuguuuguuuuuugauacgaagucucgcucuauugcucaggcuggagugcaauggcacgaucucagcucacuggaaccuccgccucccggguucaagcgauucucccaccucaggcuccugaguagcugggauuacaggcaugugccaccaugcccggcuaauuuuuguauuuuuaguagagacgggguuucaccauguuggccaggcuggucuuggcuccugcccucaagugauccgccugccuugggcucccaaagugccgggauuacaggcaugagccacugugccuggccuauuuuuguuuucuuugauggggcaagguacccagauuaaguuuauagacgacagcuaaugauaaucaaguuccauguuugagugccuauuaaauuaucuuguguaaugcccccgcacaucugggagaagaguuuuguuuugguuuuaguuuuuuaaauaaaugaagaaaaggugacucagacagguuaaguaacuauccaaaaaaaaaaaaaaaauucuguaguaagaagguggucaauccaggauuuuaaaaaaguauuacauuuuggauuagguuauauauguacaugauagaaaacuuaaauaauguuaaaggauaugcagagaaaaguaugccuuccuucugucucuguguuucagucuccuuacacuccccgcacugccaacacacaucaucaguuuucauuugugagcguguuuuggagauggguccauauuacuuuauaauaguuuccccucauucuuuguauugacaacauacuguuccacucucaggaugacuugugcuaucucgaacaguagugucuggaaggccuugguuauucugucuuuuaugguuguguguacaugucacagggucaguuccuagagacagugccugcuggaaccuggguguccucacacccagaccugugcaguagggguuaggguugcugcucuugccuagaaggagccagagggcucccaccagcccugcugcuagcagagaccuggcgaccacuguggcuuuggcacuuggccugcuucccaccagccacagagaucggggcggggggguggggugguuggucuaguagugggggugggcggguugccagagagaaggagcgggaagaggccuuucuuuucaauuuacccucuuuuuguaugccauaaucuuguuuuucuuuggaaucccgcugauccaggccugaauucuaguuuuaccauuuuacuagcugaaugaucuuugucaacuuauuuaaccuuucugaacuuaaggcuuaccaugaguauuaaggcuuaccaugaguaaaaauggugcucagaauaccuaccuguuagaguugcuucgagaacauagaauaaauauuacugcuaguacuuuauugagcuuugacuaugucagguacuuccuaaacccuuuaaccugugguaaucugauuuaauccugauaaaccucuaaugaguuagacacuguuccuauccucuuauaugugacuugaaaucuaaaaauguuaguaaacauuugaccccaaccuguugggcucccaagcccaugaucuugaccacuaggcuaugcugccucccauaaaugcagccagaguugauuguguauacucuaugucugucuaaucauugaauucuacuucuggugacacuuaagcucuuuuccugcacuuuaauguuagagaucaucauucuuccuaaggaaggcuuuuggagcguugcuucuuacggugcuuauuggaaaugugaccuggaacaagaugcaucauuucuuugcaccucaguuuccaucuuuguaaaacauugauagcaauacuuaccuucucaugguauugugagaaccgaugcgugcagggcacccuacauacuaacugccugguggauagcggguccucaguugauguguuguugucuuuuucuuccucauuugggucauucauagacuacuggagagauauucgagaauucuucaaguguuuguagaauggcuugacauaaguugcuuuccauuccuuaucuguguaaggagugauguucuggaguauuaaauugggugagugugggcacaguuuguguucugagguuuagugugacugugaaaacaugcuuuuugcauugccugagaggauacaauagaccaccagcaggaacagcagugcagaccacugagcagcuuuuuguagcccuggacccaguguucaguguuccagagagaugguaagaauaaagggagaggcaucgaagccaaacaauuccuagauuugauugaucuggccuuccagauacccucaaauuccaccaacaacuacuuuuaguguuuuuuccuauuuucuuccaaguuaaaaaaaauugugauaacauauucauaauauaagauuuaccuuuuugacuauauuuaaguauacaguucaguggcauuaaguacaugcauauuguagugcaaccaucacugcuauccaucuccagaaccuuuucaucuucucaaacugcaacucuguauccauuacacacuuacuccuuauuucccccucccaccagcuccuggccaccgccauucuauucucucugugacuuggacuacuaaguggaaucauacaguauuugcccuucugugacugguuuauuucacucggcauaauguucucagaguucauacauguuguagcaugugucagaauuuccuuuuuuaaggcugaauaauauuccuuuguauauauauuuucccauguuuuaaaaguauaggguaaguauguaaguaucuaucaguauauuuauuuauagccaucucuguaguucuguauuuugcuuuggcuuaacguguauuuuucaaguuauuacuuaaauuuugugaguauuguuagugauaccauacuguucugauucuguuuaaaaugaaggacauuuuuuuuccuuaucucuuauagaaugaacuagcuguauuacacuguuugcauauuucuagaauugacauuuccaagggacaguuuagaaauucucaauuguaucacaaacucugcagugauuguauuuugcaccuuacccagacaugguaagaaauacaggucuggcauggcaugauggcucauggcuguaaucccagcauuuugggaggcugaagcuagagauuguuugagcccaggaguuugaggcuacagugugcuaugauugugucacugcacuccagcuuggguaacggagcgagauccugaaagaaggaaaaaaacaaauacaagucugccauaccuuauccauaaauuugaaaauucaaauagcucuguaaacugaaagcaguuuuuuggaguuuggaugcaaaaccccaucugaacugacugaaucuuuuauuuuucccauuuagugugaauauuuaauguuugauuauagggaauggccccaucgcugcugggguauuauauaauguaugauauauuuauguauguacagaauuaucuuuuggggggauaauuauuuuaauuuauucaucauuuuauaacuuaauauuaugaagcacuucauauauaccuucuuuuuacuaagcaauaaaacagacuuuuucugugacauuaauuuauaauagaauauucuuuugugugcaaccauaucauauuuuuuuagaaacuuuuuuuuuuucuuuuuugagacagaguuucacucuuaucacccaggcuggagugcaaugacgugaauuaaauggaauuauauauacuuuaugaccuuucgugucuggcuucuuucacuuaguguaauauuuucuuuuuuugaaauaaggucuugcucuguugcucaggcuggagugcagugguaugaucauagcucacugcagccuugaacucuugggcucaagcaauccuccugcuucagcaucccaaagugcuacgauuacagguguuagcuaccacgccuggccaguguaauauuucuagauucacccauauuguagccugagucucuacuucauuccuuuuuaagacugaauaauauuccaugccuggauauaccacauuuaaagaauccauucauuaguugauaggcauuuggauuguuuucacuuuuugauuauuaugaauaaugcuaccaugaggagucauguacauguuuuuguguaaacauacauuucuguucuccuggguauaaauauacccaggaauugcuggaucauaugguaacucuauguuaccuuuaugaggaacugccaaacuuuuucacagcugguacaccauuuuucacucucacagcaauguaugaagguucugguuucuccacauccucaccaacacuugcuauugucugucugucugaucauauccauccuagugggugugaagugcuaucucauugugauuuugauuugcauuucccugauggugagugauauuuagcaucuuuucaugugguuguuaauauaucuucuuuggagaaaugccuauucagcucuuuguucguuuaaaaauugaguuggcuuuuuauuguugacucauaagaguuuuuaauauauucuagauaguuccuuaucagauauaugauuugcaaauauuuucucccauucuguggguugucuuuucacuuucuugauaguguccuuugaagcacagaagcuuuuaauuuuugaaacauucaaguuuauuuauuuacuuuuguugcuugugcuuuuggugucauaucuaagaaauaagugcuuaauccaagguuacauagaugcauaccuauguuuucuucucaguuuuauaguuuuagcucuuccauuuaagucuuucaucuauuuggaguugauuuuuguauauggcaugaaguagagguccaacuuaauucuuuagcuuguggauaucugguugucccaguuuuuguuaaaaaaacuguucccucuauugauuuguguuggcacucuuaacaaaaaucaguugacuguaaaugugaaagucucuuucuagauucucaauauuucauugauuuauaugucuagccuuauucugaacuauuuuuuuuuuaaaguucuaaauucugaaacauuuucccccagcggcuuagggauuagguaauaauaguagauugcuacugagccauggggagggcuguuucuccaacuccucagauaucccugugcuuaccuucccagccugucuuccugugugagcuccauggcacacccuagggacagugucugaggacagugcugaggcucauggccacaggagugguagaagcagguuuucagacugauaaugccauuacauuucaaacuuugaacauuucaaaccuugaacaugaauaugagauguuggagaucccaacugggaagguguagcuacccagcaagucucccaucucugaauacucugcuauacaggaguggguacccagggaccacauuugaacccgggcacccugacugccuccagccccauugauauuuaauugguucagggauagauaccugagccaagauguacuaaacaaguucuucugugggaauuugaaacuagggaaagagaggcagggacacuaggaguucuggaaaucagcauguugauagaaauagugugcuagaccagagagaaggcugggagcuguucugcuucugggcuuucccagagcuucugugagguaccuggaauccuucuuguaaacccuccuuuuuguuuacaauucuucagccaguugguuacuuguaagaaaaaaaaauucuucaucaaugaauguguucacuuggugaagaguggaugucauuuuuguuauuuuuuucuuuugcaaauguacauuuagcaccugcugagagcaggacauucugaauguuaggcacugagaacaucuggcagauaaaagguggcccugccccuugggacucacuguucaaugaguuggaggguaggggauagaccauaaagcagauguacugaauaugagauaggugcaucaaagaccauacaauacaccagaggguuucagaggugcgagucagggaagacuucacagaaaaagugacauuuguguggaguccucauggaugauuaaagucugccugguagcaaugagagauucaguuucagaaaaugggcauugacugcagggagccuagaaguaugaaggauuuggaggguuuggacaauccagagaaggcuugugugauuggucacaaguguaagcagccaauggugagcuggugaagcagguuggaagcagauuaugaagggcuuuguaucuuggaccaaaacauuuacacuuuguucugggggcagcagacaggucugugguuuacagaguuuacccuggcauugauggguuggaggggagagaggccaggagaccauuuuggagggcagugccagugguuagggugaugagggagggauggaaaggaaggaaggccgaaacccaaguuaggaaauagacucuccagacugggagacuagcucuagguagaggguacagugcaguuucaaggagacagggaacgaaagagguacuuggaacagaauggguaugagguaugggugugggaugaggaugcugcugcgaucaugaugagggcuggcaggcaggcaggcugaggggguggcaggcaugcagcagccccagggcuucuuuuuugugggguagaugaaaggggguccauuugccuuuguuuuaugccaaucaggugcagcuuuuggauuccuggcuagcugccauguugcccucaggcaaaaguuuggcggccuugguauuguugacccuuuguacuagauggugaaaguaucugccuugcagaccaggcccuggaaucagguauuuggaaugcauagcuaauguguuccacuccaguccguugguauuauuguuccacaguaucgcaucuaauugacuauuucuaaauguucuuguauauuuugacuguacaagcaaaguagguuuccagcagccccucuuugccggggcugccucaucugcaaaguuugcuggcaccacccuccuuucccaggguuccugguuccuuucugccugggagcccugugccugagggggcauggugaucuuacuggauuccccucccagccuugcccaccuguuguccuccagccccgcucaccugggaguuugauagaggggcuauugugugcaaaggaugguucagcauggacugccuuuccucccuugugagucuguaggggaguuggacagguagggguagacccccaggcacugauggagcccagccucggugcccaguaccuuuacauggggggggcucccaaaguuggauacuuccagcacagcaagacaggcacugcuauuaggggcugcccagaucaagugacacugaaucaucugcugagcaaguccuuccuuucucaguccgugggcagccccucuggccauguggaggaggaggccugugagcacugguucucuggacauugcucaucucccuccuugacaagcgccucgcagaagacaaaacuccauucacacaaugcauaaugacagcuuaggucaaugauggaagguauauaugaugguggucccauaagauuauaguggggccaaaaaauuccuauagccuagugcugucauagcugugguaacaucauagagcagguuacucagguguuuguggugaugcugguguaaccaaaccuacugugcucagucuuauagcacauauaguuacuuauaguaccuauuaugauaauacaugacugguuuaugucuuuacuauacuagacuuguuauuauuuuaguguguacuccuucgacuucuuuucuuuuuuuuuuuuuuuuuccgagccagggucuggcugucuuccaggcugcagugcaguggcaccaucucagcucacugcaaccucugccgccuugccucaagcgauccucccaccucagccuccugaguagcugggacuaagguccucaccaccaugcccagcuaguuuuuguauuuauuuuguagagacgggggucucaccauguugcccaggcugaucucgaacuucugggcucaagugauccaccugccaaggcauugcaaagugcuaggaugagccacugugcccagccuccuucuacuuccuuuugugucuuuuuuuggagauggagucucgcucuguugcccaggcuggagugcaguggcacgaucuuggcucacugcaaccuccaccucccggauucaagcaguucuccugccucagccuccugaguagcugggacuacaggugcaugcugccaugccuggcaaauuuucuguauuuuaguagagacgggguuucaccaugucccccaggcuggucucgaacuccugagcucaggcaaugcacccgccucagccucucaaagugcuaggauuacaggcaugagccaccaugcccagccgcuccuucuacuucuaacaacaaaaauuaacuguaaaacagccucaggcagguccuucaggauguauccaggagaaggcauugucaucacaggaggugacagcuccaugcauguuacugccucugaagaccuuccaguggaacaagauguaugagguggaagacagugauguugaugauccugacccuguguaggccuaggcuaaugugcauguuuguguuuuaguuuuuaacaaaaaaguuuaaaaaguaaaagaaaaaaguuuuuaauggaaaaaggcuuauagaauaaggauauaaagaaagaaaauauuuuuauacagcuguacaguguguuuguguuuuaagcuaaguguuauuacaagagucaaaaaguuaaaaaauuuuaaaguuuauaaaguaaaaaaguuauagugaacuaagauuaauuuauuauuaaagaaaaauguuuuuauuauaaauuuaguguugucuaaguguccauuguuuguagagccuacaggagugcagagucaugcccuaggccuucacauucacucaaccacucacucacugacucgcccagaacaccuuccaguccuguaagcuccauuuaugcuaaguacucuauacagggguacccuuuuuaaucuuuuauguuguauuuuuacugucccuuuuuuauguuuagauacaguucaaguacacagauaccacuggguuacaauugccugcaguauuuaguacagucaccugcuucagcucacugugccucgccuggggguauuuuuuuuauuaugguaaaaaauauauaacauuuaccauucccauuuuuaaauguacagguuuguagccuaggagcaauaggcuauuucacacaaccuaggugugugguaggcucugccaucuagguuuguguaagugcucucuaugauguuugcacaaagaugaaauugccuaaugacacauuucucagaauguaucuucaucauuaagcaaugcaugguuguauaccaacauagcuugauauguauauuuuuaaugguugccuucuaauauugccaugucgugguuucaucuauggcugccauauaaaguuuccuuuuuuggggggcuauuuuuuauuuuuaaauuuauuuguuuacaaaauuaaaaaaauuauuuuauuuuauagaugggucacauucucuugcccaggcuggagugugguggcaugaucauuuagcucacugcaacaugggcucaagcaauccucccaccuuagccucuugaguagcuuagacuucagcucacugugccuggccuggggguauuuuuuuuauuaugguaaaaaauauauaacauuuaccauucccauuuuuaaauguacaauucaguggcauuaaguagauucacauuguugugcaacugucaccacuauuauuucuaacuuuccaucaccccaaacugaaacucuguacccauuaaacacuaccuccccauucucccuacucccagccccuggcauccaccauucuacuuuuuguuuauaaauuugacuacucuagggaacucauauaagcagaaucauacaggcuugguggcugguuuauuucauuuagcauaauguccucaagguucauccacguuguaucauggaucagaauuucuuucccuuuuaagggaaagauaauauuccagcauaucgauagaccacauuuuguuuuucccuccaucuauuaaugggcacuuggguuguuuccaccuuuugccuguugugaauagugcuucuugaauauuggugucuagguaucuguuugauucuuguuuucaaguccuucgagaauuccuauaccuaggagaggaauuacuggauaaagugguaucaauguuccuuuaagggaaaaaaguggguuuuauaaaacagggcagggcaaaauuaguuauuuaaagaaaaauauuaaguaauauuguguguggcauugugauggaguagaaaugauggagcugacccuggagugguggcuggugcagugugcaaaugucuuaccagccuggcagaauucuguguggccuuggcugugacuucacuccgggucucaaccuauccaucuguaaaacagggcugaugccucguuucucuccaggcugccaugugaaccugacacgguugggugugagaagccugcugguucucaggugugccccuuucccgauuuuucucugcgugcuuagagaccaugguggcugcagcaggcccuggacccgcucuucuccugcagauucauucaaggcugugccugugggguuccgagcugggcucuugagcuucagcuggcuguuuccuaaucacuuucuuuccugucacccuggcugccugcuacugugacaccuagaacauuaccccagaagaucaggacucuuccuggacuucacaaacguauuuuuauagugcuuacacucuucugccaauuuuaucuguagcuugucuuuuucuuccccucuccuauuuaacuucuuugucuuuugaccccuuucauucaguuaauugauugauuaacucuuuccacaguauuuguuggacaccugugauacuggaaggaggagcauauauuuguugggggaggagguacagaaaagauacagaagacaccucccacccccaauacuuuuagucuacuuggguagaaaaggaagacauucuugaaauugguggguaguaguaauaauguguaaagcauccuaacagguauuuuucuuucuggagacuauccaagcuucagggcaggggggcaucugcuugcuuuaaacagggacuguacagcacugguagaaaagagccuggguuuuagagccuggguucaaauguuggcacugucccuuaccagcuacaugaucuuacgugacaacaugggaauuccaucaugucccuucaggguuaaaugggacggcuugcaugaauccucugcaggguggccacacucagggaccuugcuguuagugacuguguccuccucccaaggagugggacuccccagacuucacuuaugcuguccuuauguaucacugaaguuccccucucaggacuugggggaaucaggggaugcucuaaaccagugggcucagacacagguccuauuguauagccacauaccccagaaagaaagugcccuccagaccagccuccaagggaggcagaggaggcaagggcucaccauuguuuuccagcagggugcaucugagaggguguugcucucugcagagcaggcuccuguggcugugacagagcuaaccuacuggcacuucgggggaggggcugcccucugccuguagccugacuauuggcaagggcccauuuuucugcauucauucauuuauccaguuacguaauuuuuucccuucagaugaucauuugccuggucauuugggugguaauaaugauucuaaaauauuauuuaaaaaugaauugacuuauuugcuuuguagcagccaccauaccuauguguuuuacaaaugucaccuucugugauccuuaccaugacccuguaaggaccacaucaucaguucccauuacugagccucagcaauggcaagugacuugccuaggaucacacacuaauccgcaggccaggauuuggacauaacuuguacaacuccaaagccauuucuccuaguugcucggcugucccucucuuugccuuccucccuccagaggaggagggacucugauaucagcagauguguuuuuccucuggcaugggaggacagaagggaagagaaacaguauaguuaucuaagugagaaugagccaugaaggcugaguagcgguuuucugugcaaguaaaaucuuaucuugggggauagagggaagaccaucuucccccaucccccaacuugaaugaagaagaaaaaacccaaccaaaaaugacauaaagcuaagcugccacaaaggcugcacuuacccaauauuccugguguggagguaaguuuugcaccccaauuucuccucucuuccgucuugggacgugaaaucuuuucagcucauaaaaaagacagggugcccacaugguguuuuuaauggagaaaauaaggcugggaggugucugagccucuugggacuuccggagagcuuggacaccacagccuucccagcuggagggugcugagcucccaccuggauugaggaucugugcuguccugaggccauuguucuuuuucccagcacaggauggaaaaggcuccucugggaggcaucugcaggucagaugcuuuugggguggcagggugcagcaguggcuggaugggacugggaugguuguuuuaacaauaaguuauuagagaacuucagcuuggcccugccuuucagggaacuaauucugggaaaucuaucuggauccugaaauaaguucugcuuugugauuucauaauuccucuuucagggaauaaucugaaaugagccagagcuuuaugcacaaaaauguucuucacagcauuauuuauaagagcaaaaaauugggagccacccaaaugaagcaaaauaagguacuuugugcacccuucuuuaaaaugauauuuaugaagaaaauuuaaaaaugugaaaagucauccuacauauguuaagugaaaaaaagcagggcaaggaauucuuuuugaguucaguaauauacaaaauacauaugugcaagaaaaagacuagaaagaaagacauuaaauguuaacaguagcuaacauuaggggcuaagaucuaggugacuuuuaauuuccuuuuauaaagaauuuuuuuuccccaaggcuuuuucuuucccaauguuauuuucuaaaauuucuacaaugaacauuauuaguugaauaguuacccuccucccuccucgcuccuccuucuuggagcuggucagccagugcugcuuuucuccuccucccaccccuccccuucucccacccgagcacuguggcugguuuccaguagcagcaguacaauuaauauuuuacacgaucuucgccuaaagucuggugguaguuugagauacuucuuuuagucugaacucauuuucaaauuuagggcccaggcuguucuauggcuuuaggaguugaggaaacaugaaagaaaucugccuucuauuuguuuaaauauuaaagcauuuaaaauauuuuuuccuucuuucagauaaucaaaacacagcugacuugccauugcugcacagugcugaaagguagcucucaaugugggugauuaacaccauggcaauggagggggcaaguuuuaaagaaauaauuaaauagaucuuggaaaaucauuauucuuuugucucauaauagaaaaccaggccugugucugcagcugagcacaguauuuggugaucagcagauaaaaggacacuccaaagccaaacuuggagccacugucgucuaccagaugcauuuuaucuggcggaaugugugggaccugacagacacaggggaauccaggcucugcgaaccucugcugagccucgucuccucucuccauaauggagaugaaggcgccucccauucacaaguguaguuauugcauaaguguuucccucugucaguuuucaguggcuaaaccuuccuauauaauauccuuggaagauagguuggggcuugggcuugaggucaagaugguagagacaagggauuugucccagacuucauggcaagagugagacuggcaugucuagauuagugauuagagagcucuuugagaaacuggggagagcucuggcccuucucccaaacagaacgcauauaacuauuucaggaaguguuuggacccaagaugaagaacugcucuucaagaagcaaccguggccuggcuagacuugggcaauggcaugacccuguggguauugcccccaccgccuuucugcgagggccugcaaaacggggcccuuguccacgugugugggucagugcuguagccaggaggaaggccugagacagugugucugugacucucugcuguuugauugugugagagucuguaugugaagaggaaaauaaaaaggaaaugaaaccaauuuauaauaauugucuucugacauauauaacuccaaaaaacugcaaagacaagguucugagccaaaugaaauuauucguuuaugaucaauuaaaugaugaacauaaacacaagaaacacacgauuuuccuugcucaagauuuggcauguguauuuucugauucuacuauauauguaagauuuuuauuuaaaacaaaagugaguuguugugcguaucaugggaugugugcugugauacaaauacaguggcccuuuauauauauuuaaauacaaagucacuuuuuucugauuauaaaacuaauacagaccuauuuuagaaacuuuggguaauaacaguauaaggaagaaaauaauaaucaucugguuuacuugauggaaauuaaacauuucauguaauuuuuuuuggcugcuuuuaaauuuaacauuauauccuaaacauuuuucccaugccauuaaucacuuucuguaaacaucauuuuuucaugccugcaggaguuccauuguaugaauacacaauuuaaguguuugguuguguggaaagcauauaagcucugacuugaagaaaugugacccaaaccugugucugucacuuacuggcacucgauggccucuggaaccucagucuccuugucugcagaagggagacugaaugacaguaccuuggguuacugagagaccucaaagagccucgcacaguguggggcaugcacucagcaaauaguugccauuauuauuauuggugacagcaguggcagcuuugucuuguggcuccucuagggagaguuuggaugcucgcaguauguuaagaauuugcagcccagcucuggccucguuuuuuaaaugaauacuuucuuuuucucuuauugcugugauuucuucuuuugcauuuuuccucuuuguucuguguacuuuuguaaguugcuuuacaucguuuuugcaguaaggcagauuauaaauaaauaaacacugacuauucccucuaguguugguuguuuagguuguuucugauuucuugcuauugugaaucauucugcauagaauaucuuagugcaucagggucuguccuagguuggauuauuugcuggggcuagaauccuggaggcggaaauacgcauuuuguuuuucuuuuuuuugagacggagucucgcucuguugccacgcuguagugcaguggugcgaucucggcucacugcaaccucugcuuuccggguuccagcaauucuucugccucagccucccaaguagcugggauuacaggcacaugccaucacgcccagcuaauuuuuuuguauuuuuaguagagacaggguuucaccauauuggccaggcugauuucgaacuccugaccucaagugaccuggccaucuuggccaccuaaagugcuaggauuacaggugugagccacugcgcccggccggaaauacgcauuuuuacaucucugauccaauuucuucucagaaggcuguaccaaucuacacucccaccauuaacgguacgagaagaccagugccacugacuccaugacugacuggccucuuucuuucaagccccguuucuugucauggcccaggguagcaacaaucugauucucaccuggaugcuguguucugcaucaucaucaguaaauggagcucaggguugaggucugccccaggucccccgguuuugguaaaucuuauuucugaugggaaggcaguccugucgccagccaguccugccugcauagauugcccucucugcuaaacaauggacacauucagacccgacucguguuuucaguuauuaaaaaacugagccgucugucucugccugugacuuuaaucuuuaagccuuuauucccuuuaccccaucccccuucccuuaaccuuuuguuugugcaguuccgagcucagggauacguggguccaagacuuucugaauguacuguggcuuccccugacagcuacagaugguuguagcccugagugauguuguuucaggguaggcaagggggggaugaaagggaaggagaagagaggucagcucuucuugccuccagcaaucauuugaacuuugccaaaacuauuuuuacauagcucuggaguggagugccuccguuccauucucuccccauuuucaaauuugguagacuuguaccguuucugaguugcuuaggcuuaauaaguuuacaucuuacagugccucuuagcauuucuuccugagaaguaguucuugugguugaauuauguauaugugugucuaaaagcaaaagucccaagaaaggaucuucaccccaacccccuuaaaacacaaccagaaagcucagaacacaacaacaucuuccauuucagaaagggcacucuuccggcagcacaugugguucucagugucuucuugcacaaggccagccagagaaugcuggauguaaaaaccagugacagggccaugagcuuggcugacagggagcauuaggaaaccauccucucuuuugcagagacacuggggacauuccuuucugaagaaggcuccuugcauacaaaaagaauggucuuuaagaguguugcuggcaccuuucugugaagagccacacaaugcagagggagggaaccuaucacuuggauguggaggugcaggucugaaggccaggaaggagacauuuuuucauauguguguuuuuuuuuucuuaaagacuuucuguuuuuuuuucuuuuuuugagguggagucucacccugucgcccaugcuggagugcgguggcacuaucuuggcucacugcaaccuccaccucccagguucaagcgauuuucuugccucagccuucugaguaccugggacuauaggcaugcgccaccgcacccagcuaauuuuuguauuuuuaguagagacaggguuucacuguguugaccaggcuggucuccaucuccugaccucaggugauccgccugccucggucucccaaagugcugggauuacaggcuugagcuaccacaccuggccuguguguauguuuuuucaagugugugcauuuuuugugcauuuuuacaugucaacacacccuguuuguuuuuaaaccuuuuuucucacuacaaagcuucuaugacuccagcauuuuauaaaugccuucagagaaugcaagagccuccucaccccuuuacggugauguuaacagaggguuggugccuauucaucugacuuuguccacauauauguauauuuaugcuuauguuagucuauuaguauugucacuuuaaaauuuguuuuuaaaguuaaguguggggcuauacuacaucugcuauuuugcauuuuguuuucccucugcuuagcaaugucuuggagcaugaguucagagaguucaaauucacucuguuuaguggcuguaggauauucccuugugucuauuuaccauuuaaccagucuuuuaauggauguuuuuggugucuccagucuuuugcuaggugaacguaaucucuuugcaccuuguagaaguguuucugcaaguuucugucuuagaauuggaaauuguuggggcaguugcauuuuaaaaaguauugccaaauugccccucccugcaaaaaagucauacugguugucuguuuuauaaaaauaauuuuuuuuuugagauggggucucacucuguugcccaggcuggagugcaguggcaagaucuuggcucacugcaaccucugccucccagguucaagugauucuccugccucagccucccgaguagcugggauuacaggcgcacgccaccacgcccugcuaauuuuuauauuuuuaguagagacagcguuuuggcacuuuggccaggcuggccuugaacuccugaccucaggugauccacccaucucggccucccaaagugcugggauuacaggcgugagccaccgugcccagccuaaaaauauuauuuuaagugaguuaccaccgaggaaaaguaaagcuuugucuaaaaucucagggcuacguuuaucuuacgacuuucugugccugacaccaucauacacaccugggcuuauaaacuugaauuugaaaagucuagcuucaagaucagucagcuuucacucuggauauauuuauuguccgucugcuaugagccagaccuccaguucuguggcgguaacacaaggaaaucuuucuccaaacucuaacaugaaucucuuuuuuuuuugagauggaguuuugcucuuguugcccaggcuggagugcaauggcgcgaucuuggcucaccgcaaccuccgccucucagguucaagugauucucaugccucagccuccccaguagcugggauuacaggcaugugccaccaugcccggcuaauuucguauuuuuaguagagaugggguuucuccauguuggucaggcuggucucgagcuccccaccucaggugauccgcccaccucggccucccaaagugcugggauuacaggcaugagccaccgcgcccagccuucuaacaugaaucucuuuauggccauguuuuuacagauccccagccaugccuugggcagguaaggaaagaaugcuagcugaaacgauggggagaauuaugucuggcaguauggaauugggcaaaaaugaauuggaugcagguuucccgcagaacaaucgugagacuguuauggaauaagccuuuguucuuugcaaucagaguccugguuuuacaccacccagauugucucauuaggaugucuuuuuuucaggacaucuguggucacuugugugaaugugacacuguagggucaaguggagggcucaaugaagagagaaguuaaaguuccccacagcccuagaaugggacaguuugcuguugauuauguaguuaacugcuggugaucugugcugcuggugauccuggacuugaguuggucacaguccccaccuuugcaauuuucaucuuauccaugcaccaccuuuauuaguauuauuauuauguuuacuuuaaacagacuauuuauuuaaccuucuccuaaguaauauuagccuugaaauaaugaguuuaaaauacuaauuccauuuuccuucagugcauauuaaaauaaauaccuaacuaccauaauaaaaaaagugugugucaccuaaaaucuggcaggguauguccuauacuuugggcaacaccaugcucucuaauugcucuacacucacuuuccugccaggguacuagguaaugaguacacauacaggauggggcagagauaggagaugggaagugaggcaucucugacccagaguucugggugugcuuaagaaaaaaaaaaaagaaucucauagcagagauccuguggugguaucuaauugugguuuuauuuugcauuucucugaugacuaauaacauugaauacuuuuuaauguguuuauuggcuaucuguagaucuucuuuugugaagcagcuuucaaaucuuuugccuauuuuuuauuagauuuuaaaaaauuauuuuguuguugaguuauaggaguucuuuaaccuacuuaucaguccuuugucagauauaugugucgugaauaccuucugacaauuuauggcuuaccuauuuguuuucuuaauggugucuuuugauaaccaaaaguuuugaugaagucuaauuuaucacuuuuuucuguuguaguuacugcuuucuauguucuaaguaacuuugcuuaccaccaaguuaugaagacauucuacucaguuuccuucuaaaaagcuuaaugacauuagcguuugcauuuaguccuguaaucuaucuugaauuaguuuuuguauguggugugagaugggggucaaaguagauuuuuuuccguauggcuauucauuuauuccagugcaucauuucuugaaaaguuuuuuagauuguuuuguugccuuugugaaaaaucacauaaccauuuaaguguaggucuauuucuggacucuauuguacuuugauuuguuugucugucuucacaccaauaucgcacugucuuuauuaguagcuuuauaaaguaaguuuugaagucaaguaguguaaguccuccaacuuuguucuuuuccaguauugcuuugaauauucuugauccuuuguaguuccauauaaauuuuagaagcagcuuuucaauuucuacaaaaaaaauaaauccugggauuaugauugggauuacauugaaucuauacuauagcucaaucgagggaaaacugacucuuaacaauauugaguuuuccaaucuaugaacuuagcacaucucuucacuuauguauuuuuaaguuuuuaguauagaggucuuguacauauguuguuaaauuuauuucuaaguauuuuauguauuuugaugcuaucauaaaugauauuuuuaauuuguugcuaauauauuaacauaauuaguuuauguauauucaucuuguaucuugcaaccuugcuaaaccuucuuauuaguccuagugguuguuuuauagacuccuuaggauuuccuacauaaaaaaucaugucagcuaagaauaaagauaguuuuacuucuuuguuucuacucuuuauaccuuuuucuaaccuuuauguucuuuuucuuaacuuauuacacuggcuacaacuuccaguaaaauguugaguagaaguggugagaguggacauccuugccucguucugaucauggugacaaaucauuucauauuucucuaguaaguaugguguuagcuguggguuuuuccauacacauccuuuacuguguugaggaaauuccuccuguuccuaguguggugaaugguuuuaucaggagugguuguuaaauuuugucaagugcuuuuucugcauccacugaaaugauuuuauaguuuuucuucuucauuccguuaguguggggaauuauacugauugauuuuuuugaauauuaaacauaaaaagcuauaaauuucccucuaaacauuaccucagccucacccaauauauuuuuuaacaugguuuuaacauguucauguagauuuuuauuuuccaggaauggauuauuuggcccauggaucaaucaguugguagaauacagauuguagauaguauaaaugaaugguuacacccaaauguuggcaauuugagacaauuugugaaacagcaggaauggcaaagucuuuguuucaucagcaacuuccuaauggaauuuguugacggaagugauuugauuuuuauccauuuagugaugcuuauaucauggcaaaguccaagccauucacauuucccuucagguguguucuaauucaugaucuuaaaucaugauaggcuauuuccuuaaagugaugucauuguuuccaccugggcagaggaagaugaugaguguuggcgauggcagaggaaggggauggacacaaguccaggaauaaggaaggcaaaugucagccagcacugucagccaccucccuugugugcgggcacugggcuagaucaccugcauguguuaggugugaguccacagcacugaggagauggaggucuguaggaaguaaaucaucugcugcaggugacaugaguaggggcagaaacgaggcuggagccaggucugcuagcccucaaagcugguggacuuuucccaggcaguaucuaccuuuuuuuaucaugcaacaugaggauaucuacauuuuggagugagugugagcuuugaggauaaaguuguaacagaaguuuccaggauaauccauuaauugauaccaccuaucuuauugauuuaauaauugagccacuguuauacuuggccaguugaauaucaagcuuggcauuccauuagauaggaaaccugguuuuggaauaaaucaauaaucccaggaauucuuaacaggaaacaugguuaccaaauguaaaugaaacacuagaguuauuuauaggaguauuguauuagauaguucucuaagugggcugcaaagcagcucugugaagugaguccuauuuucucagugacuugcauauucuaagauuaagugauguauucccaaggaacaaguccuuuguaaacagugguuaacuuuuguaaggaaggaauauagaagauucuggacagugucacggaauaaaacuauuaagagcacagauucuagcaccauacuacuugaauccuggcuccaucacuugcuuguuuugggaucuuaagcuggugacuuacccacuuuuuaccucagcuucuuaucuguaaaauaaggauaauaauauuguauguacuuaugacagucauuguaaggauuaaugaauuaguauguaaaguacuuaacacaaagccuguugcauagucaacucucaauaaauauuaacuguuauuauugcuaugguuacugauauuuguauugcuuuaauuaugacauuuauuucuuaauuuuuggcagaauuuccuugcuuguuuuagcuugccguaagauuagguauuucccucucucuccuugugucugagguaggguucuuucagaguuuugcuguuugucacagugucuaacuacucuguguucagcuggccucccuaggguugcucuuaagaaucaauaucucuuauuaacaaauacgaugcucccagccacuccuuuccugggagcaucuccacguucaaagccagguugcacagugccuggacagcagcaggauguguguugguucccuccugggaugccgccuuccccagggcaugguaagugugcugagcagucugugcgucagugagacccucccgagcucagugagacccucccaaguuggugcuucacugagacccacccagccauuuuugccugaucaagugacagaaugguucaaaacugaauuauaaaagacuuauuuaccuggaugauaauacaaaagaaaggagcccaauuguuacacuuccccauuagguacuuuugucugcugcgugacgggcuucccuagaagaguuguucaaacugaaguugugaaguuguagguuauaaggcagauuugauucacuguuuacuaauucugugugacuugauauaagguuggugcucaaaaaguugaaggaauuuuaacuaguugaaggaacuaguuaaaauuaauuaaagugaggauaggcacccuuccuucauucaguuauccccuuguuuaaucauuuauugauugguucauuuguaugcucacucaucuggucaccugaacauuauuggaccccuccucugggccauguaggcccuguguggagcucagggacucagauguaucugggaagaccccugcccagucuacugaggagacaaacacagaagcccccuuuucagugccucugagcagugcagagauggagggagggaaagagggugccaaguugagccuaaugaggggaagagcaaggcuggacuccugcugcgggggugcccuugaggaagagucccagggugaugagggugaggguguguucccucccacaauuaaugccaucacagugagaucugccuaauaauaggaucuccagaccccagcaaauugucugcugaucucaggcaauguuugucuguaagaauccuucgcccuguguaaacauuuuauuagaccauuaaguugccgucagccucucccacauuuacuaaugccugagcaggcugagcauaggcuuccauuuuuaugaaaacucuugcuuuuccagaggcuuauucuuugaccuaauuuaucuugaauccucaucccacagaucuggcuugcuuugugugacugggauaguugucugaaagggagggcuuuccuggagcugagagaugggcuagauaacuucaggaggcccuggccugcuaaggaauucuuuagugcauuacaauuauaugccuuuaaaaaacuauucuuguaaagaauuauugacaguacagcauuuugggaguggggugugccaaguguagcaacccauuuggaacaugucuguguccuccuuuuucaaguuaaaauaacgacucuuuaaguauuuuacaaugcaauguaauguugauuucagaaucugcuaagauguaggggauaaaugcaguccacaaaucaugcugguauuucauuuuauauccuauguucuuguaagggacauggaacugagaaugaugguggguguguggagcaggauugugugaggcacaaucuggaacaccuuucugggaagagacuguccagagagcuuagauccaucugcccugggcaaaaucugguaauauuuauaaacaacccuguguuagaauucuccuaggccuccaggaagaggcaggagcuccucuuugugcuuggcuugcuuggaggcauuugaccaaucauuaaccucccaaaauuacccuuguuuuuaucaggcgcguuuugaacuugaaucuaggcauuagaggaagggguguugggaaagguuccaucucugcugugggauuaacuuggcuuggagcaagccagucacuucugucugugugagcacagaacacaaaucuguuuugaaaacuggaccuaccugaaggaaagaugaugagaauaggacauauaaacagcuguauaaaacacagcugcuggcaguaguuucucuuaguggccauggaucugugugaagaggugaaaaccuuuugauaugagagaaagaggguagauauaauaaucaccuuuaugauuugcuuauuaacguugguugcucaacauauuauuucgauccucauagugaccuguaagguaggugggcuccucucugucuaacagaugaggaugcugagacacagacagugcagagcuggguuggggacuucacuuuacuucugcugcccugccgacuucucacggcuggcccggagacagaauaagcccagguguagaagggagcagcuggaguuguaggaagagcaguggguggacagccaggaguccgcaccaaacacaggcucacucuccagacccagacuggcccgugcagcacuucugccugcagcugagggggccccuuaagagcccuaguucaagaaaauugcaucuuuggauaucagagugaagaagaguacuucuacugcuauaauucagggcuucuugcuuaauucugaaccaucuaaccuagcucaauuugaguaagagucuuauaaaacaguauuuaaagauggccagcccucccuuccugcuccccucucucccucuauuucccuucuuccuucucucucuuccucccuccaucucucucuuucccuccccccucccuccauuuucuucccuccaucuuccugacuccuugcuuucaauugucuggcuucaguuucccuuggcucugugagagcaggucucuggaguguguugcccaucuuguggcuccccuaggagguuauguuaacugugaacuaugaagaggagccacauuguuuguuuuuuaacacccacucgauuauaaauugccagggaggcuuggacucuugggucgcuaaggugaggauccaauuuugagaucugcaaaauugggucaaaaucucauugcaucuuuaagccuuuccccucucccacagacacauugcauacacacacacacacacacacacacacacacacacacacgcuuaacaagauaaggauaacguaaacuagaccuuucuuuugacuuaauguuuuuguuccauguuggcauucaaagcaggaacacagggugcuaucugacaaagcuuuucuucuuugcuguucagaauuuccauuuggaguuuacuaagccaggacugauaauggguagacagcucaguaaaauucuagaugagaagaucucuguuaauaaucacggaccccugagaauuucugaaagguucuagagagaguuucgacauucaucuggcugccaaaugaacuucuggucugacuucagggcuuauugucuguggcacccccagauuucaguucugacagggggugcuaggcuguugguagcaucagaauuaccugggaagguugccuaccugccuguuucuuuuuuuccuuugguaaaugccagauuucuuguccccacuguugggaaauuuucugucccgggagucuggaucaguacugcuacggaaacuacaggaaguuggauuuuggcucaauccagauaaggaagugauuuaaaauggagcagcccacauaguguggggcugccucaaguuuccagcacaggcuggucucugccucuaaguggcggaugguuggacgggaagccucuuugguccuguuagcacacuaagaguuuuuuguugcggauuucacucuaacaggcacccaaguuacuugaccucuauugaccugcgcuucuuuuucucccuucuguccgugaugucauagauauuggaugaugacuguaaguuaggcucaggaaaaaugaccaaauuguucugcuuuuauggggcucauagucuagagggagagacuugaaacuguagacaaacucuaucuagugagugcuggagggagucacaccuucaaccugaagaauguucagguguaguguuagugcccaaggcaaucuguugccagaauugaccuugaaaauuccuugggaaggggcuguguugaagaugaaugccuugcuccucagugagcuccacauagggccaguguuuccucuggcauugaguggauugcuaugucugagguggggccuagcugaagcaguugguugauguuuaggagcuauguuuuaugaaaaaucucuaucagauguuagagucacagcucacccagugagauggccacauugggaggggccugugagaacugcgacaauucaggggucacuuuggcacaucggcuuauuaaauggaguuuugggcaaaagcuccugcacuacuucucacugaaugcuuaccuuugaauucccaugaauuaaaccauacguugugaauucacagucuuauaggagcauagaugagagagaacaacugauucuauguggggagggaggaaagacuucucaaagaaaugacauuugagugaguucuugaaggauaaguucagaguagaauuugaucagaucaggggaaaggagaacauucuaggccagcguuucccaaagcauacuuuguagaacauguguuccauggcauguuaauguggggaaagaagagaacccauuaguugagagaugcugguuaaacucaguucagcaauugcucucaccccuuaaagaacuucucagagccuuucauccuuaauacacuucgguguaucgugaaucuuaaagagugagguacaguguuuguacuaggugagacuuuucuuggaaaccugguuuaggcaagguagacagcuccugcagaggcaugaagcuuugaaagaccauggcuaauucaggaaaugguggguuugugugucugaguagagggggaguguaggaggggaagacagugaagagauguggggaacuuggaugguaugggccagcuucugggagaacuccuuugggugcuagguaaggcuaggcgccagucuuacucaaacuacagucauuuuagaaccaucuucacaucucucuuacaggcucaaugccauauauauucugauuuaauauauuuuuauaauccaauuuuuaaauuguagauaaucauaaggaaauuuugcaucacuaaggcaagugaaaaaccaguagccuuugcaaaaguagaauaaacacacguauguacacaaguacacauauauacacgcacacaugcugaaaaccaaacaguugucaaauucuagcuacaaacuaugaacuugagcuaugauucgcuuuuguuauaaagggagauuuggguauuuuagagagguaauaaguagauuauguccccaguugagacuugcucaucguucaaucaaagaaauggacagauaaccaaaauguuaauaauuuucuuacaauauaaugccagaucugugugccaucaaaaauaucucccacuuugggaaacuuugcucugggcaguggggaaccacugaaggcuuguaaacaggagcaccuuucuuugcuuuagaaagccaguuuguguacuuuuauggaugguggugguuccgaauggguaagacuggaggcaggaaauccauuguuuaagaaaaaaagaagcccaggggagaaaugcagaggucugggcuuuggggcuaugcccauagaaugguaggagaaacuguuucguuauuuaguagagagaauggcaggacugggggacaaacagagaagggggucccagaaaugacuuggcuuggucuccuggagaggucauagcagcucagacugagguugguaguuggcagagaggcagauugaguaguuggcagagaggcacgcugacuugaggcuucugcaggaagucaguauguagguguccaggggaguaagggauuauguguauguaacuccagaucucugguggguggaaagagaacugauuuuagagccagguaaaucugugcaugacccauggcuucaccccucacaucuaggaucuugguuuccuuuuucgacggugaaaaauuguaaaccccaaccuuaaggaugauugggaagguuacuagugguagagugcuugggauaacuguggcacagggcagagcccagagucagcaauguuuauuuuaaguuccuucuagcuucccaauuacaucucugaauuuuuuggagaaagcuagccucagauucagccaauuccuacggauuuccccuggaaugaaagaagccuugauucacacgugucaugacauugagcauucuuguguuuggugggaauuuugguauagaaaaugcugauugcugaccuuuuaucuucugcagaagagcuccuucugucaggguucagagacuuaggcaucaggccagcugggcaucacuggcauuuuuuccugcccauuucugucugcuuucuaggcagcagaaaugaaaauguccugccaaucuguuagacugacuucgccaacugccaaauggccuugaaaggaguagugggaaagccagagcuugguggucagacauccucugucgcuuacuggcuguuuaagccuggacaguggcauguccuuaagucucuauguugucauuugcaaaacaggguuaauaauauccauuuugcagaguguuuuggaggacuagagaucauagagagcugucuuagcccaagguauacuauaugcuuaaaauaugggugcuauugcccuuaguuguuguguguuaaccuccucucaccucuacagaaauguaggaaggcuauuuauuauuauuuuauuuauuuuagagacagggucuugcucuguuguccaggcuggaguguaguggcaugaucacagcuccuugaagccuugaacuccuggguucaaggaauccucccaacucagccucuugaguggcugggacuacaggugugagccacaccaccaagcucuaggaaggcuguuaugaauaugagguaucuagagauaacauacuguuacuugacaauacaacauguaaaaauuuagacugaccaaaagagaaauacauauacuucuuuuuuuuuuuucuggagacagagucuugcucugugaucucaguacaguggugugaucucggcucacugcaaccucugccucccugguucaagugauucccaugccucagccccccaaguagcugggacuacaggugcaugccacugugcccagcuaauuuuuguauuuuuuguagagacuggguuucaccauauugccuaggauggucucaaacuccugaguucaggcaauuugccugccucagccucccaacaugcuaggauuacaggcgugagccaccacaccuggcaagaaauacauauacuucuuuucuuuuucuuuucuuuuuuuuuuuuuuuuuuuuuuuuuuuuugagacagagucuugcuguguugcacaggcuggagugcaguggcaugaucuuggcucacuguaagcuccgccucccggguucaugccauucuccugccucagccuccucaguggcugggacuacaggugcccgccaccaagcccgacuacuuuuuuuuguauuuuuaguagagacaagguuucaccauguuagccaggauagucucgaucuccugaccucaugaucugccugccucggccucccaaagugcuggcauuacaggcgugagccacugcgcccagccagaaauacauacacuucuuaacacucacagaauguuggugugaaaugggaguuuggaaacgucuaugauuucuuuggaggcugugggagccccugggaggcuggggagcugccccagcucauaucuggacaggggcugacccucaucagagguguuccugccacuaccuuuaguaccagagugaacuucauguguugcuccuuagagaccagccaccaugcuucugcuggccuguaagccucugggccucugcuucacagaagugcucuggucuggaagggccccagagggcucuuguuggacucagagcccugcuuuugaucuucaccucaggaaggcugcugguaccucucccugauauugagugcauaaaguaauggagugagggccacccaggaaaaggauuuaaaaccgaaugagcagucacauccuaagaacauuuguuaaaagcccuaugucgacauggagaagaucugguuuagaaacagggcuuuugcuuuggccuucuguucaauguuuuuaaaaauggcauucgagaggaguaaaagcauguuuggagguauaguuucuacccucuuugagacagcagaaucaaaauucagauagucucugugggcuuggacagugagccaaagccaacaugaugaaaugaagcaagcauaaacaggacgaguguugcgaguucaagccggccaccagccuccccaggcagugaugggcuggcgcugccacaucagccagcuccuuccagggcugccuuccugggagcauggcagccacaucccggggagcagcaguccucugcuagcacacaucugcagcgccagcuuccauccuuggucucauguuuuaauagcaaaucugacaaauucucauugacccucaguggggguuggcugcccaccacaccuucugcauugccucaugggugguauuucucccaaggaaagccuuggcuagggugagugggagggagagcaaggacgcuagguccgagaccuggguuguggcaguugcugcauuacuuauaggcuguguggccugggcaaaccuuucgucuuccggaucuuaggcuccucaccuggaacaugggauugaugauaccccugguuggugauaccaggugaagggucuggggagccuuagcugugacgggaagaaagugcuuggcauguccuuggcauguaguuggcguaguagaaaaugcagucuagcugauuuggaggguguggguaagcugcuuaaucucuaugagccuguuuucuugucuguaccugaagaauugacacuucagauaccuggcccagugccauucaagacaugguagaggucacaggcauguagguccugaacgauccagaggaagaaggggcucuguagcccaggaacugccuuacacagugccagggcccuuggggaugcugagcuccugcuugugggggagucaggugaagcugggcaggacccagcaggguugaggucaugucucacggggagugccgggccacgugagggaagaccaguggacaggcacauuaaguuuuaaacucacauacuuacuuuaauguacguuagaaaaaaaucaaauaaguaguacaucaaaucuguacuuuuuauggaaguuuuugcuuucuuuuugguuuuauaguuuuaguauuuaaaaaaagucaauuuaaaggaaaauauuaaguaaguaauaaaccaggcaagacucuccaagaaugucaaagucacaaaagaacuaaccucccugccccaaccucagccaaguaaagagcaggugaugcuucuagauuaaaggaaacuaaagacaacaaaucuggaagauauaaagaacaccucugaaagacauaauggggacaauugggagaaauuugaauauaggcaauagauuaaguaauauuaugguauaagucaguguuaaauuucuuggguaggggaaucuccuaauucuuagaagacagaugguaagggcuccagugucauuguaacuguaaccugcuuuaaaaugguuugggaauccuuuuuauauaucagcauuauauauauucacauauauguauauggaaagagaacgagaacaugcaggaaugcacacaaauguagcauacugcuaacagcuggcagcagugaggcgagggcugugcuguguucaguauucuguucuuucagcuaauuuuguaaugguggcccaggaaugaugaacauuugagaaccauugugcugugggacuuuccuucagguccuuuugaaguccuugcugacuuuucauuucuggaacauaucuuuaauuuuguauuauaauuugauaagaaaaauuuuugaccuaagaaaaaucauucagugacacauacuaauauaauguaacuugguuagaaaauaugauaugagaucaaaaaauucaguuuucuuaguuauauaaaaugagguggcuaaauugaaauuuuugucucaaugaggcagaaaucauugaguaaccauuuguggccaccaguuaagauauguauucaauagaaaaugaccuaguacaggcccagaggccaucaguuaacacuagaauauuaaugauguaugauaggauuauagaauuaccugggaucucuucauuucccggagggaaacuggaaauuaucuugcucugugccaccugaaagcuauaaggaaggcucuuugaagaugguggugggcagcacuuacagcugcgaucugguguuccucugggugcacugauaccagugaaugauuuuccugaggaggaggagguaacagcaaaaucauguaacaucagaaaccuuuguugaagauggaugugggaaaguugagguggcuggugaggaguugaauuagaagacauaguauuucauuauugugguuguaauaauguuggugagauuauacaccaauauccagcccugaaguguagucucuucaccuccuugccuuucugccauguuaauaguaccuggaccacacauuugggaucucaauuauauuauggcucucagcaacccuaauugguucauggauauaugucuuauuugaaggugauugcaugcacuugaauguuagggggugaagcuccuuuugugucucucugccugcauuuaagaugagauugagcacacagaggcaacauggccuucccugggggaaggaaccugggucugaauucagaggacuuggguuaggauccuggcuccacucccuagugucuaugugacuuuggauaaaaugaugaugauuaugacggugauggcagaaguuaacuacuucauaggauccugucugugaaguaaggguagucauagugcaccuuggacagcguugauggaucagaugagaugaugcacaugaguagucaguucacuggcauggaacaugcuauaaagcuauuaaaauaaugaugcuugaguugaacugcauuguuaaaacaugggcuaauacacuguauuagucuauaaucugugguuauaaaggacaaaaauccaccccaaacugauucuuaaaaccaggaaguuugugaggacuagcuuuaagcacagcuggauccagggccucaaauaauguuguuaggacacugccccauuuuccagauugcuuaccucaugcuggcuuaauucuuaggccacccggcuccugugagauugcagagcugccauccauucugcuugcuuucugccaaguuugccccucucacagaaagagauauuuccuaguucagcaaaaagcacaggagagacugaguggccagcucuaggucccacgccuaucccuggagcugggaccagaguuccuacugucuaaacauuagggacugagaaggggagagaggcgauccuaaagggaaagagacccugugccaguggagugcuaggucuccauaacaauggggaugcauaguucuugcauggguuuccaaaucucucagaggaggagaauuucucauacaucacacagcccagcagauccaccagucuucauuucaaaccaagcauucugcuauuuuucuugcucaggaaacuguugauaaaaacugucccauuuaguugaaacacugcaaaaguuauacagaaaaauaaacaaauugagacucgggccaguugugggauggaggaacaucaaagcuuggccagucaccaagcucauuuuccacugcggggugguuucauguccacuaaccagucugcagaucuggagcugcaguuuaggcuugauugguuguagaagccgaaacuagcucaagguggcucuaguaaaaggauuuguugggagcagcagagcugugccugggcugggcaugcuaagcccaaguuggagcagguggcucuccauaccagacagccacagugaugucccugcuaggccuuccaccugccucagccacguuaccugcccacccaccugccccucugccccucgaccagcccacucacgccuguacuguccucugauggcuggccguacauggggucucugucacacccuuagccucagugcccagcucacuggcccuguuucccagugaauugcuugcaagagccucaggggagcccuguuggcccugcucacagaggucacaugacauuggucaguuucugacuagagcacucuugggacagaucuccgugugguccccauaguugugacugauugaaggcagugggcuauagguaggacagaauacuuugggaagggaugcaggcagggacagucuuuguucccuggcuuuggcagugauccugaaaacuuuucagauacuugaccucauagauggagacucuggcugccugggcuggacacguacauauguagcucaaguauucauauguuaguauuauaguagauaauaauuuuuauuauaaguauuuauauuuaucaugaaguacauuuucuuaucccaauuuuggaaaauaacauagaaagaagaaaauaaaaguuacccuuuaaucucaccucuguagaugcuagugaugagagcugauagcuuuugcuuugugugucaccauucuaagggccuucuaugcauacuuguugauccuuacagcaauagggcgagauaggauggagaguaauguaauccucaucccucacugugggacagagguaaggucuguggugguagugguggggagggaugaagggacaccuagccuacauggggcugccauaaagcccugguucagugucacccaaggguccaccaugugcucacugguggacaucccagggugaaaugggguuggguaguagugguguccuguucauucaccuuaggcugccauagcagaaccaaagacaggaaagacaggauccugccucccucaaucucccagcagaagggcuuaaggacccgugacccuuuaauguguucacgugcaccuuggccauugguuuggcucucaggacccuaggccuagacccucugggccugcucccuuccccagggccugccugaacauguucaaauuaauuugacauguuugaauuaaaggaauacacgagcaccuggggcauagcaccagcccccccuggucccccacugcccauguauauaacuugccuuggcuguggucuucuuuuccacacuugcugugauuauuguccuggggacaguccucaggggaaaccucagcaucauggggaguagggaggugugagucaugagaaagagucaaauauuaauuagggaacaucuucuauauuucaggguuugugccuggaacuaugcgaacauuuuuccacuuggcugcacaacucuuucagguacauuucaucauccuagcuuuauagaagaggaaacaggcucaggggguuaagggguuugcucaaggccacacagcaggucaguggagaguguguguuggaauccaaguaaauggguaaagaccaagagaccacaguggauacauguuucuuuucuugguuuuucaaguccccuuuuaaggggcuuuuuaacuagcagugagaguacacagaggugcucuccaaaggguuauacucuuugugauuuaaguaagugaagugaauaaggggaaaaaugaaagaaaaaagagacaaaccacaacaaguuucauguauaggccucuucaguuggcucuggccccuucacagacauagacuguaagaacuacuccggaaacagcugguaacaggacaccguacuuucagccuuucuuucuucauuguugccagaaaauaaucagcucuauaucuuaagugcuugauagaguggccagacaccagcuguaacuuaaaacaauuuuugucuuaguugcuuuaagcaaacagaugcggcuagcuuucugggccaagcgcaguguccaugucuuagaguggacuacucaagcugcucaaccgucuugauuuauguuuaauucuugcuuuagauguguccauucagacauuccuuugguauguuuccagaggcuuggguuugggguuugaaggagugauuccggacuggccguugguuugcuuguucauuguuucggcacuuaagugugcugcgugugucaggagcagggacucagcccuccuggagcugacgggcuaguaaagaagcuggacaagcaagugaauaagaacagagccuccccuaccccaaaggcaaccauuugcaacucuuagcuuauuauuuuuauauaaucuuuacaccauguuuauugugcuacuuuuuguuuggcuuuagacauuaucuguagacuuccugcuaaggaacauaagaauucuucucuuucuuauguccuccuucaguuaggcauucccucagaacuuucagcacaugguggggcacugugcucuguacauaauguccagcgccugccgucaggaagcucacggugcaguggggagauggaccuuggaagagaccacgagaggaggcuaugccgaggccugagcagaggaguggacguucugugcuggaugccucugcucggacuuugccucccucuauggcugagcggacucauucaggcagugugcuuuggugcagugguaccauuuccccagugcuauccuggccccagccaccucaucucccauuggagugauggcagcaacugcccucuggccucccuguugccauucuguccuuugauauacauuguccacacagcacagagugaccuuuugaaacauccaucaggguuauaucacucccccacuugaaaaacugcccuuggccuucuguuaacaguaaaauacaauccugacuccauacugcagccuucaaggcuccuggugacccagcccacuccugucacccccauuuggcuugcugucugcagccacuugggucuuccuucucccccucagaccugcuccucacuugggccuucuccuugcuguuuccccaucccuuuuaucuuccaagggaaccuucuugacuacccuuuuuagaauaauauccucaucaccucccaccacuuuaucccauaauccuguuuuauuuucugugcagcuuuuaucucucuguacaagcuaugcagaaaauauuuauucauuauuuguaucucacacuagaauguaaacuccaugaggacagggaccuuauuuguuuuguuaaauggcugcauucccuuagcauagugcuuggcauguaauagacacuagaaaaaaaaaaaagaaaaaaacucuuggcuaaaugaauaucgaaagagugcccaucuagugugucccugggacccagugcuacccuacuguuugaagucauuagugaaaaaaauuaucccuuuuauacuuagagcuguguccaaggaauacaguauuguuccuaaauaucaugcaugagcagaaagaaugaauagcaguaauaaaaaugguaaacucuuugcauuugcgguggcagcucuguucucugcacuuuaauacaguaacagauauuucugaccacaacuccaugugguagcacuacaaaucuaguccuaguuauaggauuacaacuccuggagaugagggaacugaaggacagagagagugaguaacuuaacaaagucauuagcuuuauaagugguggagcagagacuugaacccagucauucuggcuccagagucugugcucccaagcaaaggugccugaguuccuuucaggaaauaucuuuggaguuaaaugaauugaacacuuugcuucucuagagguggaaccaggaauaaucucaauuacucccacucuugagugcuccgucaugguguuuauguggcuguucauuguggacagugccaucacugauaccaaagccccagcacacguagagaccauaaggugucuuuacugucaaaugauggggcuucacagagagagucacaggaaacaagagacaacaacaacauacucucagaggugcggcuggccugcuuccccccauucccuggugaaguauggcuauggaugcuacccgccaugcagucugaggauuccuccacaugcaagaagccuccugugccagucccauagagauguuaugcccuucugcuccccacuucuaacucacuguucuaaggcccugacuaugugccugccugagggaaccaguacagaaugaugccagccugucccugaaugugugcugucagaucaggcgagaaagggccaaccucccgggaguauccugcaacagacccggcuucaagccuguguuuccucuucagugcuguaugugcauugcugccaguucuuaugcuaucccuguggcugggcggugggacagaugaguagccccagauggcacagcuggcagugccaggguucaaguccaagucuuuuugauauggagucuacaacacaacucuguuuauauuucucuguucaccaaagugaauucucguuacucucaguacauuugguuuccaucaguguuuugagugcugaaaauaacaugauagugcaugucccucacaggagaacuucagaaacaucacaggugugccacacuugcaccuugcaauuuaccauguuuuuucagacuuccaguuaacauggugggccaugcugcugcuggaagccuugugucccaaacacauugaaaugcuggauaaagugaggaaacacuaagagaagaaaaaauaugcagccagguggagaagcaagaaaggagcaucuucaagagcuagacuagaaaaggaggucaaauucucagcagggaauaugaauggaagccaguuaguuccagggguauacagauuggagaugugagguucaccugguaaauuaagaaaaaagacaagaaguugccuguaacugguggagauuaaauugcuugcuuugcgaggugagcugagaaaguuuccuucacccaggagaggacagaauuccugagauugcauggauucagaugcaggccucauaucuucaucacuggugcuaauggaaauccucagccaagaaauuaacauagaaacuggugacuccuuauggcccugggcugccguagccccugaucucccuaugggggugccuuuacaguugcacacaugugcaagcccccacagaaaacaacguuugcugaagaggaguuuacagacaaaauuacauggcauacaggaaaaauuaccaccaugagaaagagaaucuauggauucucaagugggaaaacucagauccuggaaacuagaaaccauaaaacaaucugaaagagaauuuaaaauaagaauauuugaaauguaaauaaaggaauagaaauuauagcaagauuaggacauuaugaaaaaaggguagauaaauuugaaaacaaaccaaaaagaaauucuaaguauuaaaaauguauuaaaaaugcagucauugccaugugcuuucagauuaauuaucuuauuaaugcuucauggaaguuaggguagguaguuuuauucuucguguguuuuuucaaaguuuuuuuuuuuuuuuuuuuuuuuuuugagacagaaucucacucugucacccaggcuggagugcaguggcacgaucucagcucacugcaaccucccccuccgggguucaagcgauucucaugccccagccuccccaguagcugggauuacaggugcacaccacuccagccagcuaauuuuuguauauuaguagagaugggguuucgccauguuggccaggcuggccucgaacuccugaccucagaugaucugccugccucggcuucccaaagggcugggauuacagaugugagccacugcgcccagcuuaaaguauuuuuuuuuacuauagaaguacucauguauguugaaaaucuggaaaauagagcaaauuauaggaaagaaauaagaauaauuuguuaaccuguuacucggguuaacuauuuuggcauuuuuuuccuaguagggauucuacuggguauaaaauuuuagauccuuauuuaagcaaaguuuugaaccaugagccuucuucuauaccauaauuaaauuuucucugaaaacauguuuaauggcucuguauuauuuuauugucuugcucuaccauacuuuaucugucuacucuugaugaauguaugcacuguguacaauauuacgcacuuuaaccacaacauguugaacauuuguuugcauuucagauuauucuuuagagcagauuaccaaaaaugagauggcuugauuuauggguggggccuuauauucuguaaaggaaggaagggacaggaauauaugaacauuuuuuagcuguauuauauaucauaaagaauuugucuggucuuugucccagguuccuggagcuucuaaaacccuuggaauuuccagagugauaacugugucucuguuacucauggugggcccuuggggcacagcugaguuuaugcuaaggagaugacucaagauggggacuggucaugccugaaagaccaaccaugucauuagaggguuaggccuaugggccauaugauaucaggcugaccuccugaccucuggggagcuggaaauuuaguuuagucucauggcuaguaauucaaucagucauaccuauguaaugaaaccccaguaaaaacucuggacacugagguucagggagcuuccugauugguaaacacauugauaugcccagagggugauuuucccugacugcacagggagagggcaccaaagcucugaaucuagggcccucccaggcuucaccccaugugucucuucauuuggcugguccugauucuuacccuuauaauaaaacuguaauccuaagaauagugcuuucaugaauucugugaguuguucuaguuaauuaucuaaccugaggaggucaugggaacccccuggauuugcagccagcuggucagaaguguggguggccuagggaccccugaacugguagcugguagcugaagugaaagcagucuugcuggggacuguacccuuaagcuauggagucugaccauugacuuuaggugguuugugucacuauugaauuaugguauacaacuugugauacauauuuccaauuguguuauaaaguuuauguacaaaauuacaaaagaguguaccuuuaaguaacguugacaccacugggcuucaguauccuuauguaugaaaugggaaauuuagugacaacaacacagaaauguuguaugauugucuucguaaagugccuuggaccagcaccuggugcauaaaaagcagucauaggauguccaugagcaugugcccaugugcgugcauguugugugagcacugcaggaaaaccagaaaacaagcgaagaaaacaggaaaagaagaaaucauuugaaaugacaucaaagauauaaaaacgggauauuuuguauuuugaaaaccucauuguuuaaauagguuggcuuaucccuuuuacauuuauuauuauauauuuggucuuuugucaucauguuccauuuaaaaaaaaaacauuuucuauucuuuccugcucuuuuuguuauuuucuaugugaucuucuguuucucauucucuuuucauuugugcaggucuacaguuuuuuuguuuuuaccuuagagcuaaaaaugguucuacaaaggguuacuuuuaaaucuucaaugaaccugcuuaagccuggauuucccaagcuaucaccuugagaaaugaagcaccacucugugacaccucuccuccuguuuuugguaguucugcuucaggauuuuuuuuaguuggcguuagugaaauaauuuucauagaauguauuucuucuuucaagaaugauaguaaaugcaauugguguauaagaggcccaucauuuuaauggaagaauaaacgucacaguucuccagacuuaauucuguauucaaaugguuccuguggucacccuugggucuuuucaugcaugcauccuuauccccagguucucacuuaacauuuaucauguuccuauuagaucugccuucaaggagguuuuaugugaaaagugaaagguuucaaacauacucaggacaaagagaacaaacauucauguacccaucaggcagacugaacaguuacuaagauuucaccgugcuuguuucaucucucucuccccugcuuuucuugcugaaguauuuuuaaacaaauuuaugagaucuugagucauuuuaccccugaauacuuauguauauaucuuuaaaaaauauagacauuuucuugcguaaaucaaugucauuagcacagcuaauaauaacuauucuuugguauccaguacccuaucuauauuuagaauuuucuugaaaaauguucuucaaauaugguucccuaccuccucccuccacaaaaggauauaagaacauauacauccccaaguccuucaugucgaugaggagcccgaggcucagagagguagauuggcuuccucaggucagacccuaguauugggauuugaauccacaccccucuuagugagcuuuauauuuuauguacuacaccuggcugcccaggcaugguuaccccgaguagggcgaagcauguaaccucaaccucaaguuucgcccaagauguaggggcugaagcagacaggaagaugagcacugcuccaggaagccucccaccagugcagaagagcucuuuucuggaagacagggcuggaugccacagugaggcaaguccagccccagcccuaggucagugucuuuuuuugguuuugugucuauucuuaaggagguguaaagagcucuuuucuggaagacagggcuggaugccacagugaggcaaguccagccccagcccugggucagugucuuuuuuugguuuugugucuauucuuaaggaggugcuucugguacacaggcagugccaaggcccccuacaaugaagcuacauggcuacagggaguucugaagguuauagaagacuauacagccuuugggaucuuagcucugccaugcacucgcuguguguuuugagccugugacuugaccucucugacugaguuuccaccuuuggaagauggaauuagagugcuuacuuugcaggguuguugugaagauaaugugaaugcagauguaagcauccccagcaccgugccuggcacauaguagcuguuuauaaaugcaaauauaauguugucuuuaucugccagggaggaggacagagcaccagccaccucuccaucucuacugcacuguccccuggccccaagaccucuucugcauccccuuccucucuccucuggucuggaugguuaggcacccaggcuuuauggggcagggcauuggagcugagaggacaccagcucugagcaccugcagguuuuggagagaaggaaaggacacugccaagcacuugcucaguguccugucacuccucagguggucugguuucaugcugcuuuacagaccaaagugcugggcacagaggcagaugugucuuauugucuucucagaguguuaccaauuauuucuaguuucaguugaagagacucaguucauugaugcaagagauugacucucaggauaugccggagaacagagccccaauaagaaucggggcaggagcucaggggcuguggaaacacucguugccagcaagugugcugagaacacaaaggaaaugcuugugauccuuuuagagugacugggaguaaacauuuauuucaccuugaaggaaaugaauguuucaggaagaggcccaggagcuugacgaagcuagacagcccaugccguaagccacauaaaggaggacaucagaaccaauuggguuagagagggccuaauaaauugugucccucacaaggacccagcauuuucuguuccuugggugggccacaugugcucuugagaagauugggaacagcuguacugaguuguugccauugagucauaucugguccaggggccagcgguuggugccucuggucauuccguccuuuucuaacaaagcucgaggugaucuggccaucuccccaaagauccuggggaagugcaugcucagcauccuccgugcagcacuggcagcuggggcuuccguagcccccugcuguguccugugcccugaauggccccuucccuuagcuuuccggccugcucccucccuccaguugcuaaauuccccucuucuaugcuugcuuagcagaaacuucucauuuaacuuuuacauacuucacuguguugauguugucuguauguguguguguguuucccccagaagacucugaagcuucucgagggcagggacuggguuggauuaauuucugaaguucagaacccagccuagggacagccauacagaauguaacagaagcaaacuuuuauuucugugcccagauaugguggugcacagaggguuguguggugcacagaggguagcugguuuugcagguacaguaucaggcaucuugagaaauuaauaguggggaaggagagcccacuaaggugggaaugcuugccugggacaccagccuggccugccugucgccuccaccagggggccccccugccccggccccucucgggccauugcauccugucccucugguugcuugcuuggggcuugcaggacaugguggacucugcaggcugcuucacagugcaguguguuccugcugcuccuucugaaaugugaccuaccaugccuucuucagucccucugucuccauccagaaaaaugucuaauuguaucuugaauucauuuacauugcuugcuucaauggccucacuuggcagcugagcccauaugcuaauuccacccuuuucaugaaggaauucugcugauuuuacuuacuuuuugugacagauuccucccccuacccccccacuccguucuuuuuuuggucuccugcucucccaguaaacaauuucuuagguccacucucgcaggcucugugacccagugcccucaggacacuucauggggugaagcuccugauggguuugagucagggcccugagcacuggcccaagcccuuccagcaccuucagcuuaggguuagucaagaauguccugccuugguuucuuugcuucagaggaggggcucucuguggcuuggggacccauuucuacaagggucuaagacaacuguuguuuuuuggaacccauaguguaagaguuggugagagcggcauuaacucaggggccuugugaggacagacccugcuuccaugauaggggaggaggagucuggguccgggggugaauugagcccgagcucagucccagugcuugccuuugcugccaguggggccuuggaugagaguuccuugaccucucugagucuuacucucuuaaucuguaaagcggauaucugagggcccauccuccccucauucagauuacuggggucuucuccaaguggaugcaguccuugcagccccugaguccucucucuauuggcccugggccacuggaucuucacagcauuugauuuucucuuggcacagccgcuucaguuguucaacuuuucuccccuuuuuucuguuucuaaacaagcauacauaaccuuuuuaaguguuacuaggaugccaccacugaggacuagagaagaguugauuaauuguugcuggaggggguguucuaaguaauugaacaggcccggucaucucugaccucucagugcuuuucauucacuucauacauauuuguugagcaccuauucucugcugccaugugcaagggauucugugggauaagguggcccaggucccugucccagugggugaagcugcagaggagcuugggagucacaaacagcacuauccuagggcaacagggauuguggggcucugaggaggggcugucaccuccagaugagagggagccuggaaaauaccugggaggugacaucuagccaaaauuugaaggcuggguugccagagaaaggacaaggugggaagaaugcuccaggcacaugugcaugggccacgguccuggggugauagagagcauggcugagugaggagcugaagcauggaguaugaggagauggggguggugggugugaggcugucagguggugcagguaggggcccaaccacacuggccuucuuguuccuugcccagggaggagggucaggguuggggagucggucucugaccuugaccuccugugacccucacucucuucuccacagagggcaacauagcacuacuagauaccagguccgcggccugaguggggucugauccuguccuugcacuuaccugacaauuuggccuugggcaagcaggcaaugcaaacucucugugccuugaugugaucaucugcaaaauggggguguugguaauaguaccuguauccuaggacugaguucaaugagcugauguaugcaaugcacuuagaacggagccuaguuauagugaacacuacauuaaaugucaccuauaaaaacagugcucauuucuuguggaaagggcuugguaagaauaacuucugucccagaggaaauuccagccuggugucucugagguuuuccugcuucaugauccagggaaauaauugucuuagguuauuccugggcuuucuaccuccuggggcuauauugagacucaguaugaaaaccuauguuugaaauucuagggaaaauccccacuagagagaaaauaaugucagagacuguuuggagcuuucacaugcauuaacuccuucaguccuccuaacagucuaugaaguaggcccuguuuuuacacagcauauguauacuguggcuaugauacuagguguggggccucgguccagaguguuggggagcgaguguuuggcagccucugcacggccuuuucaucagcuuuggaagaagccaaggcuagagagcgaagugcucuccccacguggccccacuggaggggcaagggcugagugagauucgucugcucucauuuggaccccagagagcccauuguccuuuccuccaggaugacccuccuggcauccaccuuccccacccccaccaugggcaaaacaugucucaugggagaaagaaggagugggcugucaaaucugcccuaccccaggcauagcggacugauuccugagugcuuuucugacuccaauaguuacaggccuaaaaggcuagauguuuauucuguuucuucgaacuuuccuuucuagcgaaaacuccagaguucucacacuagggagcuacaggccagucuuggcccauggacauguuuuguuugggccaugcuguuuaaacauuuuuuucaauugguugucaacauuuaaacauuggcgaauuucauauaauauuccagauuuuuggcaucucuuaaaaaaucagaggaucuggcaacuugaggccuacauuccugucuggccaugguguacuggagcugaggagaaacgguccccuccaaauggggugcgggaguuucuguucccuuuggucucacaccuugacuuaugccuagcccauguugcucaugugaggugcccaccagcccuggaggguuuccuuuccuuuccuuuuccuuuccuuuuccuuucauucucuuucuuuuauuuuuucuuucuuuaucucucuuuuucuuuucuuuucuuuuuucuuuuccuuucuuuccuuuccuuuucuuucucgcccgcuuucugucauucuuucguuuuuucauucauucauucuuucucucccucccucccucccuuccuuccuuuucuuuauuuucuuucgagacaagaucgugcucuguggcccaggcuggaauacaguggcacgaucauagcucacugcaaccuugaacuccugggcugaagccauccucuccuucaaccuucagaguagccaggacuacaggcaugugccacugcaccuggcuaauuuuuguuuuuuaaauuuguuuauaaaguuggaggucucacuauguugcccagacuggucucaaacucuuggccucaagccauccucccuccucagccucccaaauugcugagauuacaggugugagccacuguacuuggccacuggaggcuuuuauauuugggacaacugcucuccacuuucuuuacuuuaggacaggccuuugugaaugauagcauuuguuagggagaaugggaacucaggcucaagagcacucauaaugaucacuuucaugaugaagcaccugcugucuuccagacccaagugagguugguuagcaaguauccaugagccucacacugcucuguuuauaguauaugauccccauuuuacagguaggagagacugaggcucaaauagguaagggccuuuagacaggucucgcuuagcaugcagauugggaaaguugaaguagaauccagaauguucccucaaagucugucugucuccccacacaccuugcccucacucucaagguggcccaugcaucaguaggcaugcccugaaaucuagagauggaggacuccaggaaguuuccuucacaguuucccuuggagaucacugggugcucuccaagagaaauccucuuuggugaccuucagguagguggccgguggaacuaauuuauguugccucagaucaggcagagccagcauuggcuccuggcuccaccacauucuagcuauaggacugcacugucccccuacuccucuccuccccuccauccccucucuccugucuucccucgccuccucccccucacucauuuuagugagcccucauuguggacugggcucugugucuaacuuuccaagccucagauuucucauaccuggauggguuguugcuuggcacuguggccagcccaaucgagaccuugauaauugguagccauuguuaugaaugaugaggcuuuccacucauuuucacaauggaaaucacauugacaggaccccagaguuacagaauuuuugugaaaaauauugacuuuaaaaaauagccuuuucccuaaggcaccuugugggaagagcugagaugacacugaauugcacagaucuuuguaacucuggcucucccgucucauggaucagguaccuucuuuguucuaagcagucugcuaggcacaucacauaccuuucuaaaagguuaguaaugguuucaucuccauaugauagaugaagaaacaggccuggaaagcccaggcauuuugugaaagaucauacugcugguauguggagcaggggcuccaacucaggcuggcccuccccagggauugugcccugagcccuuuccuguggggccugauucccaacccugccccaggauccaagguggacucaguguccaugucauguaacaaaagagucagggguucucggugcccuguuagggccuguuguuccugguugguuggcaagucugaguguuuauucagcacugcugggaaggcucccuggcuuaauucugagauuccaagccauccugucguaucucccccgacucccccagcugagagaacugggagagacacgaggacacacagggcaggggcucuucccugggugagguuuguguuuggauuucaggcgucgcugauggugaagugugcuuaggguuuucuuuguaauucacauuccugugucuaccucuuacuguuuuguccaaaaauucuuguauccauauuuggugauuugucucucuguucccacccccacccccaagccccucaaggugucugccaaaauccuguauaacucguaucaucucccaagcuguuauaguauaugagggcaaaggauaauuuaguuauuuuugaauaaagauucggaggaaaaguaaaaaaguugggcaggggguggggggaaguuuucauacucacugcaugaaauagacaauauuuccugaaacaggagauacgaaccucaaagaauuuaaaauaaaacauucauuuuauuauuuuuuuaaagaaggaaaacgaggggaaaaaaguagaauagucagucuuuuuauccuaaguacagaugaaauugauuaaaccuuaaagacuggccuccgcacacccgguuuauuaauugaagaauuuccucuuacccggaaugggaaguucacauuaaaaucgagcuugcccugagugguagugacacuugagaacugaacauuuuccacaauccuauuuucucuucagugcuagaggaaauccuaaaaugguuaaaauggggggaaggggacugaggcgggagagaacagaaacuguacauuuuaaggaagccuaaagcaugaaaucaaauuauagcuuaugggccacaauuauuuuauuucuacauuucaaauuccauuuucugcucuuuuucacugcucuugaacgggaguuguacuguugugcaaagucagcuaaaaagauuacccuagauagacuaugacacgguagcuuaaagaagcaaaaaggcaaaacucccugguuagguugggagcccuguggcccuacagagcccucaugucugcuuccaucuggaaaggcgacauaagcagccaucaccccccggacuccuuggcccugacaggagcuuggaaaccuccacucuucgugugucuuccuguaugaggcugacucugccucuuguccucccagugaucagugucuacuucauugccucccuaggggugggccgcuccuggcugacgauaagcugaugccuggcgcaucauuaaugcucuggcuuagcaggacugaaggucaugcauuuuccaguuuucuuccagucccuggauuuagugccagcacaccuuuccccuaccucucacugaccccuuuucggcagagugaguuccaggcucagugcuucagcaggccauguuauccaguuaacaucuaauaauguuuuauuuaucuuuacaguuaauuucuccuuaacgcaaauuuaagaguguuguacuuauggucauguaaaguuguuuuuaauauaagugcauuugaauuuuaaaaaaugauaugauuuaaacauacaugugaguaaauaauaguagagguaguauccaugggucuggcagaaaucaugaagguggcucauggauggagaacccuggcuuaauucauacuucuucccugauguggaucagcuguuuugaaaacuucuagccaaagagcucuuuaaucaugucuccaguuauccauccacaucuuuaccagcccuugcucucaggaaguucucuuacagaucuaccugagcucccucaugcuucuguugaagaucacuuuauuuuguauuuucauuagauagggaacauccuacauuagauaggucccuaccucugaccuugagcaucuccuuaacuuccucuucccucagccucauggugggcaugcaggcucuuagacucuggcagacaggcgauauugcuuaguaucaugguacaaguucuccuguugaguuggagguuuggguucuaauccaguccuccaguuuguuagcugugugacugagggcaagucacuucagauccuucaaaucucuucaagucucagcuucugcaccugugugugugaauaauaauaaauguuuccuuccugggcuauuaagauuaauugaaauaaugugccuggugcauucuuaagcaugcaauauguguucauucucuuucuuccuuuccccgauucccugaccuguagucaucuuuuuauuuauuuauuuauuuauuuauuuauuuaauuuauuuauuuugagacagagucuugcucugucgcccaggcuggagugcaguggugugaucuuggcucacugcaaccucugccucccggguucaagcaauucucgugccucagccuccugaguagcugggauuacaggcacacaccaccaugccuggcuaauuauuguauuuuuaguagagauggcauuucaucauguuggccaggcugguguugaacuccugaccucaagugacccucccaccucggccucccaaaauguugggauuacaggcaugagccaccgcucccagcccauuuuuuucauuuuuaagcuuuuuauuucaaagucauuucaaacuuagagaaaggcucuaagaauaguacauaggacucccguaugcccaucacccuugagucaucuuugugaccauccuugcauacgacagcaugguuuggguacagccagacagagacuuaggaguugcucucuagcaaggcugacuguggugcgaggacauuuccauggauuccuccacuggucuugcagaaggcugaaaccucauuaacagaaaaucuuuaugaccacuaagcagacauaacugggugucuucucucugcuacccucccacccugccuuagguggauugucuaacuuguagaucaaagcuagccucuugacaaguuuccuaauaggacagguacauaccuagaguugugucugagaugacuugaugugugcacagauaugguguuaagggacgucgaucccagugagaaaguuauucccauuucaagauucuuuaaguccuucugaugacuuuaaggagaucucagguuggugcugggagcucuuauacuucucuuaacauuguaagcucagugccuguuacuguaaccaugucuggcuagaacuuaauaacaguguuuuacuuuuauuguacuucuuuuuuuaaacuuuucacuuaugguaaauuaugcugguuuuccagugauaugaagcuuuacuuuuacuuacuuacuuauuuauuuuauuuuauuuuuuugaggcagggucucauucuguugcccagguuggagugcaguggcgugaucuuggcucacugcaaccucugccuccuugguucaagugauucuccugccucagccucccauaugucugggaccacaggugcacaccaccacacccagcuaauuuuuguauuuuuuuuuuguagagauggggucucuccauguugcccaggcuggucuugaacuccugggcucaagcaauccccccaccucggccucccaaagugcugggauuauaggccugagccaccgcgcccagccugaagcuuuacuuuuaaaaauaaauugcucuugagucaguaacguauguauguacauaguucaaaaucuuaaagguacaaaaagguacacaguaaaaaguaaaucuuccuuuucccccugcuuaccuaguuuacuuccuggaagcaaauugcuauaaccauuuucuucuaaagauuccaaagacacuucaugauuuuuaagcauguucuuucucccacggauccucuagaaguggcaauauacugugcacacagugaacacaccagcuccgcuagagcucuauucagugaauaguuaccgugguguuuuuaaauagcugggucauguucuguuuuauguacaugucaugguuuaguuaacuacuucccuuccaacaggcagucaggcugguucugaccuuuugcucuuccagacacguagcaaugaguguccacauaugugccccaugugcacgugggucacugcuaguccccagggguguuugacggccauuugccguugugcugcuccuacccccaaccccaccccagugacaggcaggacuaucugucuccccuguguggaugggcaaagguuuguuuguuuguuuguuuguuuguuuguuuguuuguuuucagacggagucucacuuuuucgcccaggcuggaguucaguggcgcaaucucgccuuacugcaaccuccgccucccggguucaaguguuucuccugucucaggcucccgaguagcugggauuacgcagcaacaccaggcacgcaacaccccauccggcuaauuuuguauuuuuaguagaaaugggguuucaccacaucggccaggcuggccucaaacuccugacuucaaguaaucugccugccuuggccucccaaauuguugggauuauaggcgugagccacugugcccagccaagaguguuaccaaauguuugaggugacucggccuccuguauaaaacuuggguucuggagccacauagccugacuuugaauucuagcucccuaucuuucuaguucugcgacccgugacuuaauuuccucaucuguaaauggcggggggcggggguggcggugacacagagugucagcaggcucccagaaugucagggcuaggcaggccgaacacucaacauguuagcucuuuguauuaucaucaguauuauuuugucaguacaguaggugaaaaacagaauuucaguguacagugguuuuaauuugcauuuuuuuguuacuaguaaggugugaugucuuaucauguuugagcuauuuuuauuucuuuaugccccugcuuauuucucugacuucaucuccuuccucuuccucaaacgcauguggaggcuuugcacuuguuccucccucuguugccuaccaacuccuucuccgcugagucugugcccagauagcuccuucucaaugaggccucuccugacagccugauuuaaaauugcaggccaccugcuucgcagacagcucggagccuacuucuccugcucuuucuccccaggaugcuuagccucucugacccuacugugaaauucacuuacuguguuuuaauguuugcuuuugcucuacccuacuggacugugaguucucgauugcaagggguagggacuguugucugucuggccucucaagugugccagccaccaacucuacgucuggcaugagggaguguucaguaaacgugcugcgugugaacuagcuguugauaccauuuacauuuuugauuggacugucgcucuuuuuaaaaaauccauuucuauauuuccaauuugaaauauuaaggaaaacaguccuuuguauguaguaugcauuuuaagcuucucucccuugucacuggacuuuaucguauuuuccuauacagagauauuugguuauuauauuguugaauuugucaguguuuccuuuuuauuuucuucuguguuuauucuguggguuuuguaucuuaccuagguauuuuuuuacuuuuaagauuauaaaaaauuuuuuucucacccuuucuuucaguacuuuuuugguuuucuguuuuuauguuugaaaccuugauccauuuggaauuuauucugaugucauguguaugguagacauccaauuuuauuuuuaucuagauggcuacccauugucccuuuaucacaauuaugugauugucccuguuuccagauguggaccuuggggucagagagggaaagauccuuacccaagauugugcagccagcaaauggacuugcauccugcccugcuccccucucccagcucugcggguguuuugccaugagucucuagcauuucuuguuuuuuuggcuuucuuuccuuuuggcggggguccaacaccucuauuugucugcuaucuuguccagggccauuuauuuuuugccuugaugucuuacauggaccuucuuuguuguuccuccuguuccuccacugcugacaugcucucauuguucacccuggccuuucuucagguggugaugaaugucuccuuuggcucccuccugcaggacugugccucagguugugcacuuuguucuccuuccucucuauccucagggccuugcccaccugcucuuugggaugccuuaggguucccagagcacucaggaaugcaugauucuggccaagaggcagcugauaauagaaaaagcagaaauuuugaagucagacagcccuugguacuagcgcugccucugcuguugacuguugggcaauuagaccucagauuucucuuuauggaaaugggaggucuccucuuccaggggauaguggugaggauuagaacuaaugcagaagucacaagcucaggugccuguugggagccaggcuaguaguacaaaugcuggggugugaggcaauagggaauugcaggaaccaggguaaaguugggaaugcaugccuguucuccaggagacagcugcuccucagccacaucagacaaaggcccagucuaaccacaugugcuaauucauggagauuuuuaugugacauuucucaaguuguaaauguuggcaguguaugcauauucuaacagguacugcacaggcuagacaaugcccauuccagauccucaggcaucuuuaaguugucaguuugcaaccagugaugugaaguccuuggcuccaauucagcucucaauccacaguggcuguuauucgggguuuuuugggguuuucuuugagcuugcucugucgcccaggccagagugcaguggcauagucucggcucacugcagccuccaccuccuggguucaaguaauucucgugucucagccuccaugcauaccaccaugcccggcuaauuuuuuguauuuuaguagagacgggguuucaucauguuagcccaagcuguucucaaaguccugagcucaggcaaucugcccacuucagccucccaaaguguguaauggcuguuauuugaauuguggcugcugcuuuuggguuucuugucagucaggcagcacccugcagugucccugcuggacgcugggucaacucuguucccacuaguuacuuccgguucuuggaguucuuaaacuucuucugguccacgugguauggcauauccuuuaccuggagaccaagaagccaggguuugacucuuaaugcaucaugggaccaggacagcaaugucuaguucugccgggucagcuucuccugcucaggggucucccugcaagucuggugagauuuggccaggauguuuguggaggagccugccuuugcagggcaguucaaacaaaaaggauguccugcccagugguggauacagugauccaggcuguuggcuggcacuuaccaagaaaccccgugaggggccagcuccuggguccacaggaguugggggaggcacuguuuguauucgcuccaugcugccguuaauacucuuccucuuccuccucuggagggcacaaggccuuuggguauaugugaguccuaaaggaaggaggaggccaguucuugagcucuuacugugcuggcauagugauacuugcagcagcuugcauuuagugagucuggggcauguggcaggugcugggugaggugcccuccuccaacuuacuguguugucucuggcaucagcaucuuccaaggaggaaucccaggcuccaggaggucaagagguguacuugccugaggcugugcagcuggcagagcgagaugcuuacccucugcccccgccugccucagaacuugaggugggcuuccaagcugccaccccguuccuccugcccacaggcagcaccccucucuaugaauuccuugaucacaugccucagaucaaaacaugcccucccucugggcugucuccucuacaggaaccugaguuuccaacuagagugguagacaccacugucaguagaaaacagaaaugcaauuauuguuucuguuuuacagauguggagauggagcacagagagggugaauagcuuuauaaaacuccccuccaucugaaacuguucaugaaaauggugauaacaaggaccagggucccuggagccuucuccugugacuggggccuccuuuggccaccugguccccacuggagggucugggccuggccaggagccucuagccuguuaaacuccuagcaccuccugcagucgauggaguaaccuggugguuguuagcagcaugggcagcaugaauguuuggcuucagugagagggcuaagcagaaaggcugagagagagugcaugaguguggcaugcugcccugugcccaggugggugcuaggucacaggcacugugcagggccuggucgugaccgcccuccuucucuccuccccuuuccccuuccccaacuccaucagcaggcuuuguccacuuguguuugccuggggucugccuggacuaguggggacagcaggccuuguuacaguucgaccaagagugauggggcccagguucagugcucacagcuguuaguaccagcuccugcuuacugagggugcuuagggcugagucucuccuaaucuucugcaggagacaucuuuguuuagguccugauuguggaugaggaaauugaagcuccugguaagguugugauuugaacauauccaagcuuggggaccuccaagcccugcucuugccacuuccucuuauuugugguccuuguuuccuuggucuuuaaaaugacccucuuguuuaagccccuuccauuuccaaauccucugagccugugcugaggaggacaggcuggacacugcugguuagucccacaccuuccugguaccaguaggaauuugagagggaaaguccaggcuuacccuguuucaggaaaacugcagaaggaggaaaacuaauucuccuuaaaacugauuuucuccuugcucucucugcagaaugggcugcaaugugacugaagucuugcugccuucccauccccugcccuuggcagagagucaggguugggacagcugcaaccuguguuggauggagccugaucaguccuggguucuugccccuaguuggguggcuuugggcaaguuauuuaaccugucucagccucagucuucuuaccuguauaaugaggagauaggcaauacauugaauaaaugaauaaaaacagcugcaaauaauaauauaaggcucucgcccuggagucugagaagcuguguucugaguuggggaccucugaaaccugcccguuuuguccuggaacacccgcagggggcuuguacagagcaauuguuuuauucuggacauaagaucuugcugcucagaguuucaggguacuguuguagagcaaaaucaguagacugaguucaaaucccucugaauccuugcuccuugaccugacuugguuacuucaccucucuaagccuuuguccucucucucucucucuuuuuuuuuuuuuuuuuuuuuuugagacagggucucacucugucacccaggcuggaguacagugguguaaucaggccuugaccugcagccuugaccucucugggcuuaggugauuauccuaccuuagccucccaaguaggugggauuacaggcaugcaccacuaugccuagcuaauuuuuguauuuuguauagagacaggguuucaccauguugccccaugcuggucucaaacuccugagcucaagugauucacacaccucagccucccaaagugcugggauuacaaacgugugccaccacgcugaaccaauuuuuguauuuuuguagagacgggguuucacuauguugccuaggcuggucuugaacuccugagcucaagugaucugcccacuuuagccucccaaagugcugggguuacagacccagccuguuuucccauuuguaauacccacauugcagaguugguguugagauguagguaagaggagaugaagacauguagaccaccacugugcaugucauaauagcagauguagaagugaaaaccgugguaacagcuaauauaauugaggauuucauaugucuaggcacuguucuaaauuguuuacauaucugaucucauugaaucuucagugcaauccaauaacauaggcaguaucaucguccuuguauaagaugaggagccugaggcacagagagaguuaauguauuuggcaaauggucauaauaauaguaggauauuaauugccacugcaguuuuauauuguugauaaaauguauuuacauuguucaaugaauauuuaaaaagucaccagucaaaaacaaauuuuggccaggcacaguggcucacgcccguaauccuaguagcacuuugggagcugaggugggaggaucuauugaggccaggaguucgagaccagccugggcaacauagcaagacuccaccucuacaaaaaaauuuuaaaaauaagcuggguaugguggcaugcaccuguagucccagcuacuugggaggcuaggacaggaggaucguuugagcccaggaauucaaggcugcagugagcuaugauugcaccacugcacuccagccugggcaacaguaagacccugccucuaaaauuaaaaaaauaaauaaauaaauaacaaauaauggcacacauuuaccuacauaacaaaccuggucauccugcacauguaccccugaacuuaaaauauaaguuggaaauaaauuuuuuuuucuuuauuuuaaauguaacauuuuuucuccuucuuauaaugcccauagcuuugacuuuuuuaaaaaaaaaucugauuuugagguugcuaaaauauguucaaaguauaauguuaaguuucuccagcugaaauauuuuuuucugaacauauuuuauuccuucagucccaaaaggaaaauuacaccucacagauaacuuaugcuuuguuaaaugcugacccuuguaaguuuuucauuauuuuugaaaugauuaagauauauaauuuacagaauuggaaauuguaauuuuuaaauguacugagaaacuuuaacccuauuauaauuauucugcaaaucuuuuaaggauacuauagucaguacaacuagaugaaaaacucugauagauugggaaauauagaggaucauuuauaagccuugauuuuuuugucuuguguuucccacccacucacucgcuaugucccucuagucucagagcgauuuucuacccuggguucaugggaauugggaaggacacuguuugauucauucuaugaaacuacuagggauuuugaaaaaggcaagacgggccaguugugucacuuccugucgucugaucaaaaguuugaugaagaaaagaaaguaacugagagcugcugccaggcagcaggcaguugccuggugaugaccccggguuuccagugcuagucugguucccaguguggccagucaagucccucugaccucugggcuccuuagaagucccuggugcuggcugcgcugcacgggguccgcucaagagccuggccuuuuggaacaaagacggcuuuuggaugcuggaucaggcugcagaugaaaucccaacuggcuccugaguguuuggguccuaucuaugcuuaguuuucugggucugucaaucaguuucauuucccauccacaggaucucaauaggcgugagaagcaagagggccugaugcguggagcacaugagucauuccccuacuggauaguugacuggauaguuguguauaccaauaggaaaucgacuguugaagaagaggaacagauuccuggugaauaaaguagaagaggcagggauauggacauuugcugcauuaguccagcaacgauguauuaagcugugcccaagcugggucuugugcugugaauacagauugaaaacccaggccuugguuaugaacccucagcauggagccggguggggcaucaaggaucaggggcaagugaaccuggggcagguguucugggcaaagcaggagcaggggcaaaggcaaggaagggaaaggggcgagaguccaccuggguccuaccuugaucuuuagaugggaagugggagaguugauggggggagggggagaaauugugggcuggguccccacugggcagggcgggcuguguggcgugggaguuaagaaccugggcaccaggguucagaucucuucucugccaccuaccugcuguauaaccaugagcagucaacggacuucccuaaagccucgacuuccucaucuguaaauuaggggcuagguaguggcagguguuuaaguucuagagggaacuuggauagucagaauuacucuggagaaguccuuaaggaacgcaugagguugaguggccuugguucugugggcacagcuucacccaccggagagggaggccuguggggccagugcaggauccauucugcugugaagguggagacuggaaaauaggcugggcccccaacguguuccucccuccuuguucccugcugggcuuuaucucauccugccucaagacccagucucacagcccuguggccaguucccagauuuacugaugguuaggacccggaagacaguuggguguaucuucuggguagggaaggcuugggcucagcuugugugagggaggcaugagugucauggggccauggagagagggcgaaaagcccaggaaaggguuuguggagcacacagcauggugcuuggcacaaggugagugggaagcaacugguaguuaaaaaacagggagccucccacagccacauuggggagucuuuuuuuuuuuuuuuuccaguggacaguggggcucuuagcaugagaagggcauggucaggucuguguuuuauuguauuauuuauuuauuuaugcacuuaaaauuauaauuuuauuuuagaacagauacuacacaucccuguuuaaaaugaaaaggaaccgaagaauguacagagaauuuccuuccuacucaucuuuggucucccagcagacaaccaagucauuaguuucuuuugcauucccucagagauauuuuaugugugucgaagcaaauacuuaugcaguaugugacacccacacacgugcacacacauacacacacacguauaccuuauccccuuuucaacacaaaucacacucugcacauugugccuugcccuucucacucacuccgccucggauaucauuccauagugguagauaaagagcuucuucauucuuuuaaauggguguauaguauucugucauggcauuauagcauuauauucuuauuuucaaccuguccccugcugauggacauuuaccuaguuuccagcauuagcuguaacaaacaugcugcuuggcugggucaaagauuaugugccucugcagagguuauaccaguuaacccccgacccccgcuccugcccagcaguauaugaaucagugauauauuuuuagaaagugccuuugggaaggcuguuuggaggauggaguuuggagggccacaucugagcugcagcagcccauuagggacuagccaacaugagccugccaugggcuaugggaacuggagcuggaacagagaaagaguccagaggagaguugguaauucaguagcuaugagagggagucuaucagaugagucgagccuguuuuuaauagucuguucuguucacgguagaugauagagucaguguccauccccucuguggcuguagcagagaccugggcccuccugccccuugaccuggcagaggagaugcugcugcugcugcugcgugcaccugagccuagcccuguggccccagcuggcaggaugaggagaggaggcuggacagggagaagcagagugggagacaggaggguuggggcaugccuaggucuaccugaagucagagagacacaccguucugugggaggccagaggagugucacaggacaggggugaccaagaggccucuuggaacagugggaagaauucuucagcaguggugucaggagcccugauuucuagugucuucgauacuaguuggcugugugaucuagagcacaugaccuagacccaugucugugagucuccguuucuucaucugaaacauaaguuuacuggagauuaaguaagcugaccuagugugcguagucagagugcccgaaaaaagaaaggcccucccuccuccaugccuucccucuauccccagcagugggauagaaucagcaucaucagagucauucacagagcagucuccucugcauugccaaugaccauaauccgaucccgagaaaugcuucaugggcauucuuauaagcucaaaauguaauuauucuucauuuuaauagggaaaauguuuguauauuccugcaguacgaaguuacacgcuucuuguugaaaugacuccaaaucccguuaaaaaggaaacagucacuucacuggcuaacauuauguuccugacaugauuuauagcaguuucccuucauucacuuucuguaacuugucugucuaccugcuguuguucagcucaggugugcuguacaguaggaugaugcucacaagcgugcacgcacacacacacacacacacacgcacacaaauguucaguacuuagcgauuaugacacagaaccuuagaugcuccuaacaccccagaaggaauaggacugagccguagcacugugaggaaaagaugcuguccacucccuaauccucccccuucugccuccucuacuuucucagucuucucucauuucuuagcaagggcaaguaucuagccauuugccaagccuaguacgaaacuuuuuuuuuucccccugcugagacauuucuuccucugucaaauggaaugaaagugauaggauuggugcaauagaaaggcacggguuuuggaguuagaugagccuauaccuaaacccagcccuauugcguguuagcagugcgauccugggcaagcucucuguguuuuguggaccucaguuuccucaucugccauggcaguucugaagcuucagguccaagugccuagcacagggccuguagccagaagcuguguagucaccauuuauuccacuuugcucacuuuuacugcagugcuuugaccuggggcauugggcaacuuucuguggggcucaccaccccuuuucccuuucuaaccuucucuucucuuauuccaggggcccagaucauugaucugaugaugcuggucaucgaugugaccaaggggaugcagacccagucagcggaaugccuugugaucggccagauugccugccagaagcuggucguggugcugaacaaaauagaccucuuaccugaaggaaagagacaggcagcaauugauaaaaugaccaagaaaaugcagaagacccuagagaacaccaaguaggucugcuaaugagagcaauguucacugcauaagaaggcuucuggggccucccauguucauuucacaaacaugaauuggacaggcaggugucagccucccguccuaguaagugagaucucaaccuggcauuugcucacauaagggcugcauuaaaugagguaaaggcuaacguguuuuuaaaagaggccaaaaaccacaggagcauaaagaaacuagaauuugaugaggcacaagcccuucugugucucagcucacaggaaggagaaggagcacagggacucugugcccagugugcaaggccuggacuggcaaggguucagauccuuucuacuuagcuugucuugauaaaaacuuagucccgccuacauauauuggccauacuuuggugcaagagaggcuaggacuguguucucuugcuaucugcuucucuacaacucgauuaucaaaaggggaagaucaauuuugguagaugacugguuguuucuguuacagaagcuuguaagauuggguggacagaccgacagaugguuguugcugcuggaagccagacuaggaaacaccaaaucacaaaggaccuuuuuagcaucuucugccaaggaguuuacaguuuuaucuuguggaaaguaggaaguuauuaaggaauuuuaugcaagggguggcuagaugagguuuuucauuaggagaucacuggcugcagguggaaggcuggcauggugaggaggacccaggaggcagcagagaggagaaggaggagaaggagaaggagcagcagaggcuacugaacuguagugguuuuaccagggagagaagguguugcucugaguugaggcagagcauggagggaggagguggcuuggggagauaucuagcgggagaauccacagcccuggugaagcaauucgccuggaucacaguaaguguggaagaaagcuggcagugcuaccuagaagggcaggggugcgggaggcacagggggacugugagacagaaagccaccugguugcucaggcggccacaggaaugacuaauucugauguggucaagaaaaugagaaaauguccuuguugagcacaguguugacagaccucauuguuuuaucaauuucucucuuccucucuaggccagucccuuuugaucaauacuaaauagcggucacugggagacagggaugcuuccucuuugcuaugcagccugagacaauauccugccacuuccaccucuccuucuucugcccauggagggcaagcaaguagagagcguuuuuguuucccugucauaaagauugauaugccuucccauuuaugauguuuuuuucagauccaacaccugcagcucucccucagaauucucaaguugguuaaauuaaagcuccagcucugugaaugggccaaauaugucauaaaagauuuucuagcgcugccuuuuguuagcaaaauucaucaauccgauaaaaucgacacauuuagauaaguguugcauaagaauucagacuuuguuauucccagcggaaguggauaugagacuguaaaaaggaagauaaaaaauuauaucuucuuuuuagugaguuauuugaucucccugucguuuuauuuacuugucagaaaaggaagaacaggucuuuuggacucccgcaaaaaaacccaguacaaccucaguacucagauacaaccucaguaucauuuacuauagaaaugggaccuucagggaagggcuuaggguacguuuaaggguuaauuaauaguaauaguuuugauuaaauuuaaggaaaauucucauuugcuugugaaaauuacuauuucuauuuuaguguauugauugaagaucaaauuauggacuuuaucacacauccagaggaaauuguccaucugaggguccuuggaagccccuccugcccucauccagcaccagcaggcugguagggaaaggagaggacugucacccugagggguuguaaucagugggcaugugaccugcugaacauuagcuuuuaccuccaugaagcaaagaacuucuuuaaaugauuuuaagugacuauuucauuuucuuauguucccuuguuaaguaaacccuucauaaaugccaguccagaugcaaagaaacuuucugucuauaaagggaaaauguggacuggugaaccauguaccuaucaaaaccaaaaaaguguucaaaacauuaaauguauuuuuuucuguccaaagaguaacugaaagaaaacuuggaaaauagagaaaaguaguuaaaagaaagaagagcccacccaaagauuucuuuucucaaauggcagcugcuggcacuuuuggauuuuuucauuucuuuuuucuuuuuaacuauguguaguauugcccccacuuuuucuuccacauuuuuuuuauugugguaaaauacauauaacauaauguuuaucauuuuagccacauguaaguguauaauucagagcuaucaaguacauucacagugcuguguaccuguccccacuauauauaccccaaacuuuuucaugacccccaacauaaacucuguagccauuaagcaauaacuccccuuucucccuuccucccacccuggcaaccucuauucugcuucucaucucuaugaauuugccuguucuagauaccuuuuaucaguggaauaauauacuauuuggccuuuugugucuggauuauuucacuuagcauaauguuuuuaagguccauccuuauuguaacaugugucagaauuucacuccuuuuugugguugcauaguguuuuauuaugucuauauaccacauuuuauuuauccauucuucuguugguagacacuuggguugcuuccuggcuacugugaauaaugcugcuaugaacauggauguauagcuauuuauucaauuuucugcuuucaauuccucucaguacauccuaggagguaugaagugguauaucaucauaguuuucauuugcauuucccuaguuacuaaugauauugagcaucuuuucaugguuuaauggccauuuguguaucuuuuuuugagaaauaucuauucaaguccuuuguacauuuuuagguuggguuguuuucuguuguuguuguuguugaauuguaauaguuauuuauguauucuggacauuaaucccuugucagagauaugauuugcaaauaucuucuccuguuuuguagauugucuuuucacuucguugauaguguccuuugauacacaaaacuuccuaauuuggaugaagucuaguuuaucauuuuuuuuaauugccugugcuuuuggagucauauccaugaaacuguugccgaauccugugucaugaagauuuuuauccaguguuuuuuucuaagaauuuuguagcuuuagcucuuaaguuuaggucuuugaucauuuugaguuaauuuuuguauaugauguaaguuaaggguucaccuucauuauuuugcauguggauauccaguuuuccaggcacuuuuguugaaaagauugucuuuuccccuuuuaacuuuguaaaaaaucgauugaccauauauguguggguuuauuucuaggcuuucuguucuauuccauuggucuauaugucuguccuuaggcuagugccacacugcuuugaugucuguaguuuuguauuaaguuucaaagucagaaaguaugacucuucucucuuuguucuuuuucaagauuguuuuggcuaucuggugcuccuugcaguuccacaugaauuugagaaucugcuuuuccauuucuguggaaagguuguuggaauuuugauagguauugcauugaaucuguagaucucuuuggguaguauugacaucuuaacagcauuaaaucuucuaauccaugaaccauaggauauguuuuuguuuaagucaucuuuaguuuuuuuugguuuuuuuuuuuuuuuuuuagcaauguuuuguaguuuuuagcguacaaggcuuuugucucuucgauuuauuccuaaguauuggauucuuuuagaggccauuguaaaggaauuauuuucuuaauuuauuuuggauuguucauugcugguggauagaaacacaccugauuuuugaacuuguacccugcaacuuugcugaguccuccccccaucuuuucuuuacauauaguuguagucaugaggcauguacauuuuuauuucugcuuuuauuacuuaacauuuuacauaucauuugcucauguaaccaccacucuguugaccuacuagacuggcuuaaguuucuguucuuaaaaauaaagccuuaaggugaacaucucuguacaucauuaaacuguauuuucaccuuuuuccucaugauagauuugcagguaugagauuauuagaucaaggggucugaacauuucuaaacuuuuugcugugcauugccauauuauuuuccagaaguguucuaccauuuuacacaggugucagcagauuacuuugguuuauaauuuuaaacuauacuugaaacuuaguagaaaauaguguuuuaguagaaaugguaacuuaguagaaaugguauuuuguucuuguuuuaauuugugguucuuuauuuccugaaguguuuugaacaguugugcuuuuguaugugugaauuaugcccauguaaaaauuuugucuguuugccucuugcaauuuuaauuuuuuuuuaauuuuugggaguguuuaauauuaguaaagauauugcuguuaacccuucuaucauauuugcuacaaauaagucuuuggcauuuguugucuuuccauuuuaguugcuuuuuuugacaugcagaaguuucuaauuuuuauguagucaaacucuuuguucuucuuugugauuucuuuaucucugaaagcauuuaaaauuacucuugcauaagcauuuaucaauguuaacagaaaucaaaacagaagauaaaaauguacccacaaucuucucaaugcaucaaauuaaaguguuuuucccccaggaucccugucagucuuuccugcguguacauaauuugagguaguuguuaucacagcauugacacuguucuguguucuaggcuuuucuguuuauuuuuccacuaaauguuaucaucugacagcauccuugauacaucauucccccagacucccuuuguguuucuuccugcuuuuuaaacacuuucuauuuccuucugucuguuuuagccagagcccucugucuggagcccaccagggacuccauugauccugccucccucccugugaauggguugaaugccaaucucaaggaauuucucugcuacugaguggacuuugacuagguguauuuuccauacuagcuuuguggcugacuaacugugugugcuugggcgacucacuccaucucucugagcugcuauuucuuccuuuguaaaaggggagcugaaaaguucagucucauagcguuuaauaugagggagcauuucacguggagccuggcacaccauggauauguaggaauaauagcuguaacauguggagaaccugcuguguacuuggcacuguacuagggguuucgcaugcauaguucguggaaucagucggauccuuacaguuuccuaagagguagguuuugugucuggcuugacuauugagaaaagugaggcuuaauaaauguuggcuguuuugaaucuacuaucccaaagguaaaauuuauuuauacucuauuuguuuauauaucuuuauauggauuauaaauucauauauauauguauauacacacacauacacauauauauuuaucugaaacuuuuuuugugugcuaacgaacgucagcuugcauacacagucagcacgucuaggcccagcaagcaccgcaacauacuguagcugccagggaagucuggaggagacagugggauggcagggacagcaguccuugaaugagcucuuggucagcuccugcccgcacuacagagcugugcagcugccgucucuggcuggagccccuuguacuccuagaccccagacaccaauccaguggcugcuaaacucuacuccccagggcuccauggagcugggucucccuuguacagccagaagccagggugcccuaauguguagcauguucagcguguugggaaggcuagcuucucuugagucugggaaagggccagacaccuggcccaacacacuguuauguucuauuacuauauauugcccaaaaggguuuggauaaagauaguugaauuuccaaaagcuuuauagguaaucucuggaauuccccaugcacguuccuacaacucugugucccucugagccucaggcucagggcguggaagcagagccaguguacauggcuuggucuuggcuccgucagcucugcggauggagccuucgugcuaagaauagauuuuucuccuacccaucucuuucuccuaugggagaggccuggacucuggacuccugcagaccagccacuuacucccuggcucccugggcgagucauagcuucucugaauaugguaccugaaccccugcccauggacuauugagaugguauggacaccaccaagcuuggugccugguacagagcaggucgcagagaagucugaguucuuuuccugccuuucccauuuucucuccuguguuucuuuucuucuuuucugucucucuuccucaguguuauuuuuuccuuuuccucuuuccuucccucuccucacuguuccuuccuuugugaauuauuuuucccucccucguucccucuccaagcucucuuuuguccuucuggguauugccuuucucaaggcaaagaccuaagccccgcuacuucugugggggcagugugucaugucugagcuacucuagaacugauugacaggugggucuguggcccucuuuggaaucuccuuacugaacugaaaucaucgugucacacugaccuuuggagcaaugaguggccccugagauuguuuaaguugcucuuuagggaacuucagcuuccucagaguuacgucucuugucuuuaaaaaagaaaaaaaucugauuuucuucaaggguuugcucccaaccaggccagggcagugggaugagguuuuaaaggccaguugaauuaagcuccucccaacugaggagcuuccugugcaguuggacaggagagccugaguaccuggaugauggcgaaggugagcuagggaauuugcuuugugucggaguuaaaggccagagcugaaguggcuccucagaguagcaaggggauucugaggaaggcaaguuugcuucuggcuggggagucaggaaugaggacuaacucuagaagggcaugugaugacuaagcaggggugagguucaaaauauggagcacaggccaggaacuggccacugggaaggggugccaucaucuguggcuguugugcugguauagacgacuggugguugcagcaguucccagggcuccucgugaguuccacacggcacuuuuacacauguuaaccgauucagucugggagacaacccugugaucuaggucaugccaucucauguuggacagggaaaugggggcugagugaggugaaaucgcauaaaccagcuguggaauggaaauuaguccuagguuucuagcuggaauccugccucaggcugccauugccugggugagguuugccuaggagaggaggggaaggaggugagggcaacagugugagcuuggguuuuaaaaaugcagauacccagggcuuuugcugagaugaaucaguguggggagacuggagcagaucccagagggccuuguguaccacccugggccaggacuucaucccaggacagucacagaguccugagaguggggaggggagagggccagcaccucagaguggugcugcuggaagguucucacagcuguggucugugcaugcacuuuggagagcaguugggaggccuggggugagaagagccugacccagaguggaagccauuaagaaugaaaaucaggauggauuggagcaagauccuaagaggagaaccaauuggaugcagugacugaugagagacaucagugaccaugcagucagagaggacuaauucagaggccagggcaaugccaucccauaucagaggccaggaauuagaggccaggaggcagccugauggcagauggcaggguagaacuagagugcugggaauggggcuuggcuggggaugcgguuugggagcggcccacaagggggcuguggcccucauggucaguaugcaggggaagaguuggccucucuggccacucuuuggggaggccugcagugggcgcaugagugaugaagaagggccucucggggacgugaaggauagucaagggccauggaaauaaagguaugggguugucagggaggagggaaggaugccacugcuggacagucaccuggucagaugccacagaggaaagcgauugcaagggaagagcacugaguugaccacugggagcugcucuugaccuucaggaacuucuuucucugccaugcuuccccgaacccuggcccccguuccucuuagugucacauggaauuggcacccuggucuggugccccagccccucacccccauugcucuugggagcccuuuguguauucauugugcacguuccguggagacuggcgcagaggaaguacuuaguaaauguccugcacuuaaaagggaaggagacagaagugaccuuguaagaaaaucagccauaagcucugauggguaaacagaagugggauuuguuuugaaauaugagaagaaggagaaauuggauguugauugaaaguggcagggugggggugucaagcaagagggcuuuugucccaagaggagagaaaucuggggcuguaggagucucuggaugugaguccagggaagagcuuggaggggcuggggagcggggccggggcugggguaucagcauggguuccuggaaggcccccauagaccuggcagcaagcuugggcucuucccuucaggugccucuucuugggcuggauccuucgccuggcuucuguuuggggcuauagugggggaaugugaggggauggccuagggucugaggaagauggaggcaguauuauucagagugagggacgugcaccacaugucacacaagauccaucugggacugugcuuggauguggcaaaauugcaaugaaaguuaaccuucuucaguuaucuuuaaaucucuuuuauuaagucagaaaaaaugucucaaauugguacuguugugucuuaaagauuucccuaacuuuuuaaccaggcucagugccuucagcagguaauaguaucuagcuagaauuuaauagcucuauuuuguuuucuuuguguuuauuuuuguagcuacaguaguagaagauuucuuguccccugagauuggacugugguugguuaaucaaaaaagucccuugaagcagagaaucauaaaaaaugacacauucaugccuuaaacauaauauuuuaacuuaaaacauauacgugcauauuuauuuaauaaaaucaacaauaaaagcuguuacagaagaaauacaacauucgcagcaucaugccucccuuuccucaucagcaccaagacacuggcagccgggccaggcuggucuggggcuucuuggcugcauguggauuugaguucugaauucgggccugacuccacuucuucaggcugugcuuuugaagaauguuugguuuuugugucauuuauaauuucaguuuuccaugcaugaucacuuauaaucuauauguuaucuuuaauucauuuggucugaauacaguuaaguaagcuauauucuguauguucuucuuggucaguauguauguauguauuuuugagacagagucucacuuuguugcccagucuggaucucacuauaaccuugaacuccugggcucaagcaauccuucugcuucagccucuuaagaagcugggacuacaggcaugugcuaccacaucuggcuaauuuuuaacacuuguuuuauagauggguucucucuguguugcccaggcugguauagaacuccuggccucaagugauccuccugccucugccucccaaagugcugguauuacaggugugagccaccaugccuggcccagaauuuauguuuuugaaagcucuagaguuugcugauuuggcaauaaggaaaaguuguagcguguaggcuccaguugcaucacugugggcagcaacugugaucauucuggcuuuuucuauccaaguguggcauacuuuucuuugcauaugauuguuucucuuggucacaucuucuaaguuuuugcgguuuucucaguguuguggaggugcucucuaguaagauuucccagagaaagccucagugacugacuuuaauucuguugugaguauuugaacagcaguuucuuucucuuugcucagaugcucuccagaggggcuccacggcuuuguuccaccugccacuugcugggauauguucugcccagcucgucuuuucuuccaggaugagcccacuaacuagagcuccaagucaccuuucaucuauaaaccacucccgaaugcagugcacugcccacaauuucagugaagcaagucugaguacaggauuuuucuguuuucacacaaccucccugcaggucuuuuaugguuuucuuauccacaccuaguuuaacaccagauuuuaaggagauuugucuuuaucacaccuuuccagagcauucaauuuaguuuucauagaaacagcuauuuucacacuguuguuucauaauacuaaauuaaauuauguuguuacagugaagcuuauaacgggcauuaccaacuuuacagcauaaccagguucagcauaaaggucaggaggcaaaagugcaggaaguacucaccucuugagcguggccugugcgcgucaagcuguccccccccagcauggagguuuggcaugcuaggagccaggagcagguuuugcagagggagugcagagcguugccucauggauguccuuaaagugaccaguggugggagggcuucuacucuaccuuuuauuuguggaauguggugguuuuccauuuagauaguggcaugaaauugcguuuuaaaauaaauauauuuaaguaagaacauuaauucuuuuaaggaaaauaaaugagcaaauagcuuagauggcacacaaauuugacaaagcuugugaagaggaugugggacaauuggucuaugugcaggucaacccugagagaggaggaggaagggagggagcagagcgaccuugauguuuugucauccccucuuugugcccaggcuggcacugggcucaaucuucugcuuuuguguuuugaaagaccauugaugccaucuuccaggucagugucccuggggaguggaugcuggaggucauucuggggaucccagcaccgugggaaggacagggcucuggaauagggcuuuugggaccagagugcugagcucuggauuccuccuugcuucugcuauuugcuucaccugcgacccuuuagcaaucauuugaccucucugugccucaguuuccucaucucuaaaaugauaauauaauaccugacaucauugcugugaggauuaaauggagucaugugaaagcaucuagccaggugcugugugcauggugggugcuucaccaauauuuggagaaugaaugugugacucugaauaugggaaugaugacagaaguucuuccuaccuuagaggguuguuaagaauucaauaaauuuaugucugcaauuugaaagugauagcaaacugucauaguauuggguacuauaauuauagcuaucauaucguuuuuucguugguuugagaacuaaaauuacauauauuuaauguauguaauuaagggcaaggguuuuauuaaucuggcuacaggacuuaaauauauguucccugauccuugaagaucagcugcuuuccaaauucucauauggauuugagaagggacacaugccccugccuccaaccuaggcugauggaggauuguucucaugauagucucagguuuaaaguaaacucagaguuggcuuuaaaucacagccccaccacucauuagccuguggccuggaacaagcuaccaaagcuagccaaacuuuuaggacccucuucuaugaaauagggggaggaagaauaauacccaccuuucaggauugugaugagaagauggggauuggaaagcuucuagcacaauugcuuguaccauuggugcucgguaaaagguccugucucuuucugccacucccacuguguugcaugcuagacuauauacagagaagcacuuagagcaagccucagugucaggaagguaaggguggcucuuccuggcggaaacaaacuccagaacuagaagugcuacagaaaugucuccugaaaauacauuggguauacaaacaauuggaagugguucaauauuguauggcuuacuuauuaaggcaaugcaauacaaauuaaaaugaaguauauauuaaaaauaauuuuuaaaagacuauuuuguuaugugugcagugaaauaggcaucuuagauguccauugugguaguggaaaagguagcauaccuuucaaucuauuuucucuguaauugagauagaauucacauacuaugaaauucauacuuucaauguggaaagaauuguacagccaucaccacuaucuaauuccagaacauuuucauuaccccaacaggaaauuguauucauuaagcccuuugcuccucauucucugugcgccaccagccugggaacuacuaaucuccuuucuguuuuauggacuuaccuauucugguauuucauauaaauggaauugcacaauaugcaaccuuuugugucugacuucuuucaccuagcacaguguuuuugugguucauccacacugaaguauguauugaugcuucaugucuuuuuaugucaugucuuuuuaugucacaacagaauaauauucuguuguguauauauacacaacauaguuuguguauccauucaucuauugauagacauuugagauguuucuacuuuuuggcuauugugaauagugcuacucuggacauguauggauauguacuucuuugaguauuuguuuucuguucuuuuuggauauauaucuaggaguggaauagcuggaucauguggugaucccauguuucccuucauuuuuguaacauuuuuuacugcauauaaaauucuugguugguagauuuuuuuuauuuuuauuuuuaacuuucacuucuuugaauauauuauccugauaccuucuggccuccacgauuucuccugagaaaccagcugcaaaucuuauuauggauuccuuguacaugaguucagucgcuucuuucuugauggcuucaagauucucuuugucuuuggccuucaacaguuagauuguaaugugccaggugugggugucuuugaguuuauccuauuuagaguuuauugagauucuugaaaguguagauauuuuccaugaaauuugagaaguuuuuggcuauuaaauaucacagcuucccucaggcagcugugauguuaaacaauugccucugauuauuuucaacaaacucccccagggaaaaggcuauuugcacuaagcaagcuccaaggcaggucaaauaaauauagcauugugaguagggccuuccagggagccaccagacuggaaaaucaugaucguucucuggaagaagggcuuugaaggagcucaaacccauucugccccuuucagugccuggcaugcuacugguuuucaccaugauugguuuucaggacagcugcagaguuagcauaggaagagggcaaguuaaaacaucaaaagcucacuugguuuuacugagacucuucuugaauaaacacuccacagauugcucaagccuuugguuaauuuccagaguucugaacaaguugauucugaucauuuuugccaguguucuuuguuuccauggaagagggcuuuucagauguccuugcuguaucauuuugcugaucuauuagugaguauucacucuuagauguguaccccacgaauucaucccacagccaaggcaaaaaaaaaaaaaaaacauucaugcccgcugacauguuuaucacaguguaauuuauaauagugaaaaauuugaaauaucacaaauaaguaauggaggaaagcauguacaagcauguaaauucugggucguaccauuguccaggugucaacaaugaaagaacaggcccagguggagagaagugugacaaagagacugagagcccuggcuucagacucagaugggcuggguucaaauguggcucuaagguuuauagccaacaacuuggagcaaaucaguuagacucccuaagccucauuuucucaucuauaagauggcaacaacuccaucauguguuguagaugcuuucauuuaaaccucacauuauaggcuuggcucagccauguaaguuguuauuguuguugcugucauucaacagaaaguucuuugugauauaaugguaaauaaauuagcaggauaugaaaucguauacauacuauaaccaaaaucugaaaaaaagaaucccuuggcaaagcaugggaaaaccaugguuggaagaaaauacaccaaaugaugggauuauggguuauuuauuuucucuuucccucuuuuuuuuuuuuuuuuuuuugcccuaacaauguuccuuuuuuuaaaugggaaagauaaauguccacacagaauaaguaugucuucuuaaagaugcgggggcuuugcuaguagaguuuaggcaagaaugcucugcauuagaaacugagauuguagaggcgugcuuccagguacaucugcagauacuuuuuggucacuauuauuucuugcaucucuucagaaggcugagauguauuuauuggucuucuucaaggaggucuuuuauucagaagccuaggggccaggaucacugcugccuccuuagggagugcucugaaaguggagguuaauaucuaagagagcccuuuaaaauucugauguccaaugcagggacauuucccccagacggggaaauuuggggccuccauugcaucaugugccaugugcuaguacaguggugcugucuucuaggcuugguugauguggggagagaagaggaugcucacugcacuugguacugugccaggugcuucauggacgugcuuuguguccauguugcugaucucuguaacugugaugggacuuauuuuccauuucagguuccgaggugcaccgauuauacccguggcggccaagccggggggaccagaggcccccgaaacugaagcuccacagggcauuccagagcucauugagguacugucaucuugaauccagguugcccuuuagccccagcgcugcucaggccagccccuuugugucccucucuccccugagagagaaagagaggcagcccuagcaagaggacucaguugguuccauuaaccucccuguuaacaccuuagcacaacucccccaccucccucaaaaagguagacccaaacuaggacuccuaagguucacugaagcccaugauucacccuccagccauaaacucugcagagcucgucacaccuugcugugccucacuuucuccuuucucuugucauaccuacacucagacaaagcagcucccacccaucuggaacccugggaccgugacauccauuccaguccuucagacuguaucagcuccuccaguaccccaccugggcugggggccagugaggcaggggugaaagacaugagcccaacagcaggggcaaugcagcuuccauccugggcaccuccaccaaagaugggaggcuuaucuucggaagcuguggggcugaggcccagguuguucuuccuaacuugugcugguagucagggagggagcccagucauccaucaggaagggugugugugggugcugauggugcugguacuaaggaagguagcagugagaauggagccacagaguuccuccacagagugcucaggacaguucagccggguggaguagcaacgugcauggcucuggggcuggacugugguucaggggcuagcuccaccaccacucucucugaccucaggcaaaugaucuacucuuucuugccucaguuccuucacuuggaagauaauagcacauaccucguggaguugugaggguuaaaugaguuaauguguauaaugugcucgguacagugccaugucagugcuuacuguuacagugauguugauguuuacaggccaggcacuguacuaaguucuuuacauacaggaucauugacauucacaaaaacucagggaggcugaaauuauuuauccccauauaccaacgaagagucugagauucaaagauguuaaauaacuugacccaugucuggcagcgaguuacacgguggagcugggauucagacccagguugaucgcuggggucagcuucacggccccccugcaccuggcuccgcagagccaagaugagaugugaccacguacaugcacugccaccauuucugugauuuacacgugcugaucuugucagcuuagcaaaacaaauguuuucugggugaggcuuuuguuacuuuuucaucaggcuccugagagcacuugucugggagccugggauaguuguuuuuguuaaagcgaaauccucaaaaaugcugcuuugaaagauguuuguauauuccuuuaagaagccccuacauaaaucucagaccaagccuguuuuguuugaaucucuaguguuuuuccaaaagaauuguuaucacaagacuaagacuuuggaacauucaccacugaauacuuuuuugacagccuguucccuuacgaagugaaaaaguagcaaacacaaggaauccuagucuuuguuuucauuuguuuauuggugaugagcccugacagcaucucccggcacacagguggcaugaggagaaucggcuggugaggcugaggcguguggaguccgcagagaaggaaggacccugggaacaauccuuuccuccucccucuccccacauccccuuguuucuucuucuuucacuugucauucucucaggcaugaugccagcuacuggagauaccuggcucucacagcccuaugggggagauaauaaagagaugaucacaggagaguguuagcuauagugaugggggcaggggaaacguggccauacagagaagccuguccagaggagguauugcugcaguacaggcgaggcucagccagcugguaaaacucuaggccugcuggcggcuggcuucuggcauacgucagggaguggcggaagaugaggccuaaaagguaccuaggggcuagaugaugaggaguuuuaaauucugaaggcaucaggaggcuggggaaaugcaugaggccagggagcaaugcgacaggguguccuuuaguggcuacucuccugcagcauggagggccuggcaggacagaccauuguagcagucccacgggagaagacagacgaggcuucuccaggugcccuuuccuucagacugagcggaaagagcugagagcauggcagaagcuuggaaugcagucagggaguuaggugguuuugaucuccuguccaccuugccagggcauggaccucugagcugaguucaccuuggcagccuugaugaacugcuggucagccacauucucugccuuccucugcccugccccaucuggcuccucuccccacggacuguggcaccaguuucucuuuucuagcuccugacgucccagauuuccaucccaacgagagaucccucgggaccguuccucaugucuguggaccacuguuucuccaucaaaggccaaggcacugugaugacagggaccauccuuucaggcuccaucagccucggugacaguguggagaucccugcccucaaggucagucuuaccuugucuucccuucuggccuccucgcuggcagcaagggagggggacugucccuuugucuguucagcugcugagccugcugcugugccugcccugggacucccacugccugcuccgccccaccuccccucuggcugccuggccccgcccggcuccaagucuuucaacucagauucuaggacugcugcucucccuaauucucauagcgccuguuuauuggaggccuaugaugugccucaaggagguguucccaaguaggucuucuguguagauaaagaaacugaggcuccagaaggugaggugggcuugagaucacaugguuaacaaguggggcugcuggaggggaaaccucccuuucuggacgcuguacgucaggguggcaaguauguguggaguuauuucuggguaccuuuuucuuaaccacaguaauuucaaauuaaacaugacgugaaucuuaugaugcucagaaucacagaaucuggaagaaauccagguugguuuugcacuccugguggccaucgacagaugccgcauuauucuucugaagaccugugagaaggaugagugguuggugccuucccaucaccccuccuucuacuaugauggccuggcucugauuuaaaagauagugccuugauauuccccuuauuuagaaggcauuuuuaauaguuuuacuuuaugcgacaagagaaacuuacagccucauugacugcccuccccuucaacaagaauaaaagguagggaacacaugcuacuuagaauucaugugagaccuugccuggaaugcugggguccagggcaguucucuaauccuugaaggagccuacagugcagggaaguggaggugcucagcccuguggacucagcuagcugcuagagaggcuuggaugugcaugauuucaauuugcauguuaauugggaauggcuaccuggaggcuguauugaggcauuuuaagguugucuggcucacuagguguguugguuaagguucuccggagaaacagaaccaaugggagauacagauaucuagguaucuauagauacauagguaaagauacauagauguaaauauguagauaucuguaucuccuauuaguuuuguuuugcuggagaacaccaacuaaugcaccuaguauuagaugcagauagauaaauagauacguuuuuuaaggaauuugcuuauacuauuauaaaaccuggcaaguccaaaaucuacaggguaggcuggcaggauugaggccuagggaggagcugcagcuugaaggccauuugcuggcagaauccccucuucucugaggagguuaauccuuuuguucuuaaggccuucaacugauuggaugaagcccaccuacauuauaggggucaucugcuuuacucaacauccaccaauuuaaauguuaaucucaucugaaaacaccuucacagaaacacucagaauaaaguuggagcacuguggcccagcuaaguugacacauaaaaugaaccacaucacccgcugggugagagggccaugauagcagcaccuggccugagugagggaaguggagagggucccuacuggcacccaugucuugcgugugccaucccucaucuagagcagcaugguuggauauagggaaggggcauuucauggagggcaggcaugaacaggguucccccaaaugaaggcaaccugagguuucaaccccccagcucauuuuacagcagugugucuauuacuuccuucugcaggggccagggguauuagggaagagucuccugaccagaaaggacaaaacaaaagaaaggacuuggcucuggccagguuccagagcuccuuggaucuagugggaggagucgaauggcagggccccaccauauccaaggagcccuggaaccuggccagagcuggguguuaggaugucccccagacacugugagucacaguccccuccuuuaccugcugucauguccuccucugaagaccauuggucccagaaaaagaccacuugaauaaaaucuaguuuaagccagggacuaaaagugcaaaucuucaaaaauaaagcacaaaaguguaaaaguagauucaguuuauauuuaacaaaauuaagauuacuuuggugacuguuugcagauucuuugcuagaacagaaaaugaaucaguacuaaauuucuuuccagucucugugcuuccuaagucagaccucugggggccacucugaccuggcaucccuuccacucugggagaagacaugcuugcagcuugggagaggaccugggaguaugaaagaggugucaaaagagggcucucuggggggugggguagacuuugaauuggggguaccugagguucuagagggagaaaaagguuuuugauaagagucaguggcugcaauguuagggcugagggcauggagaagggcugaggcagagaagucaguagugguaaggaggcagggauguucgagugggguccuguucugagcuuuuuggccacccucuuuguccuuauaaagguggaacuugccuaucaggaugccaguuacugaucuuuaguacuugggcacauggcaggugcuuggcagauacaaauuuaauucuccuuuuacuuuugugcaccuguuuuuccccagccuacuuuuuaacacuuuuggugucuacugccugaugaucuaauuuacuagucaggaaaagcagaacuuguaagcaauguacugagacauuugguuaaggagauuucuaagcaaacugugaaagaugcugccuuguuucuccauugaugcuuauaguaaaacaugagggaaaaggaaugaauugaggaaggaacuguuagcaaacagaaaucagcgcuugaugauuucggagguucucagucccucuagauugcaaaggauguuaagauuaggaaauucacugcugagaaagcauaccuuggagagaaggccaaaggugagccuggacaaccuucuguugaagagaggaggugugugacucacagauccaagcaacuuagcagcaaccagaaauagagauggacuucuauagcaaaguuaugcggagagccgucuuggcuaauggcauggaccccuugauguauauaagagacccucaaggguuuugagaauguuauaccagcaagaacacuggacugaaagggagagagacuugacaaaugaauaaaaagcugucagacuucugggauucuacagacaagaaacaggcugauagaacaacucagcuacaaacacauguuauccuucaaaaacuaaaaaaggaagaaugacucugagagcagggcucuggaaacagaagugaggcuaggggaguagccacagaggucagucucagguauugaaaccucauggaauuugcccugcuguguuuuaaacuugcuugggaccaaugaaccuuguauuuuuuccaccgucucccuuuuggaauguuagaaguagguaaauuguuuucuagguccacagauggagaggcauuuugccccaggauagaccauaucuagagucucaccccuaccugauuaggugacuuacaugaugacauuaggaacuuuuugagcugaugauaauuuagaugagauuuuggacuuagaguuaauggccuaauggacugagaguuugggggauguuugaagaggugaauguauuuugcaugugggauggauguaaauuuuggguaccagaggguagacuauaguagguuaaauuauggucccccaaaauaugucuaccagaaccucagaauaugaccauuuuggaauaagggucuugcagauguaauuaagguaaggaucuuaagaagaaaucauccuggauuagggugggccuuagguccaaugaccaguguccuuauaagagacagacaaggagaagacacggagagucacagagagaaguccauauaaagacuaaggcagagauuggagcucuguuguuccaagccaaggggugcccaugguugccggaagcccccagaagccaggagagaggcauggagaugagucugccucggugccuccaugggaaccaucccugcugacacgucgauuuggacuucuggcuccagaacugugagagaagaaauauuuuguuguuuuaagauaucaaauuugugguaauuuguuauggcagcccuaagaaacuuaugaauuuugcauggaaaggacugaaaucagaaaaagccuuaaguucuuucugauccugucaggucccuuaacucugagcuuuggcuuccucgcagggagucgcugccccugcucaccaucuugggcuucugggggcaacaugucagaaccauugcauacugauggccagcacugcccguuccuuucuuuccuggcaugcccaucccacaagugagagaaccuagacccgggaaacuuaagcaacuggacagcagagcugggacuugaagucauucauccagcuccaaagacccagcccuggccaugugcccugcugucacgggagccccagaggagaugccugggcugguaguggugccucuacuccagggcagggccugcaggccccauggcaguucuguggccaugcugcugugcuuugcugaggccuugccugggcugcggcauguacgagagcccauugcagcagagccugagguucagaacuccugaccuccucucaccccugcccucuuccagccaugauugguggccagugccuauugggcaccgggacauggggggccauggcccucuuuccaaacacagugacaucccugucagauuucacuaauagacuuggacacaucugaccgcuugaacucccuuggaggcagggcacagccauuccaaauaaacagucacauuccccucccagucugggcuggccugcggagccugccauacccuggcccccguuucuguugcccaggucuguucccagcuggggccaauuagcugagcaagaaaauguuggggaacagggagugaaggagaaaaaaauuccauuuagucccuagaacaguuuaaaggccacuuauccuaagaaucaccagcuuucugcugaggcauuuugacucucucgaucuucagccugagaaaucccucugauaagauuugaucuucgggguucaggcuagugauguuucuggugaugauuggcuaucaggguuguaacaucagaaacuguugaagccacagaccauggggaaagagagcaggggcugggagugcagagggacucaaggcaggcauguaccagcucuguguccacaggcaagucagucaaccucuucguguuucacugguucagcucaaacuugggaugaccacugugugcuuggcucuguccaggaccucuggaagaugggucaggguggugugguguggacuagggauaauguauauaagguuccuggcaucuaggagauacaagcuuuagcugauacucuugucauguuuauuguugccauuugauauuauucucauguagaauuuuuguuguggguuccggaaguaguaagugucagggcaccuuccuggguguaagguccuguucagggcuacuaagugaguuauugaaaugcaaauaugcuuugcggaccccacuauguggaccccacuaugguccacuaugaauccaaucaauguucugauaaugaugacaaacauuauuagauauauuuggauaccuauuuaguugauaaagcuuuuagggaagaguucagaauuugauaacauaguccucccaaaucaagucuauauucagauugauuuucuucuucauugaaaaccccccagaaagggaaaagaaaaccuuaaauacugguagguguuuuuacuuuuaccuuugccucugcucuuugaagcuaaucacaagggugagauaagauuaugacaucuggaaagaauccauuuucuugcccaaacaagccugcagucuugacucuuccagaucugcccuucccccaccuccagcaacgcugugcacuccccuucccagaggaaugcugcauugcuucucuccuuggagcccuuccgggcuuuccccuaccugcaguaugcucacuuuccagcacagcucagggcucacauccuuuggguagaggugugccccguccucugugcugccugcugcuuguauuugucuuugugccugcaucuccuguggacccuggucucccugggggcagaagcugagucuccuccaucuuuguauucucggcauccauccugggcucggcccagaaaauauuuggugaaaggaauaauaggaaaaagccaauaaaggaaauaaacaaguuguuuuucaguaggauuuugauuggaaauagguaaugagugaccugagagggcuguguuuggagucacugccacccuggggccauuuacagaaacccagagcugggcagccccccacuuccugcuggggcugugccccugucuucaaggcugcauccugaugcuccaucaguaagcagcaguggagaugcucccugugucccugugcugccucauucugggagcagugacugugaaucaggugcccgaggcugcagagcuggcuuuccaacaccuguggauaucggcucucaaggcugagcucccucugcugccauguguuuuuaucuagaaaauauugagugaccuucauccugaacuauuuucuguuccagaagauacauaaaggaaggcaguuucugugcauuugauguuucaugguugucuggcuuuuggcaguggaagcuuacgggauucugcucucugugcccauguguggugcaccagaugcacaggguuggagcucccugggaaggagagaaggcagagaaggaaaccaggaagguuuugggaaagccagaggaagccaugcuaggcccuuugagcagaucagcccacccuugguugucgcccucaggagggaccucgcagaucaggcccuuccucugcagcaccauggccacugcucagguucaaacucccgggcccugcagggccgcuucuguggcaugcugcuccuccccuugccucccaggucuucuucuugaguccagcccagcccugcugacagaaaagccuuauugcuguccugcucaucugucuguggguccucauugucuccaggauaaaaucuaaagugcauggcacggaaggcagagcauagcucuucauuaucaccucuccagccucaguuucuugucuuaaagccucauaagaccucccacugcucucuguguaucaggcaguacucugguuucaaaggacagaaacccaacuucaauugccuuaagcaggauaggaaacagauaggcucagggcuggagacgucuggaugucaucaggagugcuggcuggcuccagaacuggcucugcccugucgugugugggccacacacucagguggcaccuucccuggcauaauccccacagcucuggcuuuccauuuucuccuucaaauccaagaugcagugcuacuugugguugacuccugaacaucacgcuaucgaaggauccguccugacaguggaacaccccuccccuggcagcggcuuguuaccugacucuggccaaugauaugugaagggacauguccuagggguuuggggaaaagcuuuucugcuuuuuggaacucaacaggaaaagacagcuuuucuccuucacuggacauugaagggaggaaggaugugacgccuggacucaggggcugaacggccaccuuacucccaggcuggagguuugcagaggcugggaggcaggagaguugcccagaagcagagccugcaccugagggcugcugugugucugccccgccucagaacuucguguauugugagagcucugucuccacacgguuccagucagggcuaucuguuacuuuuggaccaaaguaucauuuaugauaugagagcaaaauggcaucucuuuccuagcuguuaggaacacaauuaaggaacaggcugcuccuggccugguuggacgggagcucaucccuguggaugaguacagugcucuaauugggcuggcuggguuacauguccaccccuggagcuggaagggacaaggugggagggaugguucacuaagaaauuuggguuacuccuaggaaaugcagaauagacaucaggcaggcaaaacugagagguauccacuggcuuggugcuucccaguguccacaccaucacagcucaggugcuggacacagauggacuauguuugaguccugccccaucacucacggggcaguuaccuccccuggcuuccuccagagguugucaugaggauuugacaagagccacguagcgugcuugcagcagggcuugacguaagccucacugucuuuaucaccacccuguacaacucugcaucuugucuuuucuuuaaugggccuuuuuacuuggcccauggagugcagagacuuggggugggguggucugagcucugcauuuccugccugcacccaggaccccaagagccucugugaggucuugccuuucuccuggcuugaggauuugaaucacaccugcagccaaguuguaauauccuguugucucccuaaggaggcacagcugaggaaggacagucgccaggcaaagauggaagguugaccucacaggaggcagggaacucaggaagacuucucucugcaggugcuguugucagagaucaaugcucaguguccuaaagcucuggcagguuggaggaugcugccccugcaggccuuuuuccuguggaagcuuggagcuuguucuuaacccccaaaccccaagugaauggcaugcccuuuuccaucaggccccugagaaucuguugcagcuagacgaacugcuaccagcaugugcuuccagaagcggaugacuggcuggaguccugaccugcagucagcuguccaggcagaggguacagccagguucuugugcugagagcggccuggaccugugacagugggucugucugcgcuccugauaggccuaagcauuucacacagucuucugcaaggauggcacuggguggcccaggcaugguuggagcaggggagaaaugguggcuuuaacccaaguggugucuuccuaaggaaggggacaggcaggaguggugcugccccacugcugaggugggcccccuuuauagagaugccagcucagucuggucgugcuugguguguuucaagccugguguaagcaucuagagucccacuugggcccagguugaccugcagccucccaacccuuugauggggcucuagugcccaagaccacaaaucaagcccugccccagcccaaccaggcuccucaacugcagcuuccugcucuuaggccagguggaugucuuaggauucagccucuccccugcucaccccaaagccugagugcagccaccacucaagcauacccugcccuuuccagcugaggggcaguguuacaaagaagugacagcagggcuucgagagcaacugggcuuggguuuguaccuaugugcuggcccugugagcucaagugaguucccugaguacacugagcuucagcguccuugucuaucagugggguugaccaugcugccuuccuccgagucgcagcaaagaggaggaggaaaggggcaagcugcucuagagcacgcacgcaugugggcgcagucaccacaggaagccucagccccugcacccucuacauggagcccuggcagucaggcagcacucagugguugcugggggagcagauguggaggugccaaauguggcgcggguagggaguguggcuggccucuggacauccccuguagaagccacauguugagggagccuaggucggugugggcccuggcccaggguggccuugggacacucccagggcagcuguagcacccuacaaguugucguaugaaaaccacucuaacuuauacgugcuuuuggguggaauuaaaugaguuuuauuguuucuaggacaagauagggauuugauuagaaacaacauuuauggaaugccagggcugguucccauccacugugcccugcaggaacacagagucuugggucccaggcauaaacggccagcugugugacuggggcaagacacgccccucuguauggccaggccaccuucuuaaauaaguaagaacagccuucaggugggaaugguucuucccaagggccauuugcuuucacaaucuuguuuaccuucaguggucaguuaaguuucaaggggaaacugugacucaggccaguggaauugucagaugcagaagcaaggggugagauggaugcgggcuugcugggcuuaccgaaacuuguaugccuguaggccucugggggugcagucauuuccucccucuagcugugggcugcggugccuuuggaauaggaugcgcaugucaucgaggggucuagcagugaccugaggacuggcaggaccucgauacuggggcccaaagcgguuuccucuccugggaaaugggugcccagccagugucagagccccagcugggaguggccuuggugcagaaaaugcuguguaaauggcaauugacagugccagguugugcccaaugcaagcaugggugcugccugguccacaaaggaguaucugaucuuugacugucugaagaccacugccuuucuagguuggaagcaagcucugauucagaugaaaguguggccaugcagggcugugugaccucagcuugcacacccaugaagccagcccugcccacaaccuuuccagauacuguugaugcgugucaugucggggacuggagucccugacagguaucagagcccaagcuggcccugggggagcccucaguggggcugggguggucaggcaggcagcuguuucuucauauggggaaggcacugagugaacauggcuuccagaguguggugggggcacuggaagggcuccaacccugcuucccaggcaaggcgacugaagcugagucucagagaaggcagagggcuuugcccaggcauucugagcagaaggaacaguaugugcuaaagcccagaggcgagagagugucuggcaugacugagguaaacauggagcuccuugcagagagucugagaaguggggugguucguaggugguuguggucaucucugaaagggcaguagggaggauguuuggaaggccgagucuagaagauguuccagcuggagucggguccuguaggccacgccuugugauggggaagcacagcugcacccuggaaucaggcaagagagccccuccaggggcccacagggucucgaggcuccugggugccgcugcuccccacuccgcccccucaugcccugccagccuguaagucccaggacccugugcuuucacuccagcuuuuccccaggccccuucuuggcccuccucacccuccugggcucagucccaggaucagccuccugcacagggugggaauaaauccuguaggcagccucugcccuugacaguggaagucagggcugccuagcagggucuaauucauuauuucucacacucagcuggggguuagggcggguugcuugagauucuuguuaaacauucuugguccaccccgggucccugaauuccagucagcaggaaccaaggaauuaacauuugugaccaucaaaucauccaaagggacucccuuuauuggcaguuugaggaaaccaugggccagagguuggacucugaaguuagacaaaccuggcucacguccugccccugauuugucacauacugugcagccugggugacuuaaccucucugagccucagcuuccuuauccgcaaaacauggaaauguuaauaacagagccugcuuuguagaguuacugugggaaggaaaagaaaauaaugauuuuacaucaguguccaacauauucauucagcgcauagucuugagcaccuacuaugagccagaugcuaggcuaggucauaggaguagagggugaguaaggcaggucccauuucuguucuuacaguucaccuucuaccaguagggguaugaguugguaaaucaccuuauuuaccuuacagugaggcgauugagaaugggagggguucuguaggccaagagagcucucuuggagguggagauaugaauaucuugagcaaugaagggguacagccauucagaggccugggagaagagugugggaaugcugggcacauucugccaccaggagggaaggggagacgcugugggacaggcaggaggucagcagggcuggaggccagggcaugcauccaggcuaagcacagcaaguacuggggagccuggccucccaaccucuucuugaggaagcagacccuucugggcagagcggcucugccugcccccucucacccucuggccuggcaccucagggagggcagaccacaccugcagucugugucgggccccucacugcccuggcaucacucuggggcucugcugggacuuucuuguuuguuuuaaaggaaaguugaguguuuccugagugugcguaaagccaauguacuacuuaaacugaguauuuauaauucuuucuuuuaagaaauaaaacaauaauaaaauaccauaaaccuugcuuuaauuauucacaggugucaacuuguaaucaucauggggaaagggccaaugagaugccuuauuuaaaaaaggcacuugccugcuuuucuuugaaguuuugcuaaaaugcuucauuauaacauguucuuguuuauaaauaaauuccagccuuucaaaguuuggguguuuuuuguuuuuguuuuuguuuuugugugcguguuuuaaaaguauuuaaaugagaugauucuagaugagggugauugauucacagagugagccagccagagcugucugugagugacagcuguggcuccccugcccuccuggggcagcauagcuaccuuagcuugcugucagcugugguguuugugaagcuauccauuguggauguguagauuagggugaaucccgauuugugugcucgcauuugccuaccugcuggacuuacugccuggcagacagcucugcacgugagcacaugugcacauauggccugagauggggccuucccaggacaggggagaguucucugagggcagauagcaagggaaccaaccugggcugaagucaggggaggcuucucagguccgaaggaggaggaagacuuacuaggagaagaugagcaagguguggguagagaggauucugggcaaaugcaaaggccccauggugggagagagccuaauguguuugaaaaccuaaaaggaaggcauuuggcaucuggacuggagcccagagacaaauguggggugagaggugcuguagagguaaguggcaccagaccaugcaaggccaguucaaguucugucuauucuuaugacgcagcugguuuugcagggugggugauguagugugugugcaauuuauuuguguguuugagggaaagacagaugguuuggagaacagauuugaggggagccaggaccuuucuggggacuaguggggaggcuguugccauaguccaggcagauugagguggcuuggaucaagcuggcagcaauccaaugggcauuaaaggcauucaggagauggaauuaacaaggcuuugugauggacuagauauagggacagugaaggggagaggcauauuaccgauggaccccagaucucuggcuucagugacaggccagguggaggagccguuggugagagagaauccagaacaaucuggaggggagagugaacagagccaggaguauggcuugggcuucacuaaguuggggacguuuggggaacccacuuggaaaggucuaggaagcaagcugacauaagugucugaagcucagagaaguuugggauaggacauauauuuaugugcuguugguggcuccaaccuugguaguuggggccucuggcuagaaaagaaaaguuaaaaagcaagcuucagcuguuucaucuaaaguuauaauuccgaugcuuuaaaggcucccaacccucuucuuguucauggugggggagccuuccuaguugugaaagggucugaguggcuccagcuuuggcauauuagggugcaggggaggguauuucuagggacacucugggagaagcugcccagccugcauggugcuagugccagucugcaaaaucuccagguaauagagagggcaggccccugcccacccccuugcagccuccaaugcugcugcuguggcagcugcugcugcgaaacaaaccagggugacugggcggaaggucaggaguuuaagagcuuguuugauucaaaacuaggcuaaaagacaggaggggagugagcugguuuucuguguggauccugguauuuuccuuugaguuggggaggagaaugguggggcagggagggaaggccggccgccagagggaacgcugccaagcagagcgcagcuaaugugaaccauacggcggcggcguugggcaguggcggccaucucccgcccagcuuaguacagcccuuacugcgggcaggggugcagacaggcaggaaggcagcucgggcugugcggccacuuaacccuuccagugcugaacuacaagcagggcuccuucaccucagcacauugauguuucagccaauaauccucuguccugggcacuguagaugucuagcagcaucccuggccucuacccacuagaugccaauagcacccucucccagcugugaugaccacaagugucugcagacauucuaaaugccuccuggggggaaauuaucccuggcggagaaccaguggccuagaacaggcggcccccucagcugcugggccugccuggacucugaugggccugcacccuucaggggcccugccccagacacaccacauccauguuuggagugcugccuggggcugagcaugugggggucguuuucccaugaagcaggcagccauagggucagaggggagacgagaccuacccagaguuguaugccaguaggagccaggguccaggauugguguugcuccacacauucccugucccccugcucccaggcauggcccccauucaguuucugugguuuuaagugggaggugugcagccugccccugacuggcuuccuggggggacuaauuccuaugccagccuucucugccuauucaacaugcaguugcccaagggaacauggcacggguguuuaccacacuguucuuauaccaagagucagugcacacgagcucaguguccagcggugggucugguucucuaaaccgugcgauaccacgugcccaucgaacacgauggugcagaucuauguggaaagaccaccauuagaaucaucagauccgcgaggacagagacuuuugucagucauguuccugggcccuuaauaaauguccugugaauaaauaaaaugcuaauugcaaaaccaaaucucaauauguaugauuuggucccauuauguaggaaaacugucugcauauguuuguauacaaaugcaucaaaaaaucuggaaggagacagcaaacugagaacaguggcugcaucuuggaggagugagggaaaguggaauuuagagggcugaaagagagcuuucauguuucagucuauuuaauugguguuuaaaucuuuuacaacgagcugguauucaucuguuucuuguguggcuuuuaugaaagaaaaaauauaaagaacuggaaaaagagcaacuuuuguucuguccuucccuguucucucucaccucccuugugcccucacucggcuuuggccuggaaaguccguucucugcuggggaggccucuguguagggagcccaggggucuggccuggcacuguucugcugagggccaccuccuuuucagaaagcuggaaugggccccuccuccuggccccugugcauggaugccacuacugggcuucccuguccucccugagcccuccaggagcucccuggcaccaguuggcauuugcccuccacauggcagugcccuccuugccucuguacggucuucccucugggcccucaagcuggggcucgcacagcaagcggcagccucuacuuuauuggggaagcucugggcaccaacccucacccccuucuccuucacuagccgcccugcaugauuccccucccagcuguuucugcucauuucucugaaguuuucagcccuuuuucuccuacucacuguuuuuuuuccccuccacacuccccuccucggagaugcagccugaggcugaggccgcauuguuuggugaccuucccugcugucccaggcugccugcacauuaucauauacaaauacuuucgucccuuucacagcagcugccaucuuugcugacucuuucauuacccccuccgcuucagccuaggcaaacaggucucugcagguggugacagugauaauuuccuguccauggaaagccugcucuccccgcagcaccauagcaggagcuucuucccuuuaacaggugaggggaauccaagguccagagaaguuaagucacauauuuuaaauguggaucggacccuccuucugagcauacuucugugccuguccugugagcagcaaugguuuauaacaucccuggagcuggccccuaauuuggcuccuccauggcccagcuuucugcaugcagcugcucuggggucccuaggagugauugcagccccuccagggucacuuccauuuuagcugagauuuggggucuugagagagaaggggccugaugugguguggcagccuccagcccacuucuaguaagaguauguuccagaaacuugacuuuguaugcagagguagcauggguaaguuggggaugggguggaugaggaugugagacaugaagauaccagccucuuggagguucuagaaucccaaaacgccaggcaguaagggguuugggccuggcuccaggaaguuccuggagaguuucaccaggaugggguuuggcugggucucacugucuuccuggauggaccagggaggacagaaccagcaugccaccucugggauccacuccagggccuggcugguucaagcauguccuaaggacagauaggggaggaaccucugaggcaggcacucagggguccuccucugggcccugugcggggguuuugagccuuauggcugaugggggccuggcgacuugcacucuccgguucucagcuguuuuguaguugacagugugugggaagcuggggcguuccccugaguuagugguggucgugggaucugagcaggcaguugcagaccugauccugcuuuggcucuggagccugaauggauuucugacaggagaagcugaggcuguccagccugccuugggaacuuggcugcuucaccaagugggagcucugagacucucccacaggucccgugcuccccacgugcccuuacaguuaccugcccaccagggcccagaggaggggcuaccuggagcaagggugccuggacugggccucugucuuccccugcugugagcagaguucucaccuccugaccccgacuuggucuaacccugugacccacaugaaaugccagccacugguggugggaaguggguggcuggucucuuccaagccaggagugcaucagcuccagccuccuucccugcugccggccucgguucacagggagcccuuugaggggcuuuuugaugugcaccauggauguuuggcuugaccaaauuuguuugcuuaagcauugcucuugccaguucauucggaccuucucuuucuuuuaaaaauaugcugcuugccaaagguuauuuuggaucuguuuuuguuuaucagguagaauuguuccagcgcaauugaaagcagacccacauguugacacgcacuggagcugcuugccaggacacgugcacaugugcacacgcgcacaugcagaauauguggcaggcaucucaucgugagcccuagaguguacacagcuuaggaagggggacuggggaagcugcccauuucaccggggacuugguaugugaagauuuucaucaucuaggugccagcacugacagacuucagguggggaaaaucuagggacuguuaccuccugggagaggcaaccuggugagucugaguaccuugggguuaggcuggcucugccgcugguugccugucauccuucccugcucuggccuggcuuccuucucugugacugaucucccgacuucacaggcuuugugccaggcuguggcugacggccuucgggaagcaagcagggcuggccggaagucagccagagugagggacuagagcgcugggcucccuacaacugugccucccuuuuaagugaguagccuuuucuugggaacacgguugggugcuuccugccaggaggccugcaguggauuucuucugaaaacacagcucuuucuccccaucaggaccugcuguguauaagcaggcugcucagaggagcccuuucaggcacuggcuuugggccuugcucccuugccccuuuggggcccuguggcaccuggaaacacacagagggacuaggcgguuaaggcucguccucuuucccaucccaggacagcccagcagaaagcuugaggauacugauucagcuccaggucucauugaagggaggacacuguguccagagggguggcuauguucguucguuugauuauuauuagugauaguaaccaacucagaugagcauaaggaaggaaaggaaauuuacuugcuuccacaagugaaaagucaggguacuugugcuccaaguaugguaguguggggcuuggaagcugucaguacugucuccuuccaugcacuuacuuuguucuguguggcucuacccuccaggcagcccacgucuuguggaacccuaggcagcuccagacuggccucugugcuuccuuccaguuccuccugcccagcaaugcugcacaagugcugagaucuagccuuguccuggggccgaauugguauagacacucaagcacugucuccccuaggagucaagugucaccguuaauguccugucaggugcaagccccagcucugcuggcucauagagcaguccacaccuuggcagaacuggguguccuuguggcuggugacauuugugugaggcugcccucaccccuggccugcaggaagaaccccuguuuuguuuccagucuuagaccaacaaaggcauccacacuggggaacugggggaagcuaaaucagcacccgcccaaaugggagagggagauccaacaucuuaacauuaucuucagauuuuaaaaaugauacauacuucuccuuaaaacuucaacacuacuaagaaggagguacauguacccuuccccauuugcuggagagcacgggugcugccauguaucagccucccuccagcaguuccugugaguaacauacacggcuacaccauggcaugagccuuggcagagucauaccaccgugcugcuguggcaccuccagcccuccaccccccacacaaccugaaugucucuccucuuucaauaaugaagauccuauagucaugaagcugacuguaaagcccaaaguaauuauguuuuaucugaguuugggaaucuuucuaaaacguauuucauacucccgccuuuccuugaacuacacaauucuuccuagaauacugcauauaauuccaucuuuucuugacgacuaaagcuugucuugaugaaccaguugauuuuauaggauuggagcuauagaaaugcaugaucuguuugcuucuccacuaaaugacuucaugcaagcuggagggccuugggggccugcccagugcuggggguugggggugggggauggggcuucuggcacugugcaggccaccaaggcuccuuccucaguuacuggagccucagagaggcuaagaugcaagcagagggucggagcaggcuuuugggcacucaggguuaccugaugaggggaaagccucugcccacuugccuuuccccugagagacacuaaacaaaugaccaggguaugugcaaaagccacaaagggaaggguacaaaauccucugggaauguccaucauggacuauagucgagucauuugauaggaccccauauagcuguacaaauucaugaacuaagacuguacaugucauaggggaggcuccuggagccgccaccacccugccacucccccaugucuacacggcuguucccaugucugcacugcacuccugugcuuuaccugagcuaugugugcuuaaccuuaagcguuuaaccagcaugcuuuaacguuuuuuuuuuuuuaaugcaauauguaaggagaagccacugaaggauuuuaagcaggggaagaggguagggaauaaggaccccuggccaggugggagucugguuggagggguccagaguggguguggaaagcuggcuggguccaggugaggguugaugacggcuuggucuagggagguguugggagagugggagagaacaggcugggcuuaagagguaccuagggugccucaagucuucaugaugccuugagcacggggcaagaugaagagguggggucauggguacuucuggguuucuggcucacaugaugagaugggugauggugcuguggaugcagaaaaccauguguggggaagaaggugccucuggcgugggagcuauggugcugcagagccugggaggcaugggguggaaagcccagugcugucagagccagagucgagagugucccccugggugcucacacuguggggcuggagaaaucagcuugggagaaggccuugcuuuuggagaacuguagcacauaauggcugggcagcagggacaggccugugaaagagauggcugggccugagagguagaggggagugaggagggccagggcuggagcacugccguguccccuccuccucaccaccuguagcauguccacuuccucuguccagccugcaggauccucuguguuugggucuacccucuugugcuucccuacugauccccaaucuguaguuguuuucaaaaauuuagccaugguuuccucccucgcacagccaucauggacaccaacccagcuccccucgcccacgcucccuuagcccauuccuguccagcgucaggccagucccacguuccuggagccgccagcacccugccacucccugccccuucacagccauccccaugucuacgcugcauucuugugcuuuaccugugcugugugugcuucaccuuaggcguuuaaccaucauucuuuaaaacauuuucaaauuuaugugaaaagagaacuugauaauaucugugaacucaugaguuugcucugcuaguuauauuuuuucuaucuggaauuugauauaaguacaucucccacauggguuuguagucaugcauguguguacagcauuguuugcucugucuuguagauaaauggugacgcucuguguguacccuaugccaagcuugcucuucgcauucagcacuaugauuuucagguuucucuuugcugauauguacagucucaguucaugaauuuuuacugcuguaugggguccuauuacaugacuugacuauaguucaugagggacauucccagagcauuuugcacccuucccuuuguggcucuggcacacauacuggucaucuauucagugucugucuccacuaccccucccucacuggagucuccuugcacacagagcuugauccaggcgggaagcaggagggaguuaaacucuaccuccuugagaaaggaguaucuauguaauuauuuggaauucuuccuuacaggagacuugucucuucucccaguuuauuaacucaguuauguauuuuuaucaggcuagacuuuggauauguauuuuauacuuuggguuauaauccaaugcuacauuauuuugcugcucaaaugguuccagccuugaccauggagcucuaugaggccagcuccuguguccucuugacauggcccauccuuuuguuuucugagcacuuucuggcacuauaagguguuccaggcucauccuguuuccugccccagaccuggaaucagcuacuucuccaaggagccugacaccuucuauaggagaaugguauuagagacagggugugugcuccuugcugcuggggcaucauugcuucuagguccuuuuagcagauagagcuaggaaagaaauguauauauagcaacccauaugugcauaucuaccauuauagauacagaggcaucuaccuaucugcauuuacaucaagcugaacaugagcucaugcucugucucugacucuaaucaaguacacauggcucauucuaggcuugccuccuugcuugucugugaccucccuccaacaguaugauguuuggcuccugucaccagcauucacucacuuauuuguuccaucacaguucacccuuaccacugacacaagauugugaagccugugaacaagggugguuuuuuacugugguuguccacaggucccugagccccugaucuauggaagcaagaauguugguguucagacagauuauuuggaagagugaacccugagggccaauuuggcaaauaaaguggugaaaugucccccuuugucuugaagcgugaagcccuuccugcugucaggcugagguggagaugagcucagagagaacucacagugaugcagcuccaagggggcaggcgggcuugugcagccauggggggaggaaggaaugagaucaagaauggaaucugggggcccugggaaguggagucccagcaugacaaacuguacuaaaugggagagagugaggaggcuggggaggggauggaaaucauuuaacagcuacacuuuucuuccuacuagccuuggcuuccuuaaggccucaacaugcacuggauucuaaauaugcaaagcaaggcuagcuguagacaaaaggaggaaagaaugagguggugaugugaugagcuguaguuugagaaaaccccagagacugagucuccuggaguuagacugggagacuugcucuuugggaaagcccauaggccagagacaucaaagugccgguaagaauaggguuccccuuggguuaccaucaguuggggaugcaauaacuacagcauuuaucuuuaacuuaaauuuuuaauuguuaaaaaaauagguaauggauucucaagauaggggaaaaaaaauucaaacuauguaaaagauguauaguuccuacccuauuaccauuucugguuucuuucuagaaauagucuaugugcauucaagcauauucauguauaucguuaucuccuuuuuuccuguauauuaaugauaacauaguauacacauuguuuuguaccuuguuuccccccgccccccccaaaaaacucugucuuugaagauacucugguaugagaacagauagaccugccuuucuuucuuuuucacugcugcauuagugauaauacagguacgccaucauucauuuguacuggucuuccagugacgaacacuucugcugcaucuagucucuugcuugacuucuguauuucuucuuuuaaaguguaaauguuuggcacaggugcuuuuuucaguuauuucaaguaagcgauuuugguuuucacaggaucccuaggagauggcuuuggcagacaaaacucggcucugagggaugauguguuuuggucaaggucauagaguugacaaaugggaacuugaguuuaggucuccuuacuccacuuccaguguccuuuucacuguauucuagaccagaagaauaaagaauauauaaauccacauauaagucguaugugccacagcaaaagccugaguuccugccuuucuuuaccagugaucugcaaaucagggucuguugagugggguuuuccuuguugugacuugucucugggaccccaagauagggccaggcccagagcaggagucaggaaucccuuguugaacaaaugugcacccugggcccugagauuuggggcucacuguggccauugacuucagggaguucuccuaggauacagcaagcugccaguacauugguuggaguagaggaccuauacuuuauacuuugcaggugaacauguugacuuaaccaucagaagucuccagauggaaaugucuugccccaucacuguaguuuaagugguauuccuuuaagaagaauaacuuggaugccagaaccaaaggccugugcuauuggacugggccagugaagacagcacaggcauuuuccaguuucagugaaguuauuuuuggucaaggcauuuccuauuugaaaacauuugcagcuccucauggguccguuggugccuggagguauagggcuuuucagagguuauugugauuguccuugaaaugguggccuuugcaguuggaguaauguucugcagaaguuagaguaucgcuaucucugaucagagucuggcacugcuaaggagcuacagggauauguaccagcuuccucgcccagcauagggaacacgcuuuucaauucaugucugcacauuuucccaccugaggcagcugugccuuagccaguugggccccucugagaaauacugcuaauacagagcgacaccaccacucagcucuguggaacuucuccccaguggccuaaaugcugauuccugggacaguuccaaauauagguuccccacucccgcuuuauaggaaccaguuuaccaagaccuggaggccaccacuaugucucaugccuuucuuucugcauccugcacauucucaguaccuuccagacucuugccaagaugcaggcucuagagccauaucacaaauucaggugccuuuuagggccuggcaggaggcagauggagggaagcagcacaugggaagaacuguacuucuuuacacugugugaguagaccugggcacacugaagacccaccacucaucucaacugugcaugggaaugcaaaacuggaauaccuagauuuugucauuuuuaaggagaagcuggaaaucuggauuuucaagugaaaugucccauuuuaaaauauaggcuugaguuuuuuugucacacaguaugggucaaacaaaacaugucugcagccuggauccugccuuugugcuaccuuugggaccuuugcucacuucucugcaccgcccuuccagccaucuuucugcagaggcuugcugucauguuugaggguuuuccuuuaggcagaguggcagacaucugucucauugcugugggggccaccaauaugguagaauggaaauauguugcucaccuuuuaauguguggauuggccaucccauaaucuucuuuugugaaaugacugcuaaauucuuuuacacauuuuuauauuagguuguuugucuuauuguugauuuguaagaguucuuauauauuuagggcacauguccuuugucagauaacacauacuuagaugauuucucccggucuauaaauugccuuuucauuuuguuaauggugucuuuugaaggcuuuuaauuuuggugaacuucaauuuauuauuuuuucuuuuauggcuuaugccuuuuguguccucucuaggagaucuuugccuuugccuaucccagaauugugaagauagucucuaauguuuucuucuggaagcuuuaaaguuuuagcuuuuauguuuaggucuguguucaauuccaaauuaauuuuuuuguauggugugaagaaaggauugaagguuuuuuuuuuccucauauauguaugcauuguuucagcacuacuuauugaaaaaaauuugucuuuccccuuugaauugccuuggcaucucuuaaaaaaaaucaagugacugaauaugugugggucuacuucugugccagugcucuguuuacguuuauugucuucucaugcuaucuugauugcuguaguuuuauaauuuugaaaugagguaauaugaaucuuucaacuuuguucuuuuguuucagcucuucuagguccuuugcaucuauauagauuuccaagucaacuuuuuuuuuuuuuuaaguauuggaauuugguuggcauugcauggaaucuguagaucacaacugggaacaauugauaucaguauugaguauuucaauccaugaacaugguauaucuuccuauugauauaggucuuuaguuuuucucaguaauguuuuaucguuuuuugggguuguuuuguuuguuuguuuguuuuuugacagaguugcacucuguugcccaggcuggagugcaauggugcaaccucggcucacugcaaccuguaccucccagguuuaagcaauucucuugccucagccucccaagaagcgggauuacaggugcccaccaccauaccuggcuuuuuuuuauuuuuauuuuuaguagagaugggguuucgccauauuggccauggcuggucucgaacucccgaccucaagugauccacccaccucagccucccaaagugcugggauuacaggcaugaaccaccgugcccggccuguuuuauaauuuuaagugcaguuuuauacuucuuuuauaaaccuauuucuagguauuucuaaguauuuuuuuuuuacuuuuuugagacaggcuugcucugucauccaggcuauauauuuuauuauuugacacuguugaaaauauuuuuuauuuuccaauuauuuacugcuaguauauagaaauacaauugauuuauauauuuugagcacauguugcugucuaugguuugaauguuugucccuuucaaaacucauguuuaaauuuaguugccauuguaacaauauuaagagguacaaccuuuaagagauguuuaggucuugagggcuccacccucaugaauagacuaauacuguuaucccuuucuugcucuuucucucaccuuuucuuugcccuuaugccacuugaagccuucugcuagguucugacacagcaagaaggcccuugcaagaugccagcaccuugauauuggaauucucagccuccagaguugugaggcaauaaauuucugcucauuauaaauuacccagucucaaguauucuguuauagcagcacaaaguggacuuaagacauauaugcugcaaaaucuuuuccugcuaaauugcucacuagauccuugcuaaaauuucucacuagauuuaguaguuauuuugugaauuucugaguacuuucuuugcaaacaguuaugauaucuggaaauaauuccuuucuacacuuuuugccuuuuuucccccuagcuuuaauucacuugccaggaaguacaguacaauguucaacauaaguggugagaacagauaucuuuaccuuguugcugauguuaggggcaaaauguuuauacuauuucacuauuaaauauguuagcuguggauuuuuugugcauaucguuuaucagauucaagaaguuccuuucuguuucugauuugcugaaagcuuuuaucauaaauggguguugaauuuuuuugaaaugcuuguucugcuucuauuaaauuauuauauaguuuuucuccuuuauucuguuaauuaaguuacacuuauugcuaaguagguuacauauauuguuaaguaaguuacauauauugauuuuugaaugucagacccacuuuacauuccuaggguuaauccuauuuuguuaugaaauauuauucuuuuuauauauugcuggauuuugauuuuacauuuuagcauuuuuuaauucauuuugaauuuaugagguauauugcucuuaauuguccuuucuuauaaugucuaugucauguuuuaauaucaacauuauucuggccucauaaaaagagaagaaguuuuugcucuuuuuuuauuaucugaaauaauauguuuaaaguugguaucacuucuugcuuuaaaguuuggaauaauucgccaaugaagcuaugagggcauauaguuuucuuuaagaggagucuuuuaauuauguauuuaaauauauauaugauguauauuauauaugauucagauuuuuauucuuguguguguuuuguuguguuucuauaaggaauuagccuauuuuugucuauuuauuggcauaaaguuaauuguaauauacucuuauuaucuuuuaauguuuuuugaaucuguagugauaucuucauuuuauuucuaauauuuuuaauuuguaauuucucucuuuauuuugaucagucuugcuagauguuuguuuauuuuauuaaucuuuccaaauaaccagcuuuuggcuuuguugauuuuuuuucuuuuguuucuuguuuucuauuccauugauuucuccucuuuauuauuuccuuuuuucuacuuucuuuggguuuacucugcugaucuuuagcuucuaagaugaaagcugagauccuuaauuaucaaccuucuuuucuaauauaauauuuagaacuauaaauuuuccuauaaguacugcuuuagcuuuauuucaaugaugugccauuuuuuaaucauuugguuaaaaguauuucaaaaauuuuuacagaauuucuccuuugacccauggguuauuuauaaguguucuucuuacuuugcaaauguuugaggauuuuccaguuaacuuguuguuaauuuauacucuuauuccacuguggucagagaauacacauuucauguuuucuguccucugaaguuuguugauaauuauuuuauggucuagccuauggauuuuggcaaaaauacagaccuauaugaugacucugaaaauguguauaggcagaugauagcagguguuggccuaggugaaggcaguuguggaugcauagagaaucaguucagaguagaaaagcuuccuauaaggacauccucuccuucuuuugcuaauuuucugucugucucuccuaguagauauuuauauuugcuaaugccuuuaaaaacuucccuugggaggccaaggcggguagaucacaaguucaggagaucgagaccauccucgcuaacacagugaaaccccaucucuacuaaaaauacaaaaaauuagccaggcgugguggcaugugccuguagucccagcuacucgggaggcugaggcaggagaaucacuugaacccaggaggcggaggaugcagugagcugagaucacgccacugcacuccagccugggcgacaaagcaagacucuaucucaaaaaaaaaaaaaaaaaaaaaaaaaaacuucccuuauaggaucacauuaauaacccgagccacagagucagaaagugcugccuuagaaugcccuuugucacuuucuggcuugugaccuugggugaaugacuucaccuuucugagccuuaguuaauuuuucuaaaaggguaaugggaguaucuucccuguggaguuguugggagaauuaaaugaaauuuuacaaaaugccuuucacaguucuuggcuuuguaaaugguaaauauuuuuagugguagcaguacucaaagaaguuagggaagcucacacacaaagguggcugcuucuccccuuuggacgguagucagaggcacuuguucuauucuuggugagaagucugcucccuaccuucugcugugcccuuggccccucagagauccagaggagagagccagcucagagccagcacuucuguagacuggcaugcuggugcucuugcagggguauugugguugggagccauuagggguccucacuggggugccuuagaccagauaccuggugaggcccagauaucccuccuucccauaggguccccuagggcuaggguggaggacuaucuguccuuccuagcccugaagauugccaggaauagaguuugcugacccuguuaggggcugacaguugaaguacauacaggaagaccugccucuuccugaaaguuuguucugggaaggggaauuuagaggggaaaagugaauuaaguucuaucauaucugaguguucuuaaaaugucagcuauugagccucuagaaaugacacauaaauucucugcuaggcacaacagguaaaggagaguuucagaaguugugccaagugcccccucuggacugagcagcagggccccagaccuaagucagacacuggcuccaccaucagaacucaugaccuugugggacagagagagccaaggaaguagagcaccuguacacugggggcacuugagauagggagggaccccaagggagggucugguuggcuuucuuggagacauggagggcucugagaagaaagaaauagguuuacuaaguggaaaagguaaggggaggguauucccaucagaggaaacagcauaugcaaggauuggaagaugccauuccagacaguuggaauggcagacuguucugauauuugacauuuuuguucgaauuagaauugucaugaaacaaaaacagaaacacaucauaccuccaauguguguugcugccauuuugaugaacuaucaaucucuugcauguaccuccaggccucugcugugccugucagggagggcuguccccaugaugccugggaaaauggcuaugucucugccagccacagaccagcaugggacauuucgcuggcugcaccaugugugguguuuguccguugcuggaaugugcucaguugaggggaauuguuucauuuggucauccaggcucaggugaaacaaaaagaggccaaugcaaaaagcugcagcugauuccaggcacccccaaaauguuuucuacucaacacuggcagcagugcgauguccccucagcccugccuuuggugguguccaacuacaggagcuggauggcccucuggcugccucuuggggccugggaagcaaaggaagcaaguucaaaucugucaccuguuuguaguuuucauaauuuuugauuuggcauuuugaucagucuguuuuuggucaaggaaaugcauccguaucucauaacaggaaaccccuuuugugaucuuuacuucaaggcauuuuucuguacuucccccuacuuuuuuuuuuuuuuuuuuuuuuugcuggcaaauauacagaccuaguaugauaugugugucuuauuaaaaguucaacauaauucauugccauugguuuguuuacaaaauaaacaauuccagggccuuccaacaauugaggcuccuuuuuuuuuuuuuuuuuuaaaucuuccuuggggcuggaacuguggugagaagauggagaaggacccaaguuugggagaagucacgugguuccaugccugcuuccugccagagucccaagcaggugacccagcagucagcuggggaggcagacaccccagcauggccuggacccugcucuccucauuuaugugagggucucagugggguggugggaacccaggaaauucuugaaccuuccucagcccauucauccuccugcccagaguccccaugggaaguaugugcauaggcacuagcagaaaagcaaaaaaggaaugcuuuccagcgugaugugguggguuugguccccagccccagccucagcucuugugacugagugaccuauagggcagcuuuaaccuuuccccugagaaagcacauguuaccaugguccagaaaucacccgcucaucccagaagagauggaaggauagagagugagagauuauccaggcccugguacugggagcugagcuugccuggcugccuuuggugggagagggcccuggcagagcaugagauuucaucauccugagcccacacuaggaugucccgauguuggaauacccuaaaagcucuucucuuggaaaacguaauccacguaggaucuugaaauaugaccagcaggauggggcuuccugucccugguaugcagaaagggugaguggaggcaggaggaaggauggugucugagcuggccaccccauguagcuaacacaguccaaugccacucuguccucauccuggccacccauaagccuuucuugucuccucuuucccuuccuaccaaguccagcauuugcaagccauccugaugcuggcccuugcuuuucucuguagccucagcuuuucucauucuucuacugauaaagcaaacuguaguucuccuguuuucucagcauacucaccuucauggccaugcacagaccugcagggccugugucuccucgucauccgcacagggguauauccaugugggcaccucaggaggcagcucgaagguuaccuccucacugaccuuccugcccuccacgcuacacacauaugccccuccgucugucucucuggcaugugacuaccacugugaccuugcugcaguuauccauuggccuuugugccccugagauggccugaaagacacgauuuggauuugucccaguuggcauagguguggcuuacagucaguacucugcguguguuggccagaaggcccccaguggcagucaggugguugugaucuuggagugggguagaggaauuguagccaaugcuauuccaaugcuagccaauaccaaagcugcaccucaugcucuacaucacacagggagggaccucuggagucccagagguuuggcaaagcucccugcagucuuucuguuaagaguaaauaaagaagcaugauaucugagguggugaguacccacugaugaguuaguagcauagagcuggccuccguccucuugggagaccauaggcacauaccagggaugaacagcauguaagaaucaggggugccaacuugggccugagagggagggguggucagggagauguguacagggaacaccaacugaaggccccggucccccaagggaggacagcuugugagggcucaccgaaggaacacaggagaagucuagccgaggauuuaugcuuacccuucucuugauuaccaucaagugugaugauaacuuucggagaacuggcucuaccagugccccuuucuuuauuuguggauugagccccugaaccucacugcuguaguuuccuuuguggaaggagagauuaaagaaccuuccaaacuuccugugggucaagaugccaucaggaggaaaggagcuggugugggaaagcccagcccaaucccagcuaugagagcagugucugguuguggaacucuggcacacacccuucuguggaccccacggucaugcugaguucugcauuacuccacaugucccagagcuuccugccucauucucaugucucggauagccucaugggagggcuccagcagagcuuugagucuugugcagccugcccuugauucugggcuccaguugcaugccuuguucccacuggcucucccaugcuaaaaauuagauauuuuuugaaaaauugaaaauaucaacauguuguuauaaaauuaggcacuuuuuugccuaagcuacucucaccacacuccuaaaucuuagguucaaacuagguaguugucucaauuuugcugaaauaguccauuggcuccuggccaauccugcugacuucuccaaguacuuccuggaugccucuggggcacacauugcugcaguccaggagcugaagccagucaguaggcccugggacagccaaggagggugcaucacaugugcccucaggcagggagugggaauccucccaguuuacagcaauauuuugccagauaagcugacacaggcuucaagaaaucaccuuuuccccuuggaacaaaugggggcauaugccuggaucaucuucucuuacucccuugugccagucuaugacaccacuguuuuuuguuuuuugcuuuucugagacagggucucugucacucaugcuggaauacaguggcgccaucagccucaaccuccccagcucaagcgaucuuccuaccucagccuccugaguagguggaaccacaggcaugcaccaccaugcccagcugauuuuaaaguuuuuuauagagauggggucugcauguguugcccaggcuggucucaaacucuugggcucaagcaauccuucugccucagccucccaaagugcuaggauuacaggcaugagccaccacaccuggccauuuuuuaaaauagauacauaauaguuguacauauuugggggcacauaugauauuuugauacauucaugcaguguguaaugaucaaauuaagguaauugggguaucuaucaccucaaacauuugucuuuucuuuauauuaggagcauuccaguucuucuagcuacuuugaacuauacaauacauuauuguuaacuauauagucagccuacuguacguuagaacacuagaucuuauuccuucugucuaacucuguaacaauuaaccaaccucucuuuaucccaucccccugcccaccagccuuugguaaccaccaauccacucucuaccuccaugagacccacuuccccacauuugagugagaacauaugguauuugucuucuggugcuuggcuaauuucacuuaacauaauggccucuaguuccauccaugaugcugcagaugacaagauuucauucuuuuuuauggcugaauaguauuccauugaguacauauagcacauuuucuuuauucauuuaucucucaguggguacuuagguugauuccauaucuuggcuguugugaauagugcugcaguaaacauggaagugcagauaucuguuugauauacugauuuccuuucuuuuggguauauacccagcagugggauugcugggucauauaguacuucuauuuuuacuuuuuugaggaaccuccauacuguuuuccauaggagccguaucaaucuaaauucccaccaacaguguacuagcauuccccuuucuccacauccucaccaguauccauuacuuuuugucuuuuugauuaaagccauuuuaacuagggugaggugguaacucauugucguuuggauuugcauuucccugaugauucguaaaguugagcauuuuuucauauaccugauggccauuugugugcuuccuuuagagaaauuuauucaggucuuuugcccauuauucaucagauuauuuauguguuuuuguuuguuuguuuguuuuuugcuauuaaguugaguuccuuauacagucugguuauuaaucccuugucagauggauagccugcaaauauuuucuagucaccacuguuuucuggcuuguagcaugugcucaggaacuacuuguugagugcucugugaagacaaaaauauuuugauguccaugaccaccugacacauggggaaggccuggaggaaggcaugggaaacccagagcacagaccuggguucagguccaggccaacagcugacucccuuguguguucuugguccuguucagcucuaugagcuuuacuucccucagcccuaacaugaggauuauaaguaauaccugcuccucagagaugaccacguauuucauaaaccuuagccuucuucuucguugcuuucauagaguuacugugaggauuaaaucagaaaaggcaaaaaugucaggagcaccucgugcacucuugaggugugauccaaguccuggggugguuccuguguguccugauuguggcccugacuuuggcucugccccuuucccagcauguaagcccuguggcuuucuuugguuuggggucugggccugggcagggguuuucuuccccaggugauguucacuggugguagucagcuccccggcagagcagacccccagcuuggaaaaggagcauguguucuucccaagucugggugugcuagaacuggccuagagauucuggaacagcuguucuggccaccuccccagcugccuuucucuuugucccagaauuucccccaucuuaacuucuuucuuucaucucccauucuugacuccagcacuguaagcaggaaucuggccuuuuaucucauucuuggaucuugauaggcuggaaugaugguaaaaagccaaugcgggccaggcgagguggcucacgccuguaaucgcagcacuuagggaggcugagguggguggaucacgaggucaagagaucgaggccaacauggugaaacccugucucuacuaaaaauacaaaaauuagcuaggcgugguggcacgcaccuguagucccagcuacucaggaggcugaggcaggagaaucacuccagcuuggugacagagcaagacucugucugaaaaaaaaaaaaaaaaaaaaaggccagugugaugaaauauacuauuaauauauuauuaauggcaaucauguuaguuuucuauuuuuauuucuguucccauggcuucuacaauaaauuaccacuaaguuuuugguaccacuaauuuaguagcuuaaaacaacacauacauauguauagacuaugugcauugaagaaauaauccuaaugcaauaugaaaaauaaaacuuucauaccuuucaguaccuuuuucccagaaguuugacaauuugaaaauuuacucuuccagauaauuccugugcauguauaagcauaaauagauacuuaguguuuuuuaaacaaguaggacuauacugugcuuauuguucuaugcuuggguauuuuuuuuugcauguuucuugcauaugccuaaauuauuuuaucuuauugucuauuuaagcugauuucagguuuuuguacuugaucauuauaguuaaauagggauaaauguaaaauucuuuauccucaaacaagcuccaucgauggagaagaaccuaucagcacaagugguaaugugguuauuugcacucuccagcuccaggcuagagcaugugauaugugcaauguuccguccugggggggucaugcuuuaaaggggucuuugcugaguugaagcagccagugaagccguggagacuugccagugguggugaaagguuacauaacugggaggccccgcagcugcacccaugcagcuccuccggugugcacgcuuguuccagcucuuccuuuuaccugggcagcuccuacccauauguaaaaaggcuugguguacaucucacuuccccugugaagccugaucaugccuaggcugugaaccucuccugggccuggggcucugcacaugggcgggacacagggugggcugcagaacugaaauguggugaaccggucagggacuuuacuggugcaagucacagaaagucuaacuggcccucaguaagugguucccaggaggccaucaggaugucaaggggaggcagguguuggacuccaggccugcuaaacguacucucagagacucagaacuguucacccccuaccuguccaguguccuccuuaggcaccucuuccuucuguccuuuucccuaguggcaacuuuguuucucuccuggagcuguggaguuacucuugacagacuggaggggagaaguccugaggggugagccugggaauggggcaggaggaaagagacuggugugcagaagggacuuacacaugucgcaacauuuaaugaggagggguagagcagcaguuccugggagaaagaacucccauggggggcaggaaaugaggcucaguggaagaccccacugggaagcuggcaggcagaccaguguggucaggccaugcagaagggaccuggggggcuacucaaaguuaccuaauggagugaagaugaauuuuucucauugaaguggaaaaacugcugauuuuuaucagggcaaguugguuagaguguuaguuaaaccaucugucaaagcucauuuaguugucaaaauuaaaucauuuuccuccacuuccuaguggauugguuauaaugauaacuuucuuggcaugacauuuaucaucuugguccaaaggcagucggggguauggggcugggaagagggcaggaauguaaugcauagagugauacgccuguuccuuuugugguagaaagaugcuauuuuaauacuguuuaauuuuuauuaucacuuauaauauuagugugcauuuugcuguaacugcaccugguuucaaagcaggacaaaacccauggccauauuaauaaaggagggugaagggaagagcuggguuagugccccuugucuggugcuucagaugguaggagagguugauccugcaggccgacugauuuaaugcccugauuuccagcuuagguuucauaugccagucauaaaguguaagaaauaaauauccuaaaacaauuauuuuuuuaaaaaaguuuggcuuauaagcaaaauaucuaaaaacauuucuaauuuuuauacagaagaggaaaaaauaaucagauaaucauugauuuuguuuuuuguuuuuuuuugggggagguaaguuauauauaugguugggaaauucuaacagcacgaaaguuacaaaaugaagaguaggagccucuccuccucuaucccaaacccauucuuuauaaccauuauuaacaauuuuucugaauuuucccagaaacaauuuuaugcauauacucacguauauaaguguauaaagcuauuuuaaaaauuauacucacaagaaaugguuguuuuauuauugugaucuuacaaauauuucucagcauguauauuuacaucugucucacuucaguguuucauaaauacccuguuauauggcuguaccauauuauuuaaccaguauuuuagugccauugauggacuguugccuuuuaaaaaaaauuacaguugaugcugcauaaacaucccauuguauguaacuugauggacuuguaugaguauauccauggguaaauccuuaaaaauugugauuacugcaucaaaugauauauugcuuugcauuuuuuuaaacauuauuauuauuauuacuauuauuauuuuguagagacggaggucucacuuuuuuguccaggcuagucucaaacuccuggacaacaggagcaauccucccgucuaccaaaguguugggauuauaggcaugacccacugcaccugaccgcuuugcauuuauaauguugauaaauauugccuaauuucccuccagaaaggugguaucaaguuacauuccuacaacaguaugugagauggcccacguccccagacuucuucccaaauuaaggaucaucagucauuucaauuuuuaccugaccugauaggugaaacaagguaguauuuccuugcuacuccauuugcauuuaauuuuugaaugagguuaucuuugcauauguuuauuguccauuugcauuucauugucuauaaauuaccuguuuauggucuuugcccauuuuuauacuaggcuguuucuuucuuauuaauuaauauaaauucugugagugaggaaaugagcucugugucaguugugugguaaauaacuacuguaccuucucucauuaaacuuuugacuugguuuuuuuuauccauuuagaaguuuuacauacuuacagagacuaauuugucauucuuuuaugaccucuguguuuucuguccugcuuaaacuggccuccaagauuauaaauucacccauacguucuucugaaauuguuuucauucuuucauucuuuugcauguagccuaccuuuauuuugacacaaggagaaagcacaguaucuaacuuuauuuucccauguuaacuaguagcaccagcaccacuuguugguaauccuucuuuuacucccgauuuaaaaugcuaccuuuguuaagaauuuaaguccaucucugagcuuuuuuuauuguugucuuauugaucuguucacauuuuuucuuccaugccaguguuucuuuucuuuuugauucuuacaguuucauaauagguuuuuuuuuuuuuucuggaaaggcuagucccugccucucaacccucccuauuucuccuuuuguuuuuucugagugucuguagcuacuggugcauuuuucagaugaacuuuaauauuacuuuuaauugccaaaaaauaauuuuugguauuauaauuugaauugaguugaauauagauguaauauaaagagaguuuacaucauuauaauaucuaauuuuccugagagcauugucuuucuuuccacuuacuuagaguuucugaguuuuuuucaaauagauccuguacauuucuuaaguuuauauuuaggcauuuugguugcuauuauuaaugugauuuuuauuuucguuauaauuuaaaauuuuucuuuguuuagaauagcuguugauuuuaaaauauaauccuguaacccgccaccuucccaaaacagacuucgguauuguuuuuauugucuuuuccguugauucucuugaguuuucuagguauauaauuauaucauuggcaaacagugacaauuuccauucuuccuuuuaaauguuuagaccuucaauuuuauuugcuuaucuuauuacauugcuuaguaguucuagaacaauguuaaauggcaggcaucuuuucguuguuuguaauuuuuuuuuuuuuucccucaagacagggucucacucugucacccagacuggaaugcaauggugcguucagggcucacugaagccuugaccucccaggcucagaugauccucccaccucagcuucucaaguagcuggggccacaggcguguaccaccacaccuggcuaauuuuuguauuuuuuguagaaacaagguuucaccauguugcccaagcuggucucgaacuccugagcucaagugacccaccuggcuugaccuccaaaagugcuggaauugcaggcaugagccaccaugccagccuguuguuuguaauuuuaaugagaauguggugaguguuuuaucauuaaguaaggugauggcuuuucgaucucauuuaucuuuucucucaucauaaggaaauacucauuuauuuuuauuuuuuuaaaucaaggauuauuuuuaauuuuggaaaaaucuucauggcguauuuuggagugauuuaugguuuuugucuuuugaccuuuuacuaugcuguuauauuaauauguuuucuaguauugcauucuggaagguauccuacuuaguuguauucuggucuuucaauaauauuuauauuauucuuucaguaauauuuaugucauaauugaaaugucugguuggcaauuuuugucaugucaagucuugguauuaguaugcuagccucacaaaaaggauuuggaagguuuucuccuuuauucuuuuuaaacaguuaaaauaguuaucuauuccuuagaagauugaagaaauuugucucucaaaccaucugaauuugauacuuuuuggggguagcacuuuaauaacuuaaacuguuuuccuuuguauuauuagucuuuuguuucagucucugccagggauaauuuugacauaacauuuuccuagaaaauuaucuauuaaguuauaucuucaaauucauuuguaucuaguuuugcaaaguaaacuuucuuauauguaguaauuuucuuuuuuaaaauuucuaacuuuguguauuugggcuuuacugguuuuuaagaacuugcaauugcauuuaucuaucaauucuauuauuccauauuuucuaauagaauaauuugugcuuuuaucuuugcuauguauuucuuucauuggguaauuugucuuuuugcuaguuucuugacuuaaagacuaaauacauugaucauauaauaguuaccuagguguuuaagguugugaauguccuuugagcuugugaauguccuuugagcaccguuuuaguugcauuccacuguauguuacuuucuagauauccugcaacuucucuuuugcauccuucuuuaacucgaguuauuuaaugagaaaaucgucucauuuccaaguuguuugguuuuuuuccccucuuuguuuugucaugcauuuaaaguuuuuauugcacugugaagggagaauauggucugugucaugucagcuguuuggaguuuauugaguuuuccuuguggccuaauauaugauuuuguaaaugauccaacggcuuuuaaaaagaagaguuauucuguuauaagaauauaaaguuugagauaaaccccccaccuuauaauauaggucuuaguucaaacuaaucacuuauuuuauaaauuguuuguuuuugcauugccuacaauuugugcuuuacaaauuuuguugcucugccuuuugauauauaaauauuuacuauucauauccucacuguaaauuaagcccuucauuaaccauuaguggccccuuugacucauuuaaccuccucugccuagaauucaggcuuguuagauuuaaauuuggcaauccaguuuucuauuuguuaacguaaucuaucuuuuuuuuacuuuucaccuuucugagucauuuuguuuuagaugugauucuuguuuacaauauauaguagcuuuuuaaaaucaaaaucauuuuuaaaaguucuaaaaaaacuuuuugaaccucaguuuccccaucuguaaaauggguaguugaaaguaccuauuggauaagauaagauuugugcuacucacuuuacauauaucuucucauuuaauucacguaaagcuauccuuucaagguacuucuuauauuuuuugucagaugagaaaacugacuuaggaaggugacuuuuccaaggucacucaauugcuaauugguugagcugugauucauccccaauccaaggcuuucuaaauucuaaaaucuuucuacuuagcccauacggcagcaucgcaccaugggugaaaccccaggucacccugcgugaaaugguuccuagcuuuuaagacaaguuguagcaagcaggguaaccugguaacuaggcucacuuuuggacuuaauuggaaccagacugcagggggcucaagggucaggcuagcagucuucucaccaguacguccuaccugccccaccuucccagaaugagagcagcucugcugcuggguguggggccuggccacacauggggccuugccugccccugcccucuccaagcuuuucccaaggcuggcaggcacccucugagcacuguuucuagccucagcuccaugugacagucagagacagcagauggagccaaagacuuggagaaaaaugacacccaguucagaguccauguucccuggggcccagaccccaguguugaauguggaggaaagggcuugguuuauuguuggggguggagauuagcaggggcuuuucuuguacccucucccuguggugauuaugucuagguaucagugaggaagagggacccagcggggcccagcuagcaugaaaacuuccuggaaguuaaggccuggcucccacagggugccugaugagccuuuauaaaauaucuagaggcauacccuauguccacuuggucucuauuccuccaggccugugguuccaguagggguucagcgaauauuggcuggaugaacugggcaaaguauugacugagcugcuuuauucgcaacaagaacagacaggaaaguguauuuagacugacuccugcagcaucuggcacugggcauuaagagaaauagugcucagccugugcacacauugggcaggguaucaguccagcugcaauacuuucaccugugugaguggggccaucacuaagucuccuagggucuucucuguaaaguggagaugaugcugacuguggaguuggcccugaccuugugccauuuucaaggaugaugaagaugcuuuugauugugcgcucucccuguaggccucuccugggcuuuguggcaggcgagagcacaugcuuguuggagcucugugaggcccaggcagugccugguucccuggggucaccugggcauaacagugcccaucuugucaguugaacuguguggcuaagggugaaagacuaaguaguuggaacucacggcaacuugcacacaugcucugcgcccacaguuaaguauaguuggaaaaguggugcucucagcagugaccucagucucugucauucagacccaggagugggucucagaagaggcuggaggccaagcuuggccguagcucugcucuuauuauaugaugcccaguggcccagguuccugaccacucagacuggaagagccaagucauccuggcaggggccaaggcucugaccucaguccuucuuggugccagcuuagugugugugccaggcuggauuggaugugucaggggagggggaauugggagaagacauagcuuuccuugaguaccuacugugugccacgugcugagcuaggcucuccaaguacuaauuucugauccucucaggaaucuuccaaagcugggacucuuauccccucuuugcagcuggaaaaacugaagccaaaugccauuuaaucgcacagcuauugagugagaaccaguaagccagucccccaaaaccuaagcuuuaccccucaugccaauagcuuuuaaacauuuuuagcuaaagaacuugaauaucaaauuuuaugaagaauccccacaaauacaaccuauagaaagggagccagucuggcugaaaugcaaaugggugacuugggcccuucuguuccugccccuccucacaccuauggcagccccaggacucccugggaacacaaggcuccuuggaauccaguuuggaaauggguccugugcccuagaaccauggaugggagagcucaagacaccgccccugcugucugcaggugcauagagccggagcuuuagcuuccccgucugugaaauggagcugcugaucccugucuugcagccugcuaaagagaguccgugagguguguuuguuuuguuuuguguuuuguucuuuugaacugaaaauugagguguuucaacuaugguugagaaccuacuggcugccagauagucaacuagguguuuguacgcaugaucucauucggaaagacugccuucgcccaugagcaagagugugaaagugaagguuuauuuguucacgagagggugauggaacagcuugucacaaacuguaaguguaguccuggcacauggcuuggagaggaccugaauuccgguggguggcuguggaaguggagaggaagagcugacagagacucugcccugaacagcugucagcaccugguggagacugagcaggugcaaagagggcagaggggaggcgauagcugagagagggccagcuggcguuuggaguuagaggaagaaaugggaaaggaggaagccuagagcaggaaaaucaaggauaauguccuuucuggaugagaggggucagcgcacagaggcuagagagaagagagaggccccugcugcugucugcugaacgcuuacuggggccauguacauaaccaguguacccaaugaguaggaccuaagccuuuauuuucagauggggaaacugagguucaaaggagaaacuuuuaccaguaaguaaaagaccaucgguucuggccauaagucauggugacuuuagcugugaagauucaaauuagaggaugcuggcagagggugaaagcaagcugagaaaggcuaaugccuagggagugaggcauaagucagaaucacuugggaguuuugugcccagccagagaaaccccuacuccuucagguguggagcuucuggaaacucuucucuacucaagaagggcagaggugcuuugcaggaagggccuggacacaccgauucuuggcgcccacucuggggccucagaguuccccacucuccugaccuagccuggcuuggccugcugaggugcuggaugccacacucugugaucuuauucaaaugucagcuuuuccuagcauuaacauccauugacccauuuaaaauagacacacuuggagaaggaaaucaaaaagcaaaacaaaggagcaguugcuuuuccaaucacauacaccuugugcagcuuaaugaagucauaacagaaccaaaggcaggugcgguaucugugcuuuucagggagaaaagcaggugucaccauuaucaucuggaugcccuuuggccacagcauuuuuagaccaucugaggcacugccaagaauauuccuguggcuuagugaugagccuuuuggcaagguuaggaaauuagaacucaccuuaguuguguauuuaauuaaggguagggagaaagucacaggauuuccuuuuucucuccuuucccucuggaagcaaggggccacauacaaccaucuccgcaucuuucagcuuugacugcuccugccccguaaucuugacuccuggagguuguggcuuuuacucacucucuuaguuuggcuucuugagaguuucuaaaauuguacaaggucauagccaagagauugccucuuagcaaccucgugccaguggccuugcgccuauccccuggucucccacacuuacaggaggcccacagagagagucaugcugcuguuuucuuuguaggcacacaacagaacaguguuuuccaaccuuuuccucauaaucacuguacagauagacuguaucaugacccaaugcacaugcagguggagaaagugaaaggcuuuacaaaauaguauccuuaccuccugacuuccauugcauugcauucuacuccaauuuuuuauuuuccuuuucacuugaaaaccacuggucuuaaugcacugcauugccaccucaguuuggaaaccugcaguagugcucaggcucuggaggucaggccccugugcucugcugccccacccugcccaccuggcaagcaggucuggaggccucugucccucagcuggucucagcaguacuggcugcaggugacuauuacaguggcaguggcuggggaggccuucuauugaugcaacauucuguguggggaaaggcccacuugauaaaacuguuugguuuuacuuaaaaggaguguaggugaggaaacaaacuacacaacaaugugaaugaacuggaaaaguaagaaaagauaaugcaggugauauccuucuaagaaaauuuuuaaaauuaaaauucagauuuagaccaauguguuuuagaaaaggacuaaccaugagauucccucuaauugcauggucuccucauucauugaaaauguaguuauuuuuacagaaaucugaccuuucugcaauuuucaacuguggacccaugugaaguguaacuaauucuccuuucacagcauucaccuuccucuucgguaaugcugagccccauucugggucugccauuuuacuacagaggagagaauuugaaagguggucagaagaagcauggacauguuaaauguuuggaaaccagauuccuguagggaaggagggaaggauuuuagcuccacaguuguguucugagugccagcuaauggggcuagcccucuacgucccacuaaaagccugcauggucccgugaccuucagggcacagcuccaaacuugaaguguguggcuggcagccugucuuccucugcagccaugcauggggagcuucaggcccacggagcuaguuugguucccuguccagcagcugccuuguccuuucaggcuucgguagcacucuuucuuuugugaccuggggccaaggacuucaccuuucugugccuccaucucuuuucagaguguuucugagcauacauugauuauucaugugcuuggagugggcacucaggaguguuccuuguuguuuugcaagggacgcccuuuccagcccugaccauuugaaacacucuuagaaauauuucaaaauccagcucuuacgucccaccucuuccugggagcugcaucuguccugaggauggaguugagcucugcuccuuaucauagcccagucaccccucuucccgcuugacucugugcugcuuaagagaaggcucccaaccucucuauguuggaauccccagcaccuaguaccgugccuggcccacagucagugcucaucaaugcugauuugucccugaauucacaugagggauaagaaaagcuucaucccauuuccaccucugauggauuggcuguaccgucaagaguuccauguugagaagauucugagacagaacuugagaaagggaaagaccccacuauguggcagauacaaagccaagcauuuuacaugccuuuucuucugauuuaacccuagacaacccugugaaguagggacuguuaucaucucucucugagaugagagaaccagagcuccugaguuacacagaagugggcagugcugggucucagacaggcaggguccccgcugcugccccaagcaccuggaccuaggccagcucucucuccuggaguuuugguccuguccaacugcuggcuacuuccaugcgcagaggauggaguagcgggaucccaccgccuuugugucaccagacugcgcuggaauaggggagccuuuguuuggugugggcacccaccgggguucagaauaccaguguuuagaagaggcuccgccuucacccuccaaggaaggacagaggcguccaugguuguugaaaagcggaauguucccgcuaaugagaaacaguugagagaugggugggccaccauccuuguggcaggcccuguguccugaccugcuugucaagguacagaugacaggcagggcuacagcagguguggcuuccucuagcuggauuggcaaagggaccugggccaggcuguggggaggagggagaaggcccucugcaauuuuucuuuucucuucccuuuucuuuuccuuaaccauuuagcuguaucuuuuaguaaaagaauacccagaagacaguuuuucugcauuaccauauauagaaaauucuaaacuucuagaaagagauaguucccugggaagauggucugguuugagggugagcauuaacuuuggacucauacagcccuugguuaaagucuaggguuaccauuucuuggcggugugaacuuggucaagucaaguagccuccguaggucucagcccccuugucuguaaguuauuuccaugccauagcauugugaugaggaugaccaugggaagcaccugggauguuguagaaucuggguagaaacugguuuuuccuauuccugccagcucuuggaaaaggcuacauccuggcucucccagccaguugauagugugccucucccugaaagagaaauugaugucuccugccaacauccaauugggggaguccaggaaaagggcaguugucuggguaaccauuugugaaagccaaggacagggcaaaauggagaugcaaggaaggguuuauccuccuggcaacaggguugcacucauguuucuggucgaugcagcuuugugcuucuugccuuuccaugccaugugggagccacggguggcauguugcauucaguuagugaccaggcugcaucuucagagcccaggcaucccugucaccaucuaagcuaguuggucagccagccaggucuggcagguaggccucccacucccagagucuauggaugccacacccaggacucaggcaugaggagguccacuuugggaaccugacuucaccgcugccugguaacggggcuuuggcaagucaggcucuuggcaucuccauuuuuaacagggcacuuguaaccaggacauccucaugagcacagcagagaacuguucccgggcucucaugagaugugugagaaggccccucauguggacauauaugaauguagcacauuuuuguuaguuuacuuugaaaagguaauacuggcagaugguuaaaaaggcaaaagaugccaagguuaugcagugauuagaguuaagucucccugacaacccccugucuugggucccuggucucucccuccuaggcagccacugcugcugccauucuggugauaaccucugcauguggaagcuuauguaucucccccuguuucuuacaccaggcccuacccagugugcuaccccuugcuuuuaucuccuccacucuagaugcaagaugguucuacaucuguacauguggaugucuguuuagccucugccuaggaaucuaccguaaggacaugcugcucucucucucccucucauugaggcauagaguaguuguuuggagagcacguuaaccaacuguugguaagaacagcuguguguauccugucugcuuugagguuucaguggcucaauguccuugagagcaguuuuuagggaguuauccagaaaauguuuagcaaauaaggaacucuuucuuuuuucucucuggugcaggauuucugaagcucaacauuguugacauuuuauuuuauuauuuuauuuauauuuauuuuauuuuuugagacagagucuuacuccaucacccaggcuggagugccaugguggaaucucugcucacugcaaccuccgccucccagguucaagcuauucuugugccuaagccuccugauuaguugggauuacaggugugcaccaccacaccuggcucauuuuugucguuuuuguagagauaggguuuugccauguuggccaggcuggucuugaacuccuggccucaagugauccuuccaccugugccucccaaaguguugguauuacaggcaucagccauugcucccagccuguugacauuuuucuaccugauaauuuuuugcuaugaaggcuguccugggcauuguaggauguuuagaaacaucccugucuguacccaguagauaucuauaacacccccacccaccaugugacgaccaaaaauguauccagguccagacauugccaacuuucccagaggugggggagucaccccagguugagaaccacugcuccagugggauuuggaagagcugagcagugcugugcacaaauguguagcucuggaguuuaguccuggggcagaccuguagcugagaaggcagggaugggggucgccuggagccaucaacauccacaccaccugcucuucagggcugcuuccuaaugugccuuugggaagccaaugucucucccuaacacacacacaggagcccacacuuacaucaaagaggcaauagagugugguguauuauggcuggguugugaagccagacuuaucaaugcuaccacuuccuugcuaugugacuugggauaagauauuuaugucugcuggaacuuaauuuucucagcaguaaagugggggauaauaagaguaccugccucauugguaguggagauuaauggguuaaugcauguaaagcacuuaggcccagggugagguaugugauaugugcuccaugcaugucagauaucacuauuauuaucagcagaaaaauaaaaugacugcugagcccucucugugagccaggaucuuugaauugaugaccacaguugaguuugcuuguaaucaugggcaguaggacccuccaugccuuuauacucaggaaauggaggcugagagagaguaaggcccuugcucaaggccacacggccaauaagauguauugagcagagccugugcccgagggccaugcugaggcugcuauggccucugccagaagccagggccugagcuccuggggaggcccaggagggagggagggagucuaccauugguaccuuguguuguagccaauuaguuauuugucagaagccauccuugggcuugaagucccugcacacugucagugguauggaguguaaagcuccauuucuugaaaacugcauacucgucagggccaguggugucaccuuggcaggguuuauaaggaaagaaauuggccauaauucuagugauaacuuuuauaugaauuuccuuuauuucaccuuccuaugcuauauguuauacauuuguauaguggagaucacuauguuuaauuguuacuaaauauaaugucacuauuucugaugcauucugguaccacuguuucauauguccucauaucuuugaaaguucuuagcuuguugccauuuuauugguugcauaauauuaaauguuuucuuaauuauuaugcaaguaguacgugaaauauauuuuuauugugauauuuuaugcauugccagaaaagaccaaguccuuuugaucacccuucuaauucuagucuguggcgcagagguauugcugcuuguuuguggauuuauuuuucaaagagcgugguauuuauucaguuauaauagaaauacaugcuuguugugaauaauuaauucacuaucagguaaaguuaaaguuuccuaaaauucuacuucccagagaaagccaguguuaagagcaugcucuguguucuuucacccuuuuuuaaugcacacaaaugcaccacacccuaauauacacacuuaggaauaaaaagcacaacaggcuucugucauaggcauuguuuguuaugucaguguuuucacuuagcauguagcagaaccaucucauaccgaugccuaccgcucucccccucucuucacucacugcauccugguccacagaagagcgcuccugcacucuugccccauccccuuaugaucgacaggcacgugguuuccaguguuuuuggcuaugggaaagugugcugcacagcaucucagcaugugugaagugguuuagggcuguuucugaauuuccggaggacugucacgugggcugaagaucuggcgaccaagggcacgugggggaugaggagugagcccugagccugccuggagcucagcacagaggaccuggggcggugagccagcagcgugggguuaccgcccagcucggugccgccagcaccgugaaccggggcacagcccucccucuaugcugcucagugccaucauuuuccccucccaugacauacgacagcagggaguugagugguuuguuucaucucuucuuaagaaaaaguuaaauuuauaaucccagccccgaccuuccuuguaacucaugugcucauccuguuaacugguuuaauauauggcaccacuauuucauuaaacaacauacaggaauaauuaguucagccacgaugccucagaacaaaagcccuugauuuaguuuaacuuuauaaguugcucucuuuugaugugcaagagcacaucuggggucuuaaagaaagcagaaagaaaaauagaagacguucuggcaggcuggggguuagaguuuuccaagcagagccaguaacccuuugguaccaggccucaauagggcagcaagggccccgcagaagcagugcgugcugcuggcugggggacgacagccagcauucccaggaggucuguggcugucugcugccaggccaggagaacccguggguuuucuuccuucauacacacggugugcucacaugcagugcguccccagacuuguaagccuggccuguucuccgccccgcugcuggagcucagacgcucacucuggccuuuccuacccucagcgugugcuuggugcugcugcaugccaggcacacugugagaacuguggacaugcucagggaucagcacaagggccccucuggggcuggcguccucuuccugucauuacaguuugcuccgauuugcucugugcccagagucuuuuuccccaucaguccucuuuccacccgggcuaccacuggagucguucugaccuuuguacuucaucacuccucaccccuguguggcaucucacgguauucaucugccggcagaggagaguuccagcuccuuggccugacccucgggcuuugcacugccuggcuccugccucagcugcagccauuugugcucacguaccauucucucgccggcugcugaccaguugggcccucugcaggccucagggccuuugcccccuucagccuucugcuccagcugcuccguccauccacaggccuggcacagauguccccuccucucugagguuuccucccaguucccugccaggugguaaccaugguuccuuucucagggcucccccacccuccuugccacacuggggcagcccuugccaugugggccaugggaacugguuguuaggugacugugcacuccaggcagaggcaggauggaguugugccugguccccuguuucucuagacauggcauaguacagggcauacaacaggcucuguggacaggagcccaucuggcacaguggggagagccaggccgucagccugcccuggcccagcacuugcugguggugagacugcaugaagcuugcauggcgcccucccgugauggacugcugugaggcaagggggguuagaaaggguucagccaaugcccggaacauaguuguugcucgacuaguggcaagugcuguccuuugcaaaguuuugcugggacaacuuucucauagacuguguuccagcugguuuuuuaacugagguggacugagugacuguuuuccaucucuggcuuuugguuuccagagagccagguugugcaguggggacagauguccuggucugccagcugccagcaggcagcagccauuagcucccugucccacccguuccugcuccagcacaugaugcucuucucccugcacccuucacccaggacagcagaagguacaggacccuugguucucucuccuaauuaauggcagagacccaguuagaaauggcgggccccucccuaaccucuccacagccauuuguaaguccagcgagacugcggacugcugucccugguggcccugguugcaagcagcucccuuuguaacaaagucagugucaccuauuugccagcauggcugcccauggcaagccauucuggucuugccuggagugucacagacaguaucccacuccucuuccugaguggccguguacuaacagguaacagauggcagauguguagacgagcagcgguugaugccuggcuucgccaccgagggagcacuugggccaggcaccugcguguacagcagcuccuuauccucacaucaccugcaggaguaaggcgguuuuuaccccauuguaccaugaagacucagaggcccagagaggagaaaugacuugccgguguucaaguccuggacagggucugaaucuagguucagacagggugcaacacaugaaguuucugcccuuuuggcuccucgggaauucuucucaaccaucagaaagagaaagccuggggauuuucacaccugucccaccuggaacauguuucauguuaagugccauuccuuuccccacuguguuuuucugagguccugaccccccuccaaccccuugucccauuuucuguggcuccugacccucaaggcagaaguagcaggccagcgggcgggagccagcuuacccugccugcugccucaccaggggacagcaggcuucagaggcucuccuguaaucucucuauccacacagcccucauuuuaauuugcaaaauugaagccagaucgagagcaguaaagccagaggaugguaaauauucaugccucagugagcgaggguggcuccauuaccguucugagauugagagaauuaccugggggauuauguauauucaugggccgauuuuuauuugcgauauaacaugacucacguuggccuguguguuacagguucuacccucaacagacuuugcacaaagcguaugcccuuaagcuucugaaagucaucucaaguggauugcccaucgccuucugccuccuaggagacaggucagaauaauaagcacaccagugaccaaccagggguuuccaugcacuccucucucugccuuacaagcugugggcacuauucuuacguccaggucacagaggaggagacgaucugaaugccacaccauguucuguuuauguggcugucccugcacugugcugccauccucucgacugcagggauggugucucauucuguccugugugcccagaacauaauaggugcucaggaaauggcugccaagggaguagccccucuugcaggccugcucugcagacacgcucaguucugccgcuggccccuggcguguguacagcaccugcugcuggcagcacagguuuggcccugcugauuggcugggugucuggcuucaauaggggcaggucaguguuccuguucauaggacacuguuuacaguguccugccucggugcacagcaggagucagcgcacugcagccugccaccuguuuugauaaauaaagcacugcaauggcagagucaaguaguugcaacagagguuguguggccuccaaagccuaaacugcuuacugucaccuucuccaggagagcuuguugcccccuggcuuguaggcuucaagggcacuggggcagagcgccacuccucugagucuuuucuugaugccagugcagcacacagcuuaucucuuuuacuuucauugucaccauaauccaaaugaaguugggaugcucaucuccauuuuauugaugauaaaauaguagcaguaguaguuuuaaucgcuaauuuauauugaacaacuucuaauuuuuaaagauaccaugcuaaucauuucacguggauuaucucaauguaaccucacaaaugcccaauuaguuagguacauuuuccauuuaagggaacuuagagaggugacaucccuggccuggggucacguagcuaauaugaaggauuugaacccaagaagucugacuugaaaaccugccuuccuaaccacuguguuaugaggagaaaagguugcuugccaucaauugcucauuuacugaacuguuguuagcacuggcagcguaccaggcccccuucuggguguggcagaugcaaagaugaauuagagugaccauucucucgaggaggucccuguaggacaaacaagcaaggcgguagccacuccaccaguguauaaguguuagaacuggcuuggcccuaugaggaagauaggagguuugcagacuccuggacgggagcuuccugggcucaugccccacuccgucacugcuggacuaguggccucuggcuagucacccaaacucugggccccaguuuggucaccuguacaaugcaggacauaacgggaccuaccucuuaggcuugcugugaggauugaguagguuaauccaugugagcuuauagaacacugcccagugcugaugaccugaguggagguggcgacaaaggcagggauggcacaaauaugugugggaggcccugggggugccaggcagccuuggaaggcugcugagaggcaguggagcuucagagagacugggagaggcagggucaggcaggccaaggugggagacaggugggaagcucugggggagagugcugugcucccgggaugggcuggggcaaggagcugagccagggcccugucagagcuggcuuggaacuggcuuucugcuuguguguuuucagauuuauaauugcucucaugugccaggcuuacauuuucugagagggaagaagagcugccccagcugcugccaaguucugccuccaugagcuggcccucagggggcagccacaguggguggagagggggaaggacccaggcaaggauuuuaugaccugucccucucccuuccuguucaggccucugucccaggcuucacucccccaggacagucucugggcagaccacauggggugcauccugcuagcuaggacacuguccugacaggcuggaggggccccugcugccugcccaggccacggcacuccuagccuuucacuaugggcgcccgccugucccugcacuggcuuuccccugccuacugugccccucauccaccuuccacccaggaagggccuucccaggagcauguauuccauucaguaagauaaggugccagcacugggcugccugcugggucugcacugguggcccauccuugccccgauggaauguccagugccauguggaagacagacuuuaaacaacagugggcccugucaccacaaguggugaggcugaccugaggagcagccucugugagaagacagcagggguuuagaggagacuggggagccucccgaggcagugagcugggagcugaagauguccagauuggcagugaggggagaagcagugagugagggccagcgugggggagcagcagugcucguucacacagcagcaccgcuccucucuguccccucacugaguuuccauccugguacucuagggcuacuuugccuuuccccaggcugguaccccucuauagcaggagcaguuuccccaugaauugagaauccccagugcccagcuuggggcacaugugucaaggaaggagcuugcauuugucucuccuggggcuguugccaugacggcccguccagguucaaaucccagcucugccaccugcuggcugggugauggcaggcaagugacugaagccagcaugccugcgccuacuugcccugcagcuuguggagggaccgugucccuaccugggagccccucaguguggugcccacauggggcaagugcucagucaauguuaguugcugucauuacugcugccgacaucaucaucacggucaucacaauugucaccaacucccuccagggaaaguguugcucccaaaggaagcaaggcugacagccuggugggguuucgaggcuuuacucuugggccuugagaaccuaaagacacuaaaggccacucaucagcuuccuguggcauccguggccugaaugggcccaccuuagcccaaagucccauccguuaaugcauugccagaacaugugagauugugagccguucagacaugagaguagcggcugagcugauggggcagagacucagaguggcccuuaaugguuggucaccuucccugggcccuuuaaggcuuuggauccagagcaggaggugccacaggggcagugagagcugugggagagcuggggucugcagcccgaagcacaggggugguuuggaccuugcugccaccccguccccaccuuugccccugcugguccucuggucuuucuuugcuugacugacauccagcugucacuuuguuaggaaguacccucugacucugcagauuggugggggcugcuuuucuaccccaccccggggcagaguauuuccuggcauuuucccauucagaguauuugcuuaacauguuuaaaguauuuccauuaaccuuagcuacaacugauaaaguuuuaagauauuuaauauugacaccccaaccucaggguaaugacuucugaaugcaugacagcuuuugggaagagcugucacauaagugguguauacugguuucugcacuuagggguaguucacauacuuaguuagcuaaaucucuccagauaaccaggaaaacacuugucagcccugagcuuugcuuguaccuuuggagggaucucuugcauaugggaaaugggaacugcuggcagaagccgagccuccuuuugaguccaucugguuacccaaguucuuggagccguuuucuccaggcggauucccugagggucagacacaguggaacgaagggauccuccuugggcugugguggagcccaugccauucugucggcucuggcccggaacugaccuuuguuauuugaagugcuggaaacagcauaccucacuucacaggugcagugcuucccugcccucccagcccuagucuuuuaauuucacucugucaauccuaacacgaauuacucuuaccugaguguuaggugcugugcuuggccuugacuucucgccauagccccacggguguuauuauccccuuuuuacuaacaagggaacugggguaaagagcccaaaguuggccagccaggaggcaguagaaccagccagcaugauucguuccagagcuggagcacuuccuccccugaaggagccagcccccagggcagaucauggagaguaaacaugacccuggaaaaucacuugggcggcugccauguugaaugccagcccauccucucaguagggucagccuguguuggagcagccugguguuccuucagcagagugaggaugcaggaucagaagguacagguguaucucugagucugagcgccucccccccuguggcaggggcucccucagcugaggcuugcugcagaaaccagaccguugaaggggcggugggcuccccacuggccuccaucugcucuggggaaggaggcacguguagccauggacacggaccucucacggccugggucccucagcugaauucauccucaccuugcauacucuuuggucuggggcugggaguggggugaaugcuaucaugugccccagggcugaaugccgaagggccagcaguugaguuuucuacagugucaguuuucccaagggcaguuaauuccaaaccucacuuuuauguuaaaacaaacaugaaucuauuaugacauagaaugcaaaguuuccaugaaucuuaaaguccaaaacuugguauuucaaagaauuucugugcuucuagcagucagcuucagggauuuauucuccucugccauggaguggggggcuucucugugggaaagagaaacacaucaugcugucuuucaggacuuccuggcccuccauguguuggggugucagcacacuguuugcacuugaggauuccaggucccauggaaaauacagauuucaggugguucaaugaaugccuuacuccauggaguuacuaagcgcuuucccugagagaucccagggaggagagagagagauccaggaggggaaaguugcucuuuuauuuucugauagccaacuuccaacccauuccauccugcacgacagaagagugcacuuucuaccagcugcucugcccgccuguggggcacaguuguaggccuagggcuuugcauggucuggcuguaccaggcccucaauucuuuuugguggaguuaauuccaggugauuuguuugaguuuaagauugagacacugaauguuuccuuaaaguuuuaaauaugcuaauacuaaaggcuaaacuuggaaaaugaaaaagaagaaauagaaaaauagagaggagaaaaacauccuuagcacaggguaaccuuccuguugcuguugccagaccucaaacucaaggcugccucuccgucccagacagacuguaccuugaccucuauuucaugguuagaaagaagcuucauaacaaagagagauaacggccaguccgugcacuuguucuucacacaggcagggcaggcccccaacaucccucgcuggccuacucucugccugaaggugggaugcaucaucccagaguggaccuggagcccagagcugucacugcuccccgugccauacagucugugcagacccagccaggcuuuuguuccuggggaagggggaagggggaagugaucucccuguugagccuugcugaggacauccaaguugucuuuugugacagcuuccucacuuugcuccagauuuggacccaagccucugugccucaggcccagccauugcuguggccaaaugagcucccacuucagucaggccuugcugggcuugggucugaguuucaccauuuaccagcugaggggccuugggcaggcuacugacucucaguuuccucaggugucaggugguggugagguuggagagaguggucucaggugcccuguagaaggccuguucugcagcaggcucuccgggaagauguuugcacggggaggaauuccuaagagucuuugcagccucaggagccaggcacaacaccgagcuacaaccuggugggauggucuuucucuuuuaguuuagguauuucuuuuugaaccuuuucuucauguaugaaagcaaugugugauuacuuuagacauuuuuguggaguauaaagaaacugggaaaaaaaaccucccccuuaacuauaguuaagacuguauuuuaaauacauuuuuauaccuugauuauugguucaguauuacagagaaaacauuuuccaugcugauaaaagugcuucauauauuuuauuauguaacaccuugccugcuguuuuauuuagccauuccucuauuguuaggcagcuagauugucuccaucuuuugccuauccuaaauaaggugaauauuuuaucauacuaaggugaauauuuccagugauccaccuuugacuuuuggagaguuucccugagguggaauucuuggacaagaaauguagaaaugaugagagcauuccagaaaggcuggaccagugugaucuuguguggugcugggggagcaucuggaggggguguugagggauagaagcaugagggguuugucauugucuccagacaacugcagugaggaacagaugcuugcccccaggcaccucagaguuagggcuggugcgcucaaguuuaguacaaaauauauuggugucuucagagugccuggcuccugggcccagccuguggugcccuccugcucucuggcugcugggccaggcacugcgugaagcuuggauugcaccucacacuuuacugcauugcccuuuuuauuuuguggagaacugagagacucccaccaucucuuuugcccaccccaucuuggcaggugguacagcuguuucuguagauggagggaaaagauagucucccauccugggccaguuaccucagcaaggagcaccucgauuuucucauguggguugggcauucuggcuucucaucuuauggugguggcuuccagguguugcuggggaaggcgagacucaagccagcagugugacagacccagccaggaggcucagaagugcuucucuuccucccagcaccugaccccuccauuuccuccucucagcccagggcuggccucccccagagucugccucagaguagacugucagucuguauugaguaaacugauuggaacuggauucuauuacauuuaauugacuagaaaaucugucuuuuuauucuuaaauaguuaaguuuuaaucacacaaucaauucaugaauuuccuguagcaaaacugaaaccuuucaguuaagggaaaaggaggccuguugcaucacaucccauccuggccucucaucuagaggagauccuguuaauucuuuuggguuuaaccuuccaaacccuuguucuaugcgcugugcucacagaaaugcacagcacuguuguguaaaugugugaauguguggcaucauauucugagcaguguuugcacuuuucuggccaugccccacauggauucucagagaccuugccucaucacuacacacagagcuaccacacugccugcccccacgugugcucaucaguguggacaccucaugucacacaucgccauguccccacugauggacuuucagacugcugcccugucuuugugauuauucccugugcugcacugaccaucuucuuguguacaccugcacagcgcucuccugggagguaucaagaacucugccucagaccugcccuggcaccucccugcacuuuucccauccccccccccccaagguugucccccucucucccgaucucauuuguaugucauugucauuccagacccaauucagauguccuccucucugcugccucccucauaauacuuucauauucuaaugaaauaugaauacacaucauauucuaaauauacuuuauacaucugucuccccagugagucuggaguucggaggacaagggccauggcuucccccacaucccaaggccagcacauggccugccauggaguaggugcuacaugagcguguugaauuaaagccaguggaaggaauaagggagaugggccaugaagaaugagugcugggaaagaugugcaggaaggcauuccacauggauaaacaguagggcagaggcagggagugugcugggagaccagcccagagcucuggagagcacugcacagaugcaggaggaaggccaggggugagcaccagggcacccggagcccuggcagguuucauugaggaccuagccugacccaggcucuguacuagggaaguggccuggcaguacauggaggagggggcggcugcuaugggugucugagcaagaagugaggcccagugaccagaaagagacugugggugugaggcaggcgaacucugggauuuguuggcucgugggcuaugggaagggcgcccaugaggaaggagccaaaggcugaggcuugaaccgugaacaagggcugggggccaccacaguucacugaggacuugguacuuacaagggcucagggagacccuaggcacaugcugccuccuucaauuuucacagaaucccuguggcuaggaccugguacccuuagucuauuggugaggacacugaagucuagaaguuacagaacuugcccacagcucagagcuggagccacagcuccaaccucagugaaucuggccccaaguccagcaugcucacugcugacagugggcacccacagaagugggccaggccuaaguggggugggaggugagugcaggggugauucuggcucuaaacagaaucacagucuaacagccaucuuguggaguaaaaggagcccaugccucaagccacaugcgccguccagaugucagaaugcagguaggcaagguccaggccaugggaugagguguggggugcaaauuagaugcccuggugcaccccaggaccaaggagugggccguaagcccauugcaugccugcccuuccagcaaguuguaaggauaacaauggaaugucauaaagcucuuguaguuucuugucuguaaggcuaaaguuguaauaaacagaaauuaugagcaaaagaauaaaccuagagagaaagucaguucuuagggucaccacugcuuuacaucccuuggauuacaagggcuuuuaugccauauugguggcacauagggaacugccccucaggggguggggcuggccuccuggggcuccgagccuuguauccaguguccacugaggccccacagcaccgugccaggugagagugccucgccguuuuacagggauuaacaauguagguggcauuccuuuuucuuugauccaccucaagaaauaguggcagguugaauuuugaauuugaaaauacaucccagaccuagcagcccccuuuugcagccaccucagucccugggauuuggguuuggaauaggauacccugugucucaggaggcucgcaguggcagcucaauuggaugacugagucccagugugauccuuggcaccccgccucucacccuccuugcucacugucacagugaugauucucuuuucuucuucccuauuucuucuuaucauuacugucauggacccaaaugccuucaaccacucccccuccagcacccacggagggagagcgaggcccaggcucagcugcugggcagcuucccuggggccccugucucugcccuuggcuugcuggucauacccuugucuagccuugcugaugcucuggugccagcagccacaggccagugcuccugcaggaugugaguccaagugauguugccccugcacagcugcacuggggugcaggggaucaucaguugagugugacggacguuccugagcaugcuccucugugccagggacggagauuagugccacccagccccacccccccccacccccgcugaugcucucagucuggacaggaggcaggagcuaaaggcauggcuacauagcaaguaucggagauaaagugggggucaaguggcgggggcugugggggccaaggugggcaggcagcaugaccugcucuagcuggaguaaggcuggaaggacgaggaggggccuggcagucaggaagccagcucugcccaggcacagggcugggaggcaccaucgggccucuaggccaugaguuggacuuggcccaagcuuagggugcugagggcagugcugaggagugcucaggagccagccagauggccacaggccugugugcccauccagcagccugcccugaggggcgggagcugugggagccacacauaggagggacauggccagugcugggcuuucauaaaccuggcugaaggacaggguagccuuggaacuguggggaucuuucuguccaccuuggauccauuccuuuaagacccagacccaccugggcucuuugcucaggcccagggcccacaggugagguacuguucacugcuccauggcggugauggcuuuucuggcucagcccugaaaacagagcuggaucccuuggcuuaccucccaaggauuccuuacccccuaaaaagcccagggaugucauuaaaaacaaagucccaguuguauagaaaacagaagaauccagcauugcuguaauucauuuaaaguuuuaugggauggcaaauacuugggguggcugggaggaggagcguaaagcucccuggugaagcucccugguaggccccuugucacuuuuaugguuuuccauuguugcagugacugggagguuaaucacgaggguuuguuuguaaggucgccacagauggucaggggccuuugcugggccacaugguagaaagccagaucauucccuuccucucagagugugccccauguggcaggcacugugcugaggaucgguggugagcaaaauaaacccagccugucuaccuggggcugucugcccgauccaggaaacaacagagcgcacaggcacacacuggacagaugcuaacagguuacggggcuuaaggagcguccuggucugccuggagacucagaacagguuuugugagcuggucgggggaccccugaggucucagugagugggauucagcuggguacagggcgccacaggggugaggagagcugggcagggcagcaguguuccuguggggcuccagguaacacuagccacgcugugugcaagggccuuacugacgcuugggaauccgagcccagccugggcacaagggggcagggggcaucagugcaucuccccucuuccccgcuuccucagugcaucuccccucuucccccuuccucagugcaucuccccucuuccccauuccucagugcaucuccccucuuccccccuuccucagugcaucuccccucuuccccauuccucagugcaucuccccucuucccccuuccucagugcaucuccccucuuccccccuuccucagugcaucuccccucuucccccuuccucagugcaucuccccucuuccccccuuccucagugcaucuccccucuuccccauuccucagugcaucuccccucuuccccccuuccucagugcaucuccccucuucccccuuccucaaugcaucuccccucuucccccuuccucaaugcaucuccccucuuccccccuucucagugcaucuccccucuuccccccuuccucagugcaucuccccucuuccucagugcaucuccccucuucccccuuccucaguacaucuccccucuucuccccuuccucagugcaucuccccucuuccccccuuccucaguacaucuccccucuucccccuuccucaaugcaucucccuucuuccccccuuccucaaugcaucuccccucuuccccccuuccucagugcaucuccccucuuccaccccuuccccaaugcaucucucaucuuccccccuuccuaaaugcaucuccccucuuccucccuuccuaaaggcaucuccccucuucccuccccuuccucagugcaucuccccucuuccccacuuccucaaugcaucuccccucuucccucuccuuccucaaugcaucccccuuccuuucuccccuucuccuccaugcaucuccccuuccuaaagaguugugugugucacugagcaccuggcucacauaguggcugagguacaugcacuuugccaccccuaggaguugugggugggacaguagauguuggggagacuccagagaccccuucuaggagagacuuuuuccugguaauuggaaacugcacacuaagauagcaaugggucagcacaccuuaucuauuagacugcaaaaauuuaaaggccugcagccucaggugcuggggaggguguggggaagagguuauuucuuguacugcugguggaagcguaaccacccacuuuagagaaaaaucuacaagaucuaguaaaacugaaacugugucccacaacaccacaguuucucauccagauaucuaugcuagaaaaacccuauguauauauacaauuugauguauaaagaaauggccaccgugaaaucauucuaguaguauaaauagcaacucacauguccauuaaggguauggauaaaugacauauaaagaaauacuauacagcugucaaaaaagaauaccauauauauguuauuguauguuuuuugacagcugcauauauguguguauauauacacauguuauauacacacacauguguaugguaguauauauauguauauacacacacacaaauaugaauagaugucaccaauauauugcugcaggagggaggcaaguaguaaauuaacuacaaacauggugccacuguuuacacuaauaagucuauacaaguugaaugucccuuauccgaaaugcuugggaccagaaguguuucgauuucagauuguuuuggauuuuggaauauuagcaugauauacuuaacagguuaagcaucugaaauccagaaauccaaaauccaaagugcuccauugaguauuuuuuauuuuugagacggagucucgcucugucacccaggcgggagugcaauggcgcaauaucgggucacugcaaccuccaccuccuggguucaagugauucucccaccccagcaucccaaguagcugggauuacaggcacccgccauaaugcccggcuaauuuuuauacuuuuguagaguugggguuucaccauguuggccaggcuggucuugaacaggugaccugagguucccucucgcagccccagagguggugcuggggagcugggaucucaaccugcaggggcagcgcuggcagucuccagggcccauacugcucuguccucaugcacagcccuagguuugacuuguugugugugagaugugauuaaaugcauuaggcgggggaaaaugucuuaucuguacccagccuaggucgaagaagagggagaaauaagagcagccaaauugaaccuuauuaaacaaaauugguuaggucugauggagccaaaccuagacugaucuuuaaaagcuuauuucauuuuuccccuccagccugaaccucuuugaauugaaguaacugauccugcuguaagcuuauuagugucaaaccuuguguguuucuuuuccucuccgauuuacauuuuauuaaguaaugaugaaguugcaaggucccaacccuagcccuuggcacaaccaggagcuuccaggcucauuaguggaacaaaauggauaauagagguccaaucuuauuauagcugguacauuauuacaaaaucucugcacauuagaaaggcugcuaagcacaagucuguuaccugcuucacucaagcaucuguugauucuguaaaaugcuggagggaccccccaacacugcuguuccuuuaaaguuuguugugauggugugggcuguccauuucuuaccugacagaaggagugcccauguuagugauaucgcugugcugaauuguguuucaucuuggacuucugugguggaguguguuuuucuggugugauguaguaagagaauaugugcuuuaaugacaggcagauugcaugcuuugaauaaaugucuuaaccucugggggcuucaauuuccuugucuguaaagugagaucaucauuagccacuaucauuagaagugaauggaaucagguguguaaagauuuuccccaucauagguauccaacucuuucuccaucuuccauaucggcccugugguaacauaaugcagcucgugugcacuucaguugagugccuacuauuucaugcaagaugcuguggagaacagagaugagcacaggaugacuccaccucaaacuguuccugcuggauguuuucaguagccucagaaagugcaugguaaagggaaaccagaucaugcugggcacacuaccaugcagaauccucaaaacaccagaaagcuaaguugaaagacagucgaaaagccagaaggaguaucgagcucaucgggccugggagcagucagaaggggguguucauuuguucucucauccacuugaucagcaaacugggcauauugugcuacucaaaaacaggaaacaugggagguugggagggagggaugcagcugagaguuagcucugaaaacuccaugggcaaguccagcagggagagggcugcugcugaccuuccccaggguagcugcuggcaugagcuuccaggugagacagccuagacugaaccugccucugccacaucugagucucgaggcaggccugacuguccugggcuuugcuuucucacccgagaaagggggcucaucuuacuugcccauuggcauugaugugagagucacacugguggcgaggaguccccugucuugagucuucccucucugcuucugccccaggagccaucuuuuugggcucaggcugugugggcucuacauguucaaucacucaggagccacagcugccugcugccugcugccagcacccugacuggcugagccccgagucuggcagggcagggugugguucugcucgacugucagagcugaggccguggaacaucaggccugccuugcagucccagcguuuaucgucccaagucucagccuauuuguuuugugaccuuggagacaucaaaaaccucuguuucuucauccauaaaauugaaugucaaaauauugaccugccugugggguuuuuuaugaagaauaacugacccagaggauggcaaagcuucuuuguuaaucagaaaggaccaaacugcuuagcaagcacgaacuugaguuuuaaaaaguguuugcuuguuugauguguuccucccucccuccuuccccagaagugcuuggugcuggagggaugggaaggaugugagggagagccucugcaaucacccaugcccucuggggagcuaggcucaggggacggaccucccagaggccaccauggugguauagggcagcagcaccucuccccauuccaccucccagccuucucugcugcccuucucacugcguaccccgccugggacacugggggccccugggcagcaggccccagcccuauccucccauuugguagacucuuuacccuugggguuuuguggauccucugagggccuggccagccccaggaccacccuguuccugcagcugugaauguggagcuugggcccaggaggagcuccccaaaagagggcccauguggcuuggcuccuuucaguuacucuucccacuugcauugaggccucccacauuccaggcauggcgcugggcacugcagauagaaauggaaaaaaacaaagcaaagccugguccucauggagguuccauuccagugcgggagugacagccagugaacaaagggaugccaagcguugggaagcucuaugaugaaaaaccaagugggcaaggugcuagagagugacagggauaggccaaugccugucucuugcuggguggggugacugaggaggggcucugauacaguggcauccaagcagguaugggaaggaagugaggaagagaggaacugcaggugcagaggccaugaggugggagcaugccuggcacauucagggaaugggaagcaaggcccacaugacugaagggaugugaacagugggucggggucacagcaaauaaagucagagacaucacgggggcuguguggcauugugaguccuggaaaggacuucagcuuuuacagagugagaugggaggccaguggagagccuggaggcaaaccccagggucacaucaucuguguuuucccaagaacaggaagaacaggcuguggggaagaacaggcucuuggaagaacaggcugcgggggagggggcaacaauccaagccaggugaggcugggaccagggcaggcagugcagggacaggaaggggucaggcacuggaccuacuuggaagguagagccgacccugucuccugauggcugguuacagcuacaagaggacaaggagaguccagguggguggaagccccagcuuuuccccugacaucagagcguugcccuggagaagcagaaggcugaaggagacuuuagguucugggcguaguaagcugggaugccugucagccauucaaagaggcaguuggguguaagucuguaugcucccagcuccagucuccaccuccccuggaacucagacgucugugucucucuggcagccucagagacagcuccuacuugcagaacucccagcuccccuccccugaagcuggcuccucccugcucccaccuagcaugaggcagauccucaaacuagaaaccugggagcuguucuuuacacaucagcuguucuuuacacaccagcuguucuuuacacaccagucucuccuuguccccacaucuagucugucaccaccaaaauaugucuugaacucugaguaucuuccuugcuaauuuccauguuuccuuucuuacuucucuaccuccccugaaucuauuccccaaacuguauagccaguuugcaucuuuuaaaaccgcaaacuggcagugucauuccucugccauccccugugccccaucacugguggcuuccuggugcuuugucccauggcaaugguggcuggcccaugucuccaaccugcugccucccuggaccaccgcaccucagccagcccugccacccgcaguuccacugggggccugguucuuccccugcccagggccuuaggccugcucugcucuucccucugccuggaaucccugugggugguuuguuaccgaucuggucuuggcuccaaugccaccuccucagggaaguccucccugacuacccacaaugaauuaggucucccaguuguucgcucucauacagccucauccuuuuuucucacaguaccucccacaguuucauaauuccucauguauucaguggugaucuaauuaacaucuuucuucucuagaagacagcagacuuuauagaacccaacugucuaaaacuaucuguuuugcucguccugcuggcauuccagagccugggccugguccugagagaagguugcuacccacguguugagagaaugugcgugcgccaccucagcugcgccccguggacauuagcgaauguuugaggagugaguuauucaguagauggagagaggcccucaaaguuggcuagaagauaaaugacuaaaaggaaagccuguuuuucucauucuuagguugguaaaauuaucuacuuuucuuuaucucugguguucuaaaugggucuucuguuccgaagcgucccucagugagcgugggcucacugaccaccccguguggcaaugcugucugcaugcgccugugagaacccaugggagugccaugcugcccuguccccaucuuuaucugcugcacaauuuccugucuaggcccuuaaaaucuugauuugcacaguuauuuaucuuugugcucuucauggugcccugguaaggcauucuuuaugauuucaguccugagaacacaagcccuguugaaaagagaacaugcuuugaauaaagccugcuugacguucggcuugauggggaggaggagggggaaggggcaucagggcagcaugaggccccuggccgcccucucucacaggaaggcucauaaacacaaggaucucgcucaagccccggcacgucuggaaucucagcucggugcuuugccagguaugauuuugccacaaggggcauuucuuuuccagaaucugaugcagucacucucuucagagcggcugggcguuuaucuggaccugucacaaccagguuucucagcagcuccugugcugggcacugaggacgcagcauagggagagcacaguccuugucucgggauuuagaagggaagagaugcacauuugauaggccaaaauuaagaaaucuagcagugccaaauguuggagcagacguguaucaauggggugucuugggccuuauugauagaaguugauuuaucuaccuagcaaaguugaacagccauucacccugcaauccagcaguucaacuccaggaacuguguccuugagaagcccuugcacaugugcccaugcaggauccuugugacagaagaaauucauugcagcauuuuccagcaaagaacuggaaacacccccagugcacaucgauaggaguccagguugugcuaaauacacaaggugcagcagauggcaucggcagcaaaugagcugcaggugcaugcacuaugugcacagguuuuuaguaucauaacuggcacaaugccuuauucauacaguucagaaacuuauacaacaaagcaaauuacugauuaggaauguguacuacauauguagugagccuuuacacaaucauacacacguguguauaaaaagaaagggaaugcugugcgccaaauucaaggcagcggcacccucccgcuggggcaggugggaaugcugaguggggaggaccacacagguagguaugaguuaucgauaauguaguucaggggcggaaagggcaaugaacucauggguguuucguauauaauuuaaaucugucggcacacagaggcuggggcugaccuguaaaguagugguaaccaaacagugagucagguuccgauggucagcugugucuggaguuaucagagaagcccuucuaggagguccaugggagcagggguuagggacgaaugggaauuugccaguggaagaaaucccagggagcagccucaggggcaaagcacagagacauucagaagcacagcauuuacaaggauucauucaagagucccuuggcuacguuuucaggguuggggagaauguggggccgaaaaggcuguggaguugggcugcaugguggaggcuuccugguggcugagcuaaggagugggggcucagcccugugagugaggcuuuucagcagauugccuuguggggcgguggaggggguaccaggagaccgccacccaucacagggaguccccauagaauuccagcugaccagaggaucuuccugcucguggcaggaccaugacaagcuuugaaagccaugagguagacgaugggagcccacaaaggagguggugacaaacaauugcuuuaucagagaaacauuuuagaaagccgcacaggcugcugcaggcgccugggagggaagaguugugaccugggccccaccucacugggcagacgacgcuuaguguaaggugauauucuccagugacucugaguaauguucccaaaaaucucauucuccuauugccuuuucagaccauuucagagauguuuucuguuucuuugugauugaucuuggcuguggcuuuugacacugugcgucucacuuucucugcccccugaccucugguuagguaguuaaugaucuuuaaacaaacacuugaguauuauggcucuccaggaaagguccugggcucaugggccauuagcaacacacucucccuuuauccagggagaaaaugaguguucguacacccugacucgguagacagggaugcuugcaaccuaagugucaaaauucucuuuaguuuaacuauuuuugauggcaggucuucugaaauauguuacauauuucucugcuucaaauccaugaacaguuuccucucaucucagagacaguggaucauagguaggaauguuuguucauuucaggaacuuuuauuggagacuuuucuaugucuguuccugauuuacaaacugugaaugcagaaaucugcccaguauaguagucagugauauuuuagaaacagagauaagaucagguuacuccuuugccuaaacuccuccagugacuuccgggccuugcacucuacuguggggcccgagccuugaccucuguguuaguccguuuucacgcugcugauaaagacauacccaagacuggguaauuuauuuuuuaaaaaaaagagguuuaauggacucacaguucugcguggcugaggaggcuucacaaucaugguggaaggcgaaaggcacgucuuacauggcaccaggcaagagagagaaugagagccaaguuaaagggguuuccccuuauaaaacaaucagaucuagugagacucauucacuaccaguaugggggaaagcaccccuacaauucaauuaucucccaccaggucccucccacaacacaugggaauuaaggaagcuacaauucaagaugagauuuggauggggacacagccaaaccauaucagccucccucccugcugucucccuccccacccuugcuguagcccuccugccucgguguauucccagacucaccaagcuacugcccucuuagggcuugcacuuaucaguugccccauuuagagcugucuuucugugggucuucacacagcugucugcuucuuaugcuaaggucuuagcucaaauucacuucuucgagaccuuuaccccacccaggccuucucuaucacaucaccuggccuuguuuucuuuauagcauauguugucuaauauagucauauaauauuaauguagauuaauauuauauaauuauauuaauauauauuugcaugcauguaauuuauauauuaauuuuauauugauaugaauugaauuaauauauauaauuuuuccuauauagguaauuuuguuguugcuguuguuucaagauauuaagcucuuuggaaacagaggucacuguauuucuuccccuagaacagugccuggcacacaauaggcacucugggaauauguguugaaugaaugaagagagauccugcccuaggcuacccacaagccagcaggcagcagauacacaauagacagugaccaugcagcaggcugugggauucagaggggcuggguuaccacuaaggagucagggucaaguucugccacugggaguugggacaggcuuuccagagcagugguguuugucccgggcuuuagagggcaaaugggcacagcuuggccagcugagcagcuggggaggccauucuugggggaggaggcaggcaaaccuggacagagggcuggaaaaugcuagcaugauugauggaagggaggaacuuggagggacuggagccuggauuggagcaggggugaagggaacuaagguagucagggauuuggcugcuaugaccccugccuuucccccagaagaacagugagacuuggagaguggggcccuggcccugcuuugcuggcggcccucggccuugugcuuucagugugguaccugcucugguccagaagagugugccugggccccagaccccccuuggcugguccucacggugccugcagguggugguaagcacaggauucucuagcugcagcuccccucuccuccccacagccccgaggcuuguugguuucaugugcucucuugcuuacuccccaucagguggugaagaaggugaaguccaugcagauguuccacaugcccaucacuucagccaugcaaggagaccggcugggcaucugcgucacccaguuugacccuaagcugcuggagcgcggguuggugugugcccccgagucccugcacacuguccaugcggcccucaucucuguggaaaagauaccguauuuccgggggccccugcaaaccaaggccaaguuccacauuacagugggccaugaaacagucaugggccgguugauguucuucaguccugcuccagauaacuuugaccaggagccuauacuggacucuuucaacuucucucaagaauaccuuuuccaggagcaguaccuguccaaggauuugacaccagcagugacagacaaugaugaggccgacaagaaggccggccaggccacagagggccauuguccucggcagcagugggcccugguggaguuugagaagcccgucaccugcccucggcugugccuggugauuggcuccaggcuagaugcggacauucacaccaacacgugccggcuagccuuccauggcauccugcuccacgggcuagaggacaggaacuacgccgacagcuuccugcccaggcugaagguguacaagcugaagcacaagcauggccuuguggagcgggugagcaugcccuugccuggccccacaccccuucccuucuugcucgggcagcugggauccauggccugacaucugugaugagagccagaaaggcccucagagaccuucuggugccaaccucuguaguuucuguacaaggcaucugaugcccagaauggucagguggccacaguucucucagcuggucagucacagagccagggccagcaccugggcagggggacccccacuguacccaaucccacccagcuaucccacccccacuuauuuacaugguagauguggcacccaugggucugagcaggucugggcucccccacagccagugucagauggcagcgguuagcacuggcuucccuggccugcugcccugaucaggccccacucucuugaccuuggugggcacuguaccuccauccagcugggaucugcccaugugccccugcaagcugcuuauguccagagggaaacacugcccaucaguggugccaggccaggucuuuccucaccuguggacugaggggaaggggcuaaugguggccaggucuuuccucaccuguggacugaggggaaggggcuaagggugccagagagcaagaggaaggaagguacaggaagcugacacagugggagguccagccccuggcuaccuagggugccugaaguucaccaucgcuagaugcaggccuuaggcauguaggugagccagucuaguugaaguaggaugaggcccuggcugugccuugcugggcggcccuuggccuugugcuuucaggguggugccugcucugucccaggagacucugacugggcccugggccucccucggcugguccuguggugcaucagcaccugggcccagugcugggugggaugggccugccacuaggguggacagaacacgguggucucccccaaaguaguggaaucaccuccucccauggggcauccauccccagcagcuguccacacagugcugagugggaauccaugcccaucgggccuugaaggcaggauggauggacagccaaaccuugccgucucuucuagaaggcuagcucccuggcuguggguccaagcggaucagcagcagcuguacugggacaugacugggcuuugacuggcuuaaagagcacggagugcuggcaaccccacugucgggggcucaggcuccuagcaggaggggucugcccugaggcuuucaacaagggccucaguuccucacaggagccugaugagguccccuggguuuagugcaggugccagcacaacaucuggcccauccacggugucacauguggugggcuuccaucgcccacccuccgcuccaggucuccguccacagguuuucuccucugggagaaaauccacugguuuucucgucuggaauucucugucacugcagccccuuccccucccuuucuccuugucuuagguucuuccugggugcuccacccuggcccucuucuuuuccugccccuguaccuagaccugcccucaagugggggacugaggagcaaccccuuccucucccuuccucagacccagagcuuggacccuuagcuccgggggggccgcuggggccugcucagggcuccaucagccuuaggccagccccaagaugcugauugaagaugaaggugauaaagugugugucacucguuugucuagccugauuuauuagcaguguuuggaguauaauuauucuauaguaaaauaucuaugagagaguaauaucccaauugguguggcuccugggucuaauugcucccacucaggccugucaacagcggugcagcagucacuuccuuugagaacugggagggagggucugugaggagcaaguaaacauauggccucaaugacucaugccuccgaagggcugagggaggggccaggagacaugccuggccuauguccuuccaccaaccuggggccaccagcauuuuccugcucaguccagggaggcuggaaguggaagcacaagaacuguaggcaguccacagaagcugaguccaaaucccauauagacaacccugagcagagacaggcuuccuccaaccagggacagccucacagggugacuguggaugugugcagaggugagauccuaugagcccagggcuuuggucgaggaagaaggccuuccugaggcuccacaagggaggaaagggcaugggugcccaggcuaggagcagcucccccaacucgcaacccccugaggcucuagcugaaugggcaccugccuuaaugcuaggggcuggcuguaggcuggggcuucugugccacaugcucuccucugggccccagggcaggaaugagccugccuccugccucccuccacucugucaccacucuacugauuaagcauauacuaugcgccuuuacuagcuacauacuuuauuuugaaaccguuuaauaacccugaggaagaggucauuauuuuuccuauguacauuuuuccccaauuaaaucaaucaaauuaugugcaaauauuuaggaaaaguaauauaugcacaugguaaaaaauuucaaacaagacaauaauuauucaguguaaggaaguuuucuuccuacgaacccagguccccuccccaaaggcagccagacuggaaaccagcccaagaaaugugaagugaccugcccaaggucacaggguaguaaagcuggaguuugaacucaggacuagcuggucucuuuugagucaugaaauuuccacuuugucagacagauucuugcccagugugucaaaagagucugcguucucuugaaaagcucgaaucuccuuggugggagacuuuccuuccugguaagguggaacuuggagaucauacagaguaggcucaagcccuugcuguacccaaaacagcuguacgccuugggcagccauuuaaucucaauuguucauuccuucgaaggauggucuugaccucaucagguuguuuugaaagagccaccauagcuuguggcuucauauguaagagccgacucucaucaggugaagcaagaagguaguguuccuguugcagcuccugagugauuggcugaguuuguuccaaaggggcagcccuguuugcuuugaguaggccccagaucacccagagauuuucaggucaucuugcuugaccaggggcucagccauccgacagacugguccaaugugcaagccugggcuuuauuuacucccagccuuaccaccugcuagugugaaaaguugagcagaccaugagacuuccauguuaagugggaauuuucacagugcugcaccaggguuagaugaaggugagaugggggauugcacauaagguucugagaucagugcuugucuccuacugcaucguuauuguuuuaucauuauuaauguuuaagcucuuagagucaaaauaauaaugccuggagcguggguccacucuuuucccugggacuccauuauuucucuuugaagcacaggagccaaucccccuggucccuaucaggagccacacaguuuugguugaagagggaggggcugagagucugguaggcucaugggugugguuauccagcgcaggggccagagaagugcccuaugcucuucuuuccccaccgugcuuggcugacucuaaaaauuccugggcacaucacaguuacuagucagcuuucuggacaugucuauucaaagaaguuucuggaagaucagagaaucuugaaaaggugaaauccagucucuugggcagaaucuccaccaccuuggugagccagcacccagccuuugcucugugauucggggcaaggccagcacaucuacuuugcaagcacaguuagccuucugagaaccugggcuugggucucugagcuaucucaguucaucacaaagggagacccuggcacuauaccuauguguuaagugagcacuuuccgccaggggggcuuaaggcauauaggccuucugaucccauuuccuauaaaggcauccuucauucauauauucggauguuuacugugcuccuacguuugugccaggcacugugcauacaacaagauagacaaaguucuugucuuccuaggggaggcuaguagugaacaguaaauuagacauuuucagguuauaauaaggucuagaaagaaaauaacagcgugauguaaauaugugaugcugaggacaguuauugaaacacagaagaugcuaauuuccaagccucugcagacuguguuuuuauuuccugugcgucugcaucacuggcucacacuggaagcuggucagguacccuaccaguuguggcuuaacucauuaguauuacauagagcaaacuauggcccaugggccaaaccuaaacaacugcucuugcuccaaaucuaauaaucuuaaacaagcuuauuuucucuggauucuucuuucagcugcuucgaucaaacacaauuuaauuaacuuaccauugguaaauggcuuuccuugcuuggcuaacaaaugagccacccggaaaccuacuuugguugcagccuuauucuuauuuuuuauuguuuugcgugucugcuaugaugaaauauacuguuuuaaguuuucucuuuuuugacauuguuuuucugugagaugggaauaucgugaugucaguguaucucauauucuguuaacacaacuaauaacaaacacaguacuuugccauguaaugugauaaaauaauaauccauacccacugcgccuuaaaagugugacauuugaaguccacuuuucuuguuuucaugugauggguaugcaccaguaauaaaauaaauaaauaaauaaaaugugucacugggugagguacugcaaguuguaacuauguuaccaccaucuguaguuuacugagcaccucaucaggucucagacucagcuacucaacucugccacugugacacaaaggcagccauagacaauauguaaacaaaugggcaugacuguguucccauaaaaccuuuuguugugaacauugaaauuuaaauuuuauauaguuuucacauguaacaaaauaauauucuuuugauauucuccaacucauuagaaaauauaaaaacccuucuuaggucacaggccauacagaaacguaucaggaagaauuugacccuuuggcuauaguuuuccaaccccuaauauaaaugguuaauagggcucuugaaauagaaugagcacccugcgaggaaaaugcuaauaauuaucugcagcugaaagcauuaaacccucucagcaguccuuaggaauugggcuuuuucuugggugcccacugucucugugcuaacacugggaugcauauacuacuuuaugugcuguguuuuuuauucuuggauacauuugauuuuuucacauaaguccacguguacuucuauaagagugugacuuguaauaaaggguuaaugaagaaaaaaaaaaaagaagaagagggagcuuggauugguagagacauccagaggucucaccugagugggagaagaaaagaagugaaaguguucuaaauggcuaaucuuucuggggagaggguuuaggaaagacuacuagagcauauggugauaagggaaauaguugguauccuguuucaaaguaaaaauauagaaauaugugcaagauuuugaguacagagaaagggaaagaaacuauaugaaugcagugaaaauguaauagcacuuucacauucucagaggagaaacuggaaugaauuugauuaaaccaacaaaaauaaggaaaaaagaacaauguuaauaaauaauaauaauaacagaaggaacaacauuaaguaucagucauuacacuaaaugugaauggccaaauucuauuuaaaugcuaacgcugagagauuggguuaaauacugacaaagguaaagaaggacaucauguaacgauaaaaggcucgguuauaaacuuguacauaccaaacauaaaaauaaaacaguagaaaccuagggacagcuugauaaaagauggaauuauaaugauaggguggcacuucagaguccauauuuuaaaaucaggccuacuagacauaaggacaacgaggcagaauauauucaauaagcuugauuuuuagauaaauguaaacucuuacacuccuugaauagaguauacauuuuuuuuccuauggcuuggaacauuuacaaaacuaaauauucagcaguugacauuaaacaaauauuuguagaacaucuacuguguguugucuuaagggcuagggagguaacagugaaugaaaaagacaaaaucucugcccacauggaacuuagauuguaguuguauuuguggccacagagaaaaaacccuaauagauuuuagaaaguaaaaucaugaaccacuaaaaugagaaacaaagcaguuauauauagauauaggcagauauggagagauacaaagugugcaugcgugugugugugugugugcgugugcgugugugugugugugcguguguguguguguguucauucuuucacauauucuaguaaauugcuccucauuugauuaaggcuguuucucauacuaucauagaauguugaaucuuaguaauaaaauuuuucucuuuuucaguguucuuucaaucuuuugauuacuuugcagagaaagcuuuagauuuguucaaagaugucuuuaacaguccucuauuacauucuaaccugcuuuuuaacaaauggaaaacaagaccaagauuccagagccuucuaguagcaauaguauguaacuaggauuauucuuuggggguuuuuuugcaugguauguacuuuuacuauuagcuuccucuguuuaugguuagugacucuuuucuuuaggauacuauauaaagucuccuuuccaggcagauguaaagaaauauauuagguaaauaguaggucggguaugcaaagaucuggcaaaaaugauguggggugaaggauguguaaaagccgaggcuggaaccacuggguccuguccccaggagguuacuugcaucucagccacaugcagauucagaccagcugcuccuccuuuagugauccaaagccucauagaaaacugggucuuucuaguggaggacagagacucaugccugcaucagaggaauaugcagagggcuaggagaggaaacaaggaacucugccaaggugggaggaaguaggcuggugagggaaaagcacaaaauggugaccuuuuaaguguaucuuguaagacuggaagguucacugcacagacacuaggggccauguggggaaacaggaagguggaggaggggcauuccagguccagggacugcuucuguaaagcauagaggccaaauaaugccuggcccugggcaucugggagggcagggacagggagcuuaaagaggcaggcagggccagccaucgaagcuaggcccuucacccugcaggggggaguaaugcagguugggggcuaugggggguguucuaggucaccugugcuagagaaauccuuggagcagggccggcccaggcagccuagagaggggaggcucagccucucucaccuacccuucuguaucccagucucgcccugaggcucugggcaccuggucgucuggagccgcagagcucaauggucugggagccacucacccuauggagccaggcuucuccacuaguaacaaaucaugacuuuucaggacugugugaacaugaaggaggaggugagggucuggugcuuaggacagugagugcucugcaauaccugcuggcuuccacagcagacuucucacuguuaccacgccccaggaugcccuccucaccuccccaagccaccaccuucucaugggucucaccauagcccucuuugccccuggcagcaugcauagcuccaccccaguaauuuucugcaaaacaaaggggguccugccagcucuuacucagaaaucucuuuuagguccacaccaccugcaggacaaagacaauacccaaccuuagcauguuagcuggcuggcaguugggucccaggacauggcagguauaugugcuauauguaacaugcugaguacuccaccuggcacagaaugggcccuggguaaacaguggguaucaucaguacuauuuauuuggacuuuccucuggaaaugcagaugccuggguucccagcuagggugauagcagacaccaucccccuuccacaguggugggauaaggccaggugugccagccauccugggucuggcacccacuggcgccggucagggaaggccuuagggcugggccacaggagcuggcagcauuggcccaaccaaguguaaacaugcagacgccaucaggagcacucgccagcuuugaagucugaagcggcgcugccuccuggcuccuggcucugccccacuccacugcugacggcuuguuaaaugugcccagggcaccagggagcgugcuggccuggggugcaggcuggcucaugaccugccucuggcacagcuugggccccaucauucucagcagggauggucuggcaggcuuggugggcccuagcgggucagcugcagggccccucgcccuugcaggaagccaugcuguggucuagcuggccacugagccuguucugcuggcccucgcuccccugggucccugccagaggguugaaggccacauuggcucccaggcuacuugagaaaacagagguuccccugaaacagagguugagaagcucuuuccccagggagaugaucaaauggcugcccugguauucuggucccagcccaaauccucagcguuucuucugacuuccaguaucaggcugugauagcuaagugucuugcuuggcugcuggagugcuuguucaccuuccuuugaaaauugcuuuuuugcccauauagagacacagggucaggacagcuugaugugcuggaaagagccaguucuggaaacugauggacugagcugggcacaagcucgauguggccgugggcaagucacucucccccagaaccuguuucuucuuuaagagcuggucaggcguugaugagaccugggcuacuucagggccucugcucuucccaccacaccagaccauggccugcauugaggaggagacacuguccguggggaaaguuuucugaugauacuggaacaacaccaucauccuagguccccuuccagaauuugucaauccugguggcuuucaaguggccuagaagaguuaacaccgcauuuuuaagggacucauccaugaucaggcagccucugaguucuucccauuccucauuggauccaaggacugcuggcuucuguccuccgagaagacuuugcuggugggguggguaagagggagagaagcagagagcugugggcagcuccaagcaugugguugguguugaguacauguucuguucuucuggcuucucuugggcagauuagauaacuggaucuugugauuucugugcaucugagaucuccugcaccaaaugcugucuuauucuucugcuucucccacaauuugacauccacuaauugagauucuuuccucugggucauccauucucugucaagucuuagguguuaucaucaacaucaacaccccugauccuaacaacaaccuuuuucaaggaggaaacugaguuucagagaagucccucgcucaaggucauagagcuguaagaggcagagucagaagucaggccucccaagcccuuccuguccugcgcacgugguucuccucaccacagaccuggaaucggcacagggcuccauuucauggcacguuugccugccuuccuucguaucacuucuacaauuugaauuagaauggucacuucacagcuugggcaauucccaagccucaucaugggagccaagcccugaaagagggacacacacacguguaaugacauaauuauaugcaccggcagccaaguccuugcucaaaggccagggacaauggggacccaccuggcguguaagcaagcgccuggacuuccaugugcacagugacugcuccucaggagcucagucccuccagugacugaaggcuaauaaauagagcaaauuauucaugcaaacagugagaauccccacuuagcgccauuguuguaacugugcuggccuggauucaggacuguucccuagaagcaaggccuauugagcagaucccacaugcguugccuuugguuugacgucacaaugauugauuucaaaaugaaaacccuccaacuguucucugaaggucuuuccucauuggaugugcuugugucugaucucugaggucucuuuccuuuagcuggaagaaucuauaauuuggugaagaacccaaccaucacacaugcaugcacacaccuucuagugauggacaggacagagcaaagccauguucccccauccucaccuccugacacucaggacagaucaugaccccuggucuuccugaaguucuccagagauguaggccucacagcauccuguaggaauguaggagcugucucccucuuucuagccagacuuccuucugauuaaaugagguuucaugcagcugacaaucacugaguccuugcccccaguacacacagcaguaauuuccggagguguagguuuuggagaugcaaaaaugugcucagaccagcuccugccuuccaggacugccuuccuccccuccccgcauccagcuggugaggcuggcguagacaagccacugcugugcugagagacaggcacacaggcuucucuguagccaauucccagcgcaacccucugucugguucugaggccggcagucucuuagagggggccuuccauuagucagcgaugucuucucagaucugcagguggcggccauugagucgcaggggugcacaggcccugcaucugcugccccuguaguccuguguggugugucugagggaguccuaagggagggagacuggucugcccagggagggggcaggcagaggccagaccaacaacaacuguuuacaagugcuccccagcacccauuuaaaccuccagcaacucuguuuccccauauuauagauggagagaugccugcacccacagagguuaggccucuggccagagugccuaggcacccagacuugggauucgaaugcagguagucuggcucuagaguccagguucuaaccugugauguaaacagugcugugccuuuucucuuauucuauugucuccagugugcccauuuuuuuccaguuauggagaccuguacaguaaauccucacuuaacauugucacuagcuucuuggaaaccaugaguuuaagggaaagaacguauaacaaaaccaaucuauuuuuuucauucauguuauaacaaaauaacuuugauauauauucaaauaacuuuaaaugaagcaacauuauuuaagggccuacuguacauuauuuuguuuaaaguaacaguuucuaagaacuuaugaugacaccaaguaaagacuuuacuggaaauugaguauuuggaauucaugggaaggguaguuuuccucuuggccccuauaaccauagguggggaaaguuuagccucccuccaacagcagugcaguccuucucaguguggcaggggcugacugggcuggaacaccuuccugugauggugaaguguuugggccccacuauaagugcugcaucuugagggccaggaucugcccucuuucccuccucuccuccucccuuccaaauaaccuggugggggcuggggucccugaacuuggggauugucuucugcaaugacuugggguuucccacaacugggacuagcagggauggggcugcccagugccccugggccggacuucuaggcccauuuguguccagucagucaugacauggcucuggugagcccaaaggauggagaaagucgucugggcucauuugcugcuucggcaccucccggcagacagggcccagcccuuccugcagcaggaaaagcaccagccucuggauccagacagucugaguuggaauggggcauugccacacucacuagcugcgugacuuugagcaaaucauuucauuuuacugagcccccuguucccgacagggcuuuccuaaagauuaaauaaugauauggggacaccucacccaugacauggcugaggacacugccgcucaccugcugcugggaaaggggugagagagcagagugcgaaggauugggagaguuggagggagaugggauuuaccugcugacuucucucugcugcuccagccuccccuccccuggggcagccaugcccagagugccaguguccucugugggacugacacaaaugcaaagauccacccagcugcugugaaaugacaguguggggccaccagcaggcagaagacgccagcacucucgagaccacacgggguuccugaacgugugcagacguccagcuccugcccucacggugccucccccacaaauggaacugcggacacagaaguucgcaggagaguaugcuucacccacucagcacuaucaugucuucuggccaagccauaaaacaagagagcaggagugacagagacacucccuuugaacuugaaauccuuucuaaacugccacuccagccccagaggcccuccucagaaggucaaaaaaagcccacucacuccucaccuuaucccggaugcuuaaaacaauuuugugggaauguaggucagugaaccgagcugcaccacacaccagcaggauuccaggggccaaccagccugugugcuggcccacuaggucagaugagaacauaaacaaggaacucugggagcccucagcuuccccuggcucuaguccuuuguuuauguagcacuuaaacuaacuuuggggucaucucugucuggcaugaaagcccuggagcuuuuugaaguuccccugaaguuaauaaaauuagucugcccucauugcaagacccuggcuuggagaaagauagauccucugcugucuuuguggcauuuagcuuuuuaaaguuaauauuuuauaaccaaaagaaaggagggggcaggggagaagaugcaguaaacguguucugaaaggcuaauagguagcaugccugcuaucccaggcucugauuacccuggagccaggccuccaggcccacugggaggcugagcgaugggccugcuguguuuagcaugagggaaccagcacuggggacgugaauugaucugucaguguguucucccagguagauaggaggaaacuagcccgggcugggcuguuggcucacucucagaugaaucgugucucccaaggacauauccacuugaguaauguauuucuaccucccggcgucuuccccuugaugccaugugugggacuagugcaguuggccuccucacacucagugagcgccuguucaccaggccuguagugggucagggccacaggaggugcacagaacccuuuccucgcagaacucccaguccgaggagggagacagauaggucagcugucagggauaagacauaguggccaggcucucagaacagagggaucuuggccucaguccugggggccaaggggagaggaggugccugcaaugucggggaagcugucugaaggaggaaauguccaaggugggccuuggguggggguagaguccccggugcacaagcugggacuagcauuacaggagcaccacacaggcggggagggaggcauaacagaggggcaugaggacccugggggugauagauauguucauuagcuuuaucauggugaugguuucacaggcauguauauguauacacauauuuagacuuauccaauuauuuacuuuuaauauguucauguuauuguguaucaguuauagcugaaugaagcuguaaaaaaaaaaaaaaaaaaagccuacaggcaugagugagccuugcaaauguaccaacaacuacaaccauguauucuugcaacauuuacucacacauucaaggaauagauaguaagcgccuguuuuaugugcagggaauguagcuauggaggagaggaacauguuucugccuggagcuugugccugguuggaagcaauaaacaaguaaacagauaaggucaaaggcauaacgucagguggcaaucugugcucugaagagagacagggcaggaugaagauuggagaggaguaggggcuggaguacaggaagagggagccaugggccacagggaacgcuguaggcaccaggccuugauuugagccugcucagggccaggcccugcugggcaccaggggcugcauagagauggggagcucauaggaucugucgcugagaagugcaaaggcugugggcugugagauggagggagaauucuguuauuuuccuguaguacaugugauuguucacagcuacaggcccguuucaugguaggcucuuauaggaauaaaacaagaauauuaauaucagcuuguugagaacuuucugcucugcuaaggauaccugcguauauuaucccuuugguccugguggggccucuuacaagcuguuucucugagaaaguuguaagcucuuaguccagggacugugccuuuuuuguuucuuggccacugcaaugcuggaggacaggucuuauuucucagucagauguaaccccagggccuagcuaugcagaggcccgaguaguagcucucuggggugaccacaaugcaugagaacugauuaaagcugccuggguggggacagagggcugcaauugucacccuugcuggaccagaagccaucaaaggaaaauguucugucuuuggagaagaugucaggagaggaugggagguccgccugguguguguguagaagaaaugcacuucuugguuuguuuuuacauuuuuaaauucuauuaacuuauuuguaaacaggugaugcauucauguauuucaguagccaaagauagaaaagguguauggugaaaaguccccaggcacccugcucccuuuccuggaggcaucaguuucuccugauuccuucuguguauccaccucugcccugcccccauccauacacagccugcaacaugcccuuugccucucacucuucuuuuuaacgugaaacacaauacucugguuuuuguaucuguccauacacacugccuacucuccucuguggucacaucaucaucucuagaggcugugcuccacuucuugaacucaggcuggacuucuaagucauugucagcuuuugcugcugcagugagugaccuuggguggagcucccaucuucuccugacaucuucuccagcaagcacaucagcgggaugcauuccuagaagugaaauugaugguccagauggugugugcauugcucauuuccauaacagcugccagacuggugggcacuucuuaucauggggcccaaguuugcuacuggaggcaggaucuacagagcagggguggggugaggagcuggguggggcaggcaaggccaccuggccaugcugccaucccaaaagcaguaccugggcuggagcugccagagacucagaagggagggagugacacuuccagucgcugaucaagccucuagggagaagguucaggaugaacauagcucauggugaaaucagggcugcaccaagcugacuuuuucacagacaugugugucccuccucucagccugggcacccacaaagagacagcagcggccaacauggccagcaggagguaugagcucugcaaagaccuggccauggccaacaggggccagggaaacgagcaauucugccuggacugagggagggugucauggagguagggagguagggcuguggaggaaaagugggccaggccaagacaggcuuccaggcacagcuagagugagcaagaguaaagccuugggccacuguacauaggggugugugcagcgggugggagacaaaggccaggcucucgggcuccugugggaggggaaaccagagugaggaggccaguucuagaaggccuuggaugcaggcucaggagcggcccgggugacugugacagcuucaaggagagugcucugggcaggugcccuggggacaggcugggucauuguggccccccagggguggggggggccugcaacaggggcuugaauucaaagcuacuucuauccccugugcucugugaccuuggauagaugacagaacucugccgugccuccauuuccucaucuguaaaguggcgccacagagcugcuguggggacugaggugcuaucuguggaaagugcucacagcaugccuguuuugaagggcccguuguuauaguggcaguugccagucucagguuucugcccugcucccaugcauuuuguuaucuguuaggugggcucaucaccaggcuacccacaggguuccuagagcgggcagcagccagccaugccuagggcccgggagagcuggggcuaggcacacagucacagcucuuucagugugcaccacuaaugcccucucucuguggcuggguguguggggacaggcgauggaugacuacagugugaucggccgcucccuguucaaaaaggaaaccaacauccagcucuucguggggcucaaggugcacuuguccacuggggaacugggcaucaucgacagugccuucggccagagcggcaaguucaagauccacaucccagguaagugcagccacuuccucccgguuuagggacaccgugcagggcacagagagauggcagaggugaugccaagguggcgcuccuuggcuuagguuccuaauccugccuuugccgagacacggggugacuuggccugccuggcagcauggccucuggcugggaagccaguauggguucugggaagagccuggauguggagugaagaucuggucugagcagggucaagauuggagucugaguucccacugcaccauuuaccaucugagggggccuugggcccgcaccuugguuucucuguggaggcgggaauaagauugagccuacaggcaguuuggagaagagcaggugagggagaccgcugggggccuggcauacuguccuggcacgugguaagguuuccagggaugugaguugucacccuccuuugcccagcacagacccccaggcucagcaccaccugcugaguuugugcuggggccucuccgugggcugggucagaggguguguguuugcugcuggagagcccuuggauuuugucagugaacucauccuucaaucacuugugcauuuauucagccuacacugcaucauguucuucuguguugcaagcauugugcuuggugcuggggauauggagcuuacaguuguaggaagguacaaacaauaaacauacuaaagaaaucccugucagaugggaguaggcaccacguagaaagauaaagcagggacgagauggaauugcugagcaugcugcuuuggauagggugaucagggaaggacagagggagggaaggagccacauggguagucagggagagcaugccacagcgagggggaagugaauguuaagguccugaggugacagugagcuucaagugcauuugcaggucaguuguuuggcaaaagugugcugagcagagaggugugcaggacauaggccaggguucauacugugcgcuggggaccgugggaaggacuaaagccuguguucguaugaaugggucaugagccacuaucuuuuuuuuagagaaagggucuuacccugucuguggaauagaauguggugaugcaaucaaggcucacuaaagccuugaccucccaggcucaaaccauccuccugcuucagccuccugaauagcugggacucaguugugugccaccacccccagcuccccacuguccuuuaucuccuguacaauuguaccagauacaaccaauccaguacaauucuguuguauuucauaauacaguaaaaauuacaaaaauuuucaaacauacagcaaaguugaagauuuuacagggaacaccuuuacccacuccugauuuuauauugacauguuacuguccucuacauaacuccaggacucgagguugauccugugaggauggaaagcuguggggagguuuggaucaggggaacaaccaagguugguuuauggcuucuugugucaaaucuccuaaagagaagguggugcccuggcuccagcuggaaaacagagaccccagcugccuccgugcucacagguggcaugagcacccuucccucuccugacagccuugccagggaaccccuuccuuucaaaguccuuccacugcccagagauagcaucugccuucucaugagcaagggcaauggucacagaggcauugcuucuccagggcacuuuguucccuguuagcagccccuaaggccucugucaagguggggcuggggcaagggaggcagaggcacccagccaugggaggccuccagcggugaagcucuaaaauucuguccuguccuccccacuucuccauaguggcucugaguccucaccucagccaaacaggagucuuugugcaucgcuucaguuuggcuguggguuguccucagagacuggagcccacagggccccucucuggacuccagggagcaugcagggggcaugagccagacaggccagcguccagaccucaguccccaagggccucgugccuaugccugccugggcuauugugagcuuucugggagggaaggaucccgggauucuuccagcugggucgggggccauacugaggagcacugauccuuccccuaaacagcucuggggcccugcuggaccaggcagagggaagagcuuauggucuucuccuuugggaacugcuaggaucacgcugaccuccccugagcucccuuccuguagcccaaggcaaacucagagcugggguauucccagggcaggcaagaaccaagaggagucuugguugggcugcuggggugggagugaagggagccucucggggugcuggggcgggaguggagggagccucucagggugcugggguaggaguggagggagccucucggggugcuggggugggaguggagggaggagggguauagggacacugccucaguccacuagaguucacauuccuucgucuggucaauguugacuuuuuagucugccugcuuccuguuuguggcuuuuaagcuuuuuauuaaauaucacuggucagauuccuccaucccacccaccaccuuccaucccucccacccccacucccugcugauuccucccuuuuaaccuuuuugaagugccuuaauugugaaagaaucuucaggaagccugagccauccagugccaggugaagggagagagagugcauugcuagcugcagccuggacaugcaggguggggaagccuggguuuuggugccaugagagguaaggcucccagccugcagcucguggacagggcuggguucagaugcacuucaugggccucgcugccggcucuacagggcauccgggcugggaaaggcagaaugaagaguccccuggguuuccucccaucagccuuucaccuuggguugcaaggucagaugccaggaaggccaagcagguguugaagaggccagguggcaggugauagggagugguggggacuauggugaccuggagagcugcuguguggguccugccaacucuucacuauaugggaacguaggccuggggucucauuuuaucuaauuuuauuuuuauguaauaucuccugauuaaaaacuacaacugucugugcuaaacaaagcaugccuuuggccugguuugagcccuagcaacucguaacuccuguuugaauuuuagaaaggacacuuggcccucagguucacgaggugaagcugaaccguaauaugcaaacaguauguuuuaaggagccacagacacuugccucagagacaaggguccugaugcuagggcuguugacucccagaaugugcugugggaaaucagagggcugggggacggccccauccuuccugauauccaaggagccuucccagagagucuugggggaucucaagguuggaaagccccguauuuacaaaacaucucccuucaaagaccuugccauuugcagaauuguacuucaugggaggauaggaggccugacaagcugccaguaggaaccuacuggggaauucugcugguggugagagaguaguuggaggaaggagcuggacauggaggagguuccuguccaagucauagcaucacuuguaauucccaaggguuguaggguggagugagucuuguuaucuccaucucacaggugggagccggguagcagagagccugagggcuuugcccacggucugucugugucaccucaccccucuccaucagcucuguugaugccccuagagagcagucaugucuucaaagaaucuggagcugggaggcccauguggugcuuggagaagcacugcaccugggaggcugcgcucccaaagcucaucuuggcaagccgucugucccaccgcugccacccuccccucugccucagugugccaggcaucagcacucacucacagaggcaggcuggauggcgggugggacaacagcuuccgcagccccuccuguucccacuuugcagggagaaaagaacaccuugaugacucccaacuggagaagaaucaugugagaagcugaauagacuuguuccuaaugacagcucugagucacugggcauuuacucuaggacagaaaagggcacacaugugcccgugaucuuaucuccugaagcaaugcucuguaaaucuaaaaucucccagggcuguuguuuuguguaccugccaagauguggcaagcuuuuugaauggcccaaauucaugauagguggccccucucccacagggugcuccugaaccagcugauuugggacaguucaugugugugucugcuuuagcauugaggggcacgcggagcuuaaagccuuguuacuggaaagccccaggccccuauuaccacucgcgugcccaugugucacugauucucaccagguaacaacugaccauggaacagagcugcaagugcuuaccucauacuagccagagagccgugauugagaacauagcccacucaaggccacagccgcggccucauccuagcagcgggugcugcucacgugccgggagcucaaaaggguacucauaucucaggcacuuggucuugugaguagccagaauucucauucaaacccuaaaauagagaucuuacuuuuggugaucuuuaauaaccuuuugauuauuacuaaucacaaauuaauguacuccagaugagaaaaagaaaaaaaauuuguagaaccauacuuacaguuaagaccccagaaggagcuucuauuuacugauuaucagggagagccagcacucaggaggaggagaaacagcccccaaaaugugagcuaugauguauagcaguugggcugcccgcuguacagcugaggagacuggggcuggcaggaugggcagugcaguugcugguguucccauugcaacaagcaccucguuucacugcacaagcagaccauuucaaaccgcucugcugcaugccagggcuaggauagucugugcccagggaggugugccacagaggugggcacucagcgcaagaaagccagaacaaagcagacacuugggcaaagguagcaaacauccacaccugagauucgaacccagagcaccucacucucaaccacucugcucgagacuccccacaccaugaugccuuauaggcagggcugggggugaggcacugaaguguaucucccuuccucaggguaugcgggagaagggaaggguuggucauucagcucagugggcccuuggacagagggccugaaaugacuacccuauggccccugggaagagggagucaggaaagccacuucugcucaccucugaagaggguccugaggagggcuccugggccauccugcacccaaugcugccccugugcccacccccagggcugcaggggcugugacucugaauuaugcccaucagugugccaugcagaaggggauggauuuacauggaauaggaaguguugcuugcaugaaugaauaaaugaaggaguuugguggaauagacuggacuggaaugaacaaaugaauguacccaggcccacgagggccacucucagcucuguuuucugcagccucacaguggaggccaaacagccuggugcuuugugugcuacaggcuuccccagaaccucagcaaugcgggcagacaccaaccucaucagacucccucagaagcugcugccuaggaacagagcuugggggagggcucgaguuuccugaucuuuaaaacaagggggccaggcacaguggcucaccccuguaaucucagcacucugggaggccgaggcaagagaauugcuugaagccaggaguuuaagaccagccugggcagcaaagcgagaccccaucccuacaaaaauguaaauaaauuaaucaauccaggguuugccaguccauuuagcucggcaaacuuaguugaggcuuagggcucgggcgggggauacugagauccuucucagaguccugucccaaggugcuuucccugugggacaggcagagacaugagcagccauucacagucagcauggcaaguggccacugggacguguggcugggaaugggggaaaguggccauccugagaggagggccagagcaagcuuccuggaggaguagccuucugagcagaagggcgagcggggagcagaaggcugcauagagagcuagaaucagaugugugauguucgcuagaacccuguggccaguggucaguccagccucauggccagggucaggaaaaggccaggacaguggaaagaccaugggauggggagucgggaaccuggcccucauaccugcccugagcuccaguuccuucgccuacacagugggcaugugaauucucagacugccccuccagggccucuuccagccucauucaucuacugcugacucugccagugcucaagccacuccucuguggagugcaccugacccccaggcccugcagcacugcuguggggaugcacuggcaggaagcaggggcugggaaggccaagagcaccucccaaacccugucccggagcugccauuuagucuagcccuccacagccugcauggcagcguggccccaacccacaggugaggaaacaggcccuuugcucacaucuacacugcuaguaagugaaugggccagaguucucugucugccccagggagaucgagcagaggggccagcaggaguaagugggcacagcauaccugcugcugagggcagugccagcccugccagcuggcucugcucccuuagcccugcagccuucucccaggacucugggguuccagcugguagcccguggccccugugcugaaucaggugucucagggcucagcaugguaucccaucccauccuccucugucccucaucacaauuuauugggcccuccguguacagaccugucuaggugcuggagggggucagaggugaaacaaggccuggguggggagggggcucccugaguggauggagagcccugggccaacacccagugggacaacuccucugugaaccacucucugguuuaggagagggacgggucagacgaggccaagguugcaggggccgcugggcuaguuaccuggagggucuccuggggcaucccaggcucccuucugauugggaccagccacuuuccagucugugcuucagcuucuucagugcuaacccagagcuagucauucugauuuccaggaaggcugaaaauuuaaucauagaaucccuggagaggacugccuauaguauccacuuacggcaggggcucccuaagugguggcuggaauugugugcugugugcacccaccccucaccugccagcccuuccucuuggugggguagcucacauguccacugagggccucacuuuauccucccacccaugcccugucccuaccacagagcacugggaaacgaugccuguaggagccccggugcugcauucaugccaggcugcuucacaggagauuaaccagccaccuuucaagcagggauuggcugugccacaaggaccucuccaauuuauugacccuggaaagcacuuugcauggucaaaaacaaggauuauaccuuucccuccugauugaaaacagaagccaaaucauagaggcaucccccagaugccccgcuuugccucagccguuggauggccaaugucucucccgggaccaguacagggcagagcagcaagugcuucagcucagcccagaagcugaugcaccucucuguugaccaggcaacagauugucaggggcucucagacccagguucacaagguggcagauuugucagggccuaagucccagaagcucuauuugcuagaaauaugggucauuuaguauggacugggccaggccugcaggaguuggggacacaccccuucagugguuuugggggaccaguguguuggugaggucccaggcaaguaacucuaagaauagaaacuaugguucuaagaaauggccaggggcauugguccauaugggcuggugaccagaaggaauggaauuggccugggugacuuguagcaugagggccuacagccauccggaggguagcaggcagggccugaggcugagacaaugucagcaguacaaucagcugcugcccaugcccugugccaggcagcacgcccuuguguagucugaccacucaauccugccagcagcccagggaaaccaggcugucaucaccccaguucugcagaggaggaaaucagaccaaccccagugcccuggcagucagccugagggcacagaggaggaggaggaggagcaggagcugggguccugauuuucaaggucagagacaggagggcucuggccucacacagucacucugacuuuagcuagcucuucuuuaccaagcacugacucuuguguguggaaaguauuuuucugguaucagacauaguguuggguucugggcacauggcucaaacaagacacagucccugcaccccgggaguucacagcuaaucaccccucuguucaacagugugcuuuugagccccuguuaugugucauccuuguguuggguucuagaaagaccacagugagccacagcccacaugaccccugagcucauggggcuguuggguugguguacuagucaacucgggcuaucauaacagaauaccacagacgcgguggcuuaaacaauaggcauucauuuccugucaguucuggagccuggaaguccaagaucaaggugucugcaggguggguuucuccugcagccucucucuuggcuugcagacggcugccuucucccuguguccucacauggcugucccucugugcgugucugugucccaaccucuauuuugaaggacauuagucaguuugguuuagaacucaaccuaaagaccucauuucaucuuaauuacaccuuuaaaggcccugccuccaaauacagucccauucuaaagucuggggguuaggauuccaguauaugaauuugaagggacacaguucagccuguaacaguuaggaugcuggcacuggcagacuuucuccugagcauuuguguauuggcagccacaugcaugcugugcacagaaggugcacaaugccaugagaucuuacaguaggaccccaaccgagucugggcuugggaaggcuuccuucggaaguggcauugcacuggggucugaggacaaauuggagucucagugccccuggaggugagggugccacaguggugcugcucaggcuauuccugcuggcccugaguaucaccuccgcaucgaaccagccaccugcuguguggacuccugugccuguaagcaagagccacauccuguuuccacaaggccuaccucagggaugccgugagacugcaacauugcugcaccccuacuuaggcugccgauuauggacuuauguccccuucccaccuuacagggagagagacagccuugaaaccagacccagagaugagugaagcaccacaguuggugcuguggccccacugccugccuggccauaucacuggcuccaucagcccuccaaagaaaccagcucuacaauaagacucccuuuuccugucacccauuucaucuggaaugccaagcaguucugcacuggugacgcgugcugacuccagcucaggcuagggcucugcugaaaagcugccuccugcgaucacuugccuaaugguucuuccucccaccacccacugggagagccgugccucaggaauuccauggggccagucacauggccugaugcccuugggcugggccaggauggugcugccacagccuagauccuggguguagccccuugcacaaggucagcuggaguguguccugucuccagcuacagccagucacagcagauggugguugcauuuggcacagaaguacaguccacaggcugagugcaguggcucacaccuguaaucccuaugccuggggaggcugaggcaagcggaucaccugaggucaggaguuggagaccagacuggccaauguggcaaaaccccaucucuaauaaaaauuuaaaaauuagcugggcauagugguuacacaccuguagucccagcuacucgggaggcugaggcaggagaauugcuugaaccugggagauggagguuacagugagccaggagauugcgccacugcacuccagccugggugacagagcgagacuccaucuccaaaaaaaacaaaaaaaaaaaaacaaaaaaagaaguacaguccacaacacacacaagaaaugaaguuuucuguguuuuaagaaagaggaguuuuaaaaaacaauaaacaacaaugacaacugcgcauguuaaaaucacucccuggaugugguagcucagcugagccuugcuggucagggccacuucccggaagcuuucucacuguugcuaauccuucugaagggccugggucagcucacugccuuuggagcccucgguuuucaucugauaaaauggggguaacaauccugucuugaaggacugugaggaguaaaccagugugcaaggaugcccagcauguugcaggcguugggagugggcugccagccccuucccucaucugccugcaccgcaugagccugacacgugccggaguccaggccugaaaacccaaggggcugggcccccugagcuccaugcccguauugcugggcuguagcacagccacgguggcauuaccacuuccaauuuuucaagaaagccuggauaucuguauuuuuacaugaaaucuucccauucucaguugggccacaauguguggucucuguguuggcaccagguccuuaaugugccgucucuuccuccugcugcagccuucaagaggaggccaucgcccuguuucucccaaaggcacugugaggcucagaggagcuagaugacuggcccaccagacccugaaguucccaauggaaguggacaucacccaugguuccacuuagcugggaggcuucuggaaacucagcauagagcaaaagugaaaacacauccuggugccaaagggacaggacacgaugagcccugagguuguggauauuguuauguucccauaaauaacaggcccucagacaaugggcugugaggcuguguguuccucugggguuugaaaugaaacuggcuuucuucucuuuuaaaaugugcucucuccaaccauccagcugcucuguuuggagcagauucuggggcaaccccaauaaccuguccuugggauuucauuagcaccaccagccagcugccuggaaaguagccccugccaggaccaaauuaacuuuuacugagagacauuggcagggcugguauugugcacacuuggcauuuucagcccacacugggauguggguagcaggguaccuucaaagaacaagagcuucggaggcagccagaccuguguuggaauccuggcuagaaugcuacccuuucugaaaaucccaguuuccucaucaguaagguggguuaucuugaggacuuucccuccuagcuuuuuaaauaauuucaaacauacugaagaguggaaagcuuauugagcaguguugcucccuuggcuucaacaauugcuccguguugucuugucugcuuuguuugugcgccgagccgacugaggguuccuccuggugcugcugcugugccugcacccucagcacauguccccgaggaacaaggacauucuccugcagaaccacaacgcaguuaccacuggagaaaugugacauugaugccacauugucuaggauacaguccauuuucagauuccccaacugucgcaauagugucuuaggaaguuuuccaugcuugaggagucagugaaagguggcaccugcgcucagugcugccaccaauaguuuuacaacacugauguuuuugaagagcccagguugguuguuucccagugcacucuuugggucugucugauauuucuucaugacuggguucaggcugugcauuuuuggaaggaauucuacagaggugauuucggggccuuaguguguccuauccggaugucugcccaucauaggcaaugcuagguuugaccacuagugaaggugguuguuaggagguucaaugaggugaugaagacagagcccaggcccagagauagcuguguggagggagugcagcggcccacacucaccaccgguaucauagcucagcagcugugccccaugcaggaugccucuguggccugggaggaggggcaccagcaggucccuugggaaguuacaguaaaggccccggucuggcagcagugaggcagagcugacucucuggagccagaucuagggauauccuaccccucucccauauccccauggggcuaagccagggccuguggagggaggagaggagcugcuacuucccccaaagccuucucuuucucccucuccccgaccacccacccucucuccccagcccagcucuguuucagccauugccccucucccugugaccagcaucagaccugagcacagaggacuggcucuaggcccaucccagggggcaccguuuggguggagauguuacagaaaggagcaagcacuauaguaggggcccuacagggcuuuggagaaagagcauggagugacugcucccuuccagagugaaggugggaaguuuuaccgaugcagugaggcuugagcuugucuugaaggugaggagauuuccccagggagaaaagggaggaaggguguucaggacagaaggaacagagugugcuagggcacagaggauggaaagaguggcauauucugggaauauggaauagaaacuaauauucauugcuuguuaaaaugaguaggacauuguucuaaguguuguauauguuauuaacuccuuugauauauauaaaaugaugguuuuggagcaguuuuuuuuuuaaaagcaauggaauucuuuguuuuuucacccgaagucuuucauggaauccaauugaggcccuggggagccuccuugcuguucaccucaaauccagcccugaggcucauccuuggauggauggggaggaggggaggaggagcuuacucccgaaaggccuuggccuccaugcuuguaucuggccuuugucuagacaggguucccaucgacacugcugacacuggggcuggaccauccucuacuguggggcugccuugugcccugcaggguguuuguggguaucccuggcuucuucuuacuagguacagccucacccaaguugcagcaaugaaaaacuucucuagauguucccaaguguccccuggggaccaaaauaucccccaguugagaaccacuggucuaagcaaguggcagaaggaacuggugguuggugugcagggaggaacacagucagaaagcucugucuggcagcugguuggagggggcaagccaaggccugaggcuggacagugggcacauggggaggagggcagaggggcaggaugcaccccagaaccuguuggggugcagaaugaggagggugauguccagaauagauucuaccccaggccucgugggcagccucuggccagcaaggagggccuaggcaugcccccagagucccagccccaugguaggggcccuacagggccauggggaaagagaggacagagugguccugcaggggccggggcccggcggcagugccucauccauccugaggucucugggugcuuggugguggggggcccugagcucugggcccaguggccuugagaggagggaggcucuguccagccuggugcggaccaggagugcaggaucuuuacuggcccuuacacagugaaugcaacuuuucuuugggaacuauuucucuuugcuuaggacucucuaaaacuuuccagauuugccaguuuguaguuuuagggaaaauuuguauuuuuccauaugcaguuauccuaccuaaauaaagucagcagagugaacugauaaaacaauuaacauuuuaggcaguggaaaguggaacuugcgauuggcugucucuggagggucucuccagaaagucuugauuuagcaaaccaccagcaaucuuagauaccugagagaaaguuccagaaaucagaggccggcccauguucuaucguggaugaucuuggcuugggcaguucuguggaucuugugucugauacuccaugcccuggacugccauggcagcuggucaaggggccuaaaacccugaagccuuuaaauacaugugccagcagcaggaaacucccugccccaaauucccccaugauuuggauucaccacaacacuuaccauguguucagagacgcuuggucaucacagucacuagcaaggggaggaaaaccccuuccuggcuaggugcuggggguacagagggccuggggcaggacggugcuccagcaugcucugccacuacuaccacuguuacugccgauguucauuuagcuccugcugugugccagacuaccugacaugcuuuguugaaauccacuacaguguagaaauccacucuuuuguuccuucagcacccccugaggugggcacuauuaguaggucgucacucacccaaugucugacagaccacacugccuuuagugaccacagcacagcagcccucucugggacaaacagguuagggugaagggugcugggccccugacuauacguaaacaagguauucacagcagugcuuagagcugcgccuagcgaggguuggugcucaccagccacugcugcuguagaugucacuuccaugaaaccucugaguuguuccuggcuuccuuccugucugaggaggaggcaggggaguaauaacaauaacaccuguaauuguaccuauagaaaacauguacagagcagucccaaggcugaguguuuccugaagagcgucucacugaucugcccuguacaaaugucaagaugaggcccugagaaguggaaugacuugcacgaggucgcacagcugagaaagggaggaggagccaggauuuuaccccauuuugucugacugcagagccccagcacuuuaugcugaaagagaacugggagccaguggaguguggaguuccgugcaauguggagccaggcaggcagggacgagugagagaaccuggcacccauuguguggauguugggcccaccuugcucuugccugccuccuccaccugggcucucucaccuggccacagagucagcugaguuuagaauggcacuugaugagcuacagguaaccauuggauugcucaggcacccagggccacuccuggaaccugucuccagggaaccucuguggcccacacaggaucuagcccugggccagaguguuucacugcugccggguaguuagccagggaccuacagcagcagcgagccuuugguuggugagcaaccccuagcuggggcuccugugaccugguguuuauuuagugcucgaagguugggaucaccacgugcauguccagggagcucugcuauccacacacaaccuccucacagauacaggcuagugccuauaccaagcccuucccagcagggcucuauucauccagucuccuguccuuggggugggucagcucuggagggggcuaaccaaaaagauccagguaucacaugcauaucuuaagccaauucucacccauaaaauuucacagucccauuagagagaaagcuuaaaaaucuggggaaaaagucacccacagucuccucaccccaguagcaucccaagggacuuuugguuccauuuccuuccagcacuuuccacaugucacuuggccaggcugggaagggcucauggucgggagugagaguugaaggcccaccuccuucacuggccauuagaccuggaccagccccgcugccucccugagcugcacuccccucugcagcaugcaagggcagugcugaugucuaucauuagcucuggagggugcaguuggaaaccaugaguaugaagugcccacccaggguccagcaccugaagaugcaccaucggugcccagugcugucaucgacuguguggcucuuuuggacgugacaccacaccagacccccaggucauacugcugcuuuccuuggggcuuccucagaggcugcuguucauguuuuccccucgccuccaagggcugugcuuguagacuuguguaagcggaccgugcuuaccucaccaucuccuacuggucagguaccuacaauuuuucccacuguuuuucguuauuauggccaacauucagagucauccuggagcuuuucucaccaucaaccuuugagugugggccauucagucaggacacacuuacucacucucagauuucuuuaguuugccucagugggugagugggggagaccuagggggcuuucuacuggggaccccauuccaguuccuggcacuaauuguggcucaauaaaggcacacugaauaaaagaaugccagaaauuucacugagacgugauuuuccuccauguuuaugauucagugaucaaaguuagaaauuguuaaaaaaaaugaaaaacaauaauauauuucucacuguaugccauauacuuuucuaagcauauuauauauaauaauauaauuuacucuucacaacaaaccugaaggaauuauaauuauugaaauugccauuuugcaaaugaggaaacagaagcacagagagguaaaggaaagugcuccaagucacacagcucuugagccccagagcugagacuugagcccaggccaucuggcacuggagcucaugcucuuagcccuguguucucugccucugacuguucucauuuuuguccaucuguuccaccuggcccugagcuaagggcccaacaugaauuccagaaguucccauuuugguuuggcccagccuuuggggugguuaaagaaauacucuaaacugcaguuuccuuguccuauauaaaaaaaggaguggucccugccuucaggauuguaauagaggaguaagaaaauguguaccaagugccuggacccuuagaacuguccugugaguucgaguguguuucucuuccucuucacaggggcugcagacagucccugggggaucagguguaggcuaaguuuugguggugaggauuugugucugucuggggauugguaaagccacugccucuucaugugccaucuuccagcaccugucugucuggugagcacuucacuucuuguggcuguugcuugcuagccccuuaccuccugcccacccucgccaugggcacaaauccacaccaggcacuaugcucagaaguugccuugacagugcccucuuaguauggcauuuggcaugcuucgcagucggucucccaccagccuucucugccuccccucccucugucccucuggaccgcaggccacccuccagcccuagcccugcagcagcccauagcagcuuuccuucauucugccacuugcgcugggugcucuggccucagcucagaugccaccucuaggaaggcucccuguccuucucaaacggagcagguccucaauguucuccuccuuugcgcaucucuuccagugccacaucggcuucuccacucccuggacagagagcucugaaucccagguggcuccacacucauuccacgacugggcugggaggugcucccaaguggaaggucuuugcuguguuagucuguggccugcacaugcucacugcucacuguuggaugagugagugagugggcaaaccccugugaucuccaccacacacccuuuauaugaacaccacccuuuauuuaagcuagauggggcugagaaauaggguauuugaagccucagauugacccaugugccugaaaaaguucagagguggugcuugaucccaggacucagcccugcccuccuucaggcagcugucccagccaggcuucuccauagauggucuuccagcugcaaguccaguggaguagggugccucuuucccaguaaccccaccaaagugcuagagccccacaccauccccagaccagcacaggagccuggggcaugcacaguucucuggccagccugggucaugugcuccucuuggcaccaaggaugcacccuuuugcaacccugcauccccaaggaaaaccaggggcuguuacuagaaguaggcggaaacagcagguguuugcugcaagcaggaaugcccacugugcuugggcuuuccucaccacuggcauggccuuaccaucaucaucacccuaaccugcacagccacagcccuucccagggccccgcagcauucugggccagcuucgcuuccugagcccucuggacugcugggguuucuuccccagaggugagcuucucuaggcugagggcuggacugagucucccagugucuccagggucccacccaucagcuggcagaccccagguaagcuguguuuugucagguauguucauggugggauuugaaggaccucugucccuucagccauugaaaacuguuccucuccccaguaacagugaccaucccaguugcaaauacaucauucauccucauuagccuuggcacacugacuugugugguggaaagaugauccuucuggccaagcagugagcauaucaggauucaccagugccuaacugggacucagaagucucagcagagucagcagugucucaugauucuugugaaagaggaaagauuuaaugucagaaccuaggucaggaauaggugauuguucugcacccaaagguuuggggaacccucacacugugggcuaauuucccucugucaccugggggaagaaggccccauggcuucuucgugcccagcagcggcacaaucucucacucaggggucauggccuggccccagacuuuuguuuccauccaaacugguuugaaaaaaaccucacaaacuguuuuuuuaauaaccuagaaguauaauaguaauagucauucaaggagauuugcauguuaaagaaaauaaaaagaagucucccauagucccauuauuaauauuuugacuuaguuucuuccgucuuuucucugcaaagccuucuuuuuauguaauugagauaugguguauacaauuuugugucugauucuuuucaauuaauauuuauuauacaaacuuuuuuuuuucuuuuacuguuuuacucuguggucuccaagggaaguugaaccacguagugauuaagagccugggcuccgggcucagacagagcuuggucugaaucccagcaccauuacuuaccaggucuacaaccuagauaaccaagcaggccucgcugagucuuaguuuccucgccuguaaaauggauaccgaaugugcccuagguggagaugcuccaagauauaaauguccaguaaaauguaaaagcacaugcaacacucagcaauagcaagagcuguguucagucauguggccauuguuuucaaugcagcguaacaguaaccaaccuugccaaggccuuaaugggcuaccuaagcaucuguggauguuccaucucuuguaaauaacauugcuggaagcaucucugucuauaaaucucuguuuuaauauguaggguauuuucuuaagauggagccucagaagcugaauuguucuaauuuuuaaaaugaaaacaucacagacauuuaaaaaguucuuaagaguuccuggcaaaguguuucccaaaaguacagugccauuuuauacuuccaucagcagugggugaaggugucuguucucuaccccucaccagcacaggcuccccuguguuauuuaucuuugcuauuuuccuacauggcaaaugacaucucagugucuuuaauuugcauuucuuugauaacuaguaaagucaaccauuuugccauauccaaguuucuuuaaagagauucagaagaagaagauaaguggagaaaaacgugcaguucacagucuggcaucuuuaugacugucugccaaaauuucccacuucagccuccuacacuggggacuagaguaccucuuggauucugaccugcagaucuccauaguguauacucgucaccccaacccugugcaauccagaggcaccucuaccaagauggcuuuuguccuucacagcaccugcaucucucauccagaugcccuuugugacuggccccaugcugagucacgaacccagagcccagacccagggccugucauaugugggcauuccaacaguccuccuccaucugaggcccuucaggagggagccaccacccagaagaguaggggagguuucucagagccuuaaaagaagagucagucuuugaucaauccaaggacagccugugaccucccgccugggacaggaaucauguuggaucugugcaccacugcauccccagggccuagcacacugaccaaggagggagauaagcccaccuacaggcagcagggagccacugagggucuuugggcagaggaacuaggauggaggaguguuuguggacaguggugguacuaguggucugggggccuggugagcugcucguaggagccccugagaguucauggcaagugugggaaagccaguacaggacucaggcagcccucucuccugugccugacacccccaggcuggcugcuggccccagcugcaggccagccugacucugacagcugacuucuccaaguugcuggcuguucccagacagcucaucccacucccgucccacagggaggcccgaagccagcuuugucagggcagucuggauguacuugugaccccugaggugagggcaaacucuccacaggcaauccugggcauuccacuggguucugucccacacagcugacuggucggccagggagacucuggaaaacagcuugguugggagaaaagaguugaagagaggugaggggugaaaguugagguuucagaaaaucccuguaaaaaugaaaacaaaccauccaucuuucuccugggugucuuagcccgccacugcccuuuguggaucuugccccagugucuguagggacggcagcucugaaaccuaauccagcagccagcuagcugcugccaacccccacccagugcaggaaugcccugacagggccagccucuccuggaagccguccugacggaggagcaccuuuaccaagcgcagagagcacuucgggguguacuuuuuuccccaaaugaauagccagccuccucccgcuuuggccauugaagcauuucaaagcaauuguaaaaauuauaugaaccccaucgaagaacuguuacaacaguguuuauacccagcguuugaaacaaagacaaugauauuauaaauaauuguagaugaugaagauaggcaagaaaaaauaacauaauuaaaagaauuuuacaagacggaccguucacaaagauggauggaguaacacaauacguuaaaaauaucugcaauuaacauaaacacagccuaguggacagaaaccaucugcuggcuggccucucccugggcauggucccaugucacacagggcggugccagggccuucacuguggcugucaugucucuggggccccuaggaagaggcugucuagggguaucuuuccuugcggcaaucggaggcccugugaucugggaaugauugagaaggaaguacagaaacaaaagggaaacugaggacuuuccaagaaggagugucuucguggggucacagagcuuucuccaggagccccucccucaccccagaugagguugggucccgucagcuguccccacacacccaaugcuuuuccaucacagagguggaugaaugcccagggacucccaagaaugagucauguggccagccucucugggcccacacaugcuccaccuuguguuggcacauaguagggccucggccccuguguguugggugacugaccuauggcuucugaggcuggcauguaagguauagggagcaaggugcgauuauuggucucaugucauuagugggugucuacagcagggccugaccacagagcucuggcuggacucuaggugcuuugggugcaaggugcuuggugccauuucucgugaugacugccugaggugggcaccccgauacccacuggacaagagccgaggccccgagagccucaugcuuagacagagacugcccaggagcacaccugaggcuuuuauaucuuaccuccccuguuaucccauccccuuuucaucacuauuugauuuucuaaaaguaaaaauaaaauuuguuuugaacugugaaaaacuuucaccauacagaguacaguagacagcccuguaaccagcaagaucagacagaugugaacuuuuugucacauccuucaaucucucuucaccucucuucacacccuuccccuaucuuguuugggggaagugaaauguacagcucaagcccuccaccaugcucucuucggcugguggccucacacacaugugcagcuuucacacuuuuccugcauaggguggccuccugagcagccuggaggguucguacgugcuuuacguuuuacauacuugguuucacacugacccagguguuauuagaacacugauguuuucuuuguggaacuugcuguucuggucagcgguucugguugacuccauuugacugcuauauguuaucccauaguccgaauuaaacaauuuguacaccugcgaccuguuggguggguuguguccacgucuccacaaugcagagcaguauaagaggguuucucuaggcaaguagggucaccuggugcugggacaugugcaccuguggguggagggggccccaauggugccggccucucccccaccagcacuguguuaucugacucaccguucccgccaggugauggaugcagccaucugauaaucagagcugcuuucuccccagaaguucaugcucagccugguuucuuggaggccuaggaucaacccagaauaucaggccuugacagggaaucuuugggccuccccuaagcagaguggagcugggauuucugauuggcucuugcuauggggugaagggaaaccugggcauuuaguuggaaagccaggccccuggcuugcuccaugugauuuccugcuagagaccaccuccuauccaugacuuggagucagacacccuuggguuugaauggaccauggguuaagugccaccaggcaguugguucacagcucugcagccugugaagaggaaaugggaagcaaguggagaugaauggguugggcggcugguguauauuuggcccucucccugaguggucaucuuuauuguuguuagaaagggaugauugccgauugcuagaaauaaaugaucaggucaaagauuuggaaacuggcuuugggggcugggccuucccccauguagugggaugaugucucaugaggcaagaacaggcuuugggucaaggccaggaugaguuccauuaggccugaacagcgccagagcucuggagccccagaucuguacauucaugcgucaaucaccucugcgugccaacccucagcucaggcuaggacucaguggcaagagagacagcuuugggccugcuuccuggagcuuccacagaagggguaguuggucaggcccaggagcauaagcuucugugcagcugcgugccguggaggaagagggcaggucugacacggaaggggcaucuucguggggccugcaggaaaugcagggcacuucuaaggaagcagcacccaggagaccuggcccgggguucagagucuacaggguagcaggaagggcauucugggagggaucugcacaaagauguuccuuucccugagguggaaaaggaaagagcagaagggccuguggcuggggcagcagggagcagggggaagaacaguggagcacaaguacgcugggccacgugaggacgccauccacuaccucgggacgggaggagacacuagagauaggcccgaaugugguucugugaagccacuucccagguggccccaggcaaggcccucuccucucugagucuccugcucucuagaaugggggcuaugacgcccagcuccugggguugucaggaagaagaaagcacugcccaucaugaccucucuguaagccccucugggcugcuuguggagagaaacccaaggccucaaaucagaaaugcuuccuucagacuccugggccuugaggcaagugucaugggaaauuggaugccaaccaagcccagggcagacacgcugugccaggauucagcagagcagggagcgugcagggagaggcaacccuaugcccucgucucagagcaggcugugugcgcccagcggacacggcaccagcaggagcugugugggcucggcuccaugcaggugcgccuacgucuauguguguccauguaugugugugcgugcucacgcuuuugugugugugguguguuuuugacaggggggaggugagugagaggccagcuuccugacagggcaguuguaaaacauucauaaaacuuuuauuggacuugccacccuuccagauaaauauuuuucgauuuuaugggcuuguuuuaggaccccaagcuuaaucauggcuuuguggcugccuuaaagaaauuaaauauuguuuuggcaaaaggagcccucuuccccuaccccugccaaaggcagccugaacucugagcucauaaauuccugccacucucaacucuugcccuuuuucccuccguagucucagagccauacuaggaugagcccgaaaaaaaaagagggagagagagaagaaaaagcaaccccuacucuucucccuccagguuccccaacuccccugacccuggcgggaaauucaacccagcucauuuguccacacaagggagcgggcagaggagucugugcugggcagucaccugcugccucccugagauggcaggcugccuuggcuggaggcgcccccauucccccagccccucccugccuccuggaagaccugaguggaucccugcccccaguuccucagaucucauugccucugaggccccacuucccacacugccuccucgggccccucugaauacccuuuccaaaagaacacccccaaacccagcaccaucccgcugucucuuugcuguacugccuuccuagcaucuagcacuaucggaaacuuucuccuguauucaucuauugguuacaagccuguccccguuacagaaauaacucacaccaugcuggacccccaccccuggaacagggcccagggcacaauaagugcuccgugaauauggggaagguaugcucagugaaugggguggggugauuuggguaaggaauaaaaauaguaaacauucuuuagaccuugcuuugugccagccgcuguucuaagcacuuucuguuauaugaacucacuugggccuuacaccaaaccuguucccauguuucagaugaggagacuaaggcgcagagaggucacaugucuuuugugaaggcacgcagcugaucugcgccuggacuagggucgggaucuugguggucuggguauagagccugagcuccuggcuguguguuacacuggguuuccuggaggaggagagcaagguggcugugcccuggccuggaaggcaucagccagcacuuggcaggcaccacccccuuccuggccucgugccaggcccugagucagaggugcuggggccauagggcugggacaggaggggcucagacucagauacagaugccuucaaggggcaggcaggugacagaaaugaggggagccagucucagguaaaagcagcagcacaugagcggugacagagaguagcuggugugcccagggcccagcacaggcccacgccagcccacuguggcaggguaggaauccaaagagaagucuucuagcuuuucaagacaaacuagaaguucagaacuguaugucaaauguccugauuuaaaaggugaguuaguaguucaaauauuucaaaaaugccauggaggcuagauucuacucccaagcuaauauaguucuuuuugaucuuugugaaaguggugagccccaggaagcccaggcacagagccuagcuaaggaggccuucuuagaggaggcaguacugaguuccaucuuggaggaggguggagagacagccuggggagagguguuccaggcagaagcguccguggcucugcccaggagagaagguaccacugcugcccagaguggcugggcuguggaggacuacacaagggaaccagauaccuaaaugcuggaagaggucgggguuuccccugcagcagccugauggagccuccagaagaccucaugggccauguugugaguggacugguucagaggugauuugugggguccagcugccagaauggggugucccaggauggagaugagcagaccagagcagagugagugugggggugaagugcucaggacccagcauacacagguggcauugccagcuugugggggccuuaccaaagcccuguaggcgggcacccgucucucccagcauucccacaugcacgcaugcacaagcacgccaguugcuggggauggaguggaggguacaaggccugagguggcuguaccccugagccccuagggaaugcaacugaggcuggagagggaacacguccaaggucaagaacucguugagggaccacaucagaggaacagagcuuuaacuucauucagccgcuguuucccaagcauuugcugggcuagugcacagggguuuccucacugacuccuccucacugucugccaagagaggugguauuaucuaucccccuuccacagaggaaauuacugagggccaaaguggugcagggcuguccccagguugcccgcacaaaagcagcaguggugggacaggucccagaccccccaguugcccccugcuaucucccuggaaguccauacuggguuuuguuugaauguggggaagaccaauacaggcagaccauccuaccauuaugauuuuaccaaaccccauagaugucaggcuuccuggcccaggacaaggaguggcagaggcauagcugccaggcaccuuguccuagcccagcucccuccuccuccagagaaaguccccaggccaccccaagguguagcaugcagucuggacaccuccaggcucuccagagcagucccagcagcugcuauagcucagacccacgauaagacccaacccuguagguuucagagcuggccacaggggccaggcaggcagcgcaggagaguagcccgacugggggacugcaguggggagcggggagugugguguacagggaccauacauccugucugaaggggcagccugugcucaccucaagccaccugcugcccugggaaugcaggcccacauuuuaaaauguugacaacuaguccacaauuuuuaaagcacaugaagaggccaaagcaaacauaccuaagggucaacuuugacccacaggcagcagauugugagugcggcuguggcuugcaggguguccucccacacacagcucagugagcuugccaugcaccagucccgaugagaacaacaguggacacuaacauuuacuacaugcccagcacgugcugacuguuuuauaugaguuaccucauugacuuaugaguuccauuccaccacucacuggcuaagcuuggagagugcaagggccucacccggacucacgaucuggcucaugaggcuggcccucugcccgcagcccucagcucccuagccugaaucugggcagaggaacaagaggcaggaggcugaggccuggggcacgacacugauaggcaggucagcccagaacaguccaaggaggccugguucuaagggagggaacaucccacgguggaacaugagcagcaguuccccaagugggcugcucacauccacccugggcgugugcaggaugacucuagguaguccacaaauaagcccccaaagaauguucacaguuacauguugauuuuaacagguacucuauuuaugucaagggagacuggauuuccacuuauggcagcauagaauguucucuaauugaguuagaugaguugacuaaagaaaucuuuaguaaauagucgaagugguggcaauggguauggcagaacuagugaugcugagaaagauuugggaaguccugggggagauuugagaguuuugaugggugaaguaggguucaggugggccuuccaagggugcaugaaaucuaccccagggagagaaagaaugaccuacaaguuggggccauacccuagcaggcugcaggcuaccuaugcccugaaaacguucucaaaaaucaggaauuuucauguaaaaaauccagauuuccaguuucucuugaaaagcaggguguucuguccaugcugagcacauccccuccaguuccccagggcccccagcccugugggauaugguaucagcugagacaggcagugggggggggaugcagugacaggugacaccacagcugaggguagugaggccaggccuucaugguggcacagccaggccccauggcugcugugugagucugcauugcuauaaaggaacaccugagacuggauaauuuauuuaaaauaaaauuuuaaaaaggcuguacaggaaguauggcacccguaucugcuucuggugagaccucaggaagcuuacaaucauuguggaaggcaaagggggagcaggugcaucacaugacaagagaaggagcaagagagugaggaggaggugccaggcuccuuuaaacaaccggcucucacauggacucacagagcgagaacucacucaucacuguggugagggcaccaagccacucaugagggauccgugcccaugaucuaacaccucccccgaggcccaccuccaacacugggggucacauuucaacaugauauuuugaggggacagacauccaaaccacaucauaugcuggccucugcagccuccucccaggcagggcugccaggugcucaccccucauaggccuggcucugugaauuaccacagggcccaggugaggaggauggacaacuugccugguggcgcgugggcagcucccucagggcuggcaacaccagccacccuccucggcccugugcuccuccacugguacugcaccuggccgcaggggcugcaggggucacagggguaugggagccauggacuggggggcuuuggcucaggagguggcuccugaggacagaggcaguguucugucccuucuggucagacccaucugcccagcauaugcuugaguuuugcuuucauaaaaauauccacauguccuggcaguucucaauaguucugacuauuuaggaaagauaaguauacaccuucuucaaaguucagaaaugaaggugcuguguggcaagacacaaaggugcaugaguccaggcucgcaaaagucgugaugccaagaaagaucugggaagucuggggggcgucgaagaguuuugaugcgugaaguggggcucgggugggccuucugagggugcgagaaaucuaccccagggagaacagauaccagccugaauuaagucggcugcuggccucuccucagcucagcccagaaugggagaggaggcuauggacuggcacgaagaaggaucuuugucacgugugcuuagcauuggauggcagggccaggcugggcuggccccuguggcaccaccaagaccccucccuacaggcuccacuggggcuggggaaaggaaugugcaccuauggaguccugcgcgcauauggaggcccacucaaacccugcgaguguauggagccccgcuugcauguuuggagcccuggcagcccccaccugaugugccugccccaggcagcauggagcacuuccuggaggaaguaggucucagccagccuuuucuagaugggcacgggcaggcacuggauggcuauuuaggcaugagggugccacgagcagagaccuggaagcucaaguaaggugcagccauuagggugccaggagaaggaggccuaguggcccagccagccccugggguugcccuguccagagccuacacccaccagguccucacucugaacuggcaguggcagaaccacgacuugagaaaaaaaguccuuucucugagcucuguuccucuuuccauugcucccgcucuuagagucuuccuuuuuuuaauauccaauuuggucgccuuccuuggggacagccacagaagggguccagcccuguuggcagccucuugcccccgccuccacuaacucgccuccagcacuaccuccucuagcugccugcaugccaagucccccuccagugcuuccugacaccccuucucggaccccucaauuuaucuacaguccaucucugccuucgagcuccuccaggguggggaacagggaacaaucugccugccaugaguccgcagccaccagcagcgggcuuggccaggguccacgcucuguaacugccguuuagguggggucugagcccccggcugccugugacaugucugcccaggugggcugugucuccacugcagcacccacugcucuccagugagggacuggccuggcccgagccuccugaguuugcugagugaggccacugcuguguaaggcccauucccugguguagucugccuguaccccucaucccuuugccucuucgaggccuucuccuggucgacugugugcuuucaguggugccggccagagcgucuagcagagaggccaacugcugccucuagccccugagcccuugcagggguguuuuuugaaacucaguccagaagacgugaaauggaggagggcugucugucuugccuuccugacuagagguagaggguccccaagcugcaggucugcuguugguucuucagggccucuucaguccaccugacacccacucuugauuucugggucaggagccugaggaacugccuggacugucccugugccucauguggugcugggacccaggagccacaagagguagucagcuggggccaccaccugaagggcagucuguagggcaggaguuccaggcaagggagccggugugcccugggccgaggcagccugcgguguccuguggccggagccauggggauggaggcuggagggaggcaggcaggcagaggugcugcagcgaggcaucuuaacccagcuaaggagggagcgcagacaucuggagcagcaagggugcugacacucacccgaggacaucacagcccugcagaggaggaagacaagccaggccgcccaccacucuggcaggcauuuugguuggggaugggcgggcauaacaggacacaggaggucauccgauguccacauuuccccacacagagugguccugccuggcaccgucucagccaucccagacagauuuucuguucagccuugguugccauaugaggacuccacccagagggcccacauggccuccuaagucacaagugguuggugguaaacccaggccuagagcccagguuucuggcuaucccccuggaagaggcccaccuugggcacuugggaacaaccccugaccauccuugagcccacgcugcugggugaggcuggccgccuugcugcaggaagccugguuuauaaacaaguccaguuacaggaagaucgggaggguuuuugguuuucacuggacgugguuguuucauggacccaccccaacagggagcauggcaugcuugaccuugggaaagggaggccuuggcuuaacgccgagagccucaucugccagcagagugaugugguguggacugaggcugcuccagcagaaugggcagggcaggccccagaugugaacuaacuagcuugagagagcaccuagccggucaagccuagcccacguggauccagucccaccuucuuuccauguugguagcagaagcugggaguccgguugcagggguggcugaguuggcagcgcccguaagaugcuguggauuuggauuuggguccuggaggcagggaggcccagugucauggguaugcuaccaccacacaacuauuuuaaaauagaaggcgcuggcccuaaauuuuucucguaucaucacauuuaucugcaucuugugaaagugcuuugccucaugaacagucccauaguugggacuguuucuccuggauauaauuuacauuguugugacaacucaaagucaugauuaacacaaaagugggacuuggggucacucaguggagugaucugugcagucacuucuccucauucauccucucaccuguccgcucuguuaauguguacuauauagaggagguggcauuugcuggggagagcuggcugugagaugggcaugggcccaggaacaagcacagccaggcucaggaggggugcauguggggaagggaccuuuucgccucuuugccacuguauuuugggagguagaggggguuagagcuuugaccaccacagaagggggugagacagaugugaaucaccuucgccaaaugaaaaaaccuaacccagaauguuaguugcuuugggcuucugugucugaaagagagaggcccuugcuugcuguucucuacagacagucaugcuggagugggcccugcaggccugggcuggaagcgacacaggacacagcggccacaaucuaccucuucucccugcuccaugcuguggucugugcccagggcccaaggcagccagagggccccugcccucaggagccagacccagccccucugcagaucuagcaggagaccccacuuucugcaccacucgggcacccacacaaacacacccucauaccccaugaucaccccggcuccaucuccugcucuccccacacgcuggccccagugcuggcccuuggggccuuugcuuggcgcccucaggcuggguguucuucccucccaguguccucaucccucacaagucccuguucagaugucaucccacccugggcccuuugcugaucacuaucuaaaggagcaaaacacccucuugacacuccccucucccgagcagcuggcaccaccugucauacgacacauggauguguuggcaucgccugucucccaccagaacgcccacacugggccugcgugauucccucaccucugcagccccgcccccggugcaugccugcauagaguaggugcucgcuagcauucuugauuaaaugaaugcacagacucccuggccugggucagccauggcauucuccaaaccacaguuccuugcccucuaaagcaguggcuggugcugugcucauuaauuccaaaaggcaagaaacgaaauggucucccgccccaagcuauggagagcucuucaggacagcagccucccaucugucuccccagaggcagaagagccccacaccuggguugggguggccucccaguugaccaccaaagguguuuccaaccucgagguucugggcccuggcuggugaccaaguggggaagcccaucuggggaaggcagggaggacauggccacgacugucgugguggugcccuccaggccugcucagggugugguggaguccaggcauggcaggagugagugauagagcaagcgcuuugaagcaagccaaugcucccaguucccugacccucaccgaugggcucuucucucucagcacauuuuuaaaguuugguuccuggcacccguuccuaucaggugcucucucauuccuuugcacauuucucuacacauauaugugggucuugcacccccuggacuguggacuccaccagcauagcggccccaccuggcccacucaggcaguccucagagucugggacagugccuggugcccagcgggugcucugagggcaaucaugggcagaaagacaagcaacgaaugcaggagugagcuucugcuugugcugugccagagggaggcgcccagcaccauggaugcccugugggggccauuggagggagucugcaagcgcuuccagaagggcgagugccugagugugccccagccguggcuucccuggguccugucuuugcggagagcauggugauccuuugcuccucuucacccaguuugcaagagugagguggccagcugagggcagagcuauguguucugggguagggaucugcagcucuuaacagccugcuggcagcccucaugcccagugcuagccucuguugucucugagccagggcaugcgggacccagagugggaguuaggcagaagagacccgcaccagccccccgugagggcagcagacauugcagaugcagguucuggagccagccgccuagguucaaagccaggcccccuauguccuggcugugggaacugacgcaagucauucaugccaugucagcugguuguuccucaccggggagcaggguuccacaugugggcccugcccaccaggcaugcagucuugcacagacggggccugcccagggaggcagggucauuguccccuuguaauaggcgaggggacccaggguaccucagcucacccgugacagaaccugccauccaccuguauucuggacaggaucuacuuccaugggccgaggcacgcggcaucucgcuuagggccuagcugucaugggcacucagugccauugcugcugcccugacccagagcaucccuggccccacacagagccaaacaagugacaggaggcugccccucacgccaagcucccuucccagcaugcugcccagaccacugugcacaaccacucccgccucaccccugagccuacuugugcccaccugagagaguguggggggaugacagaggcugggccuggcacacacaggcugcucgggugcugcccuaggcucgcugucugcuggcuccacgugcccucgggcugguguggggcaccaugagcagggaagggggugguggguacagcccccuccccagaccuccuucaguguuugcugucuccuguggcccugguuucccuugguuuucagggucuucagaagacagggggccuccucugagcccagccuugcugucagaggcccacauguggcagccauguguccaugggaaggagcaggagguggcagcuuuucccagcgcccaggcaccuggccuuuaaggcuuccacauacuuuguuuaaaaaacaaagaagaagcuuucuuuccagagcccucuguggggcccucccuaucucaggcccucucugagggcuucccccuuccccaucauaacagcaggacccauuucacagacaaggaggcugaaguucagugcaccaccccccaggcaccugcagagcugagcaccuuuccaggguacuggccuggcugcuacagggacagaccugggaaagaggccaugaugacagcuguccuuuugguacacacgcuggugugucccagaugggaguccuggcguucacgcugcugcagaaacaugaacaccagcucuguuucacugguguuggcucuguccccaagacccauccuuacuagcccuuggagcccaggcuucugaggguagagggacaccuggccagaggugcuccaagcugaggccuaugcacuccaagaccggggggcagcauaucccagguguaaaacagcccccacccagccacaaugcaggaucugagccuguggccacuaagagaugcaaccugcccagggcagaggcacagacuguguuuuggaagaaaagacgcacagugccacuagacaaggcccucuagccccucagcagcaaugcuggacaguacugggccagggggcuacugcagagagcccgaguccauggcuggugagccaagaggcaguuacagugggagguacugagggcugugagguaggugcagggccagggaccaggauguggccacuuaugggcaccugcuuugugccuggcccuguccugggcauuggggacccauuuggucacauaggccugagagcugagguggacacacggccagugggugacacgugugcagcaggagugcagccagcaucagaaagcgugugggcauuccaguggggcgguggcgggggcggggggugcggaggucagcccaugggcauaccugccuccccugggccuugcagccacaggccaccucugggaucugccuccgagggacagugugugggcacauggccaucagcacagacacagggugccaggccccagccccuguacccacgcucacccugggccucagccccugcaggucagggagggauagacuguuggagucugcagcuuucaaaucaggaguguggguggggaccagagaugccacgccaccccugcccuuccccugucagcaagaggacagccagcaccgccgccugcccacggccucucgcucugcucugggaacagggcugauacaguaaucagggugcuacauaugggcucuggaaaaugacugcuccccgggccuuuguucgccuucauuauucuagacgguuuuuuucccccaccaagucauaaaaaugacauuuuuaauauguggauuuuuuuuuuaaagaaaagcaauaugaagaagacuuuuauugucaauaagcucuaccuuuuaaaccaguuaucuuaguuucugcucuagguauuuuaauugaagauuaacugcuguuaaagaguauacacauuuagggagugaguguuuggaguauuaaaauucggcucccuugguggggauggagcuccacgggaggccaccaggaaccaugcucccccaauggccagccuuggggggcugucugaggaggagggccgccugcaggaggggcccauccuugccucuggccacagccuuuucuuucauuggaaggggcaggcuggggugaguccuagccccacaggggagcagaggacagccugagagcauauggcuguguggucagaagggcauccuggcccggccucugcacccuugguugaagcaagcccuuccuuccccuuggccagccauuggguuugggcacaaaggaaggagagagggaaagggccacuaaccgagcacucugugugccaggacuucugcaugcagcguuggucuccacggccaugagcgaggggaguguccucccugugcugcuggcagcauggggccuuaugucccuagagcaucuaugaccccgggcaggccugucccccucauuagacacguccccagcauccucacagcaucaggaggucaggcgccuguuaucccugcgucacaagcagacaggagguuucagcaugugugugaggccuccgggccagaaggcagaacgggagccauggggagugggucagcucccagacccucagccagggccucagcagggcagccaucaguggcccacuccugccugacccacugcuccauugaggccaugcugccucacugagaccugcccagggaaaugucaccuuuuccaccacagucuuccugaccccagcuuccuuccuccuccuccucugaaugcccgggugugacugucuguggcuccuucccuuucuucccagggcuuuucacugcugucaugggugguuugcauccaagucucccucuaucucaagaugccugugagagaacaaaaagaggagaaaacuagcucugcauuucccuguucuuugucaggcccagcuuccucccagcagagugggacuccugccaggccucccucacaggggaucguggccgugcaaugaggcggugucuguccagugcacagcccagcacacccaggccaaucagcagccaggaacggggcccagcagagggcugagccucaguuguagcuuaguuagccccgagcugacggagacacaaugauacagcacccucagccacagccaugaucagaauggcaguggccucucuuuaccaagcgcuuccuggagagagccgggccaugugucuuauucccaccaucccucaccccaacugaggaaaaaaccaaagcuccgagcaggccagucaagcugcugugucaccaagccugguguccaaaccccagccaugagcacagagcucaggcucugacagcaccacugucaucccugccugcccugcaggugucaaggccugccuucaggaccugagauggccuggacagccaccauuccaaccaaacagaaccugcugaaggaauggcccugcccucuagggggucccucauucuagaggcacauguguaucugugugugguuuguguguguguauguaugucauggaccaggccuggcuuaccaacaguacaggcacaggguggcagcuggcggcgcuaguggagaagagagacagccccuuccucuagcuccagcuaccuggagaggaagcugggcuucuccagcuacuggcgaggacaugugaucucuucucugccacugacugugugaccuugggcacaucaauuugugucccugggccuccauuucuaccucucaaugauggaguggauaauguacccuccucacaugaguugaggcacagaaagcacuuuucugauccuuccuaccccaagcccugugccaggcacugggacacacugucaaaugggaucgucuccgcccucccaaagcccccauccaugcaggaguuggacacacagcugcugagagcugggacugguuccugaggguggauggccuacugggcaugaggcuguggugcugugaaggguuugagcucaggcccaccacguucuugcuguguuaccuugggcaaguuccugagugcucugugccucaguuuccuggugugugugaauagcaugauugugaacugagguuugcuguugucuguggagcauguggaauggugccuagccuguaaaggugcagcaaacauuagcugugauugcuacugggguucuuucugugauuguugagaacuggcuggugcccauuuuugggcauuuugggccagaccucccuuacacaagauggucuuuucugugucaggcccccucuuggccaucugggcugcuuucagugccagucuccacaguggcaaggccccgcagcccacaguccugguugccaauggucccccgacugguacccacaacacagaggcacccugggccucugcccuggaaguguuuggagacaaggccccaccuggcucagccccacugcccugggccugggagaugcugggugggaagaaacaucauucugguugggggaguccccaguugaucccacacccuugucucuugccauccucccuccuuccacaggagauggcugcagcccccugcugccccccacccauggcacugccauccaggcugcuguauucccuguagccagacucucaggcccguggcaggguggacagcuuugugaagcuggggccuggaugggaaucgcugcucccuggcuucccagcuguugugaccccaggcaaccacugggccugccuguaaagugacuuguaggauguccugaggcuggaauaaaaugaugucuuugcagccccuggcugagugggaggcauuuggaggaggcugcuagaaaggcagucacuaugaggguggcaaugguagcagcagaggggaccucuggccaagccgcaucccagcugccaaucugcagagccuagcuugcccagggcugcaguccaguguccuucccauccagacacuugucaaaccucagccccgcccagggccagccagaaggguccccagaagcacagaugcacaggcucaccuuccggaaacugccacugaagcagcucagcucuggcccagcuggccucuacucaucaagugcaugucuuauucucucuggacggaggagucgggcauccacccagcugcucuggcccauggauggggggcaugagccccaagggaaggggccaggcccaggccucccuacugauuccuccuccuaguucugggcaggcaggcucacugccugcagggaugacaggaaagucugugcaguccaguucucccaccucugccaucagcccagcugguagguggucggcagaccugcucaccccccagccucugugcacugacaggacccuguggaggcugucagccuggaggagggugaugaggagcccagaaggugggugggggagcucugaccccauuggcagaugagguggggugcacacgggcugaggucaccaauacugccccuuccuggcauugcugggcugugcaggcccugacuaucucugggggcauuggaucuguacucagggcagaguguggggggccuuggcccuaggggaaggcugggcaggcgucagagaaggccaagccaagaugcuacagagccuugugccgagagagccaagggagacagaagcgggcaagauagacaagugucauggguuccccaggccgagggagcgccagucccgaggcuggggcagugcugagauggaagaggaaugugugguaaggaugugcagggcuguaggggcagcuucugagggacuccuuagaggaauugggacccugucugagugguugugagggacugaagaggucuucagugagcagcugaacugagaggaauguugggguuuuguccuagaagaaucucuggcaacagcacuaaggacagaccagugggagaggguccuggccacucaugugcaggagccccguguccgggcccuggggcagggaccugccccugccgggccugcagggacaccuagagcaggagccuccaaggagccuguggcaaaccaccuucugagcugucccgagaggcugggcaggcgccccacucgcagcugugugagccccagccugagcuucuggccugcacagcaaggaagguaaccuuuggggcagggcuggcugcacuaggaaugcaccucacggaggccucacagccacuccacagggugggggaucccauuccagagggguaggcugagacuccgcugaugagggaugggggcuaucccugcagcagccccuucaggaggcagcugguccagccagucccagagggacugagaauuuaggacaacaaacuuuccuccgcagaggcugccccucccuguauaauugagacucagggccaagucauuuucugccuauuucagaauggauuuguuuuuugccuuaaaaaauaaauaaauaaauaaauaaauaaauaaaauaaaaaaaaacccuuccauccgcauaaugcacugguguucccuccccacgcuccccaaucuccacagcuuugacugcaugauaauuucaauuuacauggugcgggaaagauuucugcaaagggcccuuuuuuguuuuugaagaauucaucauugcugcuaagaagcuuaauguaaauuaaaggaggaauuaggcaacauuaagacaucaaaaugggggugcggggcgcugguugccuacgcuuccgcccaaucaaaggggugcaugagcccgucgagugcgcgcuugagagccucggaaagagcgaggcuccugcgaagggcccgcuccgccgccugcuucccccuaauuccuuuuguugcagggacagcagaguacaggucugauaaaaacuuaaucaccuuaucuuuuuaaagcaaauugcaucuuuguuuacauacgggauccauagcugggagggaaggagagaaaaccaaggagccggccccccccagccagcgacguuaaaggcuuuagcuccccaggaaaacagaagagcccagccugacaaagagguggcuggaggauuccagagucgcugucacugcucacagaggagacuggugucagggcuguccccucucagggagcgcucacacuggcucucucugcccaccuggcucuccccagcccugccaggccuguccuccugggccucucuguccccagccgggucuguguuagagcuaaacccucaucgccucugccuguccuccgggcccgggcugcccugcccugcuagcaggcagaggggucugcauucagacucagcugcaccacaacugccaggaagccagggcaagucauugcagcuccaugagccuggcuggccgcugauagauggggguguugaugucaaccauagccuccaugcguuucagacaugaccgccaggccccacauuagggacacuucugcccuugccagguucccccuucuuucugucuccccaccccuggccuugggggcagcucccucuuggccaggccugccuccagccacgcccugacuuagaggucucacuggagcacugugccacccacacaccuccgugaccaccuguggccugugcagggcagcuuccuaccuugggguggaggggaacuugacauuggagcccaccagcacccuguugagggacagggcuccaccccagcugccccauggccccugcugauggggguggccuugcuaggcagccccuccuguuccuagggcccaguauccaguucagacuggagccuggcugaauccaaggcccucuguggcuguccagccuggccaucccauauaucagccccaccugccauuuaggcucccagcugucagucaucaccaggaugcugaccccaaagagauccccugccccuggcucuggcucucuuccaacccucuccaaaacugcuuguuuacagcaguggguagugcuggagugacuagagcggccccagccccacagggccacaaaggggccagugaccccaagcugcuugcaaggguucaguucccacuggggcaugcaagccacccaccagcguggagaccccucuuccagucuggcccccaacaugaaagcaacgccagcaauuggaggcaauuugccggccuuugauggccaugucagggcggcaccauggcuagggcuugggaaacaguugugcuucccgcauucuucccugauuaccccagcccaagccaggacccggcagccugcagcccauugugccuuuguguggagcuggcgcuuggugagaaagggccagccuggcccugggagagugucuccacgggaagccaugaggagcaguguugcccccagggucauggccgcccgcccccacugcauccugggguuuggguucaucaggggguggagcagggccauaggcuccgagaauccugagguuugggaaaaaagaggcccuacugaaugacagacguacauguagcacacacacacccuagcccacccugccagguagagagccacccuccagcacaugggagagggaccagggggccaggucagccugagacccgagccuggacuucuuucucccuugggucacucaagggcagacagguguuuucugguccuggaggcagggguccugcccugcuggggcauuuuucuucccuccgcuguccugcaccccugcugugagugcuugugaggaugaauccauacucauucccuuuguuuucaucaaaccucccugagcccgugugcuaggcccugcacacaauccuggagaggugcccccucacaggccacugggggaggcaggcauauaaggcaaugacagccacaguggugcugggcagggcacccaggaggaucucacuuggcugggcagcugaggggcaccuucccaaggggcagcaucagagugugagcauggcaggcagagggaaccacacauuccaaggcccugcuuggcuucuuauagcugaagcaugguacaugauggcgucagagagggaggaggggugaggcugagagagaggccagaaagagaauagacgcuucuguugguggagccaggucuagaugucugacccggacccuagagcaauccuugggauagccaggugggaugagggaggaggcagcgaggcagggcuggaggacgguggauuccugcgcccacaccucccagucguugcccuugaugcaagcagcagagcagcaguguggggaccuugaacuuccagcagccauggaggagucaugagcaucaccaccccuaccuuaccucuugucccuguccuuccugggcagacucagagcauggcagagacagcaccaugggccuagagaugucagcgagcuuucuggcccucccuccccuccccggcuccugugugccauggauugagcagguuccagccagauugcaccgguaggcaccgugccuucucugggcucccagcuggaugccggaggccacagugauggggggccuguaauagacaucccccugugaguaacccagggucacaguagaagccuugggaaauacauaaaagaagaaagaaggaacagugcuugcaacccacucccgaccccugacagccaaauggacagucuuccggucucuuuucccuucaucccagggcugcagcagaauucuuccaaaaauuuugauugcugcauuuuuuuugaaucagcauuauaacauaggucuuucuuuguguaacuuuaaacucuucucagguaucacuuuuagucccacagaacauuuugcugcagcaaauagaugcuggaugggucugcuggccucccuuggucuuagaggcccuuuguaguucucaaaaacgugccgcucccuuaguggguaagcaaacgggcuugggaaucagauagccuggcguucccgcucugccuguaaauagccgugugaccuugggcaagguacuaacucuucugugccuguuuccucaacacgguguuacgagaggauucaguaccuccgugcuguggggacaucuuuguguagaaaucuucugccguaucucagaccacuuguuuggaccgaauuccuagaagugccuuucuuaguucacacugugaccaucuaggacuuugucccucccagguugucaccagccagugcuuaaacagcugcccuucagguucuuggaaaaccagagcaguuugccccucagccccagcagggucuccuccaacgcuuauuuggagaguguucucugaguauccgccacucaccagcaaucacuccagguguuaggguuacaacagugaauagacaaaacucccugcuaggguggagcuugucauuucagcagaggcagacaacaaacccaaaacaaggacaucauagaggacauuagaaggugauaagagcuauaggaaaaauaguggggugagagggggucaggggagcaugaggggguuguaguucuaaacaagggggucacaaaggccucaccaagaggugacaguuguacagugacucgaagaaagugaaccugcagcugccggagcucccaaguccacaggcggagggauuggcaaagacaggggccccgaggcagagacaggccaggugugccucccaggugggucuccaggcagagggauuggcaaugacagcagcccugaggcagagacaggccaggugugcagaagggcagcgaggaggcugacacaggggcggggcugugagccaggggcaagcagaggccagagguccagagcagcccccagugcagggaggaagaugggggcaggacugcaccucccugacagcguagguccuagcagagcggguggcagagcaggcccuguccugccugccuuggagacacagggccugcaggagguagacaccaggcagaugggcagucggcacucagcacguggccuugucaccgccuucccgcguacucugaccccaagucagaauggggagccuggcacacagggcaccguguggacauggugagcuguggucacccuggagccaggcccucguaccgcaccacgcauggcacacgccuucaucugcccucagcgccucucgcauacccuaggaauugucacucaaauucccuuugccuguggauccgugacagcaauaucuauggcugguccccgucaucuggccuuggguccagcauuccuccuccuccuccuccuccucccuuggagcaugcugaagcagcccuguccccacacagugacugcggugcuguuuccuucgccacccuucugcugucuggagaucuggcugccuuguucacugucugugccuucuuagaugaguaaacugcaugggagcugggcccuggucugugcauucaccacuauuuaucuccuguucuggcauguucccugaauauuuuuaagugaaaaggcacagaggcagguugcgagaagcagagagugggacccgcagagucuggcuggguggguagcagcucuuaccacgugacaaccuggguugcucuucacuucccuauguuugccacauggcuaagaaaggaaaaaaaaggccacugggaaaacaaagcagcuccuggugacauuugccacaaauccaugcugccccauguccaggucucccuuuggucaggcuuuccagguguggcuucccggccaguccauaauagagcagagguaaacgagccugaccaucucaggagagcaauuaaauggccacaucuucaccagugccagauagacuuuccggcucugccugcuccgggcagugcgagguaugcauuguguguaacgagagccaucgcgggugagauggacugccgauugggccacgccugucuccccagcccagcacagacgccggggagccccacgccuucucagccuccagaccuccuggcaccagagggagacgggcugcccaugccauuugucggggucugcugccagcuaccugcucuguuugcagaaggaaggccaggcucugauucagggagucagauaccuacaggccaggcgcucacuugaggggacuggccaggguccuccccaugcccacacucugugccccaucccaagcggggggcagaccaccuagguauggaaccugcagagcagacaccgcucaggcuccaaguaagguaugcugcucacagggagcgcuuccuuaaugcagguccccaaggccauagugucacaugucccucaggcaggcgugcaagggccuggcuucuggagccccguucauaucagcugcauguccucagucuucccaggggacucaggcuuuagauggccaguaaucucacuuccgccugccagagggagaccggacccuuugugcaguggggcaggcugucccuggcugacucuacagauggccucuuuauccagcacccuugucacuuuuuuuuuuuuuuuuuaagacugagucucgcucuguugcccaggcuggagugcaguagcgcaaucucggcucacugcaagcuccaccucccugguucaugccauucuccuacuucagccucucgaguagcugggacuauaggugcccgccaccacgcccggcuaauuuuuuguauuuuuaauggagacgggguuucaccguguuagccaggaugaucuugaucuccugaccucaugauccacccaccucggccucccaaagugcuaggauuccaggcaugagcccuugucaccuuuuuaaacaucuagagcugcagggccagugcacgaugcucucacagccuugagaaccauugucagaagcccucugaaagggguaucccccacccaucacucugaguggagagcagaagcuggcuuugccauuggguaagggcuguagcucaaauccuggcucuucugaacucacuguggggcuuccaguaagucacuggccucuuagaccuucauuuucucauccguauaaagaagggguggccaacaucuucaggaaacugagccagaaauaacccacacagccccgccagccagcgcucccagucugagacgacaggccagggcccuccggacugaagcuugaugugcgagccuuauagcugccuugacuuuucagggacgaagcuaguacugggcaggacugggaaaagggaggaaaauucuucaggugccagcaggugcaguggcacaggugccaacggcacauaggaagcugggcccucugccugugccucugcccagcuuccucccugcucugguccucuagguucccagccuguacaggcccuuugugcacauggggaggggauccuggugggacaccuccuuggcaggcaggguaugggcugccuucacccccaccugcccucagugccuucauacccagcugccccuagcagcagucucaggagccaccacccacuggggcucccugucccaugccacucucacaguguccccaugagcuugcucccaccaggaccccccaguggggcugugaggcucacagagugagugcuuacacugaggugcucugccagggguggaacugcuccgagcccugggcccacccacucccacagaugcagaggagccugcuaaguggucucacccuggccaguggcccacauggaggcugcaccaugcugccaccaggagauuccucaugaauacaagccccacagcacagaaagacaaaugcugaugaucucacuuacaugugguaucucaaaacccaaacucauagaagcagaggguagaagggugguugugggagccugggggugcaggcuggggugggaauggggagaucuuggucaaaggguucacaguuucaguuagaccagagaaaucgauucaggagauccgcugugcagaauggugacuguaauuaauaacaauguguaauauucaaugaaauuugcuaagagaauagauuuuaaauguucucaucaccaaaauaaguaugugaggugaugaauguguuaauuagucugauuuaaucauuccaaaauguauacauauauuaaaacaucauguuagacugggcaacauggcaaaaccccaucuccacaaaaaaaugcaaaaaaucagcuaggcaugguggcacgagccugugguccccacuacucaggaggcugaggugggaggaucacuugagcccaggaggcagagguuguagugagccaggauuacaccacugcacuccagccuaggcaacagagugagacccugucacacacacacacacaacacacacacaaauauauauauauacacauauauauacauauauauacauacauauauauauauuacacuauaaauauacacaguuugucauuugucaauuuaaaaaugaaaaagacaagcuccagagaaagggcaguugcagcagcauguuuaaggaugagugggacuucuauugccuagaaugggaaggguguuccaggcagagggaacaacacgugacaggcuuguaugugcaaugaggagcccaggaaugggccaugaucagcagggcugcagagacggugcacaaaggcagagaguggugaagauggagguguuggagugggugcgugucggggcaucagcagaaaacaaauuuccacucagguguucagcuggagggaguugaacaaaaggucuuuagugaggcgugggcugguuaaagcaacucauagagguagcuggaaagcggugggggcugcacccacccaagccugggggcggggcugcguauaccccuggcagaggaucccgggaugagccacugacucugugagccccauggccccacugggguguccugaugggagcaagcucucagggcaguggcaaacugagccgagggggcacugugagaauggcguggggcagggagccccagcggguggugguuccugggacugcuacuggggcagcuggguaugcagccugcauaucccacugagggcaggugggggugaaggcagcccagguccugccugccaaagggagccagggauacacacccugacugcccucucuucccacacucuggccuguuggggcuuccacugcuaaaccuggucgugcugucugcaggggucagccucccaggcacacaagaggguggagaaguggagaaugggucuccagaggcaaucagggaguaccccacccagggagccucagaugccgaguuuccagacguggacuuggcaugagugcacuggaaagcaauggaccacucggcacagagcagcagucccuccagggccugagcacggggguggugagcugaggccccaagaggcacagugcccugcuguacaccuaucagaugggugccggagggaccaaaaugucagaauggaccacaggccucagggcugauuggcuagggagggaggcagaagaggggugagucuaggcagcaggugcgcgggcagggagcccacgggugcuugggguacggcagagugacaggcucucuucugugccuugcagguggccucagccccgaguccaagaagauccugacacccgcccucaagaagcgggcccgggcuggccguggggaggccaccaggcaggaggagagcgccgagcggagcgagcccucacagcauguggugcucagccugacuuucaagcguuaugucuucgacacccacaagcgcaugguucagucucccugaguguccggugaccucccccagggccuccuugcccagcccaguccaggcugcugugccaaaucccaaccagccacgccucagccucucccagucucucccugcaguccugcagcagcagcccccacccccaagcuuggugcugagcccuggugaggagcugagggggauggguugcuggggccaggagggucucuccuccagccccugcacacucccacccaggacagcccccagcccaacuaggaaagggccaugggcagagggcugguagccaguaucuuccacugccccaucuguuggccaccugcaggccagucucaacccucccccaggugggcaggcacuugauggcuacaaauaaaugucccguggccccagcccacucua

SEQ ID NO: 191657 - RNA, 48799 nt, Homo sapiens
agcuuuuagcaaaaauguuuaaucucuccuuaauguguguguuuauuuacaaguacuaaaucugaagaacaguaaaauaggaaauagccguauauguacacaucugagggccgggcccacagucagcggugcugcuucugcaaagagcccggcugagggugcccgcccggaccguccgagggaucgcucuucuucugggaggggguucugcgguguuaaaggacagcuaauugugggcuuugucuuaaaaauaucucucucucuaaauauaucuauucuagcuguguagcaccaacgugagccacugaauccagacagggagaaagccagggcggaggcucucagcaaggccgagccgagauggcacgccgcuccgggcucucucccggacucgacgcugcaggucguggggcccccagccccucaggccaaggggccagugguccuggggcuggggagcacaggggaagcucgagguauaucaagaggccaggcucccaggccgaggcgugagcuuuuccagcacuccugagccaggcgcggggagagggaggacacggagcaggguaggaggugcugcaggaagcaaguggcggcagcagcacgccaggugggugccaguuucacagcacaugugccgcagcccuggcucccugcagacacagggcccaugggagccgcucaccgcugcugggcacagaacggccuccaacugcagcuccuaccagggccuccagccccaggccagagcucccaggugcugcacaguuaggagcacagugggaaccagugacaaguagggacuggggccuaacuccacgaccuggcagagggagguacggaguagcucggagacugcugucccaguagacagcacagguagucggcuugauccuugcgcauguaaacagauacugcuaaagugcuugcgccuagacacagccaugugcucugugguggccacgccccagccacacgcccaugugggaacugcuucaugaggccuguggugcacccccuucaucaccacugccguccccaccacccgcccaugcuacucacauggacaagggcagccuggcagggcagagcagagcacaaggccuaaggagaguggggguuggaacuggauucugaaggugaugcaggagccccuaccuaacccgugaggaacuggaagaaccagggacuucaaccugaagccagcauccagggaagacuuugggggaaacugagguucccaccccaccauagccaggaaacaucagaagggagguggaggcgcacccaggaacaggaaucccagccaaugcuaggggcuacugaaaaaaacagcccagccacuguaauauggacuggccucagcucuggcccccaagacugcccagggaguaagcccacccccucagugggcugggggcaggggcuggcccaggccugagcuggguguggcagcagcagaaggccccagcccuggcacagugcccacggggccaaggagcucccugagucagcagucacugacuccacaccgacccgcguucagggaagaggcgggucucuguggcgucaucuggcucacgcuacucagcuggggcggacugcaagacuggcacaccccauggggccgaguccucuccuugggccuggccaaggacauggggcugagucuggccacaguuagcugucccuuaauguccaugggaucuucgguaccaucaaaaaagugaccuugaaaaggggauggaccgcuuguuugcuuuuacaagugacugauuaauuaaaaaacauaaaaaagggucuaacaaccucuaguauucaacacuugcaguuuuaaaaagaucaacucagacuaaacgcuagcacaaucaugcaugccccguggugccgcggcaccccagaggcucucagggucagcaggaaguccuuuccuugucaugucaaaccaaaacagcggcccgcaggucggggggcacaggcuucagggcugcuccacuccagggaggcuccggccacuuucuccacaaccauuuggcauugcuuucccacugccuucauuuucuuguucaaaucgucuuuaaaauucuucuucaguuaacuguacaguaccccacuggggcuggagccugaggcuagagccacauauauauauaugcauauauauacauguacagcuuucuuuuaagaaugcauucucucuugcugagggcaaggguggacaccgcuggccuccagucccucuggucacugcccgucacucauggcccagauagauccaggccacugcgggccagaggagcccugccacagaccucaaggcccaagcagagugcagcagaauuuuuuccccuaaacacaaaaacaguccccagaugucccacugcucuggaggggccaggacacugcugagaugccacacuggaagccgcuggggcagggacagagagaguggagagagaggagugcucaggggccgcccucaggggcuccaggguggggagcucagccuacccuugaagacagcugccagggcagccuguguaggacgcggaggggaauaaauaacgggaacgugcucucugcgacccggggccccuggcccaguggcucccagaggcacagcccugaggacggagaggggcugcccgguccgucuggaagccacccaggagucugagcagccuggcccacagccccuccauaggagggagcagagccucucuggggcgagguggauguggugcuccggccucggccgcgcagagcacgcggugaaucugaggauggcagcggugcagcgggcaugggugcuggaggugggagucgguggcaacgggcccagaccgacuugagcuccucuugcccggcuacgggcuuuuugccucuuucuccagcugccaaccgggccccgggacccucagacucugccgccugggggcagcuuggaaagcugggaaugcugacacccccagccucuuguccuggucucaaggggacagcccaagcuggcuaccccucccccuggagggcccuggccucaccccucagccccucagaggucagcccuucucccaugaaggccacugggcagcucuugccaggcaaugaagguccuuggccagccugagcacccagugcugucccggccccugagcaagcagcugugugcgcagcugugguguggcagguaccaucaccuccacacaggaagagccgggacccgaccgggugaggcaggggagggagggccgggcagucgcugcacugcggcggcccgagcaccaccggacacuccacacgcaugcggugagggcugucccggucccugcucagcuguccucacgcugcaucaugcuggaugaucacagcuggggcucagcugcucagggccaucguguccaccaccugcuccagcuugcuccgcagccgcugccgccgcgccugcucauccuucuccagggcugccaggaucugcagggccaggagaacugucagcaugccgggccaccagccuccaugcacucagcaggcccagggcagaugccuccagaguaggugccagagguucaaccccaucuaccccuggccaaaggaccuugguugugagccuggacccuccaggaccccaauauggagaaugagcccugccccugucaucauccuacucucacccccuaaaacagcaggcucugaucccuuggcugccuggccaugcugcugacauguccccacccaguccucacacccugggguuucugugccccuuuaaagcagagcuccccagagagccucagcuccccuuucccuggugagccccaggaccccaggcuuuuguccccacuccccacccuaauacaugcagucucuggcugcuccucugcuccccuggggcaccugccugaggacagcccucugccuccugucugccuccuguggcacccuggggaagguuccuugccucugcugcaccugcccuggccuccccaggguggcucugguucacucccguggccuucuuagcccucagagccuuggcacaggccgagacuguccugcccucuggccccgugcucccauccugugcggcccaggagccaguucuccuuccuggauaccuccuggaccccguccccagguccauguacguggccucacuccaagucagcagaaaagauacugaaaggaaagcucugccaagagccuaugcccagcccuggagaugcuggcccagacuagaaaacccugaaaugagccccucagggaaguugcucaccacccacacacccucugccucaggaagaagcugccaucccaucuuccccaccccugaccccacauggcugcacacagugacuccaccacggccuucucugcucggccuggcaggcucccuccuggccccaaggaaccagguggccagagggugcagaggagugaagguggucaguggcagcccagagauucagggaggaguggcagggcggggcagagcaggugacucuggcaggggccggcaagcccuccuagcccagccugugggcucccacgguguucaccucauccuuguacuuggugauguaggaguagaucucgugcaaggcgcucaugcuguugaacuggcucaggugcaggcgggacugcucagccagauacgcacucauguccuggucgcugauggcuggcaucuuggcgaugucugcauaguaccugcaggugaguggccaggugggcacaugagcagaguccaggcugcccccgggccccugcccccgaccccugcacccuccaccuaccucuccacccagcucuuguaguuggggauguccuuggcguagagcagcuuguuggagggugaguccuugcccagcuugugcucagagguggagcaggaguccaugaaggucugggccaccaccgacaagcaggcguccgugaugcuguucuugugaaugucgaacacaaacuguggguucuugaucacguucacccagaagcgcaggggcaggcugcaggcgagaguccaggcgcugcucagauaggccucugcucccuccugagcagugaccuuguggcccucccagcuccgaauccaaagugggcauggcuuuccaugcagacggggaaacgaggcccacagaggugcagggcccaugguuaagugaaggccguccccugccacccaaccagagaugugcugcccccaccaccugcaucucacgcagagcaucaugagauaggcgugcucaaacgcacucguuugcacaagggcaagaugugaccaggcccucaggggcccacuccacacagccaccacccuccuaggccugcaugcuggcuugcacucauggcuccugcacugagaccugcagcucagcuccggcccaggggacccauuccugcagagaccagcccucugugccccaaacaccaccucagggacugccauuagcugggcugccuggcagcacuggccacacguggcugcuuaacuuaaaugaagugaagagcccagacacucagccacaccagugccauuucaaaggcucaggagccaccacccuggacagcacgggucuagaauguuccacugugacagaacauucuccaagaacaugcugaccuggagacacugcgucccuggaggccccaccucccgcugugcccaaucagcauggcccaggagaggggcuucgugacacuucauuuaaauccuagacuccgcgagcagugggcggagcugggacagguugggguggcugcaucccagguuugggaagcaacacaugggauggacaagaccaagucggggguggcugcuggcccgggagccagcagaaguggcagggacaguccaggagagaggggagcuaagacaguggagagugugcacagaacuggggggagaccccagcaggaugcacggugaggaggggcacuuccuggugaagcaggguccagccauacaggcaagggcauccaccugaccccaggugugggggagcaguccuaccccagaagcccucggccaugcagguagaggggccuggugcacagagaggggcuccccuguagcaggcaauggugggguugucugcuggggugggggccacacacacagcagggacccgcuccaggggcuaggguguggcuacagugugccaaccggagcagggggccacagaccagagcuuggggguccugaguaaggagugaggccaagggcuggccugccuguguggcagagaggaagccaacauugcugaguugggcaguccaugaccagggaagaagcaggucacugucccaggggugggccaggccggaggaaagcaagggacuggcuggccagggaggcagauacucuggagggaggccacucagaggcugggugccucuucauaacaaaacccagccucauagagccccagcucacauugguguagcugugcacggugcaggcugggcaggcccugcuccguacuccagcugcuccgugagaccguggcaaguggcucggccucugcgccucaguaagcaggcucuggccuggccccacacugcaauggggaggcuguaaauuccucgcacuaaagacuaccaggaguaccugcagucccuguugcccucaucacugcaaccagccggcuuggggcugguccacugugcccuguuucucacgcugcagcccacacucauguccgcacagcugugcacacccagagccacucacaccugcacacaguuccugcagcagugggaggggcucagcggcuggagcagagggcgagccgugggucaaggggcacaggcagauagggaaggccaguuagcacaggacuggcccgccaugccccugcuggguuguguccccacgccagggagccccaagugggggcuccggaucagaacagggcgagggcccugggaacacaucuggccuggcccugggggaugccccuccucccccugcccugcauuaccaguugcucuuccagguguggcgcacgucagcaucguggaucuggugcuugucggccugcucauccaggaagucgaacauguacuugauggccagcggcagggcugagccccggugugccgugcugaagauggucucaaacaggucguccacaaacuucugcagugugcccugcggggggcaggcagggacacugagccccagggcgcugccuggcugccuacaccuccugggugacuaggcaaguggccaugggagcaugggggugaggcccuugcucugggcuuggcacuuucucugagcucaguuggcccagcguccccugcccccaucugccagccaggcccaccuugguggccaguagccgugucaaguagaucuccgagaccaucuugcugccgcggucacccucacgcugguccagguggucgugguucuucaccaggugccacagcuuggugccgcucuccaggucgggcgugaucaugggcgugcgcgagcgcaggcugucggggcugcuggccgugcgcagcaugcucucugcagcaccaggcugucagcgcccgcguuggcuggcaccccgcaccccccgcccgagccuguuuccccaucugaaagcuggggauggcacccccacccaugugggauuuuggggcagccgaugacaccacagagguggcauaauuguguacggacacacagucgcgaggaggcgcagccuccagagcuggaggguaaggccaagagugcgagugacaggcuugacaccugccccuggguccucccguccggcugcugcagcgugggagcccgggggacguccugcccaggccagggacccaugcgcugcccucucgcccgcugccuggccccucaccguaucugcugagggacuuggugaagguggaggaguuggagauguuguaggcggacgucugcuugggcaccagugccaccgaggacccgucugucaccugugggcagagggccagggacccugugacccaccagggugccccugcaccaccaggcucccacuccccggcuggggaccccggugacacccuagugcugugccuggaggcagccaccucacucagucuggaacucuauaucaggacagcccagggaugcuaggcaaucccacaagcccagcucgaguccugggacgguccacacacauaagugaccaccuccccuccucucccugacagauccagcugcuguccagcccacaugcugcaaacauugguggcugcgcuguggaagccccaaggggagggaggccugugcuagggucggagggccgggagccaccugguagugagccaguguguucagccucuuccaaucguugucaaucuugguggugacguccucguccugcaggaugaugcgcgccaugcggcccuggcgccacucugggggaggagggagcuggaggguggggccgcuggggcccucuuucccuccuccaucacagcaguguagugggacggggccugccugcagcucucagcaccagcacagggcagggacauaccuccgccccugcugcagcacacuuaaccugccauaguccccugcaaugugccacagcccucccaaucugccacagcagccccagccuaagggggucugcccugccuuccgcaagccuuagggccccaacuccucagccuggcaccgaggcuucuguggggacccagccucuccagucacaucugcagcaggacuccgggccccaccccaaacccgucccauccccucuggcccucaauggcuccaccugccccucucaugagccugaguaucccccucagggcuccaagagcccacugccucccagagugcacuggaacccaccaccucccagagucucugcccagagcagggcagccacccucuauacccaaccugggacuggacagcccacucgccauuccacugcccuccagaccagccugguguggaggacuggccuggccuuccccgccaagcucaguacuaggccauggcccugccccucugcuccagcacacaccccgggcagccguggccccgcccgcucacccagguccauguccgcggccuugggccgcugggaguagggcacgcccuuguaggcagcguccagcagcuucuccuuggccugggugaccgugucacaguccagccccuucaccggcaccucaggugcauucucauucucaggguucacacaguucagggucugcgggcgggguggagcaagggggcagcgucagccccacaacugggggguggggggcaccagggcacccaggacagagggcagccacgcucaccagugucuuguagucaaucugcugccggaugagcuuguccucacucagggaguagcgugccucacccgugauggcgucaauggggcccuucuccaucugcugcuugauggcgcaguacagcaugaacagcggcuccccagcgcacuccugcggggguggcggcaugaggcugcagccaggacccccgggccuacccccaaccugccccuccacccgucgagugccagccaugguguuccuggcaaggagaaaugagcagcacuucccaacucuuugggaggcaaguacagccuuagucccaaagcccagcagagacugcaagaaaaucaggaaacaaaacauacccaccaucccacaaauaucacaugaaaacccuaaauuacacaugagccaggaggcgcaguaguguaucgaggaacauggcguggcacgcgggaccugcaucagggagggccgaggccuauuucacccagaagucuccccuggucucagcaggauccccgccuagcuccagccucccaggggccugcuccccagcuggaggugcucaggacaaagcuccccauggcccaccgcccauggcacaagcggaccccauacuacgcaacuccaagugugacugugauccacuggccuccuagggaccacccagcugggcccccauauuacucugggacacaacuauggugugucauggauacugacauacccaccugaggaggcuugcccacccagggagguucaccagcacccaagcacacagcacagggccagcagcacagccccgggcccucagcgggcaccugaccccucacccuccggcuccccgcgcuguagcaugagaaccgccuccugucccaccucagggccuuugcaacugcugccucuacaaccagaaauuuccccuggcaucuucaugggcccuuguggacccaacccaaugugcccucuucagaaaggcuccuggggagcgcccagcacacguacccccgaccacugccucgcugagucuccccgccaucugucguucucugaaggauccugugcaccccuggcaaccccucuggagugggagcugccuggccugcucacuauacccuacugcuagcacuggcugagccugugcauggggcaucacagacacuugcuggaugaauugagugaauggagagcugucccugggaaacguucacgucugggcugggugaguuggccacacaggcgaggcccgcccagagccugggcaugggguccacuguagguccugccugcccaagggccuucagguguguguacaccucaauggaggggcagguuuggcagcccugccuccuacccggcccuggcaaacaaacagcagcucugcuccuguaaccagaggcuccaggcaccucguuagcaucugcgguaauuagagagacagcuguuaagaccaucccagaccuuccaacaacaugucugucuaugaaauuauguuucauuugcaaacuugguuucauuaaguuagccacgaaggaggaggaaaaggggugcagauccggauggagagccauuaaugugacaggaagccuuugaggguuucccaaagucagacaccuguccgaggguucccaggccuggccucagagagugaaaggacggcagcuagucucugaaggucagggcagugcagauauuggcccaaggucacacagcaagaaacuggagaagccaagaucugaacccagauccagcugaccccaaagcaccugccccauacaagccagguguacccagagaaggcucaggcugagccgggcauucacacucaacccaggcagcaggccccgccccacuccacccacuucuucagccaggccagccuagaggcugcaaaggagguuccaagagcucagaggccagggaagaggaaggcccaguccuuuucuugucgcagccucaaucucucgugcagugacggggaaaaggaagaccucagacuccucccagccccacucaggaaugugcaaaaacugcccaacaaaaagugccacuuuucaaauagaaggauaauaugggcaguucaauaaaugacauuacgacaagcacuucuccauccucccuuccagguuguuuacaugugcuaaaauggcauggguuccuuuucuaguuaaaguuuuuguuucuaaagacagcaaggaaugaaaaggauuuggguuguuuaaaaagaguuuguguucucaaaguucauccauguugcagcaugucagaauuuccuuccuuucuaaggcagacuacuaucucauuguaugcacagaccacauuuugcuuauucauucaucugucgauggacaccuggauugcuuccccauuaagcugaugaaauuaagccagccacgaaaggacaaacaaugcaugauuccacucauaugaggucccuagagcugucagauucacagagacagagaguagaaugguuccaggggcuggggaggaaggaacaaggaguggguguucaauggggacagaguuucaguuucacaagaugaagagucauggagcagguggccauggccaacaccgcuguaaaugcauccaauaccacucaacugugcacuuaaaaaugguuaagaugguaaauuuuaugucauguguauuucaccauaacaaauuuuuuuaaguuuguggcacacuacaaagaaaugagcaacaagcuaugaaaauaaauaaaggaaccuucaaaauagauuacgaagugaagggagccaguuugaaaaggcuacgguaacagugcacgauuccacuacaugacaucuggaaaaggcauaacuuauggagacaaugagaucaacgggugccaagggcucagggggagggagagaugacaagugagcucaggggauuuuuagggcagcgacacuauucugugugacacuauaacgguggauacauggcauccuacguucauccaaacucacagaaugcagagcaccaagagugagcccgcacagaaacgaggggcacuggguggugaagaugucuccuggcagguucacugacuggaccaaaugcaccccucuccuagggaugcugacaguggggagacugugcaugugugggagcagcgggcgcaugggaaaccucuguaccuucuguucaauuuuacuaugaaucuggaacugcucuaaacaauaacaucuaucuuaaaaaagacaaaaacaaaaaaaccccagauaugguggcaaaaacaaaaagucacuggccaguuauguggauggaaacagcccuaggcccaucucagucccauccagggggcgcccagcuccagcaugucugucugcgccucucagccucaggccauguccuugcgcccaguacguguccucccuugcauauauagggguccuccuagaacuggaggagggcagugaugaccuaaggagaucuaacagcuccuggccccugccugcccccgacacugguaccccacuaacaacgagggugggcuggggucaugggcaugggcugugaagcccccaacacacagcccgcaccccuuguaccugcaccacucccacccaaauggucaccccugccucccuccucccuguguccccuuccuauggcucccuuggccaagacuggccucccucucccucccuccacugcccacacaucccucagcgccugucccaaauguccccggcucuccauggaaugucugauccggccuaaagacaaccccuccacagugccccacugccacccucucugcuuauaauacccuguggggccacacucugcgcuggcugaagcuggcccccuauauccuggcaugaaagagaauccacacccaacgucggugcuuauaggcauuugcugcccugagcccugucucuguggguguggagaaucgggaucagacagggacucagguuagcggugcccucuccaccucacccaggacgccugcugcuuuaggcucacagagcccagcuuacccagcaugcacacauacuaugcagucuucauagaacuguacuuucuacaggacacgcacgacuuuguguuaccugcuuccaguucugccuaaggauguuaucaucuacugggcacuuacuaggugccagggacugcuauauacacauaaaugucccaccuccagagacgacccaggacagacaagcccagccccugccuaucccaccuggggccuucuccccaguggccucuucugccugggacucucuucccuccccccgccuggucuucagaccucugcucgaaucccacccucccugcucggcccugccccauugccugucugcuguauuucccguccagugucucucccggcagcgaggaugucuggccaggacuccgcucugugcaggcaucugugcgcugaucaccugagcucagcagcaucuggcugcaggaggccugaaagccccacggcccagagacagaggugccaucccuggauuccauaaggaaaccaggagaaucgaacccaggcagucagugccagcucccacccucgaucacugggcuacacugucagucacccucacccacagagcagcgacagggaccacugaagccaggcgaggagcaugcacuucaccaugcacacaccgggcuccucccaccucucaggagugggcuaaccaggccuucagauuuccaagagaagccagauaccugagucuguaaaagucccaacaucgaaagugcagacagcaauucaacugcuuacugcccagauaaagcccacccagauccccauccagccugggcccuggccugcagucucuggccuacacccuguuccuguucugaggacggcagcauccuucugcuggggggugggaggggcuugaauggacagcacaggggaagcccagugcggucaccuguccccaugacaggugguggacuggagccuucaggcacccccaggcuggccccucagaggccccugcccagggugcccccacccuccugagcccaggccagcugugggcacugagagccuguauccgaacucccacaccuaccuuggugggcugugugagggccugacagccucagaaggagggaggagggagccgggagccaggagcugagagcggcugcaugcccaggggccuuggcccaagccagaacucgaccaagaccccaccagcugucauucuccagcaccucccacuaauccccaccucucuccguuuuccccucccgcuguucaccugccucugacaccugcuuccucccgccucugcuuaccuugaggaacuuauacaagaggaaggugaaccaguuaguuagcaucuucucugccaccgacucaguccuggggagcacagaauaugggcagaguggugucauuccagcuguccagcaggcacagggccccugcaggccucacucaccgaucccaccccacccugccccccuuccuacagcaccgaaggucaggucucgaaaggcacccacaugagugggcagcaggcgcuucaggggcugccauggagaccccaguccuucgcccagagcccaggccuguguguauggagacuccagccuggguccucacuaucaguaccuagggagguggcagcugagccucagaggccaggugaguccucccaccccugcccggugggaacugccacagcaacgucucugggccugcuagaccaaccuguccaaagcuggaggcaugggccugccucccccaaccccagugccccccaggcucaccggcgcaguagcagcuuggggugguucuugcucuccagguucuucucgaugaggucggaaagcagcugcuugagcacgccuguggcguauuccaucucgcccugcagggccgucaugaugagcgaggccacauucccgcggucgcgcauggagaagcugcgcugugccuccagcgugcggaugaaggucagcaggaagugcuucuuggucagcagcugcccgaacagugucagcgacuucuccacauuggccugcaccugagggagcacacagagcucagaccacagagaagcacccagccccagcccccaagcugaccagugaggggcuguccaggccuggcuggugaggcagggccccaucagaggacaggccuggaaggcaagugacaaguugcccugacuccucagcucggcgggucauucccaagcuucaccuguccuuagcaaaauggacacgaccugggugcugccaccacugccuguugccaucagggcagccuuggccacagagucccuguggcagccugagaagccccugcaagccgacaugacaaagguguuacgagugcggcugggugcagaaugagaggggcugcucacgccacccucuccgugacugggcccuuugaacagcaaccccugcagcgggccugcagcagcucaaaggaaguccaacucaaugcccccauccacuggguaccaggagugcaugucuaccaucucccuccgccuugacaaugauaaccaaugcacgaccagucucugcaucucauggaugaggacacaagguuggagacaggaagagguuugauuagggccacacugcagguaggaaaaaggaguggaguagaggcauagcuggcuccagggucccuacucucucucucuuguucauacuaagguuuaucagggcaauauguucccuauuaggcagagcccagaggccaccagugauaccaggcucccagccaaggccaacagguaucaggcagacagguaauggcccaggcagaacauacacagucacagcugagagagacagugugacagacacagcaaauggaggcacugaaagagagauacaaccuggggaggcuguguagccccguguggcagcaagcccaggaacaggauggcagcacucagccacaggcagcccagggcccaaggcgggaaggucugcucaguaucagcucaaaagggacuucccaccaacagagucaccacaagggacaugggcuccccaacauccaaggcacacgguuggggggugcccucagcuggagagugugacugagcuaaccugccgagccccuggccguggcucgccaaggacuggcuccuagccugccugccgcugggggccuuuuaggggugugggagccagcccucuuuucccucgccaggcucgcugccaaggucuacggggcaaagcccuacucucugagacccuggugcuaugccagccacaugcuccccucccaaaccgccauagcagacuucaucaggcacccgcaccucccagcacacggccccugcccagcgaggcuucgcauccagagccacccaggagaccaggccaguggagccgcaggcgggacccccaacagaggcagggcccaaggggcagccaccggggaggugccagaagcccaggcugacaagugguuugcugggaugaggccuggcaucccacggaggcccuggggccagagccuccuccugcccucuggagguacuuuauggagcagagccgugcuggccauuccccugccccaaccccagggcucagggcuccacugugcuugccuggucuugguucugccucccagcaccugcuccccacuuggcugagcccagagcccugcaggccuggacccucccccaggccacacaggcugccccauaccauccaucagcacccaaggagccucaaaggcagaagauagcagcugccucugaguuccugugaccccccggagccagugguccuaccuccaucuccuugagcacagggugguccucgaucccaggaaagagcacccgcauggcauauguccgguagucaaggaaggggaugccggcaccguccaggucauuggucagcucguggaugucugucugcagcucugcaaaggcuguggccagaugcggcgucaggggcagcaugcccugguggccccgcuccaugccccaacccucccacucuuggggccuacaucaaauccuggcucugacacuuacugguuucgugaucuuaaggaaacuacugugccucuucgucccccagcuacuacagcccuagcacagggauaguaacucuccucugcaagguucccacaggaucaagcaagacaagggcagagaaagcaucagcaccaggggcaggcugggcagggccuccugcaucucagacacuggcaguuaagcguagagcagcuuuggaguucgggcuccuuccacccgcugugaggugguggagugcggccaggggugaggucccagggcugcaggcuguccccaagcccccacaccauugcaugcacaucucgggccuggugcacccucaacauggcccacccugcucagggccagcucugccucugucaggaacaaaggcaggcaggcccugacagaacauuccagagcugugaggugucaguccuguggcagcccgaggaucaggcuaucugaucagaagccaaaggagugccaggcaggcucugggggacaucugacagguuuaauuaagagcuggagucuucgucuccugggcaucgcugccaggcgucuaguuaucugcaccuggcuggccuggagcagccaccagccacugcauccacacacgccagccucgccagacagccagccucagcaggcgggagcacaagggagguccaggccaccugccucccaccuggccccaacacacaccugccuccagucccaccagggcugcccaagagguagggugacccucagcccaccacagggccacuuagguuugucugggacugagagggcucccaggaugcagaacuuugcauuuuaagacuggcugaguccugugcaaacaaaacaccccaucccaguugagucccaguggaauucaugacaaccccaugcuggaccacauggcuaagguccuacacugcagcaggaacacuccuaguaucugcccccuagagcccugaacaugugugaguuacuaucugcaaacgcucaaagucucgcccggcauggaacagauuucugccacucacaccugcccugaucaggagcaugguguggcaugacucccccuauagacaucucaaggacaaaggucagcucaggccaagaucucuaugugcccagggacugccaaagcgcaagggcuccccauugcugcaugguggaagcaccccucucugcugcuccgcuggcaccagccaacccaccacgacucccagcacccagggaaaguaggcacugucauugugcccacucuagagacgacaagacugagccacagaaggguaaguagccaccuucagccuuauagcccagcugggauacaaaugcaaacagucuggcuuuggguucugugucgcaagcagcaccccaaggaggugguaccugcugcagggccaggcccuggucaggcacccgcccacugcccugggaccagcucuggcacagcaaggcuaucaggaacauuguaaacugagcugaagcagggugggggcggcggugggaaguagguguggggacaggccagggccuggcucggagguggcaguugccccagugagcccuggccccaacagaccuuccuugcauucgagggccacgcgggacuccagguuguccaucuggagcugcagccgcuugagugugcggucagcaucucgugacuugcgcuuguaggcgaugagcacagccacgaugaccagcagcaggagacccccgccuccgccaaugcccacaauggcaggcagcgucagcaggcuguccgaguacaccugcagugucccuggcgagaacucgaagccaccugcccgcaccugccaguggguggaggccacucaggagcuucccaugcuuuccacaaagcuugggagccccucccgaugggcaagacccacccccaacaccugccugugggaaaggucccaccgacaggggcacagaguggucaccaggguggagacacugggacccagggcaggcgccuggccagccagggcaccacuggcauggcaagggcucaggguggguaggcagucucggggggcucaaggagguggcaggcugaaggcuacggcagggccugcacuggagccgggcgcccucugagcuaggggugagucucgggcaaggucagagcuggggcugugcuaguggggcaggguccacagguggggcauggcucucccagcucugcacccccgguggacagacgcaccgugaccuugugcugcccagugagguugggcgccucgcacagcaguugcgucuccgacacggugaggguacaggguguggagccgaugagcaccguguaguugagucgggaguugccgggugcagguggcaagagguuccggcccuguaggagaugggggugagccagagcccaggacgaggggccucuucccuggcuuggcccagccuacgggcaauggugacccaccuugaggaugaguggggagcugggcuucagcuccagcaggccaguggggcugaguggcuccaguacggggucaggguaguagaggaaggagguggaguugagcacaagcagggagcgcacguuguccaugacgaagcccagcucauccggccgcucccccagcucuggugggcugcgcacaggguuggccacagacggggcgcggcauaccaugguggugucauuguacaccaggcagcccuggagacacaggguggggaugcugggcgggaccuccgcgaguggcccggcagcucccagugacagagccccuggccugggggcugccugcucccugcacagaugaugccaggcacuagcagggcugguccugggccacccacccgacguggaccagggacauguggccugaaggagaggugugugcagccagcaacccagagccagaccuucuacccgccaggcaggacaggugccuccccaggggucuccaggcacagccaagguuggcauaagcugggaaggggcagggguaggggcaggggcagggacacggguauuccuagcaggagccccaucccaggugaaggccuggaccgaggugggcagcugagggcagggacucacguucucccucucaaugccuccauacuuggcccggauucgggguucacggacaguggccagguuggugccugugaccgucaggagggucccaccgcuggaacaggacaggggugggggggucaccaaaugaugcuggggcccagugagcuggaaacgugggccacagcucagccaggcaaagccugccuuccccaaagacaggaaacagguaaaagcucuuggcaaggggugcuucccggcaggauaguacccggcaugcaggagggccaccgccaagugcccaguggaagagcuccuggcucagcgcugcucucaauagcuggggauagggaauggguguugcugggccccaccuguugaugcuccacucggggucgauccucaggauggugggguccucgguguaguuguacuucaccucaggguuggugagcugggcgcgguugauguugaugaugaugggagcgcugccagggcucugcccggggggugucaggcaccggaucucacgggaguuccuccuggaggugcccgagugggacagugaggagcacacggguggaacccaggcagguggaaugcagaugcauugagggacggugggaacagcgccaucugucacagguacugccuuggguggcugcauacuaucaccgcuacuuucccucccagggcugugcaugucuguccuacccucgcccuggcucccagccccuucaggcccccacuguugcccagccuggcauuugggacccggccugccgccucuccaggucugcuuucaucacagccucccugucgcccacacccacuccuggugacccuggccagggcuccacacccaccaggccucugccuccccagaggcaguaggcagcaggcccgucccacgcacgccaggcugggagguaggcucaugcugcccucccucugucccuggggagggcuggcgagacuaagcccuggcgcgaccuucccugccugucucagggccagccucacucagccggggcuccgagugcugggagcccagcacccacuccuacuacccugggccaggcagacaccuucccucucggcaccugucccagugggaauaccucgcccuauccccgcaucccagggggcugugaggagacuagaugagcuggccugggugggggucacggggacaccccacugggcaggcagccaggcauagcccacaccuggguccggacccucaguucuuccaccacugccaggagccccacagccaccaggcccccucagcugcagacaccaaugauuagucugauaacggguaauuaccauaggaaaauauuuaaagggacauuccauuaucaucccuaaucuaaaauuauccacuucaagccucagggcuuuuguuaagauuucuguuuucucucuuaaaaauuuuuaaaaaauacuucuuauuuuguacccaagggauuccccccuuccccacagggaagaaccagggcagaggcagccaaguugccccgccccacaaaggcaggccccacgcccaucaccgcccaguccuaccacucuggagguagccuguuuccaugguaaccuccgccucuggguuucacagugaucaccccagccaggcucuccauagccccguugcccaggcaacaagaaggggcaugcaaccaucugaaacaggaggaggggcagccaggcccccacccccaccugcaccccguaccaggagaaggagcagggccggccaccgaccgacacagccacaucacugccugcguucagguggcuucccucgaugccaauccaggugcccccugacagaggcccacgggaggggcucacacgguagaagguuggugucugcaggaagagggaacuugcugaaacucucaggaaagucccccucgggccacauggggacaggccccacuuggccugcuuacccccacagacaguuccccagacuaggagcccgcaugcccgggagcugcacuucagagccaguacuuccagguuucucaggcacagcccaaggugagccagggagcccuggagcuggccuaggcacaggaggggaggggcagcacccaggccguggaaaagcaguggcagagcauggccagacaaggggcccugaagaggcacagaagcccugagcggcacccucucagagcagcagagaauagggagagagggagggcagcagacucaccacgaaggugaagcgcuugggugacagggcgcgguaguguggugagcagucccgcacacacaccuccaccagggcgucaugggcacgcacggagcuggcguccccgaucucacagacgauccugugggcaggcgggccucaggggcugcaggagccccgccccgucccgucccgccccgcacacacccagggcugcacucacugcuccgcacugauguacucgcucuccacagggcugcacagcaccuugcccacgcgcacgcccagacgcacgucuucgaaucgcaggcccagguucucgccugugauagugagccgcgugccgcccugccucgggcccgucucgggggacagcugagggaggcagaggcugggguacaggcaucccacagggcguagggugugcgguggugcagggcggggcauggggugugggggcagggcugggggcccuaccuugaggaucuuggggucggugcagcgacugcugccgugacgcgcgugcauccacgaugcaggugugucggcagcgcaguggugucgcagggagcagcggcgcucggccacgcaccauccgcacucgaagcgcgggucggccuugaggcagaggccgcagcucucgcgcagggccgggcacuuguagaggugcgcuguggggaggggugcggucagcucgggcccgcccacugcccaccccgccggggcgcccacucacccuggauguucuguggguugucaaugacaaaguugccguuccacacgacugacagguucacuggcaggucgcugacaucguuccccucguaggaguacuguuaggugauggcaccgucaggcuucccagcuaagcggccuccaggccucccaagccucacgcccacaaagccaccagggcgccagcuuagggggaaguuucugcagccacaaccgcucccucuccacccucauccuacacaggacuuccuuccuggcuccagagcccccucucuccaggcuagcaaccauaugaggugcccuuccaagggaaccucugugcuucccacagucaccucuguggcacccccuuggagaccaccuccaaccacaggcagccucugaccacucccuacagucagccaggcugggaaaccaagacucccagcuggcccuagaauacgcaucagcaugcucuguguaccucagcaucuuugcugaaugggccaggacugcccugccuugaggugggagauccguguccccggacuggggcagagacaggcaaaaucacugucaggugcagcucugcuccccguccccuccucaacaaggcugggcugggcccaggggaacugccccuccccgggagccuggcuaggacuccagcugugccccacuuucugccacagaugaccucaacucuguucccgugcugggacggugcagggagcccagcaucuccaaggggcggcccggcaauucaucauuauuuuaucugcaggaauuuaauuggauccugucaaauuccccgauacucccgcuucccuuuaaacacagcugaagggaagauuaaugugggccuggugagaagggaggguggggagggagacgcagguggaaagugcagggcaggcgaagaguuggugauagaacagaaaugucuggaaagacuggauggcagagagaacuccagauagcugugguggccaggagugauccucauggcugaccugcaacccaaccugccccaggaagccuguugugacccuccagacccuaccccacacugcugggacagaccaggggucagccaaggggcuccagaccucugaccccaucaaggcccuccccagggcuuccaggggaugggguccagccaaggccuugucgacagcccagugccccacacaacagcccagccaccugccccugcagugaguuacaggaagcccacugcucccuggaucacacccguccugagcagaaggggagacagaggccuacugggagugcaggacuucagcccaggccuccaacugcugggcaacugggccccacucccccaccacucaggaaauggcugguucuauagagaucccgucacugaacgcacugcaccugacaguagagcuuuucaaacacuauugugucagaucugaaggucuacgcaugcucggaccacaggcaacaaccgucugcuagugugcaagugcgggccaaugggaguguuuucugcauuuggccagggauggacggagccaugcgcucuggcacccugaccucugcccuccgggagccacagugaugaaggcuggcagccaccuggcuauuccugcacacacucagaccugaugaucagcccaugccugggacccacggaugcugcaaugugcgagucccaugaggcuggcugcuguccacucccacauucaggcugcucccaccacacaacugggugcucucagcagcuaccaggacagcaugggcccccugcagcccacuugccuacaugacccaggcacaucugaagggccuggcaauggccuggggaagccaggaguggcuucugacucaucagagauacacgugagcacgugcacugcccuuuaugaacaagcacacgccaggacccagggccgugaggauaaccggcccauuccggcucacggcccccagccccugcccuggccaccucaccgaggaauucuggcacugcaggcuggagcuguugaagcgcagggcggugacacgggccgggcugcccgggauguggaagaggcacucauauccacgcuggccugacuguggcuguggcagguuccgugcggccagggugauggguuuuaccacucccacuggcacguagaucugcguggagggcaggaucugugggcaguccuggggauaagaagaguuuggcugagcccgggggcggagaccagugagcaaggugcaccccacuacgcuccagaugugcacugggccuguggugcucccagccaagcaccaaugugcccauuuuaugcacuggcaaacugaggaccgcuggcugggacagugacugcauacuaugacccagacaggcucuauuaccucuggccccugaaugcccugccccauguucuaggacccccaccauuccagagaccaaaggagccccaucuggccagcagcugaaaaggccccagaggcagaagagauuggggcucuggggcugcaggcucugcgcugggggcccagggaguguauaaaaauagccagagcccagcagaaaaacaggccuggccucuggggccagcauuucggcaacaauaacugaugcaauggccuggcuuccuugcagcauggcugcugcuggccucaggagauggccccucgggaacacugagaagcugggcuuuaaauagggaugcugaaaacaggcuguaauccccaagcccugcaacagcccccaaggcaggcaggaaggcccaggcccagcucugcagagauuuuccaggacccaagagggggccuggacucuggccuggccccucaggagcuccagggaagcagaguuaacaaggcccagcugggcaagaugaccacuaaucucugggucugcagggaugcuccuguguccacuggggagaggcaggugguggcaccuugcagcuagggccacuggccccaacuuaggggcugcacuugcaacucuguguucccagaacagcugcagccggaaggcacaggcacgcacaguggccauaccuaugcuguaccucccuggcagucugaggcgcgcccagugacucugcaugcugaggcucaggcuggagucucaccgugacacgggccaccgugggccuugucaccuuagggccccagccaugaaaacggguggcucagggcacugagacuccuuucaguccaagcuaggcugcccgugagcgcccgagaauggucagucugagaccagcugagcugcccccaccauccaaccaacugaaaaaugcccagaggagcccaggcagcucagccugcagcaagccagaaggugacuauggugagggacgggcuuuguuggugcccguaaguucaggaaaccucuuggccgguagcacgagacaugaagcuggcucaccuggcgugaggucucagucauggcccacccccagaacccaggucccagccaggaaaaagcaccacccaccccaacaccagugugagcgugugggcccagcacgcaucaaggccaauguggcuggccccuaccugccugccccaucacccugaagcuggccuguccccucgccaccccugcccucugccaggugcaggaagcugacuggcugccugggccacacccgguccucucaggugcuccccauacccccaccccaucuccuccccaacacccagcugagugagaacccaggaagcucggcacccaugcggcccacugagucaggauuaggcugaaacuccagugaucaccugacucgaccuggccugacucugacucugacaggaggccugcaguggcgugggucuccugggaucaaugacagcucagagccagguccaguuguccccaaaggcucugauuacagccucuuccccagugcauagucuccccgguaaaaggcuggagguccuucuucagagccagguccgguuguccccaaaggcuccgauuacaaccuucuccccagugcauagucucccugguaaaaggcuggaggucccucugggaaacgcugggggaagauuaacagggugcauuuugccagcgcacaaggcuccuuccucaagggaccccagccucuccuucaagcaaggagucuauagacuugcucagaucugggagcugacuggcggggcaugcaacuguuaugugaagacacgaaccacacuccucccuuucugcagaguccagaaacaggcauuucuaagagaaagucccgacuucucagcgugucucaugagcucagcuucggugggggcuccacgugggagcccuuaggcccuggcacacagcaccagcugccuccauggccccagucuggcggcccuucccaucaacaugcacaggccacuccgccuucagacaaaacacacagaccccagcaugcaggcaggcacaagaaggggccacagagacccccucccagcaugggggcagggggcggaugguggccuuggggguuaggcccggcugucucagcaggaagcugaauguaguacacuccugucucaggggguggcccgaggaacccaccagaaacagagacggaaagagggcuuguggggggguuggggggggacugccacuggccauuguucccugagucccggaggacucacgucacaccccuuaggaauggcuccauaaaaaucugggacucaagcuaaaaaaaagaguaaguauuuguggagagaauccacuccccacauaguccugcgaccccacacgugcccccagcccagcccugccugcucugccuccccaacccugaggccuagggccacuacuccaggggccacuuccuccacuccccaagggugccucgaaguucauggcauggauggggagggcucagggaaggcugccacugaggaauugggcuaucucagccccaaaaccaucccaagcugcccagggcccugcuaccaccccugacgaccacugugcugccccccacugcucgaacccugggcugcgcacagcgccaaagccacugcaucugcacaucauccccacagugacuucaugcccagcucucccuggcccgagaggcccccaggaccagcucucgccucagauuccaccgugggcucugcccacacccaggacaccuuggccuggcucuucaggcaggccgcacccccagagaagcgccccacugugucccuggcuccugcauacccacuguuauaggcagucacccugacacaggcacuguggucccugcugccccgggcuacccuccaccgcuguccugugcccugaugucaugccagggagcagaaaaguccaguccagagggugacgcugggggccaggggaccucugugagaagggacccagaggagagagggccaccaugcaacuuccucagcccccagcccccagccuggcagggaagugcagcccagcugcagccuccaaggucucccuggcaagcagaaccugcccccuccagccaacaggcggaguguccacagcaaaggaaagggaccuggcugcaagucccggcuccacacccacagccagacccgguggggaugggggugggggcugccacagcuccggccucagcuuugccacucagcaccugugggcccuggguccugcccuguccugcuacuaagcgccucauguuccagaaggaacagccugcuguucauaaagcuagugccuugcccagcccagaauaauuacuacuuaauuacuagcaauuaccacucagcgccuggugacuccagaacccaccagccuucaggcacgcuaggccggcaagcuccccugcccaacauggaggccucugugccugcccagccaggcacccgcacuccaggcucugcccgcaccugcuuugcagccugacagugcccccaauugcacccaggagcccgugucugcagcccccacacagaggcccagggacagaacucaucugaggcuuuucccccucccugagugucacgaaggacacccaggggucaccaacaaauaccacaggccugacuucaggccaagacagugaccccacaggccucccagcuggcauccagggucaccucacugacccagccugguggugcaugcaccacacggugacaucccagacauccacaggugcucccugggccaggccucaggcgacacccagaugggaugucucaacccaguucugcuccaccucugaaaaccugacccucacccuugcccggccuuaccucagacacguugacacggcccuccaggaaggcgcagucagccacguugugugugcacacguggcgguauuugcaccaguggcagggaaaggagccguugacacaggacaggcagcugcagggagagggugggugcugaagccuggggacccgcaaccacguggagucacccaugaucagaaggacacugugccgccccugcugguauucauagugccaccucagggucuuggcacugacugcuccuggccuggaaaguucuucccccaaaccugaauguggcugccucucugccuccucacaccuccccgacagcuggaggugucuugccuccccaccuucuugccugcccacacuccugaccccaggcucccuauccucuuugccgcuuuuuccuccagagccuugaucaccaccugacugccagccaggcauggguacucgcaucagaaauguguuagugcaacuaaggaacuucauuuuaagucuugacuccuuuuggcaaacuuagauuuaaacugaagcagcacgugcugccacagaacuggacagggccaugcacaucaccucccugcagaaagcaggaucgcuggggcaggagcuugucuguuucccucugacacaccccagggucugccaggcuggccacuguaggcgcucugcccacaacucagccuugcacagggcuggcaccuugccaucucaacagccuccaggaagacaccaccuccaucuccucuccaggaucuccugacccgccagcucccccaccacccugcuucuccuguagcccucggcccccuccaggccucugccccagagaucccccaccccaccugggacgggagaugcugcauccuggaaauaaaaagccugcuuggcucacggcaguugcuccacaaagagcugugacagaguccaucugugagucagucaacaaacaaaagcauaccugaaaagccacgcaccuccugucucugaggccaaacccuacugccucagccuggguccucugguucagggaaggagugagggcucuccucugggcucacagugggacucacaggaggcccccagauccucccauccuuccucugaggcugggggugcucacagccaaaaugggcagcaggcauagcagcugccuccuagacacacucccugcccaagcagggggcgugcacaggggccagcaccaaccagaggggaccuggaugcugcaucguccaacaguagccugccacaaccagaagcagcagguacccaggggccgugucugggccccugcucaggcccccaaaccagcccgcagcuccucccugagcgccuccccuccaugccagugcccaugggccacuguccauaucacgguggcaacauugcacaaugugcccuugcagccauacacagccaccuggggcccuacaagaucccuguggggcaggcacugccgcccacucugacugcugcuuccugguacgccugccccagccucaggcacccucugcacucauggccuugcccuggcuggcuccucuaccugcaagcugcucucacaguggccucuccucccucccugaccgcccagccucaggagccccaaucauggaaucaccaucugcugccuggccacaugaggacaggucugcagacagcaagcacagugggaccacagggacgggaguggggcaaguagcccaggcccaggcgggcggaggggccuagagacacucacgacugguggacgcugcaguuguagaagacgaaguccacagacgcaaacuucuucccugucuccuuggacuuuagguagaguuucaccacccgcuggucuccugcacgagcagcauggcugagucaccaggacugcuugcccaggacucccacacagggcaaguccagacaggggaacaacuugcccggagacccuccuagcugccaccaucagucgcaucaaacacgcauccagcccccucagcccccaggugaccagggccugggaucugcccugcuugccuccugcucagugugagggguugagaaccgcgagacucuccccaggcccccaggcugccugcuccuguggaagggccugcagagcgacuguccaacgggcuguggcagccagagggguccugcaccccaaguccccaugagacugucccccacccaaccugcgccccacauagcccaccccucacccacucccaccuucagccugcagccccccgcaagaccccaggucuccgccauguggucccuucaucccaccuacccugcccugcucuuccacccucugggucaccaugggacaccuaaagaccuuaaugccaguagggauggcaauaauuaugguagcggaggugaaguaugcucaugugucuauggcuauuccuacuguaaauguauggugagcccauaagauaaauccuaagaaggauguauccgcuguccaccucccuggcaggaaggcucucacucuggcuacaugccuggaggguuuucuccacucccagaccagcagguggugagacccccacccauaucagcugucagagugucaccaacaugcccuuggaacugaacaagggaggcgcuaaacaggcggcaacuggauugcagcccuggaccuggccaggcagcgggcaccauuguguuggggccacucacccuggccccgcgugaugggcgccaccucccgggcggagggugagcggcaguggauccggccauccuccaggacgcucucagauuccgugaaguccucgaaggagcaguugacgccagcugagaggucaggcacguuccaggccugcagcacaagcugggcaggcagcaggaggcauggugagcaggguccccauggcugucccccaccccuuaccaccuggggugccacacuuacugggaccugggacauggugacagacacauugcggggcugcacagucagcugcacacacugcagcagguccgcagcaaagcgcuggggcucgucugcucgcucacaggcgucccgccgcgagcagcugcaggcagagggguugaggcugggcggauggggagaccuacggggcccgccugccaggcgggaccugggcagagaacucgggguggcuugcccugcaccaggcucccccucccccacugugagaccaccauggcccuccccgccugccccugcccaccugcccagacucacaugcugugcaggacacaccagccacagugggggucccgugaccccagacacagcucacaggacguguacugcacacagcucuccacaggcacccgcgucaccuggugugggggaggugucaggccccuccaguaccaccccagggguccuugaccauccucaccucugacucccuacucugcucuccuuaggcccggggaggcccugcacuuguucucagucuauucaaaggcagaucuggugacccugcccuggccaagccaggucgcacaggucaggccucugcccuggaaacccagggggcagcagccagagagaacaguccauauggggugagacaaucaaagaagcaccugcagcuucaaccagaguuccucuccaucugucuggacucccucccagcucugagcuuccccagcgaucaaugggcuuggcaggucccaauccuaagcuccaaugcaggcccagacaaugcucagaggggcaggcugggccccagcucacucuggcuccuuggcucagcccagcaucccagugcccacggaggcacgucccugagguccccaggaaggcagaaccccacugcgcccaggaggggcagaggaaaaacgagccagccagaaggggagggaggcuuggccucagcuggugugcccaaccuggccccaccugccccaucugcccacccuccagcugccacgagguuaccagguugggccauagggcagggguggacuccaggcaagccaggccagggacucaacuccauggccuuacagagcugggccaggcaccagguuggguagaccaggccagccacaggcccugugggcagacccacuggacagagacccagcccuaggccugaggacucaguggcccaguacacaccccaaacccuccagugacaccugccucugaaauugcucuccuucauacaucuguuucuguggucaggaagucaacaggggaggggugggaaugccaaacccagcccaggagaacauggaggcagcaaugaggcuguggggccccuggugaccagaccgguuccccugcagacccagccgagcccacaagucugcagggaggcagagcacagaccagcuugaaacuacuuuuaccaggagccauggacgcccaacuugugauguggccccaccccuacugcucugugacugggguuccugguaggagggcccccaccuucagccacaccgucugacuggugcagcacccaccugcuucucggucauggcguagagguacuggugguuggggcugaggacgaggucucgcaggauggggcugcccuccugggccacgacgcucucguaggccagggcaggccggccaccgggguuugagagguccaccaggaucugcggcagcaaggggcccuaacuggagcugugcugauaccucccugacccagccccaccccccacagaaggucaggggucuaaagccccucccugagcugcccagacaugcaugagcagagaggaccagcgccagccauacucacucuccacauccccagccccagccccagccccagccccagccccagugcagggcaaacucagaccccaacaggccagucugugauucagccccuuuaacagucagcagaggccagaagguauuggggccuggagacaaccacagcccagcacccaccacggagcagcauggccacacccagggugaaggcuacaggagucccacgggugccuagccaucccuggggccaggcugggcuuuugaaggagggauguugguugucgggggcagaggccagggcucacaggaagucuagggcaguggaccaggagacuccagaaugggguguccuaggggugggggcauccuggcaaggcaguggaggagggugggcgucucaucggcauggaaauguauuccagaucccaaacaaaccaggcguuaauuagccagcucuucuccgcagcucacgaugcugcaaguauuuuuaguugcuuuuaccaaacaaauguauuuaauuaacagagagacccacggggcuuuccagagaugggacucuuggggcgugucugcccagcucugaguccaggguaggcucucaggcugcgggcuguggccugcuucccccagccugacccacuccugcucccgcucuaccucuccacuuccaccucagggcaggggccuaggcccagacucaguaccccuccucuguguccucacuccucacgguuacagagcagggcagguccagggcagcagggcccagcgaaagcccugguuggaguccgauccaucaggccugggcugagggcggccagccaggguggggcgcuguguuucugagccaaagaggcugucggcugggagagggggagggccgcauuccugagcgccgccggccaccccccacauccgcucagcugccucgccaccaagcaggcuuaagucaaaccagacccggaagaguggagcccaaagcugggcaggggaagaggcggccaggaugggcccagcugcacuggcugcagggccauggcccacggccucugggaggagagaugcagggacagcgggcggcccaggagcaaccaggccacggccgcccagcaccccugccgguggggccuggacugcacccacacccgcaccaagugcacccgugccugccugcccugcagccacagcaggaguaggaguccuuguuuaagaugaccacuggcccaaggccugcccgacggacgcuuaggaugccagcaccacaaacccccugcuuugcucugggucaguggccagaggcagguacucagacccaggcggaugccagccaggaccagccucugggccacagugccuggguccaaaccucucucugccucccucagacagaguuguucugaggauuauaugagaaccaggccaggugugccaggcgggagcagggggacccaggguggccaggcccacagcaaucaccgcaccugcgcagccaaccacacauccaagccagcggcuuaagacagccaccagggagugggggaaggaaggcgaggagggcaggacacagacuggguggaggcuggggcagguaugcccagugcgcagaccugcggcuccaaccuggaagaccccgguuagggaccacgauuccucucaucuccuccauccucacaguccuguggauauccccagcggcuucccgcugugaagcccagccccagcucccccuccccuaccagcaccaggggauauggccccuggccccucuugccccugguagcagagccccuucagccugagcugauggacccuggcccggcaugcagggagcacuugagaggugucucaacaaggacaugacccaccuccccaacagccagggccacaugaugccggagccugacccuggcccggccugcaaggcauccacccacucaggguugggggcacaaaugucacaccaaggggugaagaaacgggucacagaagggcagguccagggggcacaccagcuccaaggaaaggaacggugggugaggggugcaaggaggggucccaggaagggaagaagccauaggagcuucuucuggagcugggccccaggcuccagaacgccccgcuccacccagcagcaugccgacuggacaguuggcucugacagcugcagccgggagcacacgcguccagcuguccauccgccauguacccaucuguccacccaccugccaccuccaccccuucacacacacaggcugggcccagggagacagagccccaggagaggccauggcauggccagugugagcggggcacuggggaggccacuacggcacagcacaccagaccagaggauggaugugacgcaggugcaggccccacacuguucacugaggcgccacgguccagacucagcagggccccugugcacccacacauguucuacagggcauccagcuaggacaaugguccccaggacaugugucuguguccuagccagaguucagggugaagggccugugcagccaagccagcuuuaucaaaccacacagacaggagguaagcugagacucacacagcaccugccagaggaaccuugggcccuggacccgcaacugcaccugggaggaguacagaggcugcucguaaagugggaagggggagccaguacccagcaggaggguauuccaggagaaccagagcacaggggcacagacggcaggugaaccuggggccagagcggguggcaggacagaagggcacacgccggccgggagcccacgugccgacgcccacacccuggccacagcuguccacuuucgggccacccgccuggaggcagcccacccucgagguggcugggcccagaagccccucccacagcagcugggcagcuggcagagcaaaugagaggcuugacgugucccgggcaugggaacgggccacaggcaugcccuggaaucuucccccagcugucaccuccuugcucugcaaaucuuuccccaaagaccaccagaaccuuccacaacuggccccaacagcccacccucccaccucccagcacaaaccaggagcuggcgcugcccaugcaugccgcccccugcuugagaggacccuccccuugacccaaggggcuucagcagagccagcagccucccuggauaugccccuuggcugcaccaggcccccacccaccccuggcuggcggaacacgggaugcccccaccugcuucugccuggaccaucuaacccugggguaccuguccuacaugcacacgggcgagucgacccugggcucggagccgagaccgaagugcagucccgaggccucucagugcccaggccacgccaggcauggcccucacuccuggacugagcaccucccaccaccacagggcucaucugacccuccccacagauaggccagggagcagguucaccccuuugcccccaggacacagcaggcagggcucaaugcaggccccaggcuggcccugcuggcuguacccacucccaucaccgccacagcccuggccaacugcugccggcgggcagcugagggcccggccaggucagcuguccaucccgcccagagccaacaaagggcccauucuccgggcugagggcaggcgggggugccgggaggaugucugggccacccaggcuaugugccaggaccggcacgcgccccagccgccgggaggcagggggcugcccggcuuggcccugaccuggcaaggggaguugcccaacucugccugccccaugauggcagccaggggccuggcccucccucuuucugugaggcggggaugcaccuguggagcugccuccgggccccagggcugggagaaggacaggacaagguggggacaggcaaagaccggggcagcagcuaaggaggugcccacacguggaggccucacacacuucucagccuuucugcagaggcagcugccaaacccguccccagccugagguggccccaggaagggcugcccgaggggcaggagccucugcugcccucucuucucaggacccccacagggugcagagcccaccugccccuccccuucccagccagaacugcacagcugagguaggccccagcggacccacucccagacccuccucaccccucacaggacugcccccuccuccagcuguggacagguucuaggccuccuuccuggguccccaccacucucagaaaggccaggaggaacuugauacuggaaaagcaauuagcaauuuccucuuggcaguaauuggguaauuaaaacaggauuugcaggaagcccgagggcuggaaucaggccagacacaccugucgggggagagaguguccuaggaaucccaucucuuccacccccaacccccagcacacagggagagcagagacugaggucaggguccuggcaggugaaggacagccagggcugccuuagacaggcuccagccugccccagcagcaaccccucagcaaggaguggaccuccccaaccccuggucucaucugccaacauccaccucacagagcugugugagaauucaggaguucaugguuccaaaggggaagugcuuggcccugcuguggggcagaugugcacagcugccuggggaaccuagcacccagcuggugaggccacaccugguggggccaccgugaaccaccauagacugcaccaccucagucacauaccacugccugggcuccgggcuaaccuggggcuuggccagagucuccgccacagccaggcugucaccagcacggguccuguggggacacaggcagcagggaccaucugccccagugucuucccucaaacccaccagcugccuggugcccucucuccuccauccugugaccucaaugccaccuccagcucugacccuagugccaccccauggcccugggcccucaaagacccacaucagcaccuaccccccauccagcugguccagccaccuucucuggugaagugacccaccacacaagcauagugugcccgaggcagccccugaaaccccaaaaggcacaguacgcuucccagcauccacggggggcaccucugagcuuuggcccuccuguuccuuguccccagaacacccuuccagcagaccacccaguccccuggguuguuccagccuccauacccacugcacgcugccagcaccuccuacaucguggucucugcugugguugggaccacaggccccaugugccugugggggaaggcgacugcccgguguggauacucacaaggcugccccugccaggcuggccaugagcccgagcacacacaggacggcauggggaagccacugcugccuccaccuuaucaaugguguugacgggcccgugcccuggcuuaggccugacuggcuuagggcucuccgugagugccccauggguggcccugccagccacugggaagcagaagcgaugcuuaugcacccucgcacaccaccagcucugggacggcacucaucaugcccacagggcaaacagcaggucgcucccugcauccucauggcucagcccacaguggccaacuacauccaggagaggcggaaagggggcgggcacacgcucaccaggaagcacagaugucggcagguuaccgugcagggccccgugaaggggacugggacugcuggccugggcgggcaguggcagcacacacucaggccccacagagagcagccaugacaggcagcuggcucugccccaucccaccaagacuaccagugggggcacagcaaagacggacccgguggccugccccagagcaccugccucaugcccauugaccccacaugcugccgggcacugccacaggccgccaccaaguccuucagcagcagcagagguggucccagagaguuaaggcagaacaacaacagaggcuccacagccuugcucccaggcugaaaccccaaagaaauccauccuucugccacaggaauccacacacagccaugcuuacaacaggccugcaaggacuggcaacaccauggccauccagagugggcaggaugcacaggcaugugugcuugaaacacgcaacaugaggacauggcacgcaccacagcugcccacaguaaggaagagucuugccaagcaaaagaugaugacucaaccccagagcccacauagcagcacacagcgucaaaggagccagccagggcggucacccugggaagggaaggaccaggaggggcugccggggaugguaggugccuaugcucucccgugacacacccccaaugcacgcuuccaugugugucacuuccauguggcgucugucacaggcugaccaugcagggcacaggacccuccugcaggcucgggagugggcugcaugcugcaggugcaaggggcacguccccaaagaacgccaacagugcagcacaggcuguaccugggaaugacuguaggcuucaagggcaagucauugaaaucaacuccccuugucccucccucaacaacacacaagaugaaacucaauggugggggacagcagccucuccacggcuaaggggcugggggcucaguccugcccugcaccucccuugggucagggcugccuguggccagcacacuucuugcccccccagcuccagcucuuucaggacggucuccuaccacaucccuggcacagacccuggacagggaggcucacuacagaccugaagaggcucaagcugccaaccccacagugggcaccugccaccaacugccuugcacuugcgugggcugugagaugccacucaacuuccagaacuuacaaauuccaaaauccugccugggguccggggguaugaggggagugcaaagaggccucuaaagcaugcugaaagcuucuagagcaguggggccucuagggggcagguguuccuuguccccaggcagcccaggcacacagcaggugcccagcugucugcagagaggaagauggccgggcggaggacaccucccacgcugcgcagggcuccagaggcuucgcuccagcuccaggccccgcaggccaccauucccgaagcucagggauggcaacuaaugccacaggccuccuaagcacuucagagacccagcugcugcagguuccaccacugggaaccccuaggagugcugaagaaugguggggaccaggaaagcugcaggaggugcugcagcaugaguccugagggcccaugagcacagggacaggggccagccaggccaggacgcacacagggaacugcagcugcagccucugugcagggaccgccacagggagaugcugugauggcucaucggggucagcuccagaaggaacuucaagccccaagccucccugggguaugcccagaugcacccaacauccagggaaggaaaccaaggccccagaggauggggcuucaccagggccaugccucagagcccagguggguggcuucccuaagcuacucaaggccacagugcaggucccugggccacaaacugguggccaaagggaugcuugaguugguccuguuauacucucuuacaacguggauuuaauaaccaagagaucucacacaaaauacagguuuccagaaucuugaaaaaccgggugcucaggcagucaggccuacauucccugaaugggcaggcugggccucagccaggggcuggcuccuuuugccccgcagcagcagcaggaccagagcagggcuggccucgggugcccgucagccggcccacagggcaaggcucuccccagcuuccucuguagggggacagcacccgcucugcaggaggccggggccugugcucuccccucccauggggguacuugggcugaugcuacaggacccaaaacaggggcugcuccugugagcuccugacauggcccgggguccccagaggccacgggaggagcugggagcagggcgcaggaaguucgcugagagaggcaccccagggggagaggcugccugugugggugcagagcaggugccaggcagggcucuggugaaaggaggggggacaggggcacccccagucagccccauagccgaaguuggcaggucuuaaauuaaucagcuacaauuucacaccccaacaguuugacaggaacuggcccggggccagccaagucccuggagcuccccagacacuuuuuaaagcccggaaaagacuggccugggaaagacagggagugguaagccuggcaggccugccccugggucaagcgugggcuggggguccccagggcccagcuccaggagaccaagugaagaaggcaggaggcggggcccugugcucugagagcacagccaggccagcugccucagggaaggagaagcccuaugugaacaggcaggagggagccccggggcccggccucucccaaggcccugagagcaagaaggaggcagggcagcccaggggccgggcucagcauggcccuccuuacccuggcucuggacccuggaccacagccagccccacacacagguugggucagcaugacaaggagagacgaggagaagugaaguucugcugcccccgggccaggccaaguagaggccuguguggccagcggggagcaagcauccuucacaguggagcaaggccagaggccucgcacuggagucugcaggacauaacagagccaaggcaagcagaguaggacucgaacccaggccccagaacaagugaggguagaucuccuccuccuggccccucaccccaaacccagggcacccucugcccauguggccuguggugggaaguuaggcuuugaaggucccacgguaacuagggaacaagggaggcagagcggauggaacaggcagccaccccaaaaugcacccacagcagcagcacucccagccaggucggagggcaggagcuagccagacagccagggucuuggacuguaacacaggugggaguggguggcaaggggcuccucagagagggggucacugaggaaggggccuagcucucaaggcuagcagagaacucugcccagccuccuccaaggaaccgcagaaagggagggaagagccagcagcccugagcaccugccuugagcacucaguuuccccaccugucaaacagaugacaggcugcuaugaggccucuguagggugcaggcgcauggucaacacucaucacacaccccaggccacacgagcaugccagguccgcaugguacgaggagacaccaaggcucagagaggcuggacggcuugcucaaggccacacaaugggcaaggagagggcugggacccacaaugacaugcagcauuugcaugacguugagguucaaaaacccugcacgggacaugcccagcugcuggacaguuugagagcagguggauuugggugaaagaguacaggcggcagguucuucaccaacaugaccgugucugcauccagggggacaaagcagaggcgugccuugccugggggggccuccgaacaaaacucagacccaaguccccgacugcagacucugccaggccagcaaccccugggcacagcugaccccagaugcucccaaagggugccacucacacauggcccacggcacccagcccagacuuguuuggggguggagggaggcgguacccagguugggugcugggaggcagguaugggcaccuagagccucugaggagaacuuggggcucugaggggugggggcccggccagggucaccaggaaggaacuagccaugucaggccaugaggacgcagccuccaccuucccagcugcaccauccagcagcugcccacaaagccaggcucaaggaggcaccuggcccagggagcagaggacaggcuccacccauaccugccucccugagaacgguccuccuugggacuaggggugggaaggggaaaauugggagaaggaaugggggcaggaagaaggggaagaguugguagaaucucaacccagaagcagccucuucccauagaugggcccaagcccaacucugcaguucccuguucuguaccucaguuucccucugugggacuggggugaggaggcaggggagacaggccaacuggcacccagaggaacagcuguguccugcugcucccucagcaaagcucugacccaaacggugccccuggggcacaagagggugagugcugggcagcaggaacaggguagggcuagaggaaccuggucacuggcuggguaacaggcucuggggcgccccacaaaaugucucuaagcugcugcacugggcuuccacacaagcacgguccucugucuggcaaaacccacuccaacacccaccccaugcgcucgagagcccugugugccuuccagugugaggagagggagugcaggcugagaggacgggaggggccucgcaccagagccacagggcgguaccccacaugggggccaagagggaagucacagcagaggacccaacucaggggucacaggacuuuccccaucagcuucagccucauagccacuaugagcagaaccagcaggaccccagggcacccccacccuggggggccuacaaucagcagcugggcccccacgggccccaagaccaccagcaccccccgcccccagcccagagccugaacaucuggcuuauuucacagagggaagcugaggcugcaggggauccccucccagagaucacagagccagggaggggcaggacuccccaccacucccagggcaacuaccauggcagagaugggaggcccccuuccuaacacugggcaccgggcugagagcugcaagcccuggccagcccccggcccagccccacucgcgggcacacaugggcucaggggagcugcaucggcaccagccucuggugccgguuaugcaccccaggacccaccacugcccacugggccucugggguguccaaguauccccacccuucagucucuccgggagcuuccuccacaccaggccagccuggugcccaccccagcccaggcagcuccccuccacccacacccuccaggaagcucugcacugccucuguccagcccacuguucuggggaaggaaaggagaacccugaagaccagacagccaucccuguagcaccuagcccucccccugccaccguggggccagcccagggcugugugcuggagcuccucaagcaccagccaaagacaggcaggggcacuacccuugcccugcccuuggcccaguagaggggcuggggagaggcagggccaaggccucuggcccggcagagugcugaggcagcagacacuggaucuccuggcuggggagcagggcccagaggggagggggccgcgcaggccugcccucaccacccacacacagcagccuccccaggaggucaagugcccuuggagagccagcccccgccucagcaucccugggccccugcacaggcuccugcguggucucaaaguguccuugcuuagugggccuggggccagucaugggcagaggcacagaggggaguggggcccuucaaggucacugggccuaguguagggcaacauucccccugcccccuguacgccagaucuagccucccacagcauacagcagcacugggccugccaccugggacggccgcaagccuuuguuccugccccaagcccccuccucaccccaccccacccaggccugaccuugcggaugcggccacuucgcgugccggcgaauaccacagugcggccccgauagucauaggcagccacggcggucaggccaucauccuuguccacgaacaggggcguccccucaauggugacugugccccccaggggcugguugaaguccugcccgcagaagucgucaucgaucugcaggggcugugggaaggggcagggugagagccacuccccgggcaccuucucccggaggacugggccucccugggcagggcugggagugcaguugucuuucuagagagguuggggguagcccccagaggagaggugcagacagagaggguuuaagacaggagggagcagaucacaccugaaaggcagagggcgggcucccagcuaagagcacgagaaagcaaucaauagcuugagguuccggagcagcugggggccaguguggagggggcgcugcuccaccgccaggccuaaggagagggcagggcaggcagggaagggauguggggagaaguggggcagaugguccuugucugcagaggguucauuggcaggggccaggcugcucaggaggaaggagcaggggaggcugggccagggcuaggccacauggaaugaacaggugggagggggcaguggggacuguccccagggaugaaagagcaggccccagccuuggggcagggcacaaagagagagugugguggggcuucacccaggcucugccccuacaagccucagugucuccaucuguauggugcagagaaaacacguuccuugaaaagccaaggggaggguggacaaccgcaucugccaagcacacaugggcccugccucacacaggcagugagcgugagacggaaggacugaggggcccuugcagucccacucugcccugaggacaaaaccagcaacacccucaggucagacaugggagacuacagccagagagggcgaggccuuccccugcgauggccagcgacccccagcagcaagcccagaaggccuggccucgggggucccaggucugggccgagucccagccccuucacuuuccacccuaagcaaggcccgugcccucugagccugcccaggagugugaacaagacacucccugaaaggcagcgagauagaggccccaccccagcugugccuucugaugggugcugggggcuguggcucccugcagucagggucacuuucucugcaaguuguuaacuguggccugcaccaggacaccaucagcucccauugcugggcaaaagcagaggcccagcgggcaggugccaccagggucaugugggggacacaagcgcuccauggaaauggugucugggcucaccugauaggcucuggcaccagccucucacuugcugugugacccagggcaaguuaccccaccucucugauccuauaaccucauuuguaggauggggacaagauggagcaggcaagcaccagguguaggaccaggcauguggcuggcacucuguccagugucccacaggggcuguggacuaugccagcagggccucgucaccccaucuucugaggcacaagacagcaucauggcugggagcagccuuuggggcuagcacccuggguccaaacccacucucugggggauggaaaagggcagccccaccuagcugagccauggggauggccaagccaaaagccaggccaggcacacagcaggcaccacugggcgugcaucugacaccgaugccgucgucccuggaggggauggggccgcgggaggaggggcgccccugcccaacucaccgaguugaugcagcccagcuccuuguugagcagccacggcagggagagcuugcccucaccacgguagcaggacuggaugcgcuccuuaaucuucuccuugauggcccugagcgugaacaggcacagugcugacuccuuugguggcuucacgcgguucuucuggcccugggcgaacacagugaacagcacguccucguccucagccaggcccagcuggugggccagggcacggccgggccggcucagguaggcauccugcaccaggcgguacuccacacccgccugcucgcagccaauggggaacucaacguacgaguagaauuuggggucguccacacagagccgcacgaucuuggacgugaagaagugcucgccggcggcaucaggcgaggucagcugugugucuagcugcagcgugagguaguagacaaacugcucgcugcggaagcuguacacauaguagaugucaaaggccgggaacuuggacagcguguccgaagggaucuugagcugugaugacacaaacucauccugguacacgaagccgaacaugucggcauccuccucguuggccaugagccgacggcuggacaguguggggaaguacucggacuugccaucgaugggugugcccacgaagagcuuggccuggcccuggcccgguggcccggcaaugagcacgcccgccaugcugccugccuccugcacgcuggacagguagugcuccuuacggugguguggcucacccaguuugaagagaucguccagacgcaggaacuggcagaugcccugggaggcgcugccacaggccagcaggcgguuagcggcauaguccagcagcagcagcuuguugacguugucaguacugcccaggccgugggggcaggacugcacgcugggcggcggguagcacuucucguuguccuccacagggcccgugacgugggcccgcagcagugucagguuccccgacagcuuauagaugcgguucacugcgcccacauacaccucgccugucugcucaugcaccacuaggugggugaggccccagucgcuggccgagaaggugcggaaggggggcugugaacccccgccugcccugggcaagccugccucagcccacaugcccggcagcagcagcagcaacagcagcagcagcaggagcaccugcaggcuccgcgguggcagcggcau

SEQ ID NO: 191658 - RNA, 48799 nt, Homo sapiens
augccgcugccaccgcggagccugcaggugcuccugcugcugcugcuguugcugcugcugcugccgggcaugugggcugaggcaggcuugcccagggcaggcggggguucacagccccccuuccgcaccuucucggccagcgacuggggccucacccaccuaguggugcaugagcagacaggcgagguguaugugggcgcagugaaccgcaucuauaagcugucggggaaccugacacugcugcgggcccacgucacgggcccuguggaggacaacgagaagugcuacccgccgcccagcgugcaguccugcccccacggccugggcaguacugacaacgucaacaagcugcugcugcuggacuaugccgcuaaccgccugcuggccuguggcagcgccucccagggcaucugccaguuccugcgucuggacgaucucuucaaacugggugagccacaccaccguaaggagcacuaccuguccagcgugcaggaggcaggcagcauggcgggcgugcucauugccgggccaccgggccagggccaggccaagcucuucgugggcacacccaucgauggcaaguccgaguacuuccccacacuguccagccgucggcucauggccaacgaggaggaugccgacauguucggcuucguguaccaggaugaguuugugucaucacagcucaagaucccuucggacacgcuguccaaguucccggccuuugacaucuacuauguguacagcuuccgcagcgagcaguuugucuacuaccucacgcugcagcuagacacacagcugaccucgccugaugccgccggcgagcacuucuucacguccaagaucgugcggcucuguguggacgaccccaaauucuacucguacguugaguuccccauuggcugcgagcaggcggguguggaguaccgccuggugcaggaugccuaccugagccggcccggccgugcccuggcccaccagcugggccuggcugaggacgaggacgugcuguucacuguguucgcccagggccagaagaaccgcgugaagccaccaaaggagucagcacugugccuguucacgcucagggccaucaaggagaagauuaaggagcgcauccaguccugcuaccguggugagggcaagcucucccugccguggcugcucaacaaggagcugggcugcaucaacucggugaguugggcaggggcgccccuccucccgcggccccauccccuccagggacgacggcaucggugucagaugcacgcccaguggugccugcugugugccuggccuggcuuuuggcuuggccauccccauggcucagcuagguggggcugcccuuuuccaucccccagagaguggguuuggacccagggugcuagccccaaaggcugcucccagccaugaugcugucuugugccucagaagauggggugacgaggcccugcuggcauaguccacagccccugugggacacuggacagagugccagccacaugccugguccuacaccuggugcuugccugcuccaucuuguccccauccuacaaaugagguuauaggaucagagaggugggguaacuugcccugggucacacagcaagugagaggcuggugccagagccuaucaggugagcccagacaccauuuccauggagcgcuugugucccccacaugacccugguggcaccugcccgcugggccucugcuuuugcccagcaaugggagcugaugguguccuggugcaggccacaguuaacaacuugcagagaaagugacccugacugcagggagccacagcccccagcacccaucagaaggcacagcugggguggggccucuaucucgcugccuuucagggagugucuuguucacacuccugggcaggcucagagggcacgggccuugcuuaggguggaaagugaaggggcugggacucggcccagaccugggacccccgaggccaggccuucugggcuugcugcugggggucgcuggccaucgcaggggaaggccucgcccucucuggcuguagucucccaugucugaccugaggguguugcugguuuuguccucagggcagagugggacugcaagggccccucaguccuuccgucucacgcucacugccugugugaggcagggcccaugugugcuuggcagaugcgguuguccacccuccccuuggcuuuucaaggaacguguuuucucugcaccauacagauggagacacugaggcuuguaggggcagagccugggugaagccccaccacacucucucuuugugcccugccccaaggcuggggccugcucuuucaucccuggggacaguccccacugcccccucccaccuguucauuccauguggccuagcccuggcccagccuccccugcuccuuccuccugagcagccuggccccugccaaugaacccucugcagacaaggaccaucugccccacuucuccccacaucccuucccugccugcccugcccucuccuuaggccuggcgguggagcagcgcccccuccacacuggcccccagcugcuccggaaccucaagcuauugauugcuuucucgugcucuuagcugggagcccgcccucugccuuucaggugugaucugcucccuccugucuuaaacccucucugucugcaccucuccucugggggcuacccccaaccucucuagaaagacaacugcacucccagcccugcccagggaggcccaguccuccgggagaaggugcccggggaguggcucucacccugccccuucccacagccccugcagaucgaugacgacuucugcgggcaggacuucaaccagccccuggggggcacagucaccauugaggggacgccccuguucguggacaaggaugauggccugaccgccguggcugccuaugacuaucggggccgcacugugguauucgccggcacgcgaaguggccgcauccgcaaggucaggccugggugggguggggugaggagggggcuuggggcaggaacaaaggcuugcggccgucccagguggcaggcccagugcugcuguaugcugugggaggcuagaucuggcguacagggggcagggggaauguugcccuacacuaggcccagugaccuugaagggccccacuccccucugugccucugcccaugacuggccccaggcccacuaagcaaggacacuuugagaccacgcaggagccugugcaggggcccagggaugcugaggcgggggcuggcucuccaagggcacuugaccuccuggggaggcugcuguguguggguggugagggcaggccugcgcggcccccuccccucugggcccugcuccccagccaggagauccagugucugcugccucagcacucugccgggccagaggccuuggcccugccucuccccagccccucuacugggccaagggcagggcaaggguagugccccugccugucuuuggcuggugcuugaggagcuccagcacacagcccugggcuggccccacgguggcagggggagggcuaggugcuacagggauggcugucuggucuucaggguucuccuuuccuuccccagaacagugggcuggacagaggcagugcagagcuuccuggaggguguggguggaggggagcugccugggcuggggugggcaccaggcuggccugguguggaggaagcucccggagagacugaaggguggggauacuuggacaccccagaggcccagugggcagugguggguccuggggugcauaaccggcaccagaggcuggugccgaugcagcuccccugagcccaugugugcccgcgaguggggcugggccgggggcuggccagggcuugcagcucucagcccggugcccaguguuaggaagggggccucccaucucugccaugguaguugcccugggagugguggggaguccugccccucccuggcucugugaucucugggaggggauccccugcagccucagcuucccucugugaaauaagccagauguucaggcucugggcugggggcggggggugcugguggucuuggggcccgugggggcccagcugcugauuguaggccccccagggugggggugcccugggguccugcugguucugcucauaguggcuaugaggcugaagcugauggggaaaguccugugaccccugaguuggguccucugcugugacuucccucuuggcccccaugugggguaccgcccuguggcucuggugcgaggccccucccguccucucagccugcacucccucuccucacacuggaaggcacacagggcucucgagcgcaugggguggguguuggaguggguuuugccagacagaggaccgugcuuguguggaagcccagugcagcagcuuagagacauuuuguggggcgccccagagccuguuacccagccagugaccagguuccucuagcccuacccuguuccugcugcccagcacucacccucuugugccccaggggcaccguuugggucagagcuuugcugagggagcagcaggacacagcuguuccucugggugccaguuggccugucuccccugccuccucaccccagucccacagagggaaacugagguacagaacagggaacugcagaguugggcuugggcccaucuaugggaagaggcugcuucuggguugagauucuaccaacucuuccccuucuuccugcccccauuccuucucccaauuuuccccuucccaccccuagucccaaggaggaccguucucagggaggcagguauggguggagccuguccucugcucccugggccaggugccuccuugagccuggcuuugugggcagcugcuggauggugcagcugggaagguggaggcugcguccucauggccugacauggcuaguuccuuccuggugacccuggccgggcccccaccccucagagccccaaguucuccucagaggcucuaggugcccauaccugccucccagcacccaaccuggguaccgccucccuccacccccaaacaagucugggcugggugccgugggccaugugugaguggcacccuuugggagcaucuggggucagcugugcccagggguugcuggccuggcagagucugcagucggggacuugggucugaguuuuguucggaggcccccccaggcaaggcacgccucugcuuugucccccuggaugcagacacggucauguuggugaagaaccugccgccuguacucuuucacccaaauccaccugcucucaaacuguccagcagcugggcaugucccgugcaggguuuuugaaccucaacgucaugcaaaugcugcaugucauugugggucccagcccucuccuugcccauuguguggccuugagcaagccguccagccucucugagccuuggugucuccucguaccaugcggaccuggcaugcucguguggccuggggugugugaugaguguugaccaugcgccugcacccuacagaggccucauagcagccugucaucuguuugacagguggggaaacugagugcucaaggcaggugcucagggcugcuggcucuucccucccuuucugcgguuccuuggaggaggcugggcagaguucucugcuagccuugagagcuaggccccuuccucagugacccccucucugaggagccccuugccacccacucccaccuguguuacaguccaagacccuggcugucuggcuagcuccugcccuccgaccuggcugggagugcugcugcugugggugcauuuugggguggcugccuguuccauccgcucugccucccuuguucccuaguuaccgugggaccuucaaagccuaacuucccaccacaggccacaugggcagagggugcccuggguuuggggugaggggccaggaggaggagaucuacccucacuuguucuggggccuggguucgaguccuacucugcuugccuuggcucuguuauguccugcagacuccagugcgaggccucuggccuugcuccacugugaaggaugcuugcuccccgcuggccacacaggccucuacuuggccuggcccgggggcagcagaacuucacuucuccucgucucuccuugucaugcugacccaaccuguguguggggcuggcugugguccaggguccagagccaggguaaggagggccaugcugagcccggccccugggcugcccugccuccuucuugcucucagggccuugggagaggccgggccccggggcucccuccugccuguucacauagggcuucuccuucccugaggcagcuggccuggcugugcucucagagcacagggccccgccuccugccuucuucacuuggucuccuggagcugggcccuggggacccccagcccacgcuugacccaggggcaggccugccaggcuuaccacucccugucuuucccaggccagucuuuuccgggcuuuaaaaagugucuggggagcuccagggacuuggcuggccccgggccaguuccugucaaacuguuggggugugaaauuguagcugauuaauuuaagaccugccaacuucggcuauggggcugacugggggugccccuguccccccuccuuucaccagagcccugccuggcaccugcucugcacccacacaggcagccucucccccuggggugccucucucagcgaacuuccugcgcccugcucccagcuccucccguggccucuggggaccccgggccaugucaggagcucacaggagcagccccuguuuuggguccuguagcaucagcccaaguacccccaugggaggggagagcacaggccccggccuccugcagagcgggugcugucccccuacagaggaagcuggggagagccuugcccugugggccggcugacgggcacccgaggccagcccugcucugguccugcugcugcugcggggcaaaaggagccagccccuggcugaggcccagccugcccauucagggaauguaggccugacugccugagcacccgguuuuucaagauucuggaaaccuguauuuugugugagaucucuugguuauuaaauccacguuguaagagaguauaacaggaccaacucaagcaucccuuuggccaccaguuuguggcccagggaccugcacuguggccuugaguagcuuagggaagccacccaccugggcucugaggcauggcccuggugaagccccauccucuggggccuugguuuccuucccuggauguugggugcaucugggcauaccccagggaggcuuggggcuugaaguuccuucuggagcugaccccgaugagccaucacagcaucucccuguggcggucccugcacagaggcugcagcugcaguucccugugugcguccuggccuggcuggccccugucccugugcucaugggcccucaggacucaugcugcagcaccuccugcagcuuuccugguccccaccauucuucagcacuccuagggguucccagugguggaaccugcagcagcugggucucugaagugcuuaggaggccuguggcauuaguugccaucccugagcuucgggaaugguggccugcggggccuggagcuggagcgaagccucuggagcccugcgcagcgugggagguguccuccgcccggccaucuuccucucugcagacagcugggcaccugcugugugccugggcugccuggggacaaggaacaccugcccccuagaggccccacugcucuagaagcuuucagcaugcuuuagaggccucuuugcacuccccucauacccccggaccccaggcaggauuuuggaauuuguaaguucuggaaguugaguggcaucucacagcccacgcaagugcaaggcaguugguggcaggugcccacugugggguuggcagcuugagccucuucaggucuguagugagccucccuguccagggucugugccagggaugugguaggagaccguccugaaagagcuggagcugggggggcaagaagugugcuggccacaggcagcccugacccaagggaggugcagggcaggacugagcccccagccccuuagccguggagaggcugcugucccccaccauugaguuucaucuuguguguuguugagggagggacaaggggaguugauuucaaugacuugcccuugaagccuacagucauucccagguacagccugugcugcacuguuggcguucuuuggggacgugccccuugcaccugcagcaugcagcccacucccgagccugcaggaggguccugugcccugcauggucagccugugacagacgccacauggaagugacacacauggaagcgugcauugggggugugucacgggagagcauaggcaccuaccauccccggcagccccuccugguccuucccuucccagggugaccgcccuggcuggcuccuuugacgcugugugcugcuaugugggcucugggguugagucaucaucuuuugcuuggcaagacucuuccuuacugugggcagcuguggugcgugccauguccucauguugcguguuucaagcacacaugccugugcauccugcccacucuggauggccaugguguugccaguccuugcaggccuguuguaagcauggcuguguguggauuccuguggcagaaggauggauuucuuugggguuucagccugggagcaaggcuguggagccucuguuguuguucugccuuaacucucugggaccaccucugcugcugcugaaggacuugguggcggccuguggcagugcccggcagcauguggggucaaugggcaugaggcaggugcucuggggcaggccaccggguccgucuuugcugugcccccacugguagucuuggugggauggggcagagccagcugccugucauggcugcucucuguggggccugagugugugcugccacugcccgcccaggccagcagucccaguccccuucacggggcccugcacgguaaccugccgacaucugugcuuccuggugagcgugugcccgcccccuuuccgccucuccuggauguaguuggccacugugggcugagccaugaggaugcagggagcgaccugcuguuugcccugugggcaugaugagugccgucccagagcugguggugugcgagggugcauaagcaucgcuucugcuucccaguggcuggcagggccacccauggggcacucacggagagcccuaagccagucaggccuaagccagggcacgggcccgucaacaccauugauaagguggaggcagcaguggcuuccccaugccguccugugugugcucgggcucauggccagccuggcaggggcagccuugugaguauccacaccgggcagucgccuucccccacaggcacauggggccuguggucccaaccacagcagagaccacgauguaggaggugcuggcagcgugcaguggguauggaggcuggaacaacccaggggacuggguggucugcuggaaggguguucuggggacaaggaacaggagggccaaagcucagaggugccccccguggaugcugggaagcguacugugccuuuugggguuucaggggcugccucgggcacacuaugcuuguguggugggucacuucaccagagaagguggcuggaccagcuggaugggggguaggugcugaugugggucuuugagggcccagggccaugggguggcacuagggucagagcuggagguggcauugaggucacaggauggaggagagagggcaccaggcagcugguggguuugagggaagacacuggggcagauggucccugcugccuguguccccacaggacccgugcuggugacagccuggcuguggcggagacucuggccaagccccagguuagcccggagcccaggcagugguaugugacugagguggugcagucuauggugguucacgguggccccaccagguguggccucaccagcugggugcuagguuccccaggcagcugugcacaucugccccacagcagggccaagcacuuccccuuuggaaccaugaacuccugaauucucacacagcucugugagguggauguuggcagaugagaccagggguuggggagguccacuccuugcugagggguugcugcuggggcaggcuggagccugucuaaggcagcccuggcuguccuucaccugccaggacccugaccucagucucugcucucccugugugcuggggguuggggguggaagagaugggauuccuaggacacucucucccccgacaggugugucuggccugauuccagcccucgggcuuccugcaaauccuguuuuaauuacccaauuacugccaagaggaaauugcuaauugcuuuuccaguaucaaguuccuccuggccuuucugagagugguggggacccaggaaggaggccuagaaccuguccacagcuggaggagggggcaguccugugaggggugaggagggucugggaguggguccgcuggggccuaccucagcugugcaguucuggcugggaaggggaggggcaggugggcucugcacccuguggggguccugagaagagagggcagcagaggcuccugccccucgggcagcccuuccuggggccaccucaggcuggggacggguuuggcagcugccucugcagaaaggcugagaagugugugaggccuccacgugugggcaccuccuuagcugcugccccggucuuugccuguccccaccuuguccuguccuucucccagcccuggggcccggaggcagcuccacaggugcauccccgccucacagaaagagggagggccaggccccuggcugccaucauggggcaggcagaguugggcaacuccccuugccaggucagggccaagccgggcagcccccugccucccggcggcuggggcgcgugccgguccuggcacauagccuggguggcccagacauccucccggcacccccgccugcccucagcccggagaaugggcccuuuguuggcucugggcgggauggacagcugaccuggccgggcccucagcugcccgccggcagcaguuggccagggcuguggcggugaugggaguggguacagccagcagggccagccuggggccugcauugagcccugccugcuguguccugggggcaaaggggugaaccugcucccuggccuaucuguggggagggucagaugagcccugugguggugggaggugcucaguccaggagugagggccaugccuggcguggccugggcacugagaggccucgggacugcacuucggucucggcuccgagcccagggucgacucgcccgugugcauguaggacagguaccccaggguuagaugguccaggcagaagcaggugggggcaucccguguuccgccagccaggggugggugggggccuggugcagccaaggggcauauccagggaggcugcuggcucugcugaagccccuugggucaaggggaggguccucucaagcagggggcggcaugcaugggcagcgccagcuccugguuugugcugggaggugggagggugggcuguuggggccaguuguggaagguucugguggucuuuggggaaagauuugcagagcaaggaggugacagcugggggaagauuccagggcaugccuguggcccguucccaugcccgggacacgucaagccucucauuugcucugccagcugcccagcugcugugggaggggcuucugggcccagccaccucgagggugggcugccuccaggcggguggcccgaaaguggacagcuguggccagggugugggcgucggcacgugggcucccggccggcgugugcccuucuguccugccacccgcucuggccccagguucaccugccgucugugccccugugcucugguucuccuggaauacccuccugcuggguacuggcucccccuucccacuuuacgagcagccucuguacuccucccaggugcaguugcggguccagggcccaagguuccucuggcaggugcugugugagucucagcuuaccuccugucugugugguuugauaaagcuggcuuggcugcacaggcccuucacccugaacucuggcuaggacacagacacauguccuggggaccauuguccuagcuggaugcccuguagaacaugugugggugcacaggggcccugcugagucuggaccguggcgccucagugaacaguguggggccugcaccugcgucacauccauccucuggucuggugugcugugccguaguggccuccccagugccccgcucacacuggccaugccauggccucuccuggggcucugucucccugggcccagccugugugugugaagggguggagguggcagguggguggacagauggguacauggcggauggacagcuggacgcgugugcucccggcugcagcugucagagccaacuguccagucggcaugcugcuggguggagcggggcguucuggagccuggggcccagcuccagaagaagcuccuauggcuucuucccuuccugggaccccuccuugcaccccucacccaccguuccuuuccuuggagcuggugugcccccuggaccugcccuucugugacccguuucuucaccccuuggugugacauuugugcccccaacccugaguggguggaugccuugcaggccgggccagggucaggcuccggcaucauguggcccuggcuguuggggaggugggucauguccuuguugagacaccucucaagugcucccugcaugccgggccaggguccaucagcucaggcugaaggggcucugcuaccaggggcaagaggggccaggggccauauccccuggugcugguaggggagggggagcuggggcugggcuucacagcgggaagccgcuggggauauccacaggacugugaggauggaggagaugagaggaaucguggucccuaaccggggucuuccagguuggagccgcaggucugcgcacugggcauaccugccccagccuccacccagucuguguccugcccuccucgccuuccuucccccacucccugguggcugucuuaagccgcuggcuuggaugugugguuggcugcgcaggugcggugauugcugugggccuggccacccugggucccccugcucccgccuggcacaccuggccugguucucauauaauccucagaacaacucugucugagggaggcagagagagguuuggacccaggcacuguggcccagaggcugguccuggcuggcauccgccugggucugaguaccugccucuggccacugacccagagcaaagcaggggguuuguggugcuggcauccuaagcguccgucgggcaggccuugggccaguggucaucuuaaacaaggacuccuacuccugcuguggcugcagggcaggcaggcacgggugcacuuggugcgggugugggugcaguccaggccccaccggcaggggugcugggcggccguggccugguugcuccugggccgcccgcugucccugcaucucuccucccagaggccgugggccauggcccugcagccagugcagcugggcccauccuggccgccucuuccccugcccagcuuugggcuccacucuuccgggucugguuugacuuaagccugcuugguggcgaggcagcugagcggaugugggggguggccggcggcgcucaggaaugcggcccucccccucucccagccgacagccucuuuggcucagaaacacagcgccccacccuggcuggccgcccucagcccaggccugauggaucggacuccaaccagggcuuucgcugggcccugcugcccuggaccugcccugcucuguaaccgugaggagugaggacacagaggagggguacugagucugggccuaggccccugcccugagguggaaguggagagguagagcgggagcaggagugggucaggcugggggaagcaggccacagcccgcagccugagagccuacccuggacucagagcugggcagacacgccccaagagucccaucucuggaaagccccgugggucucucuguuaauuaaauacauuuguuugguaaaagcaacuaaaaauacuugcagcaucgugagcugcggagaagagcuggcuaauuaacgccugguuuguuugggaucuggaauacauuuccaugccgaugagacgcccacccuccuccacugccuugccaggaugcccccaccccuaggacaccccauucuggagucuccugguccacugcccuagacuuccugugagcccuggccucugcccccgacaaccaacaucccuccuucaaaagcccagccuggccccagggauggcuaggcacccgugggacuccuguagccuucacccuggguguggccaugcugcuccguggugggugcugggcugugguugucuccaggccccaauaccuucuggccucugcugacuguuaaaggggcugaaucacagacuggccuguuggggucugaguuugcccugcacuggggcuggggcuggggcuggggcuggggcuggggauguggagagugaguauggcuggcgcugguccucucugcucaugcaugucugggcagcucagggaggggcuuuagaccccugaccuucugugggggguggggcugggucagggagguaucagcacagcuccaguuagggccccuugcugccgcagauccugguggaccucucaaaccccgguggccggccugcccuggccuacgagagcgucguggcccaggagggcagccccauccugcgagaccucguccucagccccaaccaccaguaccucuacgccaugaccgagaagcaggugggugcugcaccagucagacgguguggcugaaggugggggcccuccuaccaggaaccccagucacagagcaguagggguggggccacaucacaaguugggcguccauggcuccugguaaaaguaguuucaagcuggucugugcucugccucccugcagacuugugggcucggcugggucugcaggggaaccggucuggucaccaggggccccacagccucauugcugccuccauguucuccugggcuggguuuggcauucccaccccuccccuguugacuuccugaccacagaaacagauguaugaaggagagcaauuucagaggcaggugucacuggaggguuugggguguguacugggccacugaguccucaggccuagggcugggucucuguccagugggucugcccacagggccuguggcuggccuggucuacccaaccuggugccuggcccagcucuguaaggccauggaguugagucccuggccuggcuugccuggaguccaccccugcccuauggcccaaccugguaaccucguggcagcuggagggugggcagauggggcagguggggccagguugggcacaccagcugaggccaagccucccuccccuucuggcuggcucguuuuuccucugccccuccugggcgcagugggguucugccuuccuggggaccucagggacgugccuccgugggcacugggaugcugggcugagccaaggagccagagugagcuggggcccagccugccccucugagcauugucugggccugcauuggagcuuaggauugggaccugccaagcccauugaucgcuggggaagcucagagcugggagggaguccagacagauggagaggaacucugguugaagcugcaggugcuucuuugauugucucaccccauauggacuguucucucuggcugcugcccccuggguuuccagggcagaggccugaccugugcgaccuggcuuggccagggcagggucaccagaucugccuuugaauagacugagaacaagugcagggccuccccgggccuaaggagagcagaguagggagucagaggugaggauggucaaggaccccuggggugguacuggaggggccugacaccucccccacaccaggugacgcgggugccuguggagagcugugugcaguacacguccugugagcugugucuggggucacgggacccccacuguggcugguguguccugcacagcaugugagucugggcaggugggcaggggcaggcggggagggccaugguggucucacagugggggagggggagccuggugcagggcaagccaccccgaguucucugcccaggucccgccuggcaggcgggccccguaggucuccccauccgcccagccucaaccccucugccugcagcugcucgcggcgggacgccugugagcgagcagacgagccccagcgcuuugcugcggaccugcugcagugugugcagcugacugugcagccccgcaaugugucugucaccaugucccaggucccaguaaguguggcaccccaggugguaaggggugggggacagccauggggacccugcucaccaugccuccugcugccugcccagcuugugcugcaggccuggaacgugccugaccucucagcuggcgucaacugcuccuucgaggacuucacggaaucugagagcguccuggaggauggccggauccacugccgcucacccuccgcccgggagguggcgcccaucacgcggggccagggugaguggccccaacacaauggugcccgcugccuggccagguccagggcugcaauccaguugccgccuguuuagcgccucccuuguucaguuccaagggcauguuggugacacucugacagcugauaugggugggggucucaccaccugcuggucugggaguggagaaaacccuccaggcauguagccagagugagagccuuccugccagggagguggacagcggauacauccuucuuaggauuuaucuuaugggcucaccauacauuuacaguaggaauagccauagacacaugagcauacuucaccuccgcuaccauaauuauugccaucccuacuggcauuaaggucuuuaggugucccauggugacccagaggguggaagagcagggcaggguaggugggaugaagggaccacauggcggagaccuggggucuugcggggggcugcaggcugaaggugggagugggugaggggugggcuauguggggcgcagguugggugggggacagucucauggggacuuggggugcaggaccccucuggcugccacagcccguuggacagucgcucugcaggcccuuccacaggagcaggcagccugggggccuggggagagucucgcgguucucaaccccucacacugagcaggaggcaagcagggcagaucccaggcccuggucaccugggggcugagggggcuggaugcguguuugaugcgacugaugguggcagcuaggagggucuccgggcaaguuguuccccugucuggacuugcccugugugggaguccugggcaagcaguccuggugacucagccaugcugcucgugcaggagaccagcggguggugaaacucuaccuaaaguccaaggagacagggaagaaguuugcgucuguggacuucgucuucuacaacugcagcguccaccagucgugagugucucuaggccccuccgcccgccugggccugggcuacuugccccacucccgucccuguggucccacugugcuugcugucugcagaccuguccucauguggccaggcagcagauggugauuccaugauuggggcuccugaggcugggcggucagggagggaggagaggccacugugagagcagcuugcagguagaggagccagccagggcaaggccaugagugcagagggugccugaggcuggggcaggcguaccaggaagcagcagucagagugggcggcagugccugccccacagggaucuuguagggccccagguggcuguguauggcugcaagggcacauugugcaauguugccaccgugauauggacaguggcccaugggcacuggcauggaggggaggcgcucagggaggagcugcgggcugguuugggggccugagcaggggcccagacacggccccuggguaccugcugcuucugguuguggcaggcuacuguuggacgaugcagcauccagguccccucugguuggugcuggccccugugcacgcccccugcuugggcagggagugugucuaggaggcagcugcuaugccugcugcccauuuuggcugugagcacccccagccucagaggaaggaugggaggaucugggggccuccugugagucccacugugagcccagaggagagcccucacuccuucccugaaccagaggacccaggcugaggcaguaggguuuggccucagagacaggaggugcguggcuuuucagguaugcuuuuguuuguugacugacucacagauggacucugucacagcucuuuguggagcaacugccgugagccaagcaggcuuuuuauuuccaggaugcagcaucucccgucccagguggggugggggaucucuggggcagaggccuggagggggccgagggcuacaggagaagcaggguggugggggagcuggcgggucaggagauccuggagaggagauggagguggugucuuccuggaggcuguugagauggcaaggugccagcccugugcaaggcugaguugugggcagagcgccuacaguggccagccuggcagacccuggggugugucagagggaaacagacaagcuccugccccagcgauccugcuuucugcagggaggugaugugcauggcccuguccaguucuguggcagcacgugcugcuucaguuuaaaucuaaguuugccaaaaggagucaagacuuaaaaugaaguuccuuaguugcacuaacacauuucugaugcgaguacccaugccuggcuggcagucagguggugaucaaggcucuggaggaaaaagcggcaaagaggauagggagccuggggucaggagugugggcaggcaagaagguggggaggcaagacaccuccagcugucggggaggugugaggaggcagagaggcagccacauucagguuugggggaagaacuuuccaggccaggagcagucagugccaagacccugagguggcacuaugaauaccagcaggggcggcacaguguccuucugaucaugggugacuccacgugguugcggguccccaggcuucagcacccacccucucccugcagcugccuguccugugucaacggcuccuuucccugccacuggugcaaauaccgccacgugugcacacacaacguggcugacugcgccuuccuggagggccgugucaacgugucugagguaaggccgggcaagggugagggucagguuuucagagguggagcagaacuggguugagacaucccaucugggugucgccugaggccuggcccagggagcaccuguggaugucugggaugucaccguguggugcaugcaccaccaggcugggucagugaggugacccuggaugccagcugggaggccuguggggucacugucuuggccugaagucaggccugugguauuuguuggugaccccuggguguccuucgugacacucagggagggggaaaagccucagaugaguucugucccugggccucugugugggggcugcagacacgggcuccugggugcaauugggggcacugucaggcugcaaagcaggugcgggcagagccuggagugcgggugccuggcugggcaggcacagaggccuccauguugggcaggggagcuugccggccuagcgugccugaaggcugguggguucuggagucaccaggcgcugagugguaauugcuaguaauuaaguaguaauuauucugggcugggcaaggcacuagcuuuaugaacagcaggcuguuccuucuggaacaugaggcgcuuaguagcaggacagggcaggacccagggcccacaggugcugaguggcaaagcugaggccggagcuguggcagcccccacccccauccccaccgggucuggcuguggguguggagccgggacuugcagccaggucccuuuccuuugcuguggacacuccgccuguuggcuggagggggcagguucugcuugccagggagaccuuggaggcugcagcugggcugcacuucccugccaggcugggggcugggggcugaggaaguugcaugguggcccucucuccucugggucccuucucacagagguccccuggcccccagcgucacccucuggacuggacuuuucugcucccuggcaugacaucagggcacaggacagcgguggaggguagcccggggcagcagggaccacagugccugugucagggugacugccuauaacaguggguaugcaggagccagggacacaguggggcgcuucucugggggugcggccugccugaagagccaggccaagguguccugggugugggcagagcccacgguggaaucugaggcgagagcugguccugggggccucucgggccagggagagcugggcaugaagucacuguggggaugaugugcagaugcaguggcuuuggcgcugugcgcagcccaggguucgagcaguggggggcagcacaguggucgucaggggugguagcagggcccugggcagcuugggaugguuuuggggcugagauagcccaauuccucaguggcagccuucccugagcccuccccauccaugccaugaacuucgaggcacccuuggggaguggaggaaguggccccuggaguaguggcccuaggccucaggguuggggaggcagagcaggcagggcugggcugggggcacguguggggucgcaggacuauguggggaguggauucucuccacaaauacuuacucuuuuuuuuagcuugagucccagauuuuuauggagccauuccuaaggggugugacgugaguccuccgggacucagggaacaauggccaguggcaguccccccccaacccccccacaagcccucuuuccgucucuguuucugguggguuccucgggccacccccugagacaggaguguacuacauucagcuuccugcugagacagccgggccuaacccccaaggccaccauccgcccccugcccccaugcugggagggggucucuguggccccuucuugugccugccugcaugcuggggucuguguguuuugucugaaggcggaguggccugugcauguugaugggaagggccgccagacuggggccauggaggcagcuggugcugugugccagggccuaagggcucccacguggagcccccaccgaagcugagcucaugagacacgcugagaagucgggacuuucucuuagaaaugccuguuucuggacucugcagaaagggaggagugugguucgugucuucacauaacaguugcaugccccgccagucagcucccagaucugagcaagucuauagacuccuugcuugaaggagaggcuggggucccuugaggaaggagccuugugcgcuggcaaaaugcacccuguuaaucuucccccagcguuucccagagggaccuccagccuuuuaccagggagacuaugcacuggggagaagguuguaaucggagccuuuggggacaaccggaccuggcucugaagaaggaccuccagccuuuuaccggggagacuaugcacuggggaagaggcuguaaucagagccuuuggggacaacuggaccuggcucugagcugucauugaucccaggagacccacgccacugcaggccuccugucagagucagagucaggccaggucgagucaggugaucacuggaguuucagccuaauccugacucagugggccgcaugggugccgagcuuccuggguucucacucagcuggguguuggggaggagaugggguggggguauggggagcaccugagaggaccggguguggcccaggcagccagucagcuuccugcaccuggcagagggcagggguggcgaggggacaggccagcuucagggugauggggcaggcagguaggggccagccacauuggccuugaugcgugcugggcccacacgcucacacugguguugggguggguggugcuuuuuccuggcugggaccuggguucugggggugggccaugacugagaccucacgccaggugagccagcuucaugucucgugcuaccggccaagagguuuccugaacuuacgggcaccaacaaagcccgucccucaccauagucaccuucuggcuugcugcaggcugagcugccugggcuccucugggcauuuuucaguugguuggauggugggggcagcucagcuggucucagacugaccauucucgggcgcucacgggcagccuagcuuggacugaaaggagucucagugcccugagccacccguuuucauggcuggggcccuaaggugacaaggcccacgguggcccgugucacggugagacuccagccugagccucagcaugcagagucacugggcgcgccucagacugccagggagguacagcauagguauggccacugugcgugccugugccuuccggcugcagcuguucugggaacacagaguugcaagugcagccccuaaguuggggccaguggcccuagcugcaaggugccaccaccugccucuccccaguggacacaggagcaucccugcagacccagagauuaguggucaucuugcccagcugggccuuguuaacucugcuucccuggagcuccugaggggccaggccagaguccaggcccccucuuggguccuggaaaaucucugcagagcugggccugggccuuccugccugccuugggggcuguugcagggcuuggggauuacagccuguuuucagcaucccuauuuaaagcccagcuucucaguguucccgaggggccaucuccugaggccagcagcagccaugcugcaaggaagccaggccauugcaucaguuauuguugccgaaaugcuggccccagaggccaggccuguuuuucugcugggcucuggcuauuuuuauacacucccugggcccccagcgcagagccugcagccccagagccccaaucucuucugccucuggggccuuuucagcugcuggccagauggggcuccuuuggucucuggaaugguggggguccuagaacauggggcagggcauucaggggccagagguaauagagccugucugggucauaguaugcagucacugucccagccagcgguccucaguuugccagugcauaaaaugggcacauuggugcuuggcugggagcaccacaggcccagugcacaucuggagcguaguggggugcaccuugcucacuggucuccgcccccgggcucagccaaacucuucuuauccccaggacugcccacagauccugcccuccacgcagaucuacgugccagugggagugguaaaacccaucacccuggccgcacggaaccugccacagccacagucaggccagcguggauaugagugccucuuccacaucccgggcagcccggcccgugucaccgcccugcgcuucaacagcuccagccugcagugccagaauuccucggugagguggccagggcaggggcugggggccgugagccggaaugggccgguuauccucacggcccuggguccuggcgugugcuuguucauaaagggcagugcacgugcucacguguaucucugaugagucagaagccacuccuggcuuccccaggccauugccaggcccuucagaugugccugggucauguaggcaagugggcugcagggggcccaugcuguccugguagcugcugagagcacccaguuguguggugggagcagccugaaugugggaguggacagcagccagccucaugggacucgcacauugcagcauccgugggucccaggcaugggcugaucaucaggucugagugugugcaggaauagccagguggcugccagccuucaucacuguggcucccggagggcagaggucagggugccagagcgcauggcuccguccaucccuggccaaaugcagaaaacacucccauuggcccgcacuugcacacuagcagacgguuguugccugugguccgagcaugcguagaccuucagaucugacacaauaguguuugaaaagcucuacugucaggugcagugcguucagugacgggaucucuauagaaccagccauuuccugaguggugggggaguggggcccaguugcccagcaguuggaggccugggcugaaguccugcacucccaguaggccucugucuccccuucugcucaggacgggugugauccagggagcagugggcuuccuguaacucacugcaggggcagguggcugggcuguuguguggggcacugggcugucgacaaggccuuggcuggaccccauccccuggaagcccuggggagggccuugauggggucagaggucuggagccccuuggcugaccccuggucugucccagcagugugggguagggucuggagggucacaacaggcuuccuggggcagguuggguugcaggucagccaugaggaucacuccuggccaccacagcuaucuggaguucucucugccauccagucuuuccagacauuucuguucuaucaccaacucuucgccugcccugcacuuuccaccugcgucucccuccccacccucccuucucaccaggcccacauuaaucuucccuucagcuguguuuaaagggaagcgggaguaucggggaauuugacaggauccaauuaaauuccugcagauaaaauaaugaugaauugccgggccgccccuuggagaugcugggcucccugcaccgucccagcacgggaacagaguugaggucaucuguggcagaaaguggggcacagcuggaguccuagccaggcucccggggaggggcaguuccccugggcccagcccagccuuguugaggaggggacggggagcagagcugcaccugacagugauuuugccugucucugccccaguccggggacacggaucucccaccucaaggcagggcaguccuggcccauucagcaaagaugcugagguacacagagcaugcugaugcguauucuagggccagcugggagucuugguuucccagccuggcugacuguagggaguggucagaggcugccugugguuggagguggucuccaagggggugccacagaggugacugugggaagcacagagguucccuuggaagggcaccucauaugguugcuagccuggagagagggggcucuggagccaggaaggaaguccuguguaggaugaggguggagagggagcgguuguggcugcagaaacuucccccuaagcuggcgcccugguggcuuugugggcgugaggcuugggaggccuggaggccgcuuagcugggaagccugacggugccaucaccuaacaguacuccuacgaggggaacgaugucagcgaccugccagugaaccugucagucguguggaacggcaacuuugucauugacaacccacagaacauccagggugagugggcgccccggcggggugggcagugggcgggcccgagcugaccgcaccccuccccacagcgcaccucuacaagugcccggcccugcgcgagagcugcggccucugccucaaggccgacccgcgcuucgagugcggauggugcguggccgagcgccgcugcucccugcgacaccacugcgcugccgacacaccugcaucguggaugcacgcgcgucacggcagcagucgcugcaccgaccccaagauccucaagguagggcccccagcccugcccccacaccccaugccccgcccugcaccaccgcacacccuacgcccugugggaugccuguaccccagccucugccucccucagcugucccccgagacgggcccgaggcagggcggcacgcggcucacuaucacaggcgagaaccugggccugcgauucgaagacgugcgucugggcgugcgcgugggcaaggugcugugcagcccuguggagagcgaguacaucagugcggagcagugagugcagcccugggugugugcggggcgggacgggacggggcggggcuccugcagccccugaggcccgccugcccacaggaucgucugugagaucggggacgccagcuccgugcgugcccaugacgcccugguggaggugugugugcgggacugcucaccacacuaccgcgcccugucacccaagcgcuucaccuucguggugagucugcugcccucccucucucccuauucucugcugcucugagagggugccgcucagggcuucugugccucuucagggccccuugucuggccaugcucugccacugcuuuuccacggccugggugcugccccuccccuccugugccuaggccagcuccagggcucccuggcucaccuugggcugugccugagaaaccuggaaguacuggcucugaagugcagcucccgggcaugcgggcuccuagucuggggaacugucuguggggguaagcaggccaaguggggccuguccccauguggcccgagggggacuuuccugagaguuucagcaaguucccucuuccugcagacaccaaccuucuaccgugugagccccucccgugggccucugucagggggcaccuggauuggcaucgagggaagccaccugaacgcaggcagugauguggcugugucggucgguggccggcccugcuccuucuccugguacggggugcaggugggggugggggccuggcugccccuccuccuguuucagaugguugcaugccccuucuuguugccugggcaacggggcuauggagagccuggcuggggugaucacugugaaacccagaggcggagguuaccauggaaacaggcuaccuccagagugguaggacugggcggugaugggcguggggccugccuuuguggggcggggcaacuuggcugccucugcccugguucuucccuguggggaaggggggaaucccuuggguacaaaauaagaaguauuuuuuaaaaauuuuuaagagagaaaacagaaaucuuaacaaaagcccugaggcuugaaguggauaauuuuagauuagggaugauaauggaaugucccuuuaaauauuuuccuaugguaauuacccguuaucagacuaaucauuggugucugcagcugagggggccugguggcuguggggcuccuggcagugguggaagaacugaggguccggacccaggugugggcuaugccuggcugccugcccagugggguguccccgugacccccacccaggccagcucaucuagucuccucacagcccccugggaugcggggauagggcgagguauucccacugggacaggugccgagagggaaggugucugccuggcccaggguaguaggagugggugcugggcucccagcacucggagccccggcugagugaggcuggcccugagacaggcagggaaggucgcgccagggcuuagucucgccagcccuccccagggacagagggagggcagcaugagccuaccucccagccuggcgugcgugggacgggccugcugccuacugccucuggggaggcagaggccugguggguguggagcccuggccagggucaccaggagugggugugggcgacagggaggcugugaugaaagcagaccuggagaggcggcaggccgggucccaaaugccaggcugggcaacagugggggccugaaggggcugggagccagggcgaggguaggacagacaugcacagcccugggagggaaaguagcggugauaguaugcagccacccaaggcaguaccugugacagauggcgcuguucccaccgucccucaaugcaucugcauuccaccugccuggguuccacccgugugcuccucacugucccacucgggcaccuccaggaggaacucccgugagauccggugccugacaccccccgggcagagcccuggcagcgcucccaucaucaucaacaucaaccgcgcccagcucaccaacccugaggugaaguacaacuacaccgaggaccccaccauccugaggaucgaccccgaguggagcaucaacagguggggcccagcaacacccauucccuauccccagcuauugagagcagcgcugagccaggagcucuuccacugggcacuuggcgguggcccuccugcaugccggguacuauccugccgggaagcaccccuugccaagagcuuuuaccuguuuccugucuuuggggaaggcaggcuuugccuggcugagcuguggcccacguuuccagcucacugggccccagcaucauuuggugacccccccaccccuguccuguuccagcggugggacccuccugacggucacaggcaccaaccuggccacuguccgugaaccccgaauccgggccaaguauggaggcauugagagggagaacgugagucccugcccucagcugcccaccucgguccaggccuucaccugggauggggcuccugcuaggaauacccgugucccugccccugccccuaccccugccccuucccagcuuaugccaaccuuggcugugccuggagaccccuggggaggcaccuguccugccuggcggguagaaggucuggcucuggguugcuggcugcacacaccucuccuucaggccacaugucccugguccacgucggguggguggcccaggaccagcccugcuagugccuggcaucaucugugcagggagcaggcagcccccaggccaggggcucugucacugggagcugccgggccacucgcggaggucccgcccagcauccccacccugugucuccagggcugccugguguacaaugacaccaccaugguaugccgcgccccgucuguggccaacccugugcgcagcccaccagagcugggggagcggccggaugagcugggcuucgucauggacaacgugcgcucccugcuugugcucaacuccaccuccuuccucuacuacccugaccccguacuggagccacucagccccacuggccugcuggagcugaagcccagcuccccacucauccucaaggugggucaccauugcccguaggcugggccaagccagggaagaggccccucguccugggcucuggcucacccccaucuccuacagggccggaaccucuugccaccugcacccggcaacucccgacucaacuacacggugcucaucggcuccacacccuguacccucaccgugucggagacgcaacugcugugcgaggcgcccaaccucacugggcagcacaaggucacggugcgucuguccaccgggggugcagagcugggagagccaugccccaccuguggacccugccccacuagcacagccccagcucugaccuugcccgagacucaccccuagcucagagggcgcccggcuccagugcaggcccugccguagccuucagccugccaccuccuugagccccccgagacugccuacccacccugagcccuugccaugccaguggugcccuggcuggccaggcgccugcccugggucccagugucuccacccuggugaccacucugugccccugucggugggaccuuucccacaggcagguguugggggugggucuugcccaucgggaggggcucccaagcuuuguggaaagcaugggaagcuccugaguggccuccacccacuggcaggugcgggcagguggcuucgaguucucgccagggacacugcagguguacucggacagccugcugacgcugccugccauugugggcauuggcggaggcgggggucuccugcugcuggucaucguggcugugcucaucgccuacaagcgcaagucacgagaugcugaccgcacacucaagcggcugcagcuccagauggacaaccuggagucccgcguggcccucgaaugcaaggaaggucuguuggggccagggcucacuggggcaacugccaccuccgagccaggcccuggccuguccccacaccuacuucccaccgccgcccccacccugcuucagcucaguuuacaauguuccugauagccuugcugugccagagcuggucccagggcagugggcgggugccugaccagggccuggcccugcagcagguaccaccuccuuggggugcugcuugcgacacagaacccaaagccagacuguuugcauuuguaucccagcugggcuauaaggcugaagguggcuacuuacccuucuguggcucagucuugucgucucuagagugggcacaaugacagugccuacuuucccugggugcugggagucgugguggguuggcuggugccagcggagcagcagagaggggugcuuccaccaugcagcaauggggagcccuugcgcuuuggcagucccugggcacauagagaucuuggccugagcugaccuuuguccuugagaugucuauagggggagucaugccacaccaugcuccugaucagggcaggugugaguggcagaaaucuguuccaugccgggcgagacuuugagcguuugcagauaguaacucacacauguucagggcucuagggggcagauacuaggaguguuccugcugcaguguaggaccuuagccaugugguccagcaugggguugucaugaauuccacugggacucaacugggaugggguguuuuguuugcacaggacucagccagucuuaaaaugcaaaguucugcauccugggagcccucucagucccagacaaaccuaaguggcccuguggugggcugagggucacccuaccucuugggcagcccuggugggacuggaggcagguguguguuggggccaggugggaggcagguggccuggaccucccuugugcucccgccugcugaggcuggcugucuggcgaggcuggcguguguggaugcaguggcugguggcugcuccaggccagccaggugcagauaacuagacgccuggcagcgaugcccaggagacgaagacuccagcucuuaauuaaaccugucagaugucccccagagccugccuggcacuccuuuggcuucugaucagauagccugauccucgggcugccacaggacugacaccucacagcucuggaauguucugucagggccugccugccuuuguuccugacagaggcagagcuggcccugagcagggugggccauguugagggugcaccaggcccgagaugugcaugcaauggugugggggcuuggggacagccugcagcccugggaccucaccccuggccgcacuccaccaccucacagcggguggaaggagcccgaacuccaaagcugcucuacgcuuaacugccagugucugagaugcaggaggcccugcccagccugccccuggugcugaugcuuucucugcccuugucuugcuugauccugugggaaccuugcagaggagaguuacuaucccugugcuagggcuguaguagcugggggacgaagaggcacaguaguuuccuuaagaucacgaaaccaguaagugucagagccaggauuugauguaggccccaagagugggaggguuggggcauggagcggggccaccagggcaugcugccccugacgccgcaucuggccacagccuuugcagagcugcagacagacauccacgagcugaccaaugaccuggacggugccggcauccccuuccuugacuaccggacauaugccaugcgggugcucuuuccugggaucgaggaccacccugugcucaaggagauggagguaggaccacuggcuccggggggucacaggaacucagaggcagcugcuaucuucugccuuugaggcuccuugggugcugauggaugguauggggcagccuguguggccugggggaggguccaggccugcagggcucugggcucagccaaguggggagcaggugcugggaggcagaaccaagaccaggcaagcacaguggagcccugagcccugggguuggggcaggggaauggccagcacggcucugcuccauaaaguaccuccagagggcaggaggaggcucuggccccagggccuccgugggaugccaggccucaucccagcaaaccacuugucagccugggcuucuggcaccuccccgguggcugccccuugggcccugccucuguugggggucccgccugcggcuccacuggccuggucuccuggguggcucuggaugcgaagccucgcugggcaggggccgugugcugggaggugcgggugccugaugaagucugcuauggcgguuugggaggggagcauguggcuggcauagcaccagggucucagagaguagggcuuugccccguagaccuuggcagcgagccuggcgagggaaaagagggcuggcucccacaccccuaaaaggcccccagcggcaggcaggcuaggagccaguccuuggcgagccacggccaggggcucggcagguuagcucagucacacucuccagcugagggcaccccccaaccgugugccuuggauguuggggagcccaugucccuuguggugacucuguuggugggaagucccuuuugagcugauacugagcagaccuucccgccuugggcccugggcugccuguggcugagugcugccauccuguuccugggcuugcugccacacggggcuacacagccuccccagguuguaucucucuuucagugccuccauuugcugugucugucacacugucucucucagcugugacuguguauguucugccugggccauuaccugucugccugauaccuguuggccuuggcugggagccugguaucacugguggccucugggcucugccuaauagggaacauauugcccugauaaaccuuaguaugaacaagagagagagaguagggacccuggagccagcuaugccucuacuccacuccuuuuuccuaccugcaguguggcccuaaucaaaccucuuccugucuccaaccuuguguccucauccaugagaugcagagacuggucgugcauugguuaucauugucaaggcggagggagaugguagacaugcacuccugguacccaguggaugggggcauugaguuggacuuccuuugagcugcugcaggcccgcugcagggguugcuguucaaagggcccagucacggagaggguggcgugagcagccccucucauucugcacccagccgcacucguaacaccuuugucaugucggcuugcaggggcuucucaggcugccacagggacucuguggccaaggcugcccugauggcaacaggcagugguggcagcacccaggucguguccauuuugcuaaggacaggugaagcuugggaaugacccgccgagcugaggagucagggcaacuugucacuugccuuccaggccuguccucugauggggcccugccucaccagccaggccuggacagccccucacuggucagcuugggggcuggggcugggugcuucucuguggucugagcucugugugcucccucaggugcaggccaauguggagaagucgcugacacuguucgggcagcugcugaccaagaagcacuuccugcugaccuucauccgcacgcuggaggcacagcgcagcuucuccaugcgcgaccgcgggaauguggccucgcucaucaugacggcccugcagggcgagauggaauacgccacaggcgugcucaagcagcugcuuuccgaccucaucgagaagaaccuggagagcaagaaccaccccaagcugcuacugcgccggugagccuggggggcacugggguugggggaggcaggcccaugccuccagcuuuggacagguuggucuagcaggcccagagacguugcuguggcaguucccaccgggcaggggugggaggacucaccuggccucugaggcucagcugccaccucccuagguacugauagugaggacccaggcuggagucuccauacacacaggccugggcucugggcgaaggacuggggucuccauggcagccccugaagcgccugcugcccacucaugugggugccuuucgagaccugaccuucggugcuguaggaaggggggcaggguggggugggaucggugagugaggccugcaggggcccugugccugcuggacagcuggaaugacaccacucugcccauauucugugcuccccaggacugagucgguggcagagaagaugcuaacuaacugguucaccuuccucuuguauaaguuccucaagguaagcagaggcgggaggaagcaggugucagaggcaggugaacagcgggaggggaaaacggagagagguggggauuagugggaggugcuggagaaugacagcugguggggucuuggucgaguucuggcuugggccaaggccccugggcaugcagccgcucucagcuccuggcucccggcucccuccucccuccuucugaggcugucaggcccucacacagcccaccaagguaggugugggaguucggauacaggcucucagugcccacagcuggccugggcucaggagggugggggcacccugggcaggggccucugaggggccagccugggggugccugaaggcuccaguccaccaccugucauggggacaggugaccgcacugggcuuccccugugcuguccauucaagccccucccaccccccagcagaaggaugcugccguccucagaacaggaacaggguguaggccagagacugcaggccagggcccaggcuggauggggaucugggugggcuuuaucugggcaguaagcaguugaauugcugucugcacuuucgauguugggacuuuuacagacucagguaucuggcuucucuuggaaaucugaaggccugguuagcccacuccugagaggugggaggagcccggugugugcauggugaagugcaugcuccucgccuggcuucaguggucccugucgcugcucugugggugagggugacugacaguguagcccagugaucgagggugggagcuggcacugacugccuggguucgauucuccugguuuccuuauggaauccagggauggcaccucugucucugggccguggggcuuucaggccuccugcagccagaugcugcugagcucaggugaucagcgcacagaugccugcacagagcggaguccuggccagacauccucgcugccgggagagacacuggacgggaaauacagcagacaggcaauggggcagggccgagcagggagggugggauucgagcagaggucugaagaccaggcggggggagggaagagagucccaggcagaagaggccacuggggagaaggccccaggugggauaggcaggggcugggcuugucuguccugggucgucucuggaggugggacauuuauguguauauagcagucccuggcaccuaguaagugcccaguagaugauaacauccuuaggcagaacuggaagcagguaacacaaagucgugcguguccuguagaaaguacaguucuaugaagacugcauaguaugugugcaugcuggguaagcugggcucugugagccuaaagcagcaggcguccugggugagguggagagggcaccgcuaaccugagucccugucugaucccgauucuccacacccacagagacagggcucagggcagcaaaugccuauaagcaccgacguuggguguggauucucuuucaugccaggauauagggggccagcuucagccagcgcagaguguggccccacaggguauuauaagcagagaggguggcaguggggcacuguggagggguugucuuuaggccggaucagacauuccauggagagccggggacauuugggacaggcgcugagggaugugugggcaguggagggagggagagggaggccagucuuggccaagggagccauaggaaggggacacagggaggagggaggcaggggugaccauuugggugggaguggugcagguacaaggggugcgggcuguguguugggggcuucacagcccaugcccaugaccccagcccacccucguuguuagugggguaccagugucgggggcaggcaggggccaggagcuguuagaucuccuuaggucaucacugcccuccuccaguucuaggaggaccccuauauaugcaagggaggacacguacugggcgcaaggacauggccugaggcugagaggcgcagacagacaugcuggagcugggcgcccccuggaugggacugagaugggccuagggcuguuuccauccacauaacuggccagugacuuuuuguuuuugccaccauaucugggguuuuuuuguuuuugucuuuuuuaagauagauguuauuguuuagagcaguuccagauucauaguaaaauugaacagaagguacagagguuucccaugcgcccgcugcucccacacaugcacagucuccccacugucagcaucccuaggagaggggugcauuugguccagucagugaaccugccaggagacaucuucaccacccagugccccucguuucugugcgggcucacucuuggugcucugcauucugugaguuuggaugaacguaggaugccauguauccaccguuauagugucacacagaauagugucgcugcccuaaaaauccccugagcucacuugucaucucucccucccccugagcccuuggcacccguugaucucauugucuccauaaguuaugccuuuuccagaugucauguaguggaaucgugcacuguuaccguagccuuuucaaacuggcucccuucacuucguaaucuauuuugaagguuccuuuauuuauuuucauagcuuguugcucauuucuuuguagugugccacaaacuuaaaaaaauuuguuauggugaaauacacaugacauaaaauuuaccaucuuaaccauuuuuaagugcacaguugagugguauuggaugcauuuacagcgguguuggccauggccaccugcuccaugacucuucaucuugugaaacugaaacucuguccccauugaacacccacuccuuguuccuuccuccccagccccuggaaccauucuacucucugucucugugaaucugacagcucuagggaccucauaugaguggaaucaugcauuguuuguccuuucguggcuggcuuaauuucaucagcuuaauggggaagcaauccagguguccaucgacagaugaaugaauaagcaaaauguggucugugcauacaaugagauaguagucugccuuagaaaggaaggaaauucugacaugcugcaacauggaugaacuuugagaacacaaacucuuuuuaaacaacccaaauccuuuucauuccuugcugucuuuagaaacaaaaacuuuaacuagaaaaggaacccaugccauuuuagcacauguaaacaaccuggaagggaggauggagaagugcuugucguaaugucauuuauugaacugcccauauuauccuucuauuugaaaaguggcacuuuuuguugggcaguuuuugcacauuccugaguggggcugggaggagucugaggucuuccuuuuccccgucacugcacgagagauugaggcugcgacaagaaaaggacugggccuuccucuucccuggccucugagcucuuggaaccuccuuugcagccucuaggcuggccuggcugaagaaguggguggaguggggcggggccugcugccuggguugagugugaaugcccggcucagccugagccuucucuggguacaccuggcuuguauggggcaggugcuuuggggucagcuggaucuggguucagaucuuggcuucuccaguuucuugcugugugaccuugggccaauaucugcacugcccugaccuucagagacuagcugccguccuuucacucucugaggccaggccugggaacccucggacaggugucugacuuugggaaacccucaaaggcuuccugucacauuaauggcucuccauccggaucugcaccccuuuuccuccuccuucguggcuaacuuaaugaaaccaaguuugcaaaugaaacauaauuucauagacagacauguuguuggaaggucugggauggucuuaacagcugucucucuaauuaccgcagaugcuaacgaggugccuggagccucugguuacaggagcagagcugcuguuuguuugccagggccggguaggaggcagggcugccaaaccugccccuccauugagguguacacacaccugaaggcccuugggcaggcaggaccuacaguggaccccaugcccaggcucugggcgggccucgccuguguggccaacucacccagcccagacgugaacguuucccagggacagcucuccauucacucaauucauccagcaagugucugugaugccccaugcacaggcucagccagugcuagcaguaggguauagugagcaggccaggcagcucccacuccagagggguugccaggggugcacaggauccuucagagaacgacagauggcggggagacucagcgaggcaguggucggggguacgugugcugggcgcuccccaggagccuuucugaagagggcacauuggguuggguccacaagggcccaugaagaugccaggggaaauuucugguuguagaggcagcaguugcaaaggcccugaggugggacaggaggcgguucucaugcuacagcgcggggagccggagggugaggggucaggugcccgcugagggcccggggcugugcugcuggcccugugcugugugcuugggugcuggugaaccucccugggugggcaagccuccucagguggguaugucaguauccaugacacaccauaguugugucccagaguaauaugggggcccagcuggguggucccuaggaggccaguggaucacagucacacuuggaguugcguaguaugggguccgcuugugccaugggcggugggccauggggagcuuuguccugagcaccuccagcuggggagcaggccccugggaggcuggagcuaggcggggauccugcugagaccaggggagacuucugggugaaauaggccucggcccucccugaugcaggucccgcgugccacgccauguuccucgauacacuacugcgccuccuggcucauguguaauuuaggguuuucaugugauauuugugggaugguggguauguuuuguuuccugauuuucuugcagucucugcugggcuuugggacuaaggcuguacuugccucccaaagaguugggaagugcugcucauuucuccuugccaggaacaccauggcuggcacucgacggguggaggggcagguuggggguaggcccggggguccuggcugcagccucaugccgccacccccgcaggagugcgcuggggagccgcuguucaugcuguacugcgccaucaagcagcagauggagaagggccccauugacgccaucacgggugaggcacgcuacucccugagugaggacaagcucauccggcagcagauugacuacaagacacuggugagcguggcugcccucuguccugggugcccuggugccccccaccccccaguuguggggcugacgcugcccccuugcuccaccccgcccgcagacccugaacugugugaacccugagaaugagaaugcaccugaggugccggugaaggggcuggacugugacacggucacccaggccaaggagaagcugcuggacgcugccuacaagggcgugcccuacucccagcggcccaaggccgcggacauggaccugggugagcgggcggggccacggcugcccggggugugugcuggagcagaggggcagggccauggccuaguacugagcuuggcggggaaggccaggccaguccuccacaccaggcuggucuggagggcaguggaauggcgagugggcuguccagucccagguuggguauagaggguggcugcccugcucugggcagagacucugggaggugguggguuccagugcacucugggaggcagugggcucuuggagcccugagggggauacucaggcucaugagaggggcagguggagccauugagggccagaggggaugggacggguuugggguggggcccggaguccugcugcagaugugacuggagaggcuggguccccacagaagccucggugccaggcugaggaguuggggcccuaaggcuugcggaaggcagggcagacccccuuaggcuggggcugcuguggcagauugggagggcuguggcacauugcaggggacuauggcagguuaagugugcugcagcaggggcggagguaugucccugcccugugcuggugcugagagcugcaggcaggccccgucccacuacacugcugugauggaggagggaaagagggccccagcggccccacccuccagcucccuccucccccagaguggcgccagggccgcauggcgcgcaucauccugcaggacgaggacgucaccaccaagauugacaacgauuggaagaggcugaacacacuggcucacuaccagguggcucccggcccuccgacccuagcacaggccucccuccccuuggggcuuccacagcgcagccaccaauguuugcagcaugugggcuggacagcagcuggaucugucagggagaggaggggagguggucacuuauguguguggaccgucccaggacucgagcugggcuugugggauugccuagcaucccugggcuguccugauauagaguuccagacugagugagguggcugccuccaggcacagcacuagggugucaccgggguccccagccggggagugggagccugguggugcaggggcacccuggugggucacagggucccuggcccucugcccacaggugacagacggguccucgguggcacuggugcccaagcagacguccgccuacaacaucuccaacuccuccaccuucaccaagucccucagcagauacggugaggggccaggcagcgggcgagagggcagcgcaugggucccuggccugggcaggacgucccccgggcucccacgcugcagcagccggacgggaggacccaggggcaggugucaagccugucacucgcacucuuggccuuacccuccagcucuggaggcugcgccuccucgcgacuguguguccguacacaauuaugccaccucuguggugucaucggcugccccaaaaucccacaugggugggggugccauccccagcuuucagauggggaaacaggcucgggcggggggugcggggugccagccaacgcgggcgcugacagccuggugcugcagagagcaugcugcgcacggccagcagccccgacagccugcgcucgcgcacgcccaugaucacgcccgaccuggagagcggcaccaagcuguggcaccuggugaagaaccacgaccaccuggaccagcgugagggugaccgcggcagcaagauggucucggagaucuacuugacacggcuacuggccaccaaggugggccuggcuggcagaugggggcaggggacgcugggccaacugagcucagagaaagugccaagcccagagcaagggccucacccccaugcucccauggccacuugccuagucacccaggagguguaggcagccaggcagcgcccuggggcucagugucccugccugccccccgcagggcacacugcagaaguuuguggacgaccuguuugagaccaucuucagcacggcacaccggggcucagcccugccgcuggccaucaaguacauguucgacuuccuggaugagcaggccgacaagcaccagauccacgaugcugacgugcgccacaccuggaagagcaacugguaaugcagggcagggggaggaggggcaucccccagggccaggccagauguguucccagggcccucgcccuguucugauccggagcccccacuuggggcucccuggcguggggacacaacccagcaggggcauggcgggccaguccugugcuaacuggccuucccuaucugccugugccccuugacccacggcucgcccucugcuccagccgcugagccccucccacugcugcaggaacugugugcaggugugaguggcucugggugugcacagcugugcggacaugagugugggcugcagcgugagaaacagggcacaguggaccagccccaagccggcugguugcagugaugagggcaacagggacugcagguacuccugguagucuuuagugcgaggaauuuacagccuccccauugcaguguggggccaggccagagccugcuuacugaggcgcagaggccgagccacuugccacggucucacggagcagcuggaguacggagcagggccugcccagccugcaccgugcacagcuacaccaaugugagcuggggcucuaugaggcuggguuuuguuaugaagaggcacccagccucugaguggccucccuccagaguaucugccucccuggccagccagucccuugcuuuccuccggccuggcccaccccugggacagugaccugcuucuucccuggucauggacugcccaacucagcaauguuggcuuccucucugccacacaggcaggccagcccuuggccucacuccuuacucaggacccccaagcucuggucuguggcccccugcuccgguuggcacacuguagccacacccuagccccuggagcgggucccugcuguguguguggcccccaccccagcagacaaccccaccauugccugcuacaggggagccccucucugugcaccaggccccucuaccugcauggccgagggcuucugggguaggacugcucccccacaccuggggucagguggaugcccuugccuguauggcuggacccugcuucaccaggaagugccccuccucaccgugcauccugcuggggucuccccccaguucugugcacacucuccacugucuuagcuccccucucuccuggacugucccugccacuucugcuggcucccgggccagcagccacccccgacuuggucuuguccaucccauguguugcuucccaaaccugggaugcagccaccccaaccugucccagcuccgcccacugcucgcggagucuaggauuuaaaugaagugucacgaagccccucuccugggccaugcugauugggcacagcgggagguggggccuccagggacgcagugucuccaggucagcauguucuuggagaauguucugucacaguggaacauucuagacccgugcuguccagggugguggcuccugagccuuugaaauggcacugguguggcugagugucugggcucuucacuucauuuaaguuaagcagccacguguggccagugcugccaggcagcccagcuaauggcagucccugaggugguguuuggggcacagagggcuggucucugcaggaauggguccccugggccggagcugagcugcaggucucagugcaggagccaugagugcaagccagcaugcaggccuaggagggugguggcuguguggagugggccccugagggccuggucacaucuugcccuugugcaaacgagugcguuugagcacgccuaucucaugaugcucugcgugagaugcagguggugggggcagcacaucucugguuggguggcaggggacggccuucacuuaaccaugggcccugcaccucugugggccucguuuccccgucugcauggaaagccaugcccacuuuggauucggagcugggagggccacaaggucacugcucaggagggagcagaggccuaucugagcagcgccuggacucucgccugcagccugccccugcgcuucugggugaacgugaucaagaacccacaguuuguguucgacauucacaagaacagcaucacggacgccugcuugucggugguggcccagaccuucauggacuccugcuccaccucugagcacaagcugggcaaggacucacccuccaacaagcugcucuacgccaaggacauccccaacuacaagagcuggguggagagguagguggagggugcaggggucgggggcaggggcccgggggcagccuggacucugcucaugugcccaccuggccacucaccugcagguacuaugcagacaucgccaagaugccagccaucagcgaccaggacaugagugcguaucuggcugagcagucccgccugcaccugagccaguucaacagcaugagcgccuugcacgagaucuacuccuacaucaccaaguacaaggaugaggugaacaccgugggagcccacaggcugggcuaggagggcuugccggccccugccagagucaccugcucugccccgcccugccacuccucccugaaucucugggcugccacugaccaccuucacuccucugcacccucuggccaccugguuccuuggggccaggagggagccugccaggccgagcagagaaggccgugguggagucacugugugcagccauguggggucagggguggggaagaugggauggcagcuucuuccugaggcagaggguguguggguggugagcaacuucccugaggggcucauuucaggguuuucuagucugggccagcaucuccagggcugggcauaggcucuuggcagagcuuuccuuucaguaucuuuucugcugacuuggagugaggccacguacauggaccuggggacgggguccaggagguauccaggaaggagaacuggcuccugggccgcacaggaugggagcacggggccagagggcaggacagucucggccugugccaaggcucugagggcuaagaaggccacgggagugaaccagagccacccuggggaggccagggcaggugcagcagaggcaaggaaccuuccccagggugccacaggaggcagacaggaggcagagggcuguccucaggcaggugccccaggggagcagaggagcagccagagacugcauguauuaggguggggaguggggacaaaagccugggguccuggggcucaccagggaaaggggagcugaggcucucuggggagcucugcuuuaaaggggcacagaaaccccagggugugaggacuggguggggacaugucagcagcauggccaggcagccaagggaucagagccugcuguuuuagggggugagaguaggaugaugacaggggcagggcucauucuccauauugggguccuggaggguccaggcucacaaccaagguccuuuggccagggguagaugggguugaaccucuggcaccuacucuggaggcaucugcccugggccugcugagugcauggaggcugguggcccggcaugcugacaguucuccuggcccugcagauccuggcagcccuggagaaggaugagcaggcgcggcggcagcggcugcggagcaagcuggagcaggugguggacacgauggcccugagcagcugagccccagcugugaucauccagcaugaugcagcgugaggacagcugagcagggaccgggacagcccucaccgcaugcguguggaguguccgguggugcucgggccgccgcagugcagcgacugcccggcccucccuccccugccucacccggucgggucccggcucuuccuguguggaggugaugguaccugccacaccacagcugcgcacacagcugcuugcucaggggccgggacagcacugggugcucaggcuggccaaggaccuucauugccuggcaagagcugcccaguggccuucaugggagaagggcugaccucugaggggcugaggggugaggccagggcccuccagggggagggguagccagcuugggcuguccccuugagaccaggacaagaggcugggggugucagcauucccagcuuuccaagcugcccccaggcggcagagucugagggucccggggcccgguuggcagcuggagaaagaggcaaaaagcccguagccgggcaagaggagcucaagucggucugggcccguugccaccgacucccaccuccagcacccaugcccgcugcaccgcugccauccucagauucaccgcgugcucugcgcggccgaggccggagcaccacauccaccucgccccagagaggcucugcucccuccuauggaggggcugugggccaggcugcucagacuccuggguggcuuccagacggaccgggcagccccucuccguccucagggcugugccucugggagccacugggccaggggccccgggucgcagagagcacguucccguuauuuauuccccuccgcguccuacacaggcugcccuggcagcugucuucaaggguaggcugagcuccccacccuggagccccugagggcggccccugagcacuccucucucuccacucucucugucccugccccagcggcuuccaguguggcaucucagcaguguccuggccccuccagagcagugggacaucuggggacuguuuuuguguuuaggggaaaaaauucugcugcacucugcuugggccuugaggucuguggcagggcuccucuggcccgcaguggccuggaucuaucugggccaugagugacgggcagugaccagagggacuggaggccagcgguguccacccuugcccucagcaagagagaaugcauucuuaaaagaaagcuguacauguauauauaugcauauauauauauguggcucuagccucaggcuccagccccagugggguacuguacaguuaacugaagaagaauuuuaaagacgauuugaacaagaaaaugaaggcagugggaaagcaaugccaaaugguuguggagaaaguggccggagccucccuggaguggagcagcccugaagccugugccccccgaccugcgggccgcuguuuugguuugacaugacaaggaaaggacuuccugcugacccugagagccucuggggugccgcggcaccacggggcaugcaugauugugcuagcguuuagucugaguugaucuuuuuaaaacugcaaguguugaauacuagagguuguuagacccuuuuuuauguuuuuuaauuaaucagucacuuguaaaagcaaacaagcgguccauccccuuuucaaggucacuuuuuugaugguaccgaagaucccauggacauuaagggacagcuaacuguggccagacucagccccauguccuuggccaggcccaaggagaggacucggccccauggggugugccagucuugcaguccgccccagcugaguagcgugagccagaugacgccacagagacccgccucuucccugaacgcgggucgguguggagucagugacugcugacucagggagcuccuuggccccgugggcacugugccagggcuggggccuucugcugcugccacacccagcucaggccugggccagccccugcccccagcccacugagggggugggcuuacucccugggcagucuugggggccagagcugaggccaguccauauuacaguggcugggcuguuuuuuucaguagccccuagcauuggcugggauuccuguuccugggugcgccuccaccucccuucugauguuuccuggcuaugguggggugggaaccucaguuucccccaaagucuucccuggaugcuggcuucagguugaagucccugguucuuccaguuccucacggguuagguaggggcuccugcaucaccuucagaauccaguuccaacccccacucuccuuaggccuugugcucugcucugcccugccaggcugcccuuguccaugugaguagcaugggcgggugguggggacggcaguggugaugaagggggugcaccacaggccucaugaagcaguucccacaugggcguguggcuggggcguggccaccacagagcacauggcugugucuaggcgcaagcacuuuagcaguaucuguuuacaugcgcaaggaucaagccgacuaccugugcugucuacugggacagcagucuccgagcuacuccguaccucccucugccaggucguggaguuaggccccagucccuacuugucacugguucccacugugcuccuaacugugcagcaccugggagcucuggccuggggcuggaggcccugguaggagcugcaguuggaggccguucugugcccagcagcggugagcggcucccaugggcccugugucugcagggagccagggcugcggcacaugugcugugaaacuggcacccaccuggcgugcugcugccgccacuugcuuccugcagcaccuccuacccugcuccguguccucccucuccccgcgccuggcucaggagugcuggaaaagcucacgccucggccugggagccuggccucuugauauaccucgagcuuccccugugcuccccagccccaggaccacuggccccuuggccugaggggcugggggccccacgaccugcagcgucgaguccgggagagagcccggagcggcgugccaucucggcucggccuugcugagagccuccgcccuggcuuucucccugucuggauucaguggcucacguuggugcuacacagcuagaauagauauauuuagagagagagauauuuuuaagacaaagcccacaauuagcuguccuuuaacaccgcagaacccccucccagaagaagagcgaucccucggacgguccgggcgggcacccucagccgggcucuuugcagaagcagcaccgcugacugugggcccggcccucagauguguacauauacggcuauuuccuauuuuacuguucuucagauuuaguacuuguaaauaaacacacacauuaaggagagauuaaacauuuuugcuaaaagcu

SEQ ID NO: 191659 - RNA, 9240 nt, Homo sapiens
ucauuccagcuggaaguggggugggaacucgcaguuuauuagcuugguguagcuuuuuggggggaccacaaaccacucccggucuaugauggccaugaaggcugaucccuuuacuaaagucucuguggcuacugcccagagccugccaaggagaagguggccaauaagaaggccacacacagagcccagucucuaggagaggccccuggacagcccugccgccuugcuggucugggggcaggcagccucagugugccggguggacagcaggaaggcgaguugucuggggaagcggcgacucagcaacuugaguucccaaagguugcacaguggagguggugauggugcugguaguggugccgggcaggagccagacggugauguaaaaucuggagccccgagccuagagaagccacacagagccacgccuggccuucaggaccccugcuggcugcagccauugcagcccagagaagucagccagggccacaucugggagggcuccaacugagaucuacucccaaccaggcuugaccuggccccuuccacacagaggcucugccaccugaugucccaggaagccaugggggcaccgcacacucacccccccacacaggcuccuccagccaccugacauccaagccagaaucuaggagccuccccagugccuccugagccccagcccauaaguggcuggggacguggucucaaguccugcccaaccacuaagcaagcuuuauuuuuagcaccugccggaggcauacuuacuucucugccaugccaaccugacugugaggacacccucugucucccacuccuccuuccagcccaucucccagcagcuacaugcaggacccagcaugccacccacaggcuugacugucuccgcagcuccccgacaggauggcgugggaaagcucccuucugccugcuccccauuguuuugcugccauuugacugaggcugacacccacagcccccucccuaccuccugugcucaugggcccggccguagagauguggaaacccaccaaugcccacucccccagcccuggcaugggaccaacucccugcuguggcugggcccugggagccgcuuggucccuggucaauuaucucuccccagccuuggcucagcccacugcccccuucagcucccugacauguucccagcagcagggguucagccccaggccucugcucugaccccacagcugccccugacucuaagccaguccauuuugcauggguagaaucugagaccaggaacaucugagcucucagagcccagcccuggccgcuaagccccauugcuucagcucggcgauguggggcaaaagccuggggaucugaugcuccuguagccgaacuacggggagugaggccuggcaaaggccagggccguuugugugcuggaugugcauguaagucuguucuuugugugugugugugugugcguggcacuacuaucucuccagguguguguucaggggaacgcgugugcauccucauggcuggccagaguugacaggcacuauaucaaacaaugggcauggaaaagucaacacagaccccccccugccccugacauuaacuggagugggcggggggccagggcaucaguggggccggggcauucaggaggcuagggguccugcaccgcugguggaggaagcccuucggugccacacagcuguuccccgugccgugcaugacugaggagacaccaggucagaagcucuguuucuuucuccacaucuguuuaggaggaaguaggugugccugagggucugcuuuuccguggcuggaucuuuccaaaggugugcaggguuucuuugagcgccccaugcauggggugacaagggggcaugagaguuugugcuguggucagcugagggccacccagugcagaggucccugccagggccuccacccuuggaguacagcauuagccggcccagugcagccacagugagugcagaagcuccuggcuccuucccuugcugcucucccauguggaggacuuggcuaaacuccugcugcacugaggccaguuucuccaccacuccuccaacuaggccuaaccccgguggccugggcccugcccagggaagguucugugugcccuugccuggaugcugccuggcugugggaacaauuaucaggcuuuagcaucccccuucucugccucaguuuccucagcuuuaaaguggcgcgugcugggaggauaacaugaacgucugcaugcaaaacugggggacagaaagccaggcagcaugcacacagccagugggggugguggcaucagggcagggacuuacccucggacugggauggaccucguuggcaccaaccucuucugcaggggcagcugcaccguguucgagucguuugugaccucccagggcugcaggggcucagggucgggcucugucagccacgacaaccugcaacagcacuuggaaugucaacauggccaccauccaccagccuccugaaguaacucucacucaucuggaacuuuccaucugcuaggcacuguucuaagugcuucacaaauauuagcccauaugucagcugacaagcaugcugugaggcagguguuacccacacuuuacagacaaggaaacugaggcacagagguuccacagccaggaggugggaacuaagcugcagccugcuccagagccuugucauggccacagcagccaaacggugcagagcacuugagccccugggugcuggccuccccugguuucaaccugaggccacucugugugguguguaccugccaccugggccucaugugauggugucugcggugggggacagaauggggugcaagguuauggcuacaguuuccuggggcaaggacaagaacaggugcucagcuggcccggcacagggacacagcauggagcucaucguccccaccucccucgagcguggcugcccugguggucccccguggucccuguggguagcccugccaagcauccagggccacugcugggcgcacaacacuugcuucugggguggggggugagcauggagugggaagcuugagguugcacggugccaagcugagccccagugccaggugcugccugcuguccugcgggugggaggccagcugcccugcgccccaggcauugcuggcaagauuucccuugcauuuguuuugccucuuuggcccguggcucuguccuuaugugaagugcccuguggagacuuggcccaggcccccucgggcugcccguuauccuggcuaguugcgagucccaggagcucacaaacaaugggugcccagcacaccaauuccaacacagcucaggaggggcagucgucuguggccaugcuccucgcgugacuuggggaagcagcuggccugggcucugggaugacccagggaggccugagcccacccagaggccccucggcuuaggcugugauggggguaacgaaggcggaccccagacugucagcugggcaagggcugcuaagggucucccuguggacaaaacccccucccagcugcagccccacagaaugcauuugaguucccaggaugcuggggugaccugggggaggcagggcuugucuccagaggugucagccucccgcaccuguacggaaacuucuuggcaaaauucuccugggccuggauccuccacuucuuacucuggugagacuucuugcaggcacuggaguccaucacugaguggguuaagcugaggcacaccucucagccauggcuggaagacaagaggaggcgucagagggggcaggggugguggggggcagaaggcagagugaugaguacccagcagggcugggggugccugcgggccgccaaaugaccugcaucacugcccugugcaugcaccgcuguguucaauuuucuccugcguguagcuuccugugaccaccguaaucaagguccucaccagacgcucuccccaaggcucucucacgcuuaccccuccacagccacgccuguccacagcccgguuccccaacccuggcagccacugaucuguccucaucauggggcagccaugugauuucaggagcgcuaugcggaggaacugcacacgagguguguuucugagacuggcuccuucucauccauuucuuccagaucagcccaaacuucacccacagucugucccuccugcugcugagcacuguucuagggugcgguugugcagcuucucaggccuccagcuuggggcacuuacaaagccacuguuaauauucagauguaaguuuuugcaugaaaauaagucuucauuucucugagauauauugcugggucauaugguaaguccauuucuaguuuucuguuuguuuguuuugagacaaggucuugaucugccgcccaggcuggagugccgugguugaucacggcucacugcugccucaaccuccuggguucaagugauccugccaccucagccucccgaguagcugggagcacaggcaugugcuaccaugccccacuaauuauauauuuuuguagaaauggggucuaacuauauugcccaggcuguacauacauuuuuuguuuguuuuguuuuucuguuguuuuuuuuuuuuuuuuuuugagacgaagucucgcucucguccccaggcuggagugcaauggcaugaucuuggcucacugcaaccucugccucccagauucaagcaauucuccugccucagccucccaaguagcugggauuacaggcgccugccaccacgccuggcuaauuuuuguauuuuuaguagagacgggguuucaccauguuggccaggcuggucucaaacuccugaccucaggugauccauccgccucggccucccaaaguguugggauuacaggcgugagccaccgcgccuggcccggcuguacauacauuuuaaagcaccccaggugagcagaguuaggugagcauugagacuacuggaggguaaggucugaccccugguguccuuuguggcagcaugucaccuguuccuucucacugguguguuuucaugguagccaccucagccagcaugccaccacacgggacccugaagcauguugugacaaugccgacugccugccaguuuccccaggugccacauuucguccccugagcugacaagugaagcccuggucagggaguggggcugauuccuggucuggggggcuggguccuuguggccuagccaggugguggccuuucucugggacuagcaccauccaguagaacuuucugagaugauggaaaugcccuagguccgugcuguccgagacggcagcugcuggcuacaugaggcuaucagcugagcaugacugagggacugaauaguuuucaguuguauuuaauucuaauaacugugaacggcuagcugcucauggcuagugccugcugcauuggacagcacagcucuggccacucggaggaagucugcugcuucccugggugugguucuagcgacaagcuuggaggcugcacuucaccagaacccuaggccugaguguuuggcuccuguccucucucaggaaggccagcccuuuggucaaggugaccccugaugcgugcuucccuggcugcuggggguucucaaccagccaugcugugccgaagccccguguuuaugacacugaggaggcaucaccugcccauucagaggagagaugagcagucuuugggggccaucacccuuugaggccaggacgguacagucgcaggagaccugacacggugcaggcuagaccccgcuccagcauggaacugggccgcacagcaggagguggguggcaggugagugagcauuaucaccugagcuccaccuccugucagaucagcggcagcauuagauucucauaggagcgcaggccccauuaugaacugagcauguggggaaucuaggcugcaugcuccuuaugagaaucuagcucaucccugaugaucugagguggaacaguuucauccccaaaccagccaccacucccugccacaguguccauggaaaaauuguuuuccaugaaaccguggugccaaaaagguuagggaccacuggacuagagccacccccuggccucaaagacccucuaacacccuugccagccacccccuaccuuccugcuccauaacccugccccuccagggcugugccagcuuugucuccgcaggcuccccagccccacugcccucugggaggucccuugauggacagggccauguagugugccuugcaggggcagggguguggcccugaggaaugucugccuccucccacaucuggugggcaacaucgggacagcccagcucacaggccugccagccccuccacaccacacccugucccauccuaccuggugcuccacugaaagcccucagccuagaggauugugcacugcuuugguggggaugccccagaagcagggagccugcaugccagugaggaccuggcuucagccugagauuugcagcagaugcugucaggggcccaugcacagcaccucugcccucaccuccacaccuggaggccaggccuuugacucccuccggcugcagagaugcacuaggccaugcacagagagugacagcagccccucaccaaugagggcagggaauuggauaaauaccccagcucccuugccccucuuugggggcagcucggagcugugcucugcacagucacccacagcagccugugggggcuggcugagcugcagccauggugaggacacaccccagagugcauccucccuuccccuucccuccccacaucccacuuuccucucagcgccuccugggugcagcucccaagugcagcucugcacuugcaccuguccagggccugcuuggggacugcacaucuacacacucaugcccagcaaccgcugcaaacgccccagccucagaggacccaggccaagaaggcggccgcuaagcagguuucccaccucgccucacugacugccguucccacacacacacacacacacacucacucucacagacacacacacucauucucacacacacacucacacagacugaccccacacacagacucauacucacagacucacacauacgcacacucacacagacucacacacucagacucacacacacucaggcucacccacacacacagacucacauacacacucacacacagacaccccccacacacagacucacauacacacacacacacagacucacacacaugcucagacucacacacauagacacacacagacacauacacacucacacacucauacacacagacacacauagauucacauacacacacauacagacacauagacacauacacacagacccacacaaacucacauacacauacacagauucacauacacagacucacacauucacacacagauucacacacacacagauucacacucacacacagacacauacagacacucuuacagacucacacucagaccugaccucauacacacccccacacacaggcagguggccaucuggguguggcuggccucagcucugucccuauccucugcugcgugaccugggagcuccucgcuuccuugguccaaggcagaggcugcccccaccagcccauaacgcaccuugcuucccuucccaauucaaagcagcuggcgugaccuacuaccacaccuggcaugauucaaaauccgaugaugucuggagaggagccccuggggaacacggguagcccuuuccaaaucugggauuccggaguccuccaaaagccggugggcucgggcaagacugcucggcagugaucccauaaugugccaugcugcucauccaucccucugagggcgggguacugggcuagcugggaggcugccugccgccaaguguggaaucacucaaggcccgaggcgggaggcugcacacuggacacugaacacaggccacugggaccauggccauggcaugggagaccagccugucugugagccagaacacacccgcucacccaccgccuccgugccccaucucugacucuggaagaucagccauccagagggccuuugcccuggcccagaaauacugccagcccugcucacgaccugucccuugcccgcaccaagaagucccugggcccugaagggcaggcuuccccacugacuugcccacuagucuaguacagggugcagcucucuacaccagugcuggcuaaagggggucuugguggccuccgccccugcagcccuggcuguucugaggacucugggaugccuucgcugggccuaagcccacaguccugcagccacagccugggccaggccccagcucagccccuuccugucaggugcacuugggugagucaccuccagcccaggcucaacccugaggagugcggggcaggggaagccugggccgggacaggcagcagggccacagcaggaggcugcagaauggugccuguggccucuaagugucugcuacauucuaugcauaaccucacuucauuuuuuuucuaccugauggagaacguauuaugcucacccccauaauucaagugaggaaacugaggcuccggaaaguuaacugauuugccugcauucacacagugagucggggaagagguucaggauggguggccugugcuccuccugcugggccaugcagccucaaacaguccugaaccggggaagcagcauuaccacaggaauugagggaucaagggagacaggagcgccccucagccccaccccauacccucccaccugaccccuaggucauggagaugacccuguaagcugacugcugaaucugccccacagggacagggcugcugcagaguccagggcugcccucugccaucaugacccugucccaggcucuucuccgccacccuguugcugcuucccaagucccuaaccgacuuggggacuguccuuuccagccacacaggcugcuagcacucaccaggcagcuaccuugaauucuggcagugacgaugaucaggugugaucagagaguccuggaacugcuccuauccagcaagaugcuggugugagagccgcuguggcccccgaggcuggcagggcccuggcuacagcccucucuggaaagacccagucccaggcuaugcccagagcuuccagccagaaaggacaagcugcaggacccugugggcuggcuuaugugacgccaggcagacugaagcuggccauggucccagcugccacauuaccacaggaacagcagccccagg

SEQ ID NO: 191660 - RNA, 104073 nt, Homo sapiens
gcgcgcgcgcgggcgggagcggagggcaacggggcggcgcgggcggccgggcgcagggucgcgggaggugacgcgcggcgaggauggcggcgcggggccgggggcugcugcugcugacgcugucggugcuguuggcggcgggccccuccgccgcugcggccaagcucaacauccccaaagugcugcugcccuucacgcgggccacgcgcguuaacuucacgcuggaggccucggagggcugcuaccgcuggugaggcgcgcggccgggccgggcgggcgccgugggccgggcugggccuucgcgcugagaggcugggcgggcgccgggaggccggcagagccggcaggugcgcggcgcgcucucgcugggcgcuaggcugcagcacucggagcggcgggugcgcgugggucgccaccacugcucaugucauggcgccguccgggccuccgcgccgcugaggcgcgagcagagcgggcgcagccuggcggccgugacccgcguguucuggguugugcgggaggagggguggccuggggagcggcgucugggaccgcagggcccaagccggccgggcccgagccggccugacccgggagggggcgccggggcagcugggccgcacuucccuugagucugggaccccagcucggguuugucugugaccgcccucgcccuggcgugggaagugagucugugaaacgaagcgcagcgccuagcgucgcggggaggaacggagacccuggaggaaaggaguuuuggagggaagcccaggggccgcuuuacagaggcgaagugagacgaggcaggccggcgcuuccccucaggcugccucggcgcggguccugaugcucagggcauuuccaucacccucccucucggguugggaguucuccaaggggucggaugcggagugugacccuguggaaccacagggacccaugaaaccagagaccgacacugacagggcggugcaguccagcccuuccauuuugcagaccaggggaaauggagcuccugccccuggcaaggcugcgugggcacgacugagcgcccuuagcuucccagcccagccguccuaggggugaaaagaugggcuuccgcccuucccacccccaggaugcucaguaguugcucccuuuauuucuguuucaagacugggucaagguugaggcagaacggggugugaccacgugacagccauguguguaagccuggacaugugugugucaagccuguuugaguauuagucugugcguguauguaagugugaugcccgaagcucagaccagccagcuuucucuguugcuugcacuauuugcccuauuucuuucuuucuuuuuuuuuuuuuuuuuuuuuuuuugagacggaguuuugcuuugucguccaugcugacgugcaguggugcgauuucggcucacugcaaccuccaccucccggguucaagcgauucucccgccucguagcugggauuacaggugcaggccaccuggcuaauuuuguuuguuuguuuguuuguuuuuagagugcacuccagcccuuguugcccaggcuggagugcaauggcgcgaucucuguccacugcaacuuccgccuccccgguucaagcgauucuccugccucagccucccgaguagcugggauuacaggcgcccgccacaacacccagcuaguuuuuugcauuuuaguagagacgggguuucacuauguuggccaggcuggucucaaacucuggauucacuguguuggccaggcuggucuugaacuccucaagaccaaggagaacuccucaagcgauccaccugccucagcuucccaaaaugcugagauuacaggcgugagccaccaugccuggcuugucuggccaauuuuuguauuuuuaguaaagaugggguuucacuauguuggucaggcuggucucgaacuccugaccucaagugaucccgccgccucugccucccaaagugcugggauuacaggcgugagccacugcacccggccugcccuauuucuuuuuugaaggucuccuuccugaaaucaagacguacuaggucagcccauugcauuuugguuuuagugcuuuaugcaccuggaggcuccuauuucuggccugaugccagaggcugaacuugggcauuagguuuucuguaucccagucuaaggccuagucuugugugggaaaaucagcuguuagucaauacuguggcggggauacaugcucauucucuuguugaagcugucuguccucucaguaugugggcaagaaagaggaaacugguuauuaaaaacagcuggcuucaagugaaucccuuuggauauauuuguguguuacuuucucugagauucuauagcuguacuuuuuucuuuuucuaaacuaacaacacuuuuuucccccccaacaucauuuucuuuucugagaggagcugaaggguguugguggauuuuaauuuacuugguaggaaaaagggaaaaaacauucuuaaucucugaugcaucagagaagugcuaaguaccuuauaacguguuuggcguugaucuguaguuuguauugcagaugugugacugcagaugugugacugcuauucaaagugucuucucagagguguuuggaaauugugauucccccuuaacuugacaggaagacauucugucaaucaagcauugagaauauuuucuuuauuuuuaguauugcuguuccuaguguagucgucuauugcugcaguuuugaagaaucugcucuggagauuuuaagagcuggccuauagacauauauccacaguccucuaaaccugggaggaacauuaccucuucauccagaaaguucauuguuaagucucucagacgaaaaagaaaaugagaauucugccagacccugugggaacauuugcacauccauugaauuugcagcugagcucuaaguuuacagaaaucacugugugugccugagccaacagcuucauguuuacuuuuccuauuuuuuuuauuuuauaacaucaaaauuggacaguuuucgggccaggggaaccuuagaggucaccuaguuuaaacagccuguguuucauauaggaaaaccugagcuccagaaggggaagugaucucugggaagucuuguagcgauggacacugaguuggagcaggagcugcugggaccccucccugucccacgccauuagaccuggggacuggcagccucuggcuaauuugccaggcucuaauucucuccaacugcacccagccagcacugguuuugugacaaguuccugauuccuucuagauauuuugcauuauugaaaguguuccauaaaguauauuacauuugcuccuuuuaaagguauauacaaaacgaccucauaucaaaaacugggagaacagacgaaaaagaaaucaugccauaaucuuccagcuguaauacaaucacaggcagcauuuugguuucuuuucggucacuuauguuuccucuccuagcuccuuucuuacauugccuugaaccugguuauuugggcaccucgggaaccuccuccccugccaacacuggcuagcacugaagcccaagcacugcucuguugcuucuuccugagggcuccgugucugagcaccuuucugcuggguugaaguugccuccucauugauucuuucccugucauggagucccaggguauucugggugcuccagcaagggggcgcugucuuggagaaagugaguggcucagauugguuucccagggguggagccugaggcaggauucugcugcccuaguuuacagagaaagugcucuguugggcagcuggauagggaagggaggcugccugcagguuguccugccuucaggcgaagagaccaagcuuugagcuuuuguacccacugucaggcagccauugguuccccuggggaaggggauguugugcgaccucccgggccucuggcggagacacucuguuuugaauuacgaccugcagcuccccuggcugagguggggaggggauguggaccugccuggugaacaacauccagacacagcaugcacagugacugccauaccaagcuguucacagacuucuccuuuccugccccugacagucucuccugggcaccuuggagccaucuaacacgugugccaggccugguccugcaccaggguacacccucucuuauguggucuggggcacuucucagucacagguguaaggauucucaaacagguagaugggaguccuuucagggccagggagggcacuggucccuaugccguggagcuuggccuuggggcaugcuguaccccaggcaguucagaugaccccuggggagucccucuuugcugaggggugacugugggaggccagaggccagcacuacccuugcguguggauguccugggucccucucccugccccagcaggggaagcugcagcaaauccccucacaggccuucgugggugaaguugggcacuaagggugagggaugcacgcugagccaagucagagugucaucuggccuagcuggcuucugcugggcucagggacccugagccucugggacgggcacgucagcaggucacaugcuggaaacuugcacaggugaggcaacagggccuguaagaaguugccccauagucaaaauaaaaaauucacaaaguggaaacaacccaaaagagggaguugaauucgacgggaggcccccaguuugcucuucuguaccuccuucacuuggccuucccugagcccacaccuguacuucugcucuuuucguugagaguguuuuccccuguaccacucaauuugugugcaugcugcauccccacacaccuaggccaaaucucugucuccuuccuuaugccuggccuuagagucacaggcuuuggucgauugcguuaucaucugggccuauuugauggcauuucuggcaguuagaaagugggguggagaaaccagagcucccgcagggccugggagagggcacacggugaagacccguccugccugagcaccaggggacaagcacugauggacgacacauauuucaccgaggagggcuggagagucacugaauaagaggugacaaaugucugugacucuuuuuauuuuuugagauggagucucgcuguguugccaggcuggagugcaguggcacgaucucggcacacugcaaccuccaccucccagguucaagcuauucuccugccucagccucucaaguagcugggacuacaggcacauacccagcuaauuuuuguauuuuuaguagagacaggguuucaccauguuggccaggauggucuagaucucuugaccuugugaucuacccgccucagccucccaaagugcugggauuacaggcaugagccaccacacccaccugucugugacucuuacuaugagccaggcacuacuugagguccugggaugugacagugaagcagcaggagaugcccugcucucagggacucacaguugauugccggaguuaaacgguuaauuaagaugagaucuguggaugcaugugaggcaggaguaaguccugaaggaaacagaacugcaaggcauggaauguguuuuggggagggcgcucagcauaagccuccugggagucgaacuaggaguggagugggguugaguuggaggggacagcaagugcaaagggccggaggagagauagagcuugucagaagugcgcaaaggcagcacguuuggccagggcagcagggcugggagggaggguggagagguuggcagggcggggccaugugggaccuugugggcugugguuaggagacaggaaggagaaugccaggucagaugugggcaggguuagacugggccugguuuuugggccucguucucccuggccccugagggcugucuguagcuguggccccugcagggcuggaccgggccuugcucaacucccuucaccaggcccgcagcagggaagugccaggaagugucuguggaccuggguugacuugggccuugggugauuuucuuccugcuuccuuugugggucccccacucugccugagcucugucagccccacgagguggcuuccgcucuguagacacugccuuugggcaccguuaggggcuggaccccgcggguggaugggagguggcgugugucauccaccacccucacccauccuuguucuuugugcaacucucacuucucuuuucuuuucacuguugcuuucuggccugacccaggucccugaguuccccuauggccugccugccuccuguuccuguguugugaagaguggggagcacccccucaaaagcagugccugccagacgccagcacauucugugugccaguggggccucaugcgacagugggaaugagaaaaauucacucuuucaaaacucacugucaguccuuuaauuuuccucaaaauaaaaguuuucuucuggugucuguaugugguuuacauauuuuuuuauuuuaaauugugguaaaauauauauaacauauaaucgaccuccuuaaccauuuuuagguguagaguucuguggcaugaaguacguucacaauuguugugcagccaccuccaccauccaccuucagaacucuuucaucuucccaaauggacacucuguacccauuaaauagcaacucccuauuuucuccugcucgggccuuggccaacaccaucuuuucauuguacucuuugauguuugccugucucccaagagaacaggcagacgccuagagucuuugcagguagcagcuuccccccaggacuuacugacacugcuuugagucaucuggauggaugacaaaugcugugauauucuuauuuacacuaguguguaagguuuccuuuuuuguuuguuuguuuuuuuuuuugagacagagucuugcucugucgcccaggcuggagugcaguggugcgaucuuggcucacugcaagcuccgccucccggguucaugccauucuccugccucagccucccauguaccugggacuacaggcgccugccaccacgcccggcuaacuuuuuuuuguauuuuuaguagagaugggguuucaccauguuagccaggauggucucgaucuccugaccucgugauccgcccgucucggccucccaaagugcugggauuacaggugugagccaccgcgcccggccucaagcaauucuucugccucauccuccugaguagcuggggcuaccggcaugugccaacacgccuggcuaauuuuaguauuuuuaguagagacgggguuucaccauauuggccaggcuagucucgaacuccugaccucgugaucugccugccucggccucccaaagugcugggauuacaggcgugagcuacugugccuggcuuuuuuucuuuuuuugagacagagucuugcucuguugaucagguuggagugcaguggccugaucucggcucacugcaagcuccgccuccuggguucacgccauucuccugccucagccuccuaaguagcugggacuacaggugcccgccaccaugcccagcuaauuuuuuguauuuuuaguagagacgggguuucaccauguuagccaggauggucuugcucuccugaccucaugauccaccugccucagccucccuuuuuuuuuuuuaauugagauggagucuugcuguauugccugggcuggaguacaguggcaagaucuuggcucacagcaaccucugcugcccagguucaagcgauucuccugccucagccuccugaguagcugagauuacaggcauccaccaccaugcccggcuaauuuuuguguuuuuaguagaaacgggauuucgccauguuggccaggcuggucucgaacucccgaccucaggugaucagcccuccucugccucccaaagugcugggauuacaggugugagccaccacaccuggccaagguuuccuuuuaaaguaauuuuuuaguaaagaagaauccauuuaauacaauaauaagaaaagggccgagcaugguggcucaugccuauaaucccagcacuuugggagguugaggcaggaggaucgcuuaagcucaggaguuuaagaccagccugggcaacauagcgaaacccugucucuacuaaaaaaaaaaaaaaaagaaaaggaaaauaaagcuggguguggcacaggcaccuguggucccagcuacuccugaggcugaggcaggaggauugcuuaaacccagaaggucaaggcugcagugauccaugauuguaccacucuacuccagccugggcaacagagugagagccugucuauuaaaaaaacuaggccgggugcaguggcuggccagaugcaguggcucaugccuguaaucccagcacuuugggaggccgaggagggcggaucaccugaggucaggaguucgagcccagccuggccaauauggugaaaccccaucucuacuaaaaauacaaaaaaaauagcugggcguggugcugggcgcuuauaaugccagcuaccugggaggcugaggcaggagaauugcuugaacccgggaggcggagguggcagugagcugagauugcaucacugcacuccagccugggugauaagagugaaacugucucaaauaaauaaauaaguaaauaaacgaauacaagucauaccuguaugugacugggcuagggcagguguccaaccaagaggagccugaugguggggaggggccgucggcaggugcaggugucuaggcaacugcccuuccuggccacagccugcagguccagaggcaggggcuuccaguguugcagaggagauguggggguggugacaggggggauggacagagggagccaaaaugaaagaaccaauuuuucuguuaaucccuuugcauacuaugcccccacuuaauccuaaaaaugaacaauaaacaaaacuccuuugguaagaaugacugcacuguacaaaugaggagccuggguccaagagccucacagcugguuaguggcagagcuguguccaaaaccagccucagauccagaaccacacucacucucagaugccuggggaaaugcgccacccuucucagaugauuguugguuuacccaguuuccuucagcuggauuuuaaaacuucaguaguacuuuuauuuuucugagacagauucuugcucuaucacccaggcugcagugcaguggcacaauuauagcucacuauaaccucaaacuccugggcucaagugauccucccuccucagccuuuagaguaguugggacuauagaugugagccaccacgcccagcuaauuuuuaaaauuuuuauuuauuauuauuauuuuuuagagacucacuauugcacagguuaguuucaaacuacuggccucaagcaauccuccuaccuuggccucccaaagugcugggacuaaaggugcaugccaccacaccuggcuaauuuuuuuuuuuuuuuuuuuugagacagagucuugcucugucacccaggcuggagugcaguggugccauuucagcucacugccagcuccgccuccuggguucacaccauucuccugccucagccucccaaguagcugggacuacaggcgucugccaccacgcccggcuaauuuuuuguauuuuuuaauggagacgggguuucaccauguuagccgggauggucucgaucuccugaccucgugauccacccgccucggccucccaaagugcugggauuacaggugugagccaccgugcccggccuuuuuguuuuuuuuuuuagaaauggggucucacuguugcuuagucuggucucaaacuccuggucucaagugauccuccuaccuuggccucccaaaguguuaggguuacaggcauaagccaccaugccuggcccaguggugcuuuuaaaaaucaguauuggccaggcacaguggcucacgccuguaaucccagcacuuugggaggccaaggugggcggaucaccugaggucaggaguuugagaccagccugaccaauauggagaaaccucauuucugcuaaaaauacaaaauuagcuggguauggugcuacaugccuuuuccuagcuccucgggaggcugaggcaggagaaucacuugaaccugggagguggaggcugcggugagccgagauugucucauugcacuccagccugggcaacaagagugaaacucugucucaaaaagaaaaagaaaaaggaaaaaaaaaucaguaauagcugggcacaguggcucacaccuguaauccuagcacuuugggaggccaaggcaggcagaaugccugagcucaggauuuagagaccagccugggcaacacggugaaaccguuucuacuaaaauacaaaaaaaaaaaaaaaaauuagcugggugacgugcuaaaaauuacagguggcgugcaccuguagucccagcugcucgggaggcugaggcaggagaauugcuugaauccaagaggcagagguugcagcgagccuagaucguaccacugcacuccagccugggugacagaacgagacuccgucuccaaaaaaaaaaaaauuaguauucaggauacauuuggaggugggggcugauucagguggauguuaaagccauccuucugcuuggucuggaggcagcaccagguaaaggugggaggccuguggccuuguuuugaacuccguguacccuagcacaagggagcaggagaguguccagaccagggguucugagcuagacuacacuaaggcccaugucuagggacguggcuucaugaaggucacuuaacauccaugcaaaggauuccucauguaucaaauggggguuuuaauaggauuguuuggaagcaaaugaaauguucaugauauguuucacucugugauugacacauaagaaagcauagaauaaaugaaaguuucaagaugguaccagcauggucagguucuggugaaggcugucuuccagguuuuagacugcucacuccuugugacauccucucauggugggaagggaugagcagcucugugggaccucuuuuauaaaggcgcuuaguccauccaugagggcucagacaucaugaccuaaucacgcaccaaaagccccaccuguuaacacaugucaucaccucagaggugaggauuucaacaucuggauuucaggaggacacagacauucagaccauagcagacaggcaccuacagaaaaauugagugcuguuacuggaagguauguggaggcugggcagcccaaacccagcacaugucccccacagaaauggcacucacaggucagcugcuugccuguugacagcuguuugugggaagggcaggggaggccuacagacccuggacuuacaggggagcuggugugaugagggaggacauugagcagaacagagucaggugccuuugaggaggcagccuggccaugugacagcaccagagcucagucucagcagccgucagguggucacaugagaccugcugcugcacggagcuuuugggaugcccugaaaacacuugcagaguaugcagcccuagaugccuucuguuccacuugguacauuugauaaaauuaaguuuguaauuaaaaaccuuuuuuuuuuuuuuuuuugagacagagucucucccugucacucaggcuggagugcaguggugcgaccucagcucacagcaaccucugccuccugaguucaagcgauucuccugccucagccuccuuaguagcuggaauuacaggugcacgccaugaugccuggcuaauuuuuguauuguuaguagagacagggcuucaccauguuggucaggcuagucuugaacuccugaucucaugauccacaugccuuggcaucccaaagugcugggauuauaggcaugagccauggcaccuggccuaaaaaccuuuucauaaagaaaacuguaagcccagauggccuugucuguaaauucugugaaagauuuaaggaagaaaugauacagguucuuuacagacucucaggagagagagaaggagcaauuguuuccuaauucacuuuuaugaggccaacauuacacccauugcaaaccagaugaaagcauuauaagaaaaaaaaaaucccacagaccaaaagcacaauuuuuuaaaauacuagcuaaucaaauccagaaaaauaaacaagacuaauauaucaugaucugguagggcauaucccaggaaugcaagguugguucaauauuuuuaaaaaaucaguguaaugaccauauuaacagaauaaagaagaaaagccauguauuugucuccauggaugaacauucaccacccacaccugauagaguccaugccugccuguccuuaaagucucugcuugcacagugcccccucagugaugccuccucugaguguccauggaagauggcagcccuggcccucccagcauuuuaucuguccuuagccauuacuaagaucccaucuucauucacucauuuugucuguuuuuguucuccuuccacuaaagugaaagcuccgugaagauagagguuaauguguagucuguacuuaguuguguccuuggcaccuagaacacuaccuuaaauaucacuaauagcccaguauuuaugguuucaauaaguggaugaaugccuuaaagaccucaaggaggaccagcggugccaugggagcugauaggaggggcauggguguugcagauagggacaguccauggaagaguugcuguguuuggugagcuaagaagguuggacagcauaccugugggucaagaggucaugugagguggagggaccagcaucagcagaggaauagagguggagaagcugggagggagggaggagugggaggcaggggcuuuggaaaagagguuagauuugauggcaggugguucaggcucuuuccagcagugccaccuugggccaauaacucuguuuugggccugaaucuuugauucaggcuuuaaggaugccuuggugguaucauugggaggccugugaggagggcccugacccuagggcuuuagggucaggcuucagggaagaggaaggacagguucaagcaggaguaaucacaaugccuugaacuccugggcucaagccauccuccugcauaauuggaacuauaggcacaagccacugcgcccagcuuuucuccuuucuuuaaaaagcaaaguucuuguggucagaaucaucccaaacauugcaggaccacaacuccuucauuugggagcccccuccuuuuuccuagaucugagagcugugagaagagcuugauauauauuaucccagcccagugcuuuguauaggugcuauuuucauuccuauugugcagaugaggauguggcagcccagggagguuagcucauuuggucaagaucacgcagcuggugaguggcagcaccugucugucuuacgaccucccauuccacagauaccaacagaugagagaaccgagugagccacguccccauccccgagggcuacuugcugcacuacaugaggggucccugggaaagccacacgcaccacucccgacuaugaaaccugccaugugugccguguggggggugggggggguuggggcagagguguuggugagugggaggguagggcagacaugccgcccaccugcugaggugcagagaagaaggacaggugugcagguaagaggaccaaguguccuuuuagaggaguggcuauucauuuagacuggaugggcaggggagggcuuuuccucagaaaagucgccggacucuguuucuuuggccaaacuugauguggaauccaagugaacugggcuaugagcuggcugaccuggcuucgguggguggcagaugaaaguguuggcaucucagccagugagcccuaugugcagacccugccuuuucugcuuagugagccccuguguguccuugagugcugugucuccagacccgguuuugaguaugggcugaguggcuacaugggccaccuauggcccagagccuguacuggucagggacuguguuagcuguuguagccacgugccucuuccagugguuccucuguuccucacggugggucccagccaaccagggagaggcccaucugguguuuagaguuccugauaucaguguaggacauuacccugccccugugcucccagaaauuggagaauggcagcuuauaucagacucuguaccagagggaaggcauggcuggcguugcagggcucgguuccccucuucccuggacccacacuuccccgaggugugccucaguaguggguaguggggacugcagucacuucacugccaccauuaaaaugcugcugcuuuuauguacuaccuauacuagaauuuacugaacauuuccuucaaaaugacucacuuuuuaaaaaacauugacauuaucuuucguauuaacauuuaugagcucaugaguuugguacauuuguuuuuccuaaaacacuuaaaugaauauguaauaguuaaaaugcauaaugagucuguuaaaaaauagcucaucugugcaucaucuaaacuggugggugugucauauccugaggaaaaugcuccuggaaugggagagguaucugaucuggagucacccaggccuagcugcgauaguuggcccugcugcugacagcuguguggcuuugggcaaauuacuuaaccacucugagccucaguuugguuuucccauacagggcugguggaggauucagugauaaauagaaguguuuagcucugggccugauacauggugcccuuuccuuuccucaguugcccuucucauuucuuauacccucccugauuagucaggguuuucugaagaaacagaaccaauaggacauauaugucauauauauauagcucauaugcauauauucaauaggcuauauauauagccuauauauauauaucuuauacacacacccccucauauguauaugagagguuuaguauaagggauuagcuuauaugauuauagaggcugacaaguccuaagagcugcauucagcuggaaucucaggagagcugaugguuuaguuuuagucugaaggccagcaggcucaagacccagaagagccuauguuucagcucgagucugaaggcagggaugcugacauccccacucaaugacugcgaggcccagagcgggaauucuccuugcucaggcuuuuguucuguucaggccguuaccugauuggaugaggcccacccacauuagguggcaucuacuuuacccaggccacagauucaaaugcuaaucucauccaaaaacacccucagagaaauggccagauuaguguuugaccaaauaucuggucacuguggcucagucaaguuaacauguaaaguuaauccucacacuccaccagcacacuuuuauuuuaauaaaaaacaguccuuggauaucucaguggucuccagaaacgaacuguuccugccugcccucaccucucuuaucuccuccugcacucccugucucucuuugccuggguugguuugaucaacuaccaugucugugaagaauuacccacccucccuccauguagauguaauucuucucuccccagauccuggaaacagaaacauucccgacuugcacaugacuggccagcucuuucauucccagccugggaaagagccagccugaaucuccagggacaccuauaggguuuuucuaaggcccauccuggaaagcugugaggggcagagacagcccuucggagggagggcgcuucugcguggcccugauagcagaaaguauccugcuuuugggcuuagaaccccuguguccuagccuggccucuguggccuuaaaccagucccguuuuccuaagccucaguuuaccgaucuguaagaugaggacauagcaguaguucuuuaaguuacaacuaacauuagggggaagauauuuucauuuagaaguuagaauaacacagaaaagaaauaauaauguaaugaauacccauauuccuaccaucagaauuagccauuguguaacaaccuauauugguuuccauucuuuuuuuaaagaaauaaagccuucugaauaaaagugaauuccuccuuacuacccccaccauuuccacuuccaccuucucuauuuugaguuuggugcaaaccuuucccucuguaauucucuggcagacacuuucuguugugcuuuuucauccagcauuacacaccccugugaggaaggcaggguggguggggggccugccuuacagaugaggacggaauugguggcuguugcaguucuuuugugucccuuaaagacaugcccaaagcuaugggugggcucaaaaugcccgggaaggaagucagauaacugaaaggaacacucacacuggucacaggaaaaccagcgugagcugccugcagccuccaggagguguugggaugggcugccccugauucccaugcagguccugacccagagagagcaggccccaggggagcggggaucugcagaggccagacguggcccggucugcuugugaggaagcccuggguggauggaaucuuacuccuguugcacagagcucagccagcugaagaggggaugcagggaucaagccccaggcccuggggccugaagggugggagccaccuuagauggcugaggcaagccuucccaggccaggccaggcugcuuucucucucccccaggcucugucgucagugcugagaggagggacuuucuuaagaaggucacaagagcauuuagcacccgcugccucccaaguagagccugggcaggggucagagguguccacagagaccccaggacaugagagcccugcgccugcacggcccuccaccaggaggccaggccucagagccaggccagcauuggaaccacucaccacgugaacgaaugucuguguccccucagacucauguguugacaccucauccccaaggcgauggcauuugaggauccccaaggcgauggcauuugagguagcaccuuugggaggugauggggucaugaggguggggcccucaugguugggauuagugcccuuauacaaaaggccccagagagcucccucgccccuucugccaugugacaacagugggaagacagcaggcaugacccagaaagugggcccucacuagacaccuaguaugccagcugaucuuggacugccagccuccagaacugugagcaauacauuucuguuguuggaaaaacccuguuugugauguuuugucauggcagccccaaaagacuaagacgugugacugugagcucugaaaaugcagccaguacuacaugucagaagcaugauauuuaggauauguugggguaaaucacguauuuucuuaaaaauaugacuuuuuaauagggauuuaaaaauggaggaauaggcagagugcaggggacuuuuagggcaguggugcuguuccgaaggauacugccauggcaggugugggcuguuauccaucuguccaaacuuacaggacaugggaugccgacugugcacccucaugucagcugcgaguguucugagugauugugaggucaccacagccuccuccauuguaaccaauucaccacucugguggggauguugagggaaguguuguguaugcauggggcagggcauguaugggaaaucuauacuuucuauucaguuuugcugugcaccucaaacugcuuuaaaaaacaagguuuauuaaaaauuaaucucaccuguuacuuuuuuuuuugacggaaaaugaaaacguggccuguguuacacgucuguugugcagggcuaucucaggcuuguaugaguccuuaauguagcccugcuacauggacaugaaagguguggucacugcagucggguucugcaggcuguccaggcaucucaguguggcagcccagggaagagcuuggggaguuuugcaaggagaauuucaggcuucuuuuacuuggauaggaagagcucuguuugcauuuauugggccugugucugagauuaauacacugcuguuaugaagcaagaaaagagugguuaucucuauuuuguugaggagacagaggcuaggagagggugugggauuuacaggccagaccaggaccccagaucccaguucccaggggccaucgaaugauacauaccacaguguuuuuaaaggcaggagugggaaaugaugaauucucuuuuccccccauagacuuuauuuucuuuauucuuuauauuuauucauuuauucuacuuguuuguuugcuugagacgggaccucauucucucacucaggcagagugcauugacacaaucacaacucacugcagccuugaacuccugggcucaagggauccucccucccacagccucccauguagcugggaccacaggugcacaccaccauaacuggcuaauuaaaaaaauuuuuuuuuguagagauggcgucucacuuuguugcccagccuggucuugaacuuuugggcucaaaugauccucccaccucagccucccaaaguguuaggauuagaggcaugagccacugcaccuggcagaguagacuuuuuuuuuuuuaaagcaguuuuagguuuauggcaaaauucaguaguaaguacaggcuccuuuuucugcccccagaucgaaucuaggacccaggauuuguugaguuuccuuagccucuacugcccugugugaauuuucuaauuuguccuuguuuccacacucuugugugugcuuguguaugggaaguuuaaagccccucgaaaaacaccguagggcacuagugcugucagcauuuggaugguuggacggaguguuuccaguggguaugggccggguucauaggcaccugcuucuugucuccugugugggcuugugccugcuuugcuguguuccucgacucugugccaugcuauuuuccuggaagaaauccacaaggggccacagacacacuuccuccgggguguagauugcuuuccuucacugauggaugcagcucauuuuccgugaacuuccaagguccaucuggaggccuccugccgcagcccauuguggccagguggugucggaguggucggcaugcucagguguguuggaaggggccuugugcuggcuuggcccagggaagacacuuggcauccagccagaaggcgggacaucugccuagguguguuccgcaccauugccuuuuuuuuuuuuuuuuuuuuugagccagagucucacucuguugcccaggcuggaaugcaauggcuugaucuuggcucacugcaggccuccgccugccggguucaagcgauucuccugccucagccuaccgaguagcugggauuacagguaccugccaccaagccugguuaauuuuuuguauuuuuaguagauacaggguuucaccaacuuggucaggcuggucucgaacuccugaccucuggugaucugcccaccucggccucccaaaguucugggauuacaggcaugagccacugcgccuggccacgcaccauugcuuuuugacaccaggcaguuucugacaagucuccuucagaauacucguggcuguggauguuccagugaguuuaggcaaaguuagggaggaugcagagaccccggagugucugcucugugucgggugcugugccgggugcggccccgagagacaagcgccaggcacggcuuaguggccccuccuggggccuuggucacacuauaaacucucugagggcagcauggccagccgcuuuccauggcccugcuucaccccagauccugguggcauucuuuuggaggcccuguacacuaggccugagagccugucuguagacagcacaugcuagcugggcacgcucaguguggagucugcuguccucugccucucgucaccuucucaccugggccuggggcaguuauccugggccauggaugagaaacugaggcgcugacagcagauagcuuuccccacacauuccuguuauccuuccuccuguuauccucccuggggaaauuggcucacagacgucugggcucauuuguggauguguuuaucugucugucuccccacuguggcuauaauauccgcuccgcaggcacugggagcucaugguuguguuuaucauuacagguagugauccccaggguuaguggaacccguugggguuggaagcugaugccuggagccugcugugcgccaggccugggcuagaggucggucgagaugccugugcccccucccugugcaacgugucccucaugggaucccuugagcagcuuuccugcugguacugaacgacucccacaucugcaggagucuuggacgguggccaucuguugagccuugaggucauuuccaggugugaggucuccuguuugauuugcuccaugggaacugugugcacaggccuggagcccucagcuuguggaggucuuaacuggagaggccuuggcagggccccacgucuccucuggguuugaagcugguguuagguggcccaccucacuucugucuuuggguccaggacugcgcccuagacgggugccacagccuggugucuggaccccacugugccuugcagugcagcuccagagaguaaaugcugucuucuuccacugcagguuguccacccggccggagguggccagcaucgagccgcugggccuggacgagcagcagugcucccagaaggcaguggugcaggcccgccugacccagccugcccgccucaccagcaucaucuucgcagaggacaucaguaagggcugagugcugugugugauccccggugggagccagagacagggaaacgcccacuaagacccaggguccuagaggcuaccugagcccauggcagggcuuucucuuguugaguggcaggacacccaggcaggagacaggcacccagcaggcaacacccaucccaagccuugugccagcacuucguaccguguucccuuuuguggaggcuggcuugcuaaauuucuaaauuauuauuuguuaccuaaauaacucuuaauggguagcaacucauuacuaugacaguuguccuaaucugugagaucacuccuuuuccuuccccauaucuaauuuauuauauuaguuguaaaauaguuugacaacaacaauauaauuuucuaucaugcuuuucccuacuuagauuauaggacauguuccauuuuaccauacaaugauuuuuuuuuuuuuuuuuuuuuuugagacagagucuugcucugucgcccaggcuggagugcaguggcgcgaucuuggcucacugcaaccuccgccuccuggguucaagugauucuccugccucagccucccgaguaguugagacuacaggcaugcgccaccacacccggcuaauuuuuguauuuucaauagagacggguuucaccaaguuggccaggcuggucucgaacuccugaccucaugauccacccaccucagccucccaaaguguugggauuacaggcgggagcuaccgcaccuggcccauacagugauuuuuaaugcugaauaauauucucuuuuuuauguugcuguuuugagacagugacuuacucugucacccaggcugaaaugcagugacuccaacacugcugacugcagccucaaccuccuggacucaagcaauccuccugccucagccucucaaguauuuaauagcugggaccaccacaggugcaugccaccaugcccagcuaauuuguaaaauuuuuuguggcgaguugggcgucucccuguguuguccaggcugguuucaaacuccugggcucaggcaacccuucugccuuggccucccacaguggcggaauuacaugugugagcuaccacacccggcccaaauaauauucuuaacaggagguuguccuauaagcauucccuuguauugggcauuuagaguguuuucagauguuuguuucaguguuacauauaaaaauaaauguuuuuauauagagaacaaauuagaauucuuuuacauuauuucuuaagauaaauucccaguuuuucugggccacagcuuugaauauuuuuauuuuuauuuuuugagauggaguuacccagcuggagugcagugguguguucuuggcucacugcaaccuuugccucccggguuuaagcaauucuucugccucagccucccaaguagcugggauuguaggcaugugccaccaugccugacuaauuuuucuuguauuuuuaauaaagaugggguuucaucauguuggccaggcuggucuugaacuccugaccucaagugauccaccugccuuggcuucccaaagugcugggauuacagacgugagccaccacaccuggccaaccuugaauacuuuuaaggcuuuugauacaugggaccguauugcugugcaagaaaaccacacuaaagugcacaagcauuuuuauaugguaccuggagaauggucagaacaauuuuguaucucuugcugcuauccuuacacuugaggguuccccagguaaugccauuuacauaccuuauuuauggagcaaguaaaaaaaucucugggugugcccaccagccccuucuguacuauacuugauagucuuuuauaaaaacaccagcauaugugaaaaccaaaaaccaccagcguaaucccuaaucucagugaagggacaggguucucgucuuugggaugggaacucaucauacuauaacccuugucacuucacggaaugcuuacacccugaacgaaacuaaguuuuccuggaguuuuuuuugcccacagcuuuaaaugcuggugcccugcuggaaaagccagaauggguggugacaaggcccccacagcccuuucuuucugguagucccuguuaacugucaguggggccaugugugaggcagcugcuuggcuucugagggugaagcuggugguugccguggucuuugccagaguguaagccugcaaggcuuggaaguggagccaggggcggggacugucuuuggugcugaccccuuccugggguuccuccagccacaggccagguccugcgcugugaugccauuguggaccucauccaugacauccagaucgucuccaccacccgcgagcucuaccuggaggacuccccccuggagcugaagauccaggcccuggacuccgaaggugagaacguccccugccuguuugucuucugcagcccaugcuagaucauccccccaccaugacucuggccucucugcauuccccacuccucuggcauccaacccugcaggucccuagagggcagcucuggucaggcaggugaaguuggugcugggggagaugcugaagaggcagaaaccaccucugaggugggccucaagcccucgguggugucgaaucauggucacuccuggcccucaggaaccccugcaguggggccugugugcucagagcuguggcucugugacccuggagccagacccugccugcauagugcugguccuuggugcagcacaucuuggggaagcuagcauucuuggcagcgaugggaggcagggagaggcucccugcucuggcucuuagggccagugguggcuuccuguuccagaccucagagcauguuugugggucaggucacauuuaugcugccggcccagggcacugcccucacaucuucaccuugccagagucaaauaugggcuuguuuccaggcuggaacucuucuaggugaucucuuaaaggaaguaagggaaacuuuuuuuuuuuuuuuuuuuuuugagacagagucuugcucuuguugcucaggcuggagugcaguggugcgaucuuggcuuacugcaaccucugccuccugaguucaagcgauucuccuaccucagccucccaaguagcuaggauuagaggugccugccaccaagcccagcuaauuuuuuuuuuuuuuuuuguauuuuuaguggaaacggguuuucaccaaguuggccaggcuggucuuggacuccugaccucagaugauccacccggcuuagccucccaaagugcugggauuacacacaugagccaccgcaccuggccaguaagggaaacuuuguagguuaaaauucuugucagagaaaauaaaagucaggcaaaagaugccuuucagaugaucugcccccaaaccaaguccaaaccaaggcucacuuugucuuugaaaccuuuucugacaacucuagcuccuguuuuugaaaaaaaauuucuggaucaggauuucuuagccuagauaguauugauugacauuugggguugaguaauucuuugugaugagggcugucagugcauuauaggauguucagcagcaucccaggccucuacguacuagauguuaguagugucucccaagccaugacaaucaaaaauggcccagacauggccaaaugucccuggggggccaaaccacuguuuagagcacuagcagacccuuucuuccccgcuuacccauucaucagaugaggcccuuaaccucugacacugccuucugaccugugagauugagauagugaugcuuguccuggggaccauaaggacuuagugagaaauauguacaguguucggucuugcgugaguacucaguaagccaggggguguuucucugagcacuuuguacaaacugggcauuguccaggcaccaguguugcuauagggaaagaaguaccuggcagcucccaaacaguuaaacacagaguuauccugugccccggcaauuccacuccugcccaagagaccagaaaacacauguucacaugugaaugcucauaacagcauuauucauaaccgccaagugugaagacaacccaagaguccaucaacggaugaguggaaaaacaaaacacggucgaccccugcaauggaauauuauuuagccacaaaaagaaggaaauacaggcugggcgcaguggcucaugccugcaauuccagcacuuugggaggccgaggcgggcagaucacucgaggucaggaauucgagaccagcuuggccaacauggugaaacccugucucuacuaaaaauauaaaaauaagccaggcgugguggcgcacaccuguagucccaguuacucaggaggcugaggcaagagaaucgcuugagcccaggaggcggaggcugcagugagccgagauggcaccauugcacuccagccuguuucagauuccugggugcagugugugaaggugccaugaucuccacguccuggccagcacuugcuauugcucauccuugugguucuaguuaaacccccuuuaagucacuuuuucuugaauguguauccauucuccccagguaggugguggggaugucgggauuggggaggugccugccucagccuucccaggccacuguuaugccaggauggugcccagcagcccuggaugguuuccucucacacuccccccucuccuggaggguugauggccccugcagccaguuccagaguaggacgucaccuggucuccacagacugggucauucaccaguagcccaugucaaggccccaccuuugcagcaaggaaauggauaacuucccuccucgcccacugugagggcaucaugcuuucuacuugguccuccucgccccgaaauacuuugaugaguaccuucaucauuucuuuugccuuuuuuucugagccugugaccucuuuucugaucagagucuccucugugaagaugaacuugauccuuagaaccuuugagggcagucccagaaaugaugugccuuaucuguauugaugaaugucaagaaagagaauugcucaacgaacaguggcacccuggcugcccauggaugccaggcaguagguuguccccuuaguaaguacaaugucuuauugugcuuauaaauggucucaugcccacuauauagaugaggaagcugaggcucagagagcuucaguaacuugcccauggucacacagcucauggguggcugagcagggccugggauccaggaugucugacucugucgccugagcuguuucccgcuggaugcacugccugucuccuacugcugcauuuuccugggcauugggggcccuccccacauggcugggaucugcccuuuuggccagaagccaccugcagagugcccgccuccagacagggcucugucuguugcacauaguagguacuaauagcuucuuuuugcguggaaaaagcaaaacuuugagcagagguuuucacagcuauuuccuggcccacccgugccucuugcaucagcagaacuggacuagcucaggguauccaaagaugcccccuccucaccuuuccuuaucccaucucuucugccuggagcaccuuccccuccugaacucugcuuucagaagccaugcuuccucuggcauugccucucagguguccccuccuccagggagcccuccuuggcugcccaaggugggacuuguucuucccuucgaugucccucaguucugcagugcccccugcccugggauacaagacauuuucuacuguggcuugucaaggucagcacuaggaagacauaacugaaaucaguucauucuucuggacuuuucugugccugacacuggacuuuggggccagccggcauuggguaaauguuugcuagguugaauugccuaacauuuuccuucagcuguccugcaggacaggggagguagauccucuggagacuggaucccuggcuuuccugguuaauaucuaaacuuggcugugaggcuucaaggucaagggcuccguugcacauaguagguacugauagcuucuuuuagaguggaaaaagcaaaacuuugggcacagauuuauugagagcuuucccuucccccuugccacccuuagggaugcccaccugcagcaggcccuggaaaggcagacaccugccuugacauccccagggcccacgcagcugggucuggccauguugccagcagcuggcgggagagaaagccaguggccagcagcuggcaggcccaugcaugaacgagggucccuguguucucaucugcacggagcccugcaaauccugcacucgguccugugugugcaccugcccgagcagguaacuuacagaagccuaaggacacuuucugcccuugaaauuaccacacauucaacucuucuuccacauuugaacgugguggacuuccaggagagacuguggggagcaaagaugaugaaaaacagagcuccacgugcagccccugaagugucugcaggcaugauucucucccaccguuuuccuugcuaagagccccuuagcagggccucccccaccuccauccccuuguccauaagcggaccguugugaacacuggacaugucaugggggugcuuucucaauuugaucuucccaccaaccccaugcguugguauuuucauccccauuuuacagaagagaaaagccaugcuuggagcugagcuggguggaagccccaggguagcuauucaggacucuugugguguuggcauguauuuguguuaagggaguggccugccuaguggucugcagucuugcguuucugguuacugggucacacuauuauagggacuccaugcuccccucacugagcacacuguaaagcuggccugcugggcucugacucuggaaggcaggaauuugggcccaggcuccccucaccgagcauacugcaaagccggccugcugggcucuuccccgagaagguggaauuggagcccaggcuccccucacugagcacacugcuaagccaaccugcuggcucugcccccggacaguggaacuggggccagcaguacuccauaugcacccuguuucagcucagugugcagaagaagguucucacagucagagcuguugaacagaggaauaggcugugcugggcgaugagcuccucaucccugggguaugcgggaagggucucaagcccccaucugauggggacgcagcauccaaggguuggacuagaggacuccugucuugcagccgaugugcuucgcugguguggauuuucauauccaccauccucaccuaaugcccuggauguuaggaagacagauuaauuuucaggaaaccauagaguuuucauuugcucaaaauccugcucuggaccucuaagaaaaaaucuucccgcauauauguacaucauagauggggguugucuuccucugaucaguugcucacauugacggaaagacacccagggaacuguaagaagaugccucucuucauuaaagaugcccugagaaguaaggcgaaggagcagaguuuucuggagcuucugcuaggcacuauuucaugcagucuuugagaccuugcagggccagggaucggggugaagagaagcaggaccccaggcccgucagacucuaaauaccuugcccuuugcacuguagaaaacagcuuuucuuggcccccagaucccuuguacugggagcuggucagaaggggaguguggaugagggauguggaacaggcguggaacaucaggggcuggugaggaguguggcauggccccuucuagagagggcgagcagcuucuggcucucagagggaaugaggcccagguggguggaucuucauccuuucaagaggaggugagaacuagacuugcauguggcaucuguuucuugauuggaaaggacagaucagaaggcucccaggcagcaagccaggacauaagagccaaggcuggcugggccuggcucuccuugcccccuaccuaccccacgaccucaggagucucacagucaaggugaagagacaagagucaugugacacuagacaguuuggguaaugccccuccacccuggguccccuccccugcacagggagggagaggaguuuacucccaggaaguggugagcaggaaugaauggcccagguuuccgagcagacuccuaaauuguaaaccgcucacagacgugcggggcagcaguguuaugcacugcacugagcugguccugcagucaagggcagggagucacagcaggaagagcacaagcuuucaucggacagcccuagguucaaauucuggccucgcccccugguggucacaugaccaugaguaagugucuucauuccuuucagccucaguuuccucuccugacauacaguuuaugacaccugccugguggguggugauguggagugugguuccugcauggggcagaagcucccaucacgccucccuccacccugggaaauuaacuccauaucugucugccucucccaucugcucuuauagggaacaccuucagcacucuggcuggacuggucuucgaguggacgauugugaaggacuccgaggcggacagguucucagacucccacaaugcgcugcgguaaggggugccucugcuaggccuggccccuuugaagggaaggggaaagggggacaccugugagcuccucaccagcggggggcuuucaucugggucauugaggagucugggagacuccuaggaugcccguaacauuccgagugucugauugaggaaugggauccacucacaccauugugcgggagccuggcugcuucugcagcccccagagaguguccugugagaagcugucagaggcuugggauguccagcuggagaaaugagacaugcauggcugucucagggcacagggaaaguguggguggccccaggcugcacuucuggggggccaguuaaagggcagccagguuucggcuggggcacaggccagcugugccggugggucucagguggaacaggcugagucgcccauauggcgguauaguaagaccaguugugaggcggacaccuuaagcaucuugaccugugucauccuccuggcagccacaugagcuugcgcaccacugugcucuccaucgaguaguuguggaggcugagacuuggagaggccgagccgcuugucugagcuccgggaggacagagcuggagucugaacucagauccguggaucugcacugucucgugggagccacgggccccagagcuauuuacuuguaguuagaaaaugagcaguucaguuccuaagaugcauaagccuccugucaauggcucacugcacugccacaugugggacagggcaggagcagagccacgcggguccucugccggugcuggugcaggucccaggucugagcuuguauucccgacugugccgccuuccuccugauuugccaugugauuuuuaaaaagcauggucccuuuuuuaaaguuguuuuugaaucuuuugagucuccuuuugcagcaauuuuaggccuguagaaaaucugccaguuuaguccaaaaaguggucucccucauucaccugagagccggcugccagccucaugucccgucacccugaugauuuucaugugcuuuacgaccaucggggcauuguccugcacggccaccaugcagucauggcacuaggaaacgaacacuguugccggccgucuucagaccuuacucgaguuuggucauuugucccagcuuuauccuuuucaguaaaaagaaggaucccagccccaagucaccugccgcauguguccuguuucucuuagucucugucagccugggacugucucccgggcuuugacuuuggacaccacaacgcuugugaagaggacagucuaguuaucuguagaguggcccuuguuuuggguuugucugcuguucccucacggccaggguccgaacguugugucuuuggcaggaacaucacagaagugagacuccgcucuuccacuugccucugcgcuuucucaccccuauauaauuauaaguccuuugucagggaguuuacugucuggucuuucauuaugccauuaaaguccugcucugggcuguaggggauguuggggauguggugguuccucugucacagccuucuccagggcucagcuuacagcaacuccaggccgacguccucauguccugacgccuuugugagccgaguugcccuuguggagacagccugcuggaccagcucuguggguucugguguuuuguaaaacaaugaccaugggccagagagucagagaccuggauuccaguccuggcuuugucgcuuccugccuguguccuuagccagggaacguuacccaccugagccucagccuccugcccugggaaacagagcuggagggaaucccgugccugccucugagggccacuguacagcucaguggguugauccacucagggccccucucugggccuggcacacgcuggauguugaggggaugcugaaucccuguccccuucugacaauaccccauuccccaccccuugagcuuccaggcagcuagcucugcaccugagccaaaugcuaacagaaaucccagaugccaaggcggguuggagcuggauuguccuggauuuguaauuuggcgugugacaccuagaguaaccaggcgaggaaauaaaucacagugcggcccagcauuggcagauugcucuugugcaggggaacagugggcucguuuguaaaugcaggcugaagugggaggcugcgugggaaggaucccugaaguccgccugcccagcagcccacacuccaggcuacaccacguccccgacaucuccccaagcugggauccagggagagugagacauggugccgucuggugcccagggcuaggggaccagucauggagaaucguuccccagagcugggcgcuaggccggggagguuggacaggagcaggcagccucggggaggugagggugcugcuggcccugcugugacugggcugugcucuugggccugcugccucaucucccgggccucacuguucccauguggacucagcagcuggucucgcauguuaguauuuacgucacgugugcguguggauaaaaugcagauucccaggcaucuuggagacaaagccugggccaggggccaaguaucugcauuuuucacaaggacuuuggcaguucugauguaggaagcugcagggccgugucucuaggcagccccagcccugacuagggggacaccccuuauuucagcaucagccccagugggagguacugauagggaaugcugugguagauucugacaaaucuuguguugggguuugaucaacaaacuuugacaacgugcuccuuuuccagaauccucacuuucuuggagucuacguacaucccuccuucuuacaucucagagauggagaaggcugccaagcaaggggacaccauccuggugucugggaugaagaccgggagcuccaagcucaaggcucgcauccaggaggcugucuacaaggugggccuggggcgcuggggugucagugggcuuccugggguggaaucaggcugacgguaccugcuuauagguaccaucacaccuauaggcacguugaauaguggaagugagaugcugucccgugauuucaggauguggguucauauuuuuauguguuugguuugguuuguuugagccucagcuuacaaagaaaggugguugaggccccagaaagcaucucuaggggugcauagcauuugcucauucuuaguuucuagggagguccaagagcaggagguuuccaguaacucaccuguuuccaacuggugcccccaccgugcugguauagggacacucccaagcacuuggggcuuugacaaaaccuggggcuccugggugucuucuaugcugucucuccuugggcccccauuggagcccugagacugguggcccagggauccuauguguagaucaccucaacccccugccccagccgaucccaugucuuccuggccucaccagcaucccauucuuaggguaguggggguaugccagaggaaaggagagugaggagugggucuauccaacguccugguuccuucucugucccuguggacuaauguccacccaaccagugccucguuuugagcugcaacccugagauauuuuuguuugccuagugucuggagcacaggcaggaacacugugguacuuggccugccauuuaauuuuguaaaguggcagacggagaaauccucuucugauucacucucuguaguggguuugcugcaucugggaguccuggaaaguuauggaaacauggggacaugcccuguuauaggggcuaaucccguaggacucugcagguaguacuuagagacaguuugcuccuguguagggcccaggcugggaugggguacagccacacugcuaagcuggaaaggcagacuugcuguccugcccauagacauucaguggcccucccugccugcgugcuggaaagcagccgccacagagcccugcccaugguggugcccaauacacuugucuguuuuggacacacugaagauauuaacuaguuguuaagugaggaaagcugucaguugugacagcaggcuuaaaggagaauccaaagaguugccacaggacaccaggcaugcugaacugaacucagaaaaauguagaaugcccacacccacaggagggcagucagcugcgccuucaccugaggaaauguuuuuguguuucuguggacaagaaucauuugcuguguugucgcuuuucuacaauguacacugccaucaaacaggccaaagacaaugaaaggugcaggccucuggagaauccaguaccuaagggugcacuagacagggcaccuagugaucuuucucccauugcgaaguugcccacggguuuuccugaggaggcaggaggucacaggucgggggugaaaggcgggcaggggaaggggucaaggaauagcagccaaggcucaucacagcauaugccucuccugcuuuuuauguuggccuggggcuucucaaguucccuggaccuugggcuuuuguguggagagaacuugagcucccgguggccauagcaucccuagaguucacccuggcucuccucuuuuacuccaguuuaaucaugguuucacauagagauaaaccaugcacaaugggcagucagugugagggcucagucuggguaaugcccuuuuucugggugccugcuauacuuauggagcuccccugggaccucuggguucugaaagugaggauuugggaaugauaucuuguuucuuuccucuuaacuucccuauucccauguuuaaaacaucucuuucucuugcucacaccaccacuuccccauucccuguccgcaccucacuuugucugccuuuucuuuaugccaagaauguacgcccugcagaagucaggcugcugauuuuggaaaacauccuucugaacccggccuaugacgucuaccugauggugggaaccuccauucacuacaaggugcagaagaucaggcaagggaaaauuacaggugugucauuggcucugccaucaugacagaugcuuccuuccuccuuuuuuuauugugguuacauacauguaacaaaauuuaccaucuuaaccauuuuuaagugcuccaucagguagcaucaaguacauucacacucuucugcagccaucaccaucauccauccacagaacucguucaucuucccaaacugaagcucugcauuguuaaacacuaacuccccuucacccucucccagcccuuggcacucaucacucuauuuccugucucugugaaugugacuacucugguuaccucauguacguggaaucauauaguauuuauuuuuuuguaacuggcuuauaucacuuuuuuccuagccugaugucuucaaguuucauccauguuguagcaaggguuggaauucccuucccuuuuaaggcugaauagugcuccauuguguggauggauagaccacauucuguuuacccauucaucuacccauucauccaucagcagacacuuggguugcuuccacuuuuuggccauugugaguaaugcugcugugaacauagugagcaaauaucugagucccugcuuucaaauucuuugggguauaugcccuuucaguggcagcaaguccagagcugugggcuuuguguuuagcugggcuuugccccggucugcaacugacaacugaacaaacuuggacaagccacugcccuucuccagggcuguuucucauuggaggcuuugaggccuuucugccugggcugugaggacaaaaugaaucaauaggaguguaguuguacuguguacuuguguuuagauagugacgguucucaauggagcgccaguccuccuaaggaucauuaucauuuuguucaaagcuguguauguuuaacauccagagcauaggaccugaagggucaugggcauaagagcucucagguccaguccauccgagggccucagucaggugaguuugccagguugguagguugguuccaccugugauacagggugucacuuaagaggcaggcagauacacacuucagcauaagagcaacuugaguggugucuccaguugaugggaggugcugcauuguuuaaaguccugcucaacugagagcagucaccugguuggucauuccuguguggcagaacgcuuucucucaggaggacaaaaaaacugaagacaggcgcuccugccuuugggcccaguucuuucuggcaaggggguccuaguugaagagaagcaaacucauguuucuugauucugggcaagcagcaucugcccuucagcaggaugucaagucaacaggaggauggccugcaguaggauuuguaggaagccaagcguggguguccuggucagagcccgauguuuaccugacuucagggaggcagauucuaggacagggacaguccaagauguggcuuucugagacucugaaaggggaggaggcuccaagauagaguucugaggacagcagccuaaggaagaaugcaaaggggaagcguguugaaaggccagagggcacaaacaggaggucucagaaauauaaaauuauccaugaacacugaucaagaaauggcacugcggccugaaggaagacgcuuggagagccuagucacugcugacagcaccuaaccaugacugaacauuuccucaguguugggcaguuguaagugcuuuucuuuuuaaaguuacuuuauuuuauuuuuuagagacuuggucuugcuauguugaccagucugaucucaaacugcuggccucaagccauccuccugccucauuucuucugaguagcugggacuacaguuguguaccuggauauaacccaacagcucuaugagguagauuucauuaauacccuguuucauacaugaggaaaacugaggcauagaagaccugaagcucacaaaacuguuggacuccuuggccuuaaucaccccuguaggaucaauuggaauuucccucugccgcuucuccccaaaggaaacccagaaaaaagcuaauuauaacaacagggccggccgggcgugguggcucacgcccauaaucccagcacuuugggaggcugaggcgggcggaucacgaggucagggguucgagaccagccugaccaacauggugaaaccccgccucuacuaaaaauacaaaaauuggccaggugugguggcgcacgccuguaaucccagcuacucaagaggcugagacaggagaaucacuugaacccaggagguggagguugcagugagccgagauugcgccauugcacuccagccugggugacagagcgagacugucucaaaacaaacaaacaaaaacagggccuuacagucucccagggcagcggugaggugguccauuugcaugggacucauggggcaugaaacugccccagcugggcaagcagagcccauguaguuaagaggggaugggcugacuuuagaaagagcucacucggccaggcacgguggcucacaccuguaaucccagcauuuugggaggccgaggcgggcggaucaugaggucaggaaaucgagaccauccuggcuaacauggugaaacccugucucuacuaaaaauacagaaaaaaauuagcugggcaugguggcacacaccuguagucccagcuacucaggaggcugaggcaggagaauugcuugaacccgggaggcagaggauguugcaguagcugagaucgcaccacugcacuccagccugggcgacagagugagacucugucucaaaaaaaaaaaaaaaaaaaaaaaagagcucacucuaaauuagcucagguaucacagcccagaggaacugcaccucccaagguaccuagaaaacuuacgagcuuggucacugaccuuccugccacagacaucaaggaauuggagcacaugaaagaugcccugggacaggaaaggaaagaggcagggcccaccucccuuucaucaugucaugagaugugaaaguacuccaaaaauacacacuccugugcgauugauggcacuggaugcuacugcaguagauuccagauggauguuuuggcaaaacugagaggggccgagcuagcaaaacuucacugugaacaagacacaccaauggaaacuccuaagucuuuuagaugaauuauuuugggguuuuuuugagagagagucuugcuuugucacccauguugggagugcaguaucaugaucauggcucacagcagcuuugaccucccaggcucaagugauccucucaccucacaccccugaguagcugggaccacaggcacacaccacaugccuggcuaauuuuuuuuuuuuaauagagaugcggucucucuguguuguccaggcuggucucagacuccugggcucaaguuaucccuccuaccucagcuucccaaagugcuggaauaauaggcaugaguugccaugcucagccuagcuggauuguuuuuucauugagguauaauucacaugacuauauugguuuuugcagguuugcuagacagaaaagucagggaauggugucuucauaggggaccugaauuucagcaaaucccugucuugcccggcauccuguggaagccucagagcauucugcguuggaugacaguuacaugggcucauuaacaugcgauaauuauaacugcagauuaacucuuuauauuuucuuuucuguuggguuuccuuccuuacaguaauuuuuucuucuuugguauuuuuauuuccuuuaugucugccucucuucuuuuuuuuggcuccucccuuucuugcaaauacauuuccugagcaucugcucugugccagcccuuugcuaagugcugggugcacaguggucagcaggacugcccgguuccugcccuccuggagcucacagccuagcagagguggagcacagucagucacaucaugucugcaagugaggccugugaguggaggagacaggcuccugaggcuuauagcagggcaucuguauugcuuauaggaugggcuuccagugggagccguggucuccaucuccaguccuuagugcuaaguccuguugguguuuggauugguugcagacaugacugccacugugaucaaguuguuagauguaauaaaaaugugggaagggcaugcuggcugaucgaaucaguaucugaagagaacuugaguggauagaaugcuggaauuacugaaauaaaauguacuagguuugcaaaaccaauagcaugcacauguguugggcugagguucaugugucagagacucaguuguagaaggaacuuugaaucuggcaggcacuuaacuguggcugcucagaacuaauguaucuggggcugcuugagcaggggcugaggucagaggcagggagugagcucuccaucauccuugacucagacccagcuccgcaggagcuccauggucaucccuggagcucauguggagugcaagguccgggagugggggcgcugacagaaacaaaucuggggggaucagccagggucagcaggggacagagaucaugucuuuuagaagaaugugggcuuccugaccuauagaagggcagcuguucacccccugcagaugauagcagggaugaucuggggccucaggagcgccuuucuguuguuggcccaauaauucaaagacaggaacugggcagugcccuuaauaucugcgaagacuuccacauucagugucucuuacaaggagugaguuccaggauacaggggguaucuaaggccagguaugguggcgugcauugguagucucaacuacuuaggaggcugagcccaggaguuccaggcugcagugagcugugauugcaccuaagaaagccacugcacuccagccagggcagcauaguaagaaccuaucucuaaaaaaaaaaaaaaagaaaagaaaagaaaagaaagaaaaagagguaucuaaggagucugucacaaaauccuccuuauuuucagucuuagaauuugcaaggaggguuacaucugugcuauguaaguccccuucaauguaagcauguucauuucccaaaagggccuuacucauuuagaaaacuuuaaaguaaacaagggaggaagcuagugcuucauuaaucaguauaaaguaauguugcuucauugagcaacuauguuauuuuauucugacauuuaucuuugaugcacugcuccauauucugaacacuagacacauaaucugcaagaaucacuugauuagagaugaggaugugggcugugcauucccuuugggauucucaauucuagccuacaucagaaucaccuacagggcuugugaaaacaaagcuugcuggagcccagcccuggaguuugauucagcaggucugggauggggcccaucauuugcaguuccaggugauguugaugguucagggaccacacuuuggggacccaauguucuagugaaaauuauuugauacuuauuagaucacaugaaaaauaacccaggacaagggccaggcaaguuuccucucuuuuagaauucucaucagaaucccuggagauucugaaacaugcuuuagcuggaauuccucugggaguccugaccuggcacccucuaugggguguugaagcccugagcuggccugagaggagggccaagcagagauguugucugcuguuuccuguguccucuucucucuucucuugcuggagggcuagaaugucccacuuguggggacagugaaugggugacugguuaggaagcuccgcgggcuuaggagagugaaugugaaaguggucaggcucucuggaucagaacgccagcucuguuuuccacuagcugcgcaauggugagcaggcugcucaucuugauauccucaguccccuauccccaaaauguggcucucaguagcguguucccagggcuauugagggauaugagggaacgugaucaugagacaccucauugcucugaggcaucuugaucccugcucagcagucaccauugcugucaaaagugcuuguggucucugcccacagagcaaggaagauguacaucgauguugcucacuuuauagaacucuuacuucucggggaaacucuucuccauccuagcccacguugggcaaguuauuuuucugccaagugggugugaagggcaggggaacacugaagcuggugaggauggcagcaggguucauuguuggcaauuauagaccccaugggagaccagugaccagagcuucuugggaaaccccuagaggcuggacggaaccagcaagaaccccagugcccccucuacguagaagcaaagaguucacuuugcaauguucagaaauggcauaauguuaauauucuccaagcaguuggcaaauagauugugguuaauuuuuuuuuuaaacagcuuacacagaaaaacugauugccucugaaaauucauggagugucaguuuuguccaccagcaugcagaacaauauuaacauuuaaagcacugaaaacaauuaagaaaaugcgucagcuguacugagagcagagugcagagauucgggguggcagugggaguguauuggcuucuaacauuuccugucuuugcucucucuuucccuguuauuuuuuguuucuugguggccagaacucuccaugccuuccgaucaguacgaguugcagcuucagaacagcaucccgggccccgaaggagacccagcccggccgguggcugucuuggcccaggacacgucgauggucacugcacugcagcugggacagagcagccucguccuuggccacaggaauauccuuuucuugggcuuguguguucuuaggcauggcggagcugcuguuuggaagucaagucuuuuuuucccugaaagcucggcagggcuaaaaauagccguuuccccucaacggucugaaaaucagaaagaacugaaauagcacugcugaguggaauugcucacggcugugggugacucaccccagaggcucccagcggugggaggugauggcaggagcugagugucguuccucgucuccagaaacuucuccaguaccugcagccuucucagagggggccuggcgggggcuguuuccauacuagcauaauggaguguugaugccccagacuuguuguuguguccugugcggucuccagugucccucacagagauuccccuuugcuaguguggcaagcgcaguguggccuuugauucugaaaagugccuuugcucuacguggccuaagccaggggaguuuucauccccucuucuucucuccaugugaugucuugaugaucaggauucugagccaagcugaaacuggccagccagcugguuuauuugcugucauaugucuugccccuuaauucaaaauucagguauucgcaugcaaggugcuucuagguuacccaacagcacuaucuacguggucgaaccuggauaccuaggugagugugggccuccugggcccucauggaugcugcucaguugugacuauaugaguuuaaaaaauagaaaagaagcaauagcuccacagaaaaugcuucccucuggccagcucugccacuugcuaugaccaucauugcccagggcacucaccagcccuucccuguuugguguagaaauagguagaaugagccaagccaggcaggcggcaggcucagcaaggagagaaacagaaccggguagaguggugaggggcuugcacccuccugguuuucauaccacggcuuugcccagaccugaccauugcuauggacauuuagagguuggggcccagugucagcucaauuauagagggacccuaaggugacaugacaguaggcagguaccuuagcagggaggggaggaacaugaugaugauauugaaggcaggcauuuucucagacagagcuucuuuugcgggaagguguccuggcagagggaauugcuuaggcaaugguguggaagugaaaaaguacacugggcaucccaggggacagcaagagugcugugguauccuguguugcaggggacugagaaccugggagggcagggaugacucauauggcaagagugcucagugacaggcuucagaguguagaccugcugagaugaguccaggguugguccuggcgaggucagcucaggacugagaguucaaagcagagaacuguuguggauucagagcguagaccugccgaggguucagagcguaggccugcuguguguugaggacagaguugcuggauucugaguguagacccacugaggacgggaaugaguuugaaagagccuugaucagacagagugggaugaguccaggguugguccuggcgaggucagcucaggacuuagggcugaagguggcauuagacuucugcuccucagcagaaggaggaggccagggccauaguuguggggccuccaggugggugguguagggccugcaggugggugguguggggccugcaggugggugguguggggccuccagguaagugguguggggccugcaggugggugguguggggccugcaggugggugguguggggccuccagguaagugguguggggccugcagguggguggaguggggccuccagguaagugguguggggccugcagguggguggaguggggccuccagguaagugguguggggccugcaggugggugguguggggccugcagguggguggaguggggcuucucguguggaugcugagggccccugugcugagggugguggucccauccuccuccacccugcugccccugaggccugagugcucaggcucccucugccuguuuuaggguucacuguucacccuggugacaggugggugcuggagaccggccgccuguaugaaaucaccaucgaaguuuuugacaaguucagcaacaaggucuauguaucugacgugagugccuguucagguccuggcuggggggaugagguggggucguugucugacgcggcugcugaagagcagcccccaaagcaacaggagcccccaugcaggcugaccgaggagggguccuguuucuaguggcgcucccgggucugugggaaacagugcugaggcaucccggggcaucuccagagccugugagccugcacaccggccuagcugcagagccccuguugggcuggagggcagagguugccacagcggcagggcuccaggauaggaggauagggaggaggucucugcccgccacucucccgcccccuuuuccccaagcuggggaccucagagaauccauucuccuccugcccugcagagagucacggagcacguccuggcuuucuccguacuggguuccagaaauaccuggaacccugcaugacagaggccgagcucagcacacuuucugguucuggaagggggugucagacagaugaggaaaugugcaggagucuuggcugccucucuguccccugugagaaauuccaggcucgucagugagcacccccaggcccuucagguggcguuggagguuuuagaagaaaaaggcgagguuccucucgguguccuugaagaugucguugcuuugcucauguuaucaaacaagggcugggauggucaccauuugcaguuagcuguaggggacgugauguccuuuuuuuuguauuuacugguuccuucuugagaccucgguaggcuccaagcugccccaggugccacacggggggaugaaaucgaagcgcaggucaucaggccaugcagggaggguggccucgguggggacaaaggccauagugaucagaccucuguuccagggcccagcccacccgucugcugcuaguggaggcugcugagccccagggggccccuuggccuggccuggcugcugguuucaguccuguagcuucgugcccaaauucugacuuucuggagucaccccagaagcaccucucuccuguccugccucaccuuccagaacauccgaauugaaacugugcuuccugcugaguucuucgaggugcucucguccucccagaaugggucauaccaucgcaucagggcacuaaagaggggacagacggccauugacgcggcccucaccucugugguggaccaggcaaguuggugucuccccugcgucgugccuuguccuaugaagccacccucuguaggcagaaaugucagcccaggagggccaugagucccagggaguugggccaccugcaucccuuuuccuguuugggcuacuugcauccuggguucuauuuuccuuagucuuuaagaagcccaucagccuuagggagcagagcuuugcugauuggaaaaucggccuggguguucccauuuuccuaccccgcacagaaggccuccuggccuggaaggggcagcaggcuguaacaggaagaaaugcccaugcaccgacagugacuccugccagagucggccuccucagcucugggggcugggcgggcugcuuuagcucucaagccucaguuuccccaucuguaaaguugggggggacaccacauccauccugcuggggugcccugaggauucagucaggcagcauuuccagaaagcacuucacaaagccauccccguggagaaagagagggcagcagggugucuggcaccuuccucuccacucuucccccaaauccaccuuugugacccgauccccagggagggguggggguccggugacugggaaagacugaugaugacaugguugucaugguuacguguggcacccucaccccuuguaggauggagggguccacauacuacaggugccuguguggaaccagcaggagguggaaauucacaucccgaucacccuguaucccagcaucuugacauuuccguggcaaccaaagacgggcgccuaucaguacacaauaaggguacgugagaccccucaccucugcgugcauuccuuugguguuuucaugggauuguggcuuuuuguccauucuauuacuuuuaguauuacucucuagugguuguggagaauuuuaaaucacagucuuuauguuuccugagguuuccaucauagcaaugcauucugguaauuaggaaaaaaaacaacaaaaaccaacaaugaaaaaauugagaauaaggcagggugcgguggcuaacaccugcagucccagcacuuucggaggcugaagugagaggauugcuuaaacccaggaguuugauaccaggcugagcaacauagggagaccuccaucucuacucaaaaaaaggaaaaaaaaaaaaaaagagaaaaaauagaauaaagaaaaccuggaauacaguuuugaauuucauuaauguuuauuuuucuaaaaaucuuuuuugaaagcauuauauauauacacacacccuuagagaaaacauuaaaauuuaagggauaaguaucuccaaccucaucacaugggauggaucacugcucugaccuuaauacuuccaccuggcauuagccagcaggacucgccuuagacagggcucgaguccucguggucagugcagggcacaucaguccugcugucccauggaguggugacagguguccugucugugcacuggcaccggcucucugcucaggugcgucaccauccuggccccuuggguuuugggguuguuuccucuggucugggagcagaggugcagucgcugaccucccagcagacaaugaggaaugggcaggggugugugcugggagcuugugucuggucagggaggcagcauccugcaacuggcucggugaccaaggguucgucccacuccagccugagcucugggaggugccaccagguucuggggccucugucaugggcguguguguuugugugcaucggucucgagguccccagaauaugaggacagaaacgagacaggacaaagagggugagggcagggggagccucuagccagacccuagcugauaccacauuuuucccugcugugggcaucgaccuugugugucagugaggaaguggccacagguguuuuagagccugugagaguguguauguguuugaguguauuggugcgaguauauaugugugaacguauguaugugugagaaaguuugugugcgugugaggauaagcuggugggaguaggugaauguaugugaguguaccgugggugcgaauggugagugggugaaagcgugagugugaagguaaauguaagugagcauguguacgaaugaguagguguaugagugugcacugugggugugaguggugagcaugugagcaugagaguaaaugagugugagcaggugaguagguguacguggugugcacuguggaugugagugguaagugagcaugagugugagggugagugugugagugaaugggcaaguagcuguacaugugagugugaauggugagugugugcaugggugaacccaugagugugaggauaaauguguaugagugugaguacgugcaugcacacgcacgugucucugacccucugacuuccccagcaggcuaaggguggguggcugguccugugauggcuuuuccuccgcaggcccacgguggcagugggaacuucagcuggucuucgucaagccaccugguugccacaguuacugucaagggcgugaugaccacaggcagugacaucggguucagugugauccaggcacaugaugugcagaacccacuccauuucggugagaugaaggugagaucucagggccaagacacccccugggaggcucggaugguggucuccagccgcccccucugagcaagccucgacuucacucagaaacacccccaaccuuggguccuguacuuaggagcucaagccccagcccuucccuuaggagcucacggccaugucaggaagauggacaggaugucucacaccagccaacaaugggcccagaaaggccaguguccacagagcuggguuucuggaggggagauaaucuaagagccauucuagaaaauuccccagaccugaaagauaguaaucuccauuuggaagguccaccaagcacuggguuguaaacucacagugaaagggcaccaccaggcuccgagagaccaggccagacuccucucucuucacucaccuuuggguacaaaggcagguguucccugcacagguccccacaccuggcuuuuggcccuaagugacauggggccaucucacuucacaaugguggcagguggugguggucacagcugagccucugccagccccaccuguggccacugaccccaggccauacuugccuagugcucugaccucagccccuuuauuccuucauuuggggcaggaaggggugucccauggaguccagcugcagccugcucuuacaguauuggggacagggauggauaggcuggccagucuuccgcuugagacccagagccaccucuaucuaaagugaggccugauucucauggagagggggcuucacacaggcccuugagaugaagcaugagguccagcguugggauaaacugggaccccuguccucucaccccaguuuccccuugugccacuguucgcccagcagcccagccagauccugaggacaguuccucaggaggcagcgugcguucuggguagaaccuggcuuccggggccagcuggcggggcuugcacucagacccagcaugcuguaagggagccugcccuuucccuucaggccagugcuucgccaggugagugggguugaggagagccccuccuuaaccaggaggugggauucuaguuuuaugcaaucauggcugugcuuaccucucuccuggcuccagccgcucuaccaguccaucugaugagccagacauucagaacacaucccacaucucacugguccuaacacgccugcccuggcucaagcugucgcaucucucucuggggcuuuccaacagccuccucaccacacugcucaccuggcugcugaucgguacacagaagccagggugguggggaccucugaggucccccagcucagccacaguaaacacugauuccucaccaugguugccagccccgucucuuuccacugccccugcacagugcacuucagcacacuggacuccauguuccuccaaggugcuggccugguaggugcugcagggccuuugcacgcaccaucccuucacccagaguguucuucccccaggcuuugccuggcugccuuggcuguggcucucagaucugagcuccuaggccacuccucagagaggccuccccugcucucugucccugaaucaccccacugcccgugacaggcuucucacagauguauccucagugcucagcacacagcagcacuuaggauauccgagcaacaggcccugccucuccuguggaggcagcugagcccaggccaugccccugucuuccagguguaugugaucgagccccacagcauggaguuugccccgugccagguggaggcacgugugggccaggcccuggagcugccccugaggaucaguggccucaugcccggcggggccagugagguggucaccuugagcgacugcucccacuuugacuuggcugucgagguggagaaccaggguguguuccagccacucccagguaaaccagcgcugcugagcaggugccagauacugggauuggggccagauugucuggguucucagcauggaccgccagauucccaaagagagggcuugaggcagcagaggggcugcaacauaaggaauggcaguugucuccugauccacagucuguuccugucuggccuggaucuugcccaccgugugacuucgggaaaucaguggccucgcucagccucaguuuucacaucucuaagcugugugucaucuacauagaaucacaucaaagugccuauuuuagucccuggaaugcaguugguauucagaaugcguugucaauagggguuugguuaauucuaggguccucucaccugugacaggcaaggcccacccaucuguucucugccgcaucugcugugggauuuugauggugacauugguggagucugacugugauaguuuauccagugucaguccugucaggacaggacaggcacuuugcaugccugaccuccuuaggacuuuacaaccacccuaggagaaggaucuguuauuggcccaugugacagaugaagaaacugaggcuguguagcuguagcugccuaaggucacacauggccugggacagggauggggugcagaucugggcguggcugacacugacccuguggcuuuacucaccugugaaacgggccuuaaagauaaggaaaggaagggcuuccucucugauuugccgaagaagaagaccaaaggacaggugaacuauugaauaggaguaagauuugggcagagcuuuggagguuaacagggacaccauuuggugagcaggggcgccuguaccagggcccagaggugggcaguccguggugccugugcacguggaggacugggaacagaggacccguugaaucacagcguguuuuggagggcuuggaccuaguguccaggcaguggggagccacugaagguuuuugaacagaagagcgaugugauccuggcagcguuuaggaagcuuuauuggcagagguguuuguaggaucgccuguggugccaaguggcugugcgugcaacuguagcuguaauuacgugcagagcuuuugcaguuugaagcugcacagaaggaggccaguaucucugaaaaaucccugagcauacugcauccaggagaaacuaagcucaugaagucuacagugucauugccagguaaucauuuaggauggaggaaaagucuugcacgugggagaggcccgcugacagcaggacacgaaccacuccccugcacugccugccacaaccguccuggagggagucugcagggugcugcucaggcaugggcucagguccccgggaggaaaguucagggcuuggaguuccacaggccugggucugagccacuccacucccuugcuggcuguaugaugcuggugugcugccuagccucucugagccuuggguucuuuaacuguaaaaugggaugacagcucuugcuuauugugaugguuacaagugaauaucccucagcacgaugcagggcguuucuccaggaguuugacuucugaaaacagcagucaagaugggaauccuguggugucaaauuucucuuaggaagugccuuguaccgccccugguguggagugugcaugguaauguguagggagguguguagggcccaggcuguaugaaaauauguaucuuagaaaccugggcucugucaggacagagaugcucaccccacagaaacccauggggcucaagagcagguuggaucagcagguugaccugucccuauaauacccacccuggagcuuacucagcuaaagaaacaaauuuggucccauguuagguaaacucccucugccaccucccaggcucagagcacagguagccagacucugaucauggcucugaggaggagcccugguagcccuggcccaggcuggccuccccucuguggcucccucugcuuacugcaguuggacuuggcggucccauuucugccuugcccucuuggguggcaucuucuugaaagccccugggcugugggcacuacuguaacucucucaacacggugcuggcauagacagacuuacagaauagaauacugagcccagauaaaaaccugcucguacauggugaaaugauuuuugguaagggugccaagacuguccaauggggaaaggacagucuauuuaccaaauggugcugggacaaccacguaucgacaugcauaagaaugaaguuagacccuuccauaacuccaaacacaaaaauuaagucacaguggaucaaagaccuaauauaaaauugaaaacuauaaaacuucuaaaagaaaacuggaggaaagcuucaggacauuggaauuuggcauuuuuuuuuagguauaacaccagaugcacaggcuacaaauuaaaaauagacaaacuggacuacaacaaaauaaaaaaguucuauauaucaaaggacaccacagaguacaaaggcaaccuacagaaugggagaaaacaucugcaaauuguauaagggguuaauaucuaggauauguaaagaacuccuacgugucagcagcaauaacaccaauaacccaaucaaacaguaggcagaggacuugaauagauauuuguccaaagcugauacacggacaauaagcacacgggaagaugcucaacaucacucaucaucagaguggugcaaaucaaacccacaaugaaaagcacuacacuccuuaggauggcugcgaucaaaacaacagaaaacagcaaauguugacaaggaugugaagacacuggaacucuuaugugcugcugguguguaugugaaaggugcugcugcuguggaaagcaguauggugguuccucaagaaaguaaacauggaguuaccguaugauccagcaggcaauccugcaucugggugcacauccaaagguguugaaaguacgauccgaaagagguauuugugcacccauguucauggcaguguuauucacaauagccaaaagguggaaauaacccagguguccaccguuggaagaauggaugaacacaaugaggucuauccauacaguggaauauuauucagccuuaagaaggaaggaaauuccgacccaugcugcaacauggaagaaccuugaagacaucaugcucagugaaguaagccagucacgaaaggacaaauacucuaugaucccacuuguaugagauaccuagaguaauaaaauucaugaagauaggaaguauaaugguaguggccagggacuggagugaggggaauugggaaguuacuguauauugggugcagaguuucaguuuuguaaguugaagaguuguguggauggaugguggcgacauccauucacaggcugcauaaauguacuuaaugccacugaacuauacacacaaaagguguuauggugggaaauuuuaucuuaguuguauuuuaucagaauuuuuuuaaaacuuuuuuuuaagauaaaauuuuaggcugggcacgguggcccaugcccuuaaucccagcauuuugggaguccgagaugggaggauugcuugagcccaggaguuugagaccagccucagcagcauaaugggaccuugccucuacaaaaaaaugaaaaaacuauccuggugugguggcucacuccuguagucccaacuaaucaggaggcugagguaggagacucacuugagccugggagguggagguugcagugagccaagauugugccacugcacuccagccugggcgacagagcaagacccugucucaaaaaaaaaauaaaaauuuuaaaauuuaauaauggcagggauguagggcagccguuggcagcaguguaaauugacacaaccacuuugggaagauauuuaacaacagcaaccaacaauuucuacagcuaaacacaugcacgcccugcagccuagcacuuccucucuuagggacgcacgcaacagaaaugcccaggugugucccccaagaggaaggcacccagauguuuacagcaauaccguguagcacagccccaaacuggaagaaacccagaugugcaccauagcaugggucagucuauugcucuauauucaugcagcagaaucauauggagaauguggacaaaggaucuucacggugugaccaaugagaaaucccaugaacacugcugaguugaggaagccaggcacaaaagaguuaugcccaugguucccuuuaugggaacaauaccaagcaugauucaguugugcugguaggcgccaggggggcgguuuuccuuuagggaaaggccaaauaccagaaggguuuccaggagauucuggggguacagauaauauucuauuuguugaugugggugcugcauauaggguggguccaguauguggaaaaaucauugugaauuauauacucaugugaauuaaauauuauuuauuuuucuuuaacugaguuuugcucccucguugccuacgugggagugcaauggugcguucucggcucacugcaaccuccgccucccagguuccagcaauucuccugccucagccucccaaguagcugggauuacagacaggcgccaccacacgcggcuaauucuguauuuuaauagagacgggauuucuccauguuggucaggcuagucucaaacucccgaccucaggugauccucccaccucagccucccaaagugcugggauugcaggugugagccaccaugcccggccgugaauuaaacauuuuuauuuuucuuuugagacagaguuucacucuuauugcccaggcuggagugcaauggugcgauuucggcucacugcaaccucugccuccuggguucaagugauucucccgucucagccuccggaguagcuggaauuacaggcaugcgccaccacaccuggcuaauuuuuuguauuuuuaguagagacaggguuucuccauguuggucaggcuggucuuaaacuccugaccucaggugauccgcccaucucagccucccaaagugcugggauuacaggcgugagccaccgugccuggcugaauuaaauauuuuuuuaaaaaucagggccgggugcgguggcucaugccuguaauuccagcacuuugggaggcugagggggguggauaaugaggucaggagauugagaucauccuggcuaauauggugaaaccccaucucuacuaaaaauacaaagaauuagcugggcgugguggcgcaugccucuaaucccagcuacucgggaggcugaggcaggagaaucgcuugaagccgggagguggagcuugcagugagcugagauagcaccacugcacuccagccugggagacagagugagacucuaucucaaaaaaaaaaaaaaaaaaagaaagaaaucagaucaaggaucaagccugggaugaaagagggggcccccagccuguugugccuuccccaccaaaggugauuucagggcugggcacaguggcucacaccugugaucccagcacuuugggaggcugaggcagauugaucacuugaggucaggaguucaagaccagccuggccaacaugaugaaaccccgucucuauuaaaaaaaauacaaaaauuagccggguguagugguccaugccuguagucccagcuaucugggaggcugaggcaggagaaucacuugaaccccggaggcggaggucgcagugagccaagaucaugccacuguacuccagccugggcaacacagcgagacuccaucucaaaaaaaagaaaaaagugauuucagggugaccaucuaguucucuccuuucuguagggaggcugccgccaggcucugagcacugcagcggcauccggguaaaggccgaggcccagggcucuaccacgcuucuugugagcuacagacacggccacguccaccugagugccaagaucaccauugcugccuaccugccccucaaggugagccaggggcccugcccuuuaccaccccccugcccacuccuucccagaugcaaauuacccauuugcucugacgaauuugcaugauaaacccgauuccuucaaaauagcuuuuggcacagcuuccucucccaugauuucuggcugaaagcaggauucauguggaaggagcagagccucccugauggggcagugguugugggcaucucugugguuacgcgagacagcgcuuggcaggcuuggcaggacaccgaccugccagccucucccaacgaagguaggagugugggcugcaagggcuucagaaguguguucagcaagggucagaacaggggagugcuucugcuccacuccagagcuaaccuucaggguccccacagagcccuagaauuaggacagcggccgugugguauggcagaugcugaggccuccaagacuggggucagagaggaucugcccuggccuagugugcauccauccugcuccccaucugaggacagugguggccacggccugugcggagcagaccacauagccucaguguccauaccacccuccugagcugagaccagccugacccccacccacucuugggccuuacauucccugccuguaaaaugggacugagacagcucuugccucauggggucgugaugaggauuugcugagcucacaaauggaaugagcucagaacacagucuaggggguagugcaggcucaggaaggguuaguuauuauacacggauaaaaaagaacugggccuuccucuggggugggugugaaggcuccgugcgagggcugccaugcaggaggcugcugacuaaucauuccuuucuuugaacucugccuagcuugcaggaggcgcagagaggguuuguugauggggaguuccugcuccuccuuccagggagggcuggagagcaguccuaggggagccccagacucccuggcuuggucaggcaguccuugcauuuuucugcucccagugucagccuugaagacagcuccgguccucaugguuugucccauuuuuuucuuccucucaggcauucauuggaagcaagccuggugauguuaggauuucuuuuucuuuuucuuuuauuuguuuauuuuuuuugagacagaguuucacucuuguugcccaggcuggagugcaauggcgccaucucugcucaccgcaaccauugccuuccaggguuaagcgauucuccugccucggccuccugaguagcugggauuacaggcaugcaccaccauccccggcuaauuuuguauuuuuaguagagacaggguuucuccauguuagugaggcuggucccgaacucccgaccucagaugauccucccaccucagccucccaaagugcugggauuacaggcgugagccaccgugccuggcgauguuaggaucuuuuaucucugaaccccuagcccuggguucagugccuggcacagagcagacaucaaccaagggugguuuuguuuagaaugaacgugugaggaaauguauccaaggucacccagccagggcagaagccaaggccuccugaccuccagagcaaacauaacagacacuucucagauguccauuagugaucagaggccuagcccugcuccucauccuccacacauuuguuccuuuagcacacaggcaugaauaccuaccuacuugugcaaucccuucugcaggcccuagaguugcaccagggcagagaacacagaaccuuuguccccaugaagugacauucuggcaaagagagguagagaugaccauaaacaaagcaaagaauguauuuuaccucugcuugccaugaaaaaaguagagcaugaaggggugauggggguggaaguuuaaaaugaggagaucaagaccugcccccacaucccaacucaagcacagcacugcagcaggugagagugucagagagcagaguggagagaguugaaauccccgagcacagcaggcauucugggguugcccugcgcaccuucugggagcuagagcauuucaccaggcaccuggagagggguucuucagggccccuccuggcucuggauuaucaggguguuuggcuggagcagcagaagccagaagcugagcucacaguccugagcugggauguaacaaugaagauaagguagacaugucccucagggagguggcuuccugauuggacagauuauagagaaaaguggauauggaucucuucuccuuucaucugucuccuuccuaguuagcagguaagaucagguuuauuuacaaggaacaaaagccaagugacagggacuuaaccaauagaggaauugaugucucuguugcacgugaggaauauuuggaauauuugggcuuugacauccgcugaggagccugcacaauucaugagcauccuucaucagcugcguuguuaaccugucuccuuggcacaggguuccaugauacuuucaugccuaagggagagaauuaaacaggaaggugauaauuccucauccuccaguuguuaauuguagaacacacagcuccuucgcacaguucuuucacuuugggcuggucaugaaaaugucuuuggcaagauacacaguggccugcuuugcccauagugggguuuuauugguuguggccaugagauguggguaagagcaugggaucaagagucagaacagacccgggcccaccagcuggguuagcuugguuuagugucuucaucugcugggauuuauccuugcugucuauaaaguggggaugacaguuaauaaucauaacaguuucuaacagcaggggccauugauugagcgugugcuagucacauauucaggucuuucauuccagccccugaaucacaacaguagcaccgcgagguaggcauuaucauuguacccauuucacaggauggggaaacagccuuguagacauuaacuuguuuaaggucccacacuagcuucacuccaguggggacagagaagcaaaugaugguauauccagugaugucugaggggcagagaugaagaguugagcuggaaaggaggugacgggggaagggagacccugcuucagacaggcucagcagaggccugccugaggaggugacgcucaggcagaggccugaguggcaugcagaacugggaguucugagaggagcagagaugaaggcccugagcauacuuagugcuucuccugcaggaaacaggggccacgccuggcucuguugaaggucgaguccggggauggguuacagcaggggcaccgcgggcuccuuggaauuguuugugugugagcacacaugugcagggagggaugcccagagacagucgauaaccuauaucagaucccaaaaauguucauauucaaaaacaaagucaaaaggacagaauucucauuugagaagucauagucuguucaggucgccuuaacgaaacaccuuggacuggguagcuuauaaacaacagaaauuucuuucuugcaguuuaggagcugggaaguccaaggucaaggcaccagcagauuuuggugacuggugagggcuuccuuccucauagauagccauaauuuggauguuuguguccccacaaaauacauauguugaaaugcugacccccacagcaauggagcugaggccuuugaggggugauuagaucaugagggcagaagcuucacggcugggauuagugcccuuauaaaagaacccagagagcuagcaugacccuuccaccgcgugcagggguggaagagguuuuuuuguggguggggagggaauauuuuucuuauaagguuuuuccuuccucaugugguuaagaucaugccacagacagagaaggaaacagacacaccguacccuccacaagccuauagcaugaucagggagaccucucaggccaugaagcuccuucagggugaggagcaccaggugaagugggggccagagaagagucgccugggcugcagguuggggcuggguuggggaggaagcagggcuuucuggaggccagugugcugagcccugcagugugaggaggggucgccuaagugagacaaggacaggaggguagccucuucgaaggccuggggacagcugagccugguucucuagaaggaugccacuagucugaagcugggacuggagccagguugagagagcccaagucccaggacagaagcugagccuguauuccaagggccgugggugcguggaauaguuuaaugcacaagggacagggucaggucugugucuuagugagggacacaugggcagcuguuugaagggagaguagaugggucuagcagggagcagacugacaagugaggacuuggcagucacugcagugggacccucugcagugggagguuagcccagcugggcagggauucaaggagcaggacugcgggaccccucagagugaaucccuccucuccgcaccccugcugugugucacuggagggaggaguccuccuguggagucuccacgucuuccuggagguuggcugggaaugacacccuguuacauagaaucuaagcacugccauugcccacaccaggaggccauggggcccugggcaccacugguugcccuaggccauggaggaaaugagagcuuugugugaaauacuacuuuaauucuuccuuuguuuacuggguacuuuaaggacuccauaguuuuacuugccaacucacuuucauucaacaaagaauugcugagcacccgcuaugugccaggcaugguucuaggugccacaaaacucacccucgaagcucgugcauacguggugcaaaguaugggaagcccagcggcucagaaggaagggaauggaccacuggcaaugaugccagcaaggacaccacaggcugcaucuccuuuggucaccugguggauaucucuuuaggaugguuuuaugcuuuuuacagcaacaugauugugaucaaacggcaccaucagauuuguauccugcacuuguagaucuuugcgaagacugcuuugggggcccgcauaagguuccaucacugggaaacaccauguguacugagccccuugugcuggauuguagauuauuguugguuauuugcugugggaaauaauagugugaugaacaucugucuguacauugacauguuucucuccauuguguuguuagguuagguuccagauggggaauuccuggguuccagggcuguggguauuuucaaggcuuuuaccagauuguuugacgaaagaggcaaauccauguacacccuccagcagucugucagagugagggcuuaauucuaucuacaccccauuccucuggaucuuugcaaugaucccugugagugcugcagaugacgagaaugaguuucaaacaggagauggggcuugccugaccaccagcccccacaagcggggugaggauguggggcugggaugcccggcuccugcccgugcugccuuagaagaaugccaagucuucugccucuucuguccccaggcuguggaucccuccucuguugccuugguaacccugggcuccucaaaggagaugcuguuugaaggaggucccagaccuuggauccucgagccguccaaauucuuccagaacgucaccgcugaggacacugacagcaucggccuggcucucuuugccccccauuccucccggaauuaucagcaacacuggauccuugugaccugucaggccuugggugagcaggugagugggcagcugcuccagacccuccuugcccuaaggcagggguggaaaaugacucucucaguauuguuuuauuuacuccuuggaguaacgcugagagacagccacuccuauuguacccauuuuacagacaggcaaacugaggcguggugagguggaaugugacucaaugaacgccaggcagguguggcaauagggaccucccgcuaugccagcuuucauagaguaggccaguuggguggcuugccaccuccaugggcuucagcaucccccacuaaccaaaccagagcuggaggcuuugaguucgggggucacaaguccaaugucuccagggucguaaaugaaugaggcuguagacccagguuugacacaucuuguugguucuugaggauaaccuggaaaucacaauauuuuuuuuuguauagguaaucucuuaaguuuuuuaaugcugaaaaccaaaagcugaggaggcugaggggaccagacaaaacacaugugugaccugaauccccacaugcuggcuggagggcuucuugcuguucaggcgccuuggggccugacacuccuuccccggggagggugagcugagagcuuguggggcuucuggugggcaucuacugcucuguuuccaaggcaggaagcccaaagcaaaagggguauucggcgggaaucaggaagaugggagagagcccauuucuuugggacgugaaggguauuuccugcaugugugcagggcaaagaaugucaguuggcaauaaaacgcacaugcaugccucccacggugcccuuaugguaucagccaugccacagcugcccugguauggccagaaaagaugccuggugauagguuccacucaccaguggggugguuuuagaaaaacaauaaaacaacaagaacaauaacagcaucauaauaaauaauacaauaagaagaauaaaauuccucaugaauuaaguuggauauauuucuuaucccuggcaugaccccaccaucccuguccccucucagggcuguaagaaugugaccuccaauugggguuaccucuagggcccucccaauccauugcucuguggcucccucacaugcggcaccaggugcagacagaaagccuguguggagucacggaggacacugcccuugguccugccuuauggucaggagggguaggggcucguguccuccaucaagugcauguuaucugaggaggcugagggugcuaccucaagaugggcccugagccauggugcuccaaaaaagaggaggccagauaugacuucugaggucccagcucuccaggcagacagguuucccucuuuucuugcaccauggauuucccucucugcagcagccccuggagcugcagagcaugagcaggcggagggcaggcccugccuccaggcugcagcuccuccugggcguuguccugcagagcuccuaucugauucgcuugcccugucaucauucugcagcaugcacuucccacgucuguuccucguuccauggguguuuucaccuccauauggacuccucauugaagcauccuugaacuugugaauuuucuaaugcaaccgugggguuuucccaggguccugggaaaccaugaagccucaccgggucuaccucuucccugggauaggagcagcccauagggcacaugggcucccaucugagagucucuuagguguugagaaagugcauucccaccugugugccacugggccuuuguuaagacccuguggcauggguaucgucaucacucccauccuauagaggagaaaacugagucagagggagcuggggugggguguggcauagcucagagaggagugagaacucaagcuugggggucugacuguucacugugcccuaccaggucaucgcccugucgguggggaacaagcccagccucaccaaccccuuuccugcgguggagccugccguggugaaguucgucugcgccccaccguccaggcucacccucgcgccugucuacaccagcccccagcuggacauguccuguccgcugcugcagcagaacaagcagguggugagugugggcuaugcucgggaggaggugagggugccacccgcuugggcaggaggacauugguggccucgcccauggucccgagcauugcaacggacauagcuccacgcugcacuuccuucgucucaacaacuggcccugugaggacgcugguuucauuuguguuuuauaugcaggggacacacagcuuggagaggugagagacauaccaaagucacagcuacuaguggcagugccaggugaagauagaguccucuuccacauuugcugccugccuuuguuuggcacucgguaguuuaaaaacaacuuguugucuucugugccuugaggguguuaaaauggggcuugcugucuauggacaggguauguagggucagaguaggcgugggggcugcugaggagaggugaccagcuacagcauccccaugaugugggugacgugggguuguguuucaaaaguaaguguugggagaggaagaaagucccuugggagucuugucuaacagcagggaugguaggggaagccacaggucugcuccccuuggacuugagacacauccaugccuuagucccuagggcauucagagcccaaggugcugaguguguccaggguaagggacaugggacauccucuggccagcaucagcccccagccccuuuucagaggaggugggugagcagcuccucacuccuugagcauguacuuauggagcauguccucugugucagauacaggucugaguuuuggauugcacacuaaucaggacaggcaaggaaccugccucccagagaugacagggagaccaggagaugcacaaauaagauggaucagagguggcaagcgcugcaagggaagugaaauagggcacgcagcagagugaggaggaggcugcucaggaggagcggaguggggcucugaggagggcaugugcgagcucaccgcuaucuaacgcuguggaacucacuccauugauucuuugcgaguccuagagcagacccuggcucauaggaggagcucaguaacuaggagcgaaggaugagugaaccagcgaaugcacugugcaugcgccacuccugucuucacccuugacucuugcagacucguggguggagaagccacacugcuggagaacuggccagggaguagcugaacuggagagcagguccucucuggacaggcagccugcucagcucagggacagucaauucaaccccaggcuggcccagcuuucucauuuucaaagaaaaacaaaucauaccuaugugcaucuucccuguccuuagcguugucugugagcugagcgggccaccuuggggcuggauugguccuggucugucuguuggccaggaccucugcuuuagcccaguguugucucucuggacuuaaauaugauggcugcagggcuugacucugauuuggcuuugcacaucauagaugucgccagaaaauaauggaccucaaacacggaguagcugugugauccaucagugcucagguuccugagccaccagccagccauucaggugugacucuggcaauuuacagccucauuagggaacuuuuguuuuucuuuuuuuugagacacagucucgcucuguugcccaggcuggagugcaguggcgcaaucucggcucacugcaaccuccaccucccagguucaagugauucuccugccucagccuccugaguagcugggauuacaggcaugcgccaccacacccagcuaauuuuuguauuuuuaguagagacaggguuucaccauauuggucaggcuggucucaaacuccugaccucgugauccgcccaccucggccucccaaagugcugggauuacaggcgugagccaccaugccuggccagucauuagggaacuuugagaaagauauauuccugcaaugcagccuggaugcaggaucaagguaauuuuauacucuccaacuucagaggcuacccaagauguguuugcagauuaaauuauuggugaggagagacaccagaauggaauugacugaucagaaugacaagguagagccaggcucagccugacccuggcccucugagcagguccucuagcguguggcucacucacugugggugggcaccaguugcaugggacugauuaggggcuugaauggggcuguccccagauugagacaccagagauuggccacacugagucaggggagguccuugggcucuacaaucaggccagcugaguuccaccccuaaaccugugugaccuuggacaagucauucaacauuuaacgucccuggaccucagccucccuguuuguaauauggggcuuauguuguugccucaaaugggccaguuagcuugcacaugugcuuggccagugucaauuuccuucccuggaggagcauugguuuuccagccaggauugcaucugggggagccauggagcaccuaggauaggucccuacagccccugcccaaacucccggcuucuauauuaugaauaaugaugagaccuuugcaugccugcugauggugcuggccuacucagagcaggguguggauuaagaauuuguagccugcuugaaucaaguguucucuuggggcaagagagcuagaaggaguugggaggagcccucauggugcaggugggguguuuugugacuguaucggucaggcaggcggggccuggccaggcugccauggcaaacaagcccacaucccguagcuucacauggcacaagcucaccucuugcccaugcugcaugagccucucuaguuggcugggagaccugcuuugugucauugugaucuucauuccaagacaugggcuguggagcagccaccauguugaucauggcaggugccacuguggagagaaagggaauguggcaggucgggaucuggcagugaagcuucccccuagucccauuucacuggccagaacaagugccucagucacuucuaaccagaggaugagagaaggguaguucuuccugcaggaucccccucuccccgaauggaaaacuagcccuguuugugaaugaugcucauggcugcccacuuuccuacccgaauguaggaaggcucuaaaaugaccuugcaguccccauauuuaaaucccucaguugugcuuugugugucauagcuggagaaacugaggcucagggaguucauaacuugccugggcacugagagguggagcuggggcugaguccaaguuguggggucagagacacuuggccucugcuuuauggcccagcccacacugcccccaugcuauguggccagagaagggagggauagcccacaggaaagaggcuugauucagcugguuucuaaggggagaguccgcucggggagcgagagaucaccccagaguggugggaauccaggauuuggaccugcagccuggcgcucccauugcgaaccuccuuggaugagcuccuuucccugacugggcuugugcuuccuucacguggggaugaccccuuccaccuuccugggacauuuaaggauuaggcgaguauuccacuuucaaaggagcuguacaaacccaguagcucugggacaucuuaggcguugaaaucugcauuccugugaaaccacuaguggggccauccuagaggcaccgacaugugccugggugggggauggcaaucauuugggaaggugagggcagaggggaaggagagcagccugcccacaguaguaggucaggauggugguucccagcuucagcacuguugacguuugggaccagauaguuccuguggggggcuguccuguguaucguaggguguuuagcagcaucauggaccucucccgaguagaugccaguggcaacccccugacucaugcguagggacagccagaaaugccuccaguguugcugaaggcccccuagugguucucauuccacugagagcuguggucuggagccagaggccagcuuggacagggccauggggggaccugguggguggcaauagugaggauugcuuucuggcauaucccauucccucaccagcacccccaagagcccacagggcagcugcuggccucagagugcacugcguggucaguguccagguccaguccugggggugaccacaacaucugaccuguguucccugcaggucccaguguccagccaccgcaacccccggcuggaccuggcugcuuacgaccaggagggccgccgguucgacaacuucagcucucugagcauccagugggaguccaccaggccaguguuggccagcaucgagccugagcugcccaugcagcuggugucccaggacgaugagaguggccaaaagaagcugcacggugagcugggcacaagccugauggcccaggcaggagaacagagaccagacaggaagccugccaaggugggccagugccugugggagcuuaguuaucugugcuuagauccuguuaacucuuacaauccacauaguuucaacacacacaguugucuguuuucagauucgaaacugcaaaucagaaggagggaggggcugcuucagggguggugaugggcagacauccaacgguggcuuccuucuuccuggucucagguuugcaggccauuuugguucacgaggcaucaggaaccacagccaucacugccacugccacuggcuaccaggagucccaccucagcucugccagaacaaagcagccgguaucucccagggcccaguggugggugggcuauggguagcggggcaagccuccuacuucugcuuaaauuccaccggguaucacaguguccugagucacugucugcuugaccaccacucccccaccccagccucuuggaggccccaggagaggcacugcuauuaauaguaggggaccaauagguacauuggaggugggaaugggaagggcuucucaagaauagcccuuccuggaugacagccaccucaugggggguacagccacaaggaaacuuaggucuugaauaagguggaggcagcagguacaggcuggaaggagaaggugggacuguaacuguauucccauggucccuaaaugccaggaugaggcacuucuauuguccucuugggagcaaacuuugaaagaggcuggggucccgugggggcagcacuggggaggcuggccuggagggagggggucacugaaggggcacaccugugccuauaccugauggcucaguccucacuggcaccaggauucccuugauugggagugagggggcgucacggccuccugccugaugccugagcacccugacauguuauccccaugacuuugcacuuccucccugcccugauguccccccaccccccauagcugagucacucaggcuuccuccccuugcagucuguguuccccugagagcugcucucccuugcagacaccuuccuuguccuugucacccacaaugcacaccuuccugucauugacucacucuugcucuuccauccgugcauuggagucgccucucccugccggcaguugcugcaccccgagugccuggcacaccuguggcccugaggaggugcucaaacacgugauuccugggggccucagaucuggguggcuccuuugugugacacauggugggaagcagagcucagugggucaugugccacccuaggggaugagggcugucauuguccucuccugagccagccuuggccacacuuccaggggacccucccccgaugccuggccuggccagcggccacaugcucugaagcugacccuuugcugugagguccugcaaggcagggcgugugugugaguugcccaccacuggggccugguggguugggguggcgucuucuaagcuggauugcucccaacccucuccucagucuggaguggaggagccagcaacucauuccaccucaggaggcugaagggagaccucaaagggucuguggccauucugcugggcucaggagcaccaggggcuuguggccaggagcaaggccaggcccuagggcuuuugggccuguucuucccgaggggcagccuaaucauguccuccuggaucuaauggccuugcccuuguccuucagcaugacccucuggugccucugucggccuccauagagcucauccugguggaggacgugagggugagcccagaagaggugaccaucuacaaccacccuggcauccagguacaguccuugcccugccaccuuccugggcaagacccacggggggacuccucgcccucccacaugcggcccaacccucccugcaucugccuccugcaggcagagcuccgcaucagggaaggcucagguuacuucuuccucaacaccagcaccgcagauguugucaagguggccuaccaggaggccaggggugucgccaugguaagcuugggccaucgguccccacuguugguuuucauuccuuaucugggcuguugugugguuaauugauugaucauuuugaaagcuagcacuugacucacacucggaaucccagaacuuugggaggucaaggcaggaagaucacuugagcccaggaguucaagaccagccuggacaauauagugagacccccaucucuacaaaaaaaaaaagaaaaaucaaaaauuagcugggcaugguagcacaggccuguggucccagcuacacaggaaccugaggcaggaggauugcuugagccccggagguugaggggugcauugagcaguggucaugcuccagccugggcaacagaccugggugagaaacccagacccugucuccaaaaaaaagcuggcacuuaaucacauuagcuauaauuagcaaggucuuuagauucucugauucauucuacaacuuuagucauucucaugaaaccuuugugauuuguauucccuguccacaaacuguuaguuaccuaaugguuuccuuucaaucaauccuuuaagauuaaaauauuauuccauaaggagcacuguaacagccauaaagaaaauugcuuuuaaaagaugucucaccuuucucuauuuuuccuguguuucucucuugacccucucccuacucuugcaagcauugacuuuagcugugcucauggcauggaagaauuuaauguucugcuuuuauuauguuauuuuaaguuuuuauguuuuugcguguugcuaauguaagcuggcaguccaucuucaaguuugcuaaugcuuucuuuugccaguuuaaaucuacucuugugcgcuucuagugaauuuuucauuucagcuguuauacuuuucaauuuaagaauuucuggccgggugcgguggcucaugccuguaaucccagcacuuugggaggccgaggcaggcugaucacaaggucaggagauugagaccauccuggcuaacacggugaaacccugucucuacuaaauauacaaaaaaaaaaaauuagccaggcguaguggcgggcgccuguauucccagcuacucgggaggcugaggcaggagauggcgugaacccagcggguggagcuugcagugagccaagauugcgccacugcacuccagccugggcgacggggcgagacuccaucucaaaaaaaaaaaaaaaaaaagaauuucuauuuuuuuuccuguaacuuuuccccuuuauugauauucgcuguuugauaugagauuguuaucaaaucuuccuuuacucccuucaucguuguuugguuggaaggcuuugccuggugaaucugaucucugguggcccucacagacaguuucugucaucugccuuuuuucuggaguacgggucauguuuuccuguuuuguuuuguuuuuuguuuuguuuuguuuuguuuuguuuuguuuuguuuuguuuuuucauguccuauaauuguuggaaacuggacauuuuagguaauguauuguagaaacucuggguacugauuccccauccccaugcuggagcuuguuauuauuauuugcuuguuuacuucuuuagugacuggccuuguuauuuugcugaagacacaaaaacacacgcgcacacacacacaaacacacaggcuguguuauuuugcugaacacacacacacacaggcuguguuauuuugcugaacacacacgcacccacacacacacacuuuuccccaguaagaagucucugauacugcucuuaggggauaacaccuugguauguccuuugucacucugggaugacuguggccuuugcagggcuuuuuuuggcugucuuucacugaccacucaacuguugagcugcacuaauugaggcugauugcuccacugucuucaguaauucccuggggcacacauuccuacacaacucaguccaauccuauucaggauccuuugaagggacccuuucccuagaagauguuuaagguuuguucugaccccaggagagcucuuccuaccucucucuuuuuccguuugucucuggcaaacuugccggccuccaguguagcccacaccucccaggcucuccgucaccucccaguugccuuucagcacaacuugcaguguuuuggagagugugcuuaggcuuggacuucuccgagcucuguugcgcaugaagucaguuccuucaggagcaacucacaccuguuuucugggugcauuuaguugcugugcaccagcugcuuucccaggcaaacucucugagccagagcuauggugcugggcacaguggugcaucucucucuggugacaccugcacguuaggagcuggguccuuggugaguggggcagcagcuccaguguuccuuggcuggccucucuuagcagggaaccccaccccaugagccagggaagggcagccgggccccaguauucucacgggugccgcacccaaggcagagccuccaucccacgaauggguucuggguggaagaugagagcccccaccucugagcccacuuuccugggacucagucucagcaagcuguagcugggggcaugguaagaaaagaaaagcugacauccugccccuccuaggaaacgaaucaccugaccgagagcugggggugagggaguccugugaucuuggaggaaccaguauggagcggagccccgcucacuggggugggaggucagggaggaugggcaucuuauuucacgcaccacaggcccuuguucuucccagaugucagcaggcuuucuccaauaaaugcuucuucauuugcuguugcccuuggaaucaucccagagauuuuaaacggcuguguguauguuucauggggaagucuguggccuccuuacacuguccugcagaacuggcaccuccggcuguuuuuugaugugugggggugugggccugugaggcaagagcuucugauuuucaagagaaaauagagaucucuauuuuugugugaaacacccccuguuuaauaaguuuuuuaauucaguuuuuuuguuugguguuugggguguuuucgaaaaccuuccuucagcguuugauguuggucuccagcugucuugcaaagaggauguuuucucagcgccgugccucaaggagggggagggagucccacuguuccuguucuucucagaggcagacccuuggauggcaggacgcccucagcagcuggggacaugcuugugguuggaggacacuggaggaggcgaggagccugagaccacaagcagcgucuccuaagcauucuuauccccucauagaagaaagaacaauuccccagcucuuccuccagccaugcgagugaagagaaucuuacaucuuaauucugacugcuugacauaugccuuguuuuguuuauuuuuggaaauuaauaaaaacuuccccauuaccaagaagaggggaguuccaaguuagggaaaaauguguacagugccagugaaaccgaggcacacucucauucacauuuaccuugcaccugucauucugugcaagcucugaggguggacuugugaccagagggagaccuuuacuccaagaacaagaguuccuagaggucggugauggacuaggcugccgcuguagguagugagcucccugucucuggaggcauuugagcagaagcugggacacuugucugaaagacucaaggugggauuccagcaugggagucaaguuuccccaggagaccuuuaaaccccucuugaauccuaaaaugcugcaauucuaggagugccucugcaguucuguuuuacagguggccacaggggagcucuggcacucucuuucugaauuguggaauggccgcuggccugguugaguggcacagagugcccauugcaggcaggacccgggacgagucuccccuauggcaagcagcagcccgugccacaggcccugcgaacugcucugguccagaaguuuccuuccauggaggcgcccugcccacuggggucuucaccucccuucauuucaggcuugugccaaagacucucgcaacuccaaucaggcccugguuccucuggucucuucugaagccugcaggaggaauuuuccagggaguauugacgucagcagcaaguccugguugcuucagaaacaguugcaggcgacuguuuccgagggaugucuacucguggcuguggcuuuuuccagcugcagagcagcagcacagagauagacaagcccccagcgcuccccaguuagcucagagaaaggguuucuuuccuuccuguugauacauauucagcacggaaggauggcuugcgggaauguguggcuuuggagugucucuggggggcucucuggggcucacgcagcagggguccuguggggguuuuuauccccacacaguggacauggacugugcagggccgugaugaauuuugcucacacagccccagaacgcucuguaagggccuuuauuuuguuuucggcugguuugcacauaggaguguuuauccgauuuaagccuaaguuuuccuucuuuucaacgauucuuuacauuucaaucaaguccucuaggcggaacccaugagaugaccagagcaggggaaggagccugcugggcacuuuacauuucccauuaacucgugcacucagagacgcuggagugcuuaucgugugccaggugcuguguuaagcacugcggauucaggagggaaugaagccggggggcccagcuccugugagccgcagcugugucucuccaucuccuggguccuaugagcugcggcugcuucucuccaucuccuggguccugugaggcgcagcccgucauggggccauuguucaggugaggacauguguccaggaugaguggggaguggguggcaauugcagggccugaagucaggugcauccaccuuuucccugagacugaucuguggacaguggugcacguccccaguccucgcccuugggaaggucacagggcuggccgggucccugugugaaguuucauccagcacccaggccagggccccacucagugccugugauuuucaugugagcuuagguccuucccugcuugccuugagggcggguaaucaggggcacacucgcuuggcacuuccuggcccaucacgugacguugacaagcagccugcaggaaauggaagccgaugacuccagugacauucaaaaauagcugcaaggucccuuauccccugcagucgccaccugucgggacaaaucugaaaugugaucagggcuccaggaagcggggaccgagaugaugugggcagagccuuggggccuggcaagcuccgagguauuugacaguuucagcccccacaugcacagagcugccucuggcugcacucagcaucuuaaugagcaaugacacauuugucaucucugacuugacagaacuuuccucuuggcucaguguuucccaauguucucagguggcaccuucaacacucagaaauuaaaauucauccugggcaugggucaccacuaccucuuuccccucgcaaacauucucccaugugucaaucaggaagcagguguguccagaaugcauggagaagcuguguggugugagcugcaugcacaguguaguuaggagugggugcagggucucacucugccaccagcuagcggccaagugcccuccauuacccaagccuccagaguggccuggugggcacgcccuuacagcaucgcuguggggugcauuuagcugcugugcaccagccugaggggcaggccacgcuucgagggcuccagagaugguagcuggaugcccauccccugggaaaucgaguggaagagcaauugauuuccccacugccauuuuaugucucuguuuaaaaugugcaagaugguucuuuuaaaggaggaaaaaagagaaaaagcccuucccugcauugcccuguguugcccugcguggggcuccgcagucggugcacuauggaauuucuucacauugugaaggaccugcccacuccugacagcaguaacuacaguaggaguuucagguuggagccuuaaauuggguucucaaagaaagcugucauuacucucuguaauuuuucaaugaguuuucuuugagagaaauguaauaaccuggggucaaucagccccagcaaaaccagaaaccugguggcuccuggacccugcuccucagcccauacuugacaccaggcucauguggcaauggcuccagucacaaagcuauuguuuuguaguguaagugugauguccacuccgggaucuuuauucaucuacuguaagucauuguguggaauaacccaggcaugcuuugucuguauugauguacccaucauuacacggguggugugugcagcucgggccagcucguugauccuccgugcccccagccagcugugggcuugggcucuucucagcuaggccuuugcuuuuguccacucucccuccuccccagccccgcaguuccguucuggcugcaggaggccuccagccccauucuccugggaaguggagagucggaggaggagccuaaacugggaguuaggguauuugguucuauccccagcucugccuuuucaaagccauaucccugucccaucaucugggccucaguuaacucauuugcacauugaagugguuggaccagaaucagcacuuuccaaauaagugaagguccaugaggguugcaggugauuuucagaauuuccaagucuuaacaaagcugguuuuacucuguaaagcugagcaggcuggagcaccagguuccaugaccuuauccagaauuacucagagcagcggcccuggaucuucauccaaucaagaugugcucguaggaggcuaggcuguaccagaugcugggcugagucccgagggcaugugagugcuagggacagccuggaggggaaggccaagugcacugugggucccaucaacacugauggcacccggcaggaccagcccccagaagaggggagaagaggugcuggaggagcugacguggaugcaggaagacuguucugaggaaggacgcuggaccugggccuggaggaugacuuggagccagcagguggaggcuggggaaagaguccaggucuuuaaggugggcugcgaggcccggaggcaggcagcagcaagcugucuguaugagugggagagaaggccugcguggcuggagcguaaguguagugggggagggugaugugcauggaaucuggaguggaggcaggagccaggccauaccaggcuuuacagggcgugguaaggcuuugagcucauucucagagcacugggcagcuguugagggguugauguugggagugaugugauccuauuugguugucaccuuugggucagaaacuuuauuuuuauuuuauuuauuuuuauuuuuuauuuuuuuguagcuucuugauauugaaacucuagcuuugcaaacccugaagugcuuacuuuaaaaccucuugcuccccaccccaugaauaugagaccacaaagagcaagcaacaaagccaggcccagauagaggaguggggcagccugcuggacucgccucauggccugucccuacuugcccagcuccaggaccaccugacugaaauaugcgccuaaguaguaagacaagcuguaugaauuccaucauaaacagacauguuacuugugugaaugcccaucuucugcagcaugaaagggugauugugaugcacuuucuuaggggagagucuuaaagguagaaucccuaaaaguggguagagagaaaaggauuaaaaggugggcucuugccuugagcccaggaguuugagguuguagugagcugugaucccgucacugcacuccagccuuggggacagagugagacccugucucuaaaaauaauaaauaaaauaaacaaauguuaaaagggucucuggcagugaaaaggcuggaaaaaacuagcucugauuuguucauucacucacaacaccuuggcagucacugcuucacacagagcuagggaugugaugagacacaaagaugagcgagaugcacauagcucacacugggguggccuugcgggucacucccaggcucugugguuccaucagucugauugggacuuccugugcaagcugccgugggaaagcaucugccucguuuucugccagccccugacuugcgguuucacagaagaccccauggggugcuucucuagcaccagggcugcagcagcagguggccagcucaggauguggcauccugggacugcauccucacucugcccucaaguuggugcacgucccaaggcugcugacuggcccccuuggagcagcuuccauuuucuucucuuuguaaaaugugcaaguggagaucaaugcucugugagauccagccuggcacuaauguguuauaucccaagcccaucuccuggccagcaguggggcucaugacgagaggugggcagggcacuacuuggggugauuucccuuguccacugcuucccagugcuggccuggcgggcucugccacuggcaucccaugaggugauaggcuggugcugagggcgaggcacugcucacaaaccugagcagaggggggcccugcagcugcguaacccaccacccaccccuccaccuccgccccaaccuugcaggugcacccuuugcucccgggcucauccaccaucaugauccaugacuugugccucgucuucccggccccagccaaggcugucguuuacgugucggacauucaggagcuguacauccgugugguugacaaggucaguggaagcuucaugacggggcacccucggcugaccugcaggaacugggagggaggggacugugggaggaauguuccgcauggccuuugcuuuugcuccuguggucugcaucccuuccccugugagcuugcggagcugucucccaucuccuucgcuccauguggaggauccagagucccuucaguaagggacuucuucaucccagaugacauacccaugaggcuuggcaguaaauccugcugucucuaaauuagccaugaccugggaauucaugucuucuggcugguguagguuauuaaccaacgaggcacaugcccugcugagcauguauuuucuucccagaauauagguuuuggguucacuggggugucaguggcaaaugaguacaacucacccaugccaagcgccauugcaaaaagagacaagggauagaucucgguuuaucuuucacacugauacagaauuuuuauuacuccagauaucugaggugacugaagcugggcuuccagaggguugcggucagguuccucaguggauagaagggcugguaauuaaaaggggaguguucauguggcuuaggcuccuuaagaagcuaauaugcuguacccagccucacauacuccuuguauaaucucauuuccacugcuguuugcuaaucaucuguuucuucgcuguguauuucugauucuuauuuccuaaaguucuuacuguauuauacacugccaggugugagcuguucagucagugagcauuuauugagcuccuacuggaugcugcuguucuaaguggugucucaucucccuaauuaguguauuaguuacuuaagaguagaauguggaauuuaugccucuaaguauccccaagcucccccucaucgauuuucauuugcugacuggcugauaguccagaagucaaccugggugacucuccugauucccaggucuguggguugagguuagugaugcuaucucagaaagucacggagcaccauagaugguaggauuggucuuuuggaggcugccccugaaccucuguccccaugaugcagguggagauugggaagacagugaaggcauacguccgcgugcuggacuugcacaagaagcccuuccuugccaaauacuuccccuuuauggaccugaagcuccgagcagccuccccgaucauuacauuggugugaguucuccuaggggucagaggagggcaccucagagacagugcugaccccagcugcagccuuucccacgggguggucuuggagaagucccagcccuucccucuguuucagggcccuugaugaagcccuugacaacuacaccaucacauuccucauccgcgguguggccaucggccagaccagucuaacugcaagugugaccaauaaagcuggacagagaaucaacucagccccacaacagauugaaguaagacgaguucuucccacaccaugugggaucagcccagugcuggggguugggagugucuuuauaguacaguccaggaagcuacuguagagaagccauauaaaaaucugugucccacaauguccucucaucaaaaggcagcuguuacgagcucuagggaucugggaggcagcaaaguuagacuggcagaaccagagggagggggccaagugacuugaccuuuccucugugacuugggggauuguguggcucagagaaggggugugccuggucacauggcaaggggacacaccaggacuauucccagaaagcacugacuggguggaagcuuagacagaugcugacucauguguagaagaacuccuuaaccauugguccugagccuuagaacaggcacuucgagggcagugggcaccugucacaggggcugcgugagcagagguaucauaaagggaacuccugaaguaggugauuccuggaugaagggagcuuugagguccccacaccagcucagugugugguauggggcugucucggggcauuagguuaugacaggagccccacugcagccacaggccauggcaguuguggcccaggcauuguuuuaagucuauucacagcagcggcauuaaaccagcccugccagcauccacccugcauccgggccacucgggggcuggugagcgucauuaaucugugauccgaagcaggugggugccaucugugucucuagauggaggugcaccuuucuucuggugaugagaaauuuguuucugcccaucaauagcacagcuacagagaccgauacucccacacaaguagcacccuggccaccuccugcguccacucaccuacucuugccaggcaggcucuuguagggguuucaggaggagcaggugggggcuucaccugcugcaaagaguggcaccaacgucccuggucuccucccaggcuaauccggagggugugcuagaagagcaaccucugggggucugggugcucccauaucggcagggcuguccuguggggccaccccuggcuccacaggccagguggcuggggcuguacauugcuaauguguccccaggcgcugcugacauugcugcuuagugaccacacacugagaaccgcugcucuaaggggauggcucaacugcauaaaagccaucccuccaaggggacggcccagcuuuuggguuuuaacaucuagggaaagugaaacacagucacaaacagaagaacacaccccagagaaccagggagccucggccaguggcugggagacagcccccagcauuggcccaggacccugggcccucuggucacugcucagagagaagugauguccaugucccagguuuuccucucaugaaacauguagugugugaguuaugcuuggcgccaugggcuuggggcacaguaguccuuucucuccugugucucucaacaggucuuucccccguucaggcugaugcccaggaaggugacacugcuuaucggggccacgaugcaggugagagccaagaggccacguccugcuccagccccagugcaggccaccaccugguuccaggcacgccgccucuggcccugcgugcagugacugggagaagaaggcagaagcugccugcacuggggcccuggcucucugagugggaggugcgggcugccuggcaugacgggcacugacacgccgcuguuuccuccccgcucaggucaccuccgagggcggcccccagccucaguccaacauccuuuucuccaucagcaaugagagcguugcgcuggugagcgcugcugggcugguacagggccucgccaucgggaacggcacugugucugggcucgugcaggcaguggaugcagagaccggcaagguggucaucaucucucagguaacaggcgugcuauuggagacugggcagcugugccugggacagaagccucuuuacuguguuugaguucuaccucugaggaccaccccucuccaagggugcugcuucugcccccugggucugcagucacugcaggggcccuggugcaggacagcccugccaauaugggagcacccagacccccauugguuguucuucuccaagcugagucucccaguccuuccagcugcuccuuaugggacaggguguucagcaacucccggccccaaagggcccuuccaguggaggaugauggcaaucauggugaaggcagaugcugcucugagcacuuugccuucaucuccuugaauccucucaaggcucagggcuaaaaucagggccuuugcauucucccugaccuccuucgccagcagugacuugcagaagcaucucggaaggcugcuuugggguuccacucacagcugcgccagaaaccuggucuguaagaagagccuucugugauguguaaugcaacuguggacagaaaccuguuucagagucagucauaccauuccucaugagaacuagguccccuggaagcaguccgugcaguccugaguucagaaccuguaaacacagcaccccagaagcuggcaagugcaccgcccuagagggggugcagggaaaugcuuguucucagaggcugacugugauccgucauugaguucauugauuuacuccuuuucccagugugugucaauuaugaagacaaagagaaagacuuggggauguaaaaaccuguccuggggaugggguaggguucagaugggcuuccuggagcgugacauuccagaccacaggagacucugugguuuuuuuucucuaaaaaggagugcagccucaggagcuggcugauuuuucuccugagggcguagguaaagggcagcuggcuagaaauucagcaagaggggcacagggcccugcguauuccuugucuuuguggucuaaccuugcugggcacccucccuucuaggucccccaucuggcagguuggggaggugcuggggaaaggcccuggugguccuuggcagguggaggggcugcaccacgagcccuaucugaaaggcauguucugagcccaggcaggcagagguuucaccugcggcgccuuguccaugccuggaaugugauucuggucagaugcuuccaguuccaucuguccaauccagagcacacaaccagcaccccaaggccguggggugggccaggacuagcaggaagagacugagcagaaagaugagugaaaggaggggaaugggugcuuuucaagcacuuacugugugccaggcauuagcccaagucaugagccucaagaugggcucagccugagcacgucagagagucuaaggguuuuaauagccucaguucagcaugacucagcagcacuaggaagaagccaggagaguuagucuuuggccagauuaauaggaguguggaguucagaaugaaggagguuauaaguucugaucagacucuacagggcuccugcauucgucccuguacccugcucagucagagacaggcaggcuggauuugggguugggagggccuggagaccuuuugcuugagggcagccaggccuaaggaagagcaggcaccaguccccggccccaagucugcagugcugaccuggaacagcuggaucagacagggcagcagccucaggggacuggguugggaccugcggggccuugggagaggcaguggcuggcccaugaggggagagccacucacaaagccaggccucccucggcagaggagcauggugcuggucauccugaggggccuucucgccacagacucugagccgcagccugcuucccuugaggggucccuuccugaaacaucccuggccagcacugcauccccacaccuaagugccacccuguuuccccaggaccucgugcagguggaggugcugcugcuaagggccgugaggauccgcgcccccaucaugcggaugaggacgggcacccaggugaggggaccuccugggcucugaauccugguucccgaagagccacugcugggacccuguccucaaguuagagugcuucuccaccuccuccaucugccuggcccggguaucuagggccugcuucccaccuguccccacccagggagacacccuccauugcucucugguagccacugaugaaggccugcuuccugcuggccugucaccuucccacaucuggaauaguaccaggugccuaacaggagcacagugacuguggcacuuaacucaacuccgugcugucuuggacauuaauccauuugguguucauagcagcccugggaggcuggugucagaaccaucuucgugucgcagaugagcaaaugaacacacagaaagcuuaagacccgugcccagggccacacagcuaggaaguggcagcagugggaguggacugggcagccuggcacaacaccugcuguggccuuuugccgucuugccuccgccugugcccucaagccgacacagcaaauagagacuaaaggagccagggaccccacccacacgugcccugugagcagggaccccagcuagauuaggagagaggggcccggaggaaccagcacuguggggcagcacgagcugugcugcugggggacccauggccuccuagagcuccagggacuccuuccggaaaugaguaucuuggccauggagaggugcagcccgcugcaggggagggacaguauggggaaaacagucccaccucugguuugcucguuugauauuucaucaaaauucccaaaccugugccaugcucuucucuaguuggggaggaauuggguucaucucccacugcuugaaggaggcagcaaagcuucugggggcauucccagugcugggagcuacugcucacugggccugacuucuccccugcagaugcccaucuaugucaccggcaucaccaaccaccagaacccuuucuccuuuggcaaugccgugccaggccugaccuuccacuggucugucaccaagcgggacguccuggaccuccgagggcggcaccacgagguagguaaccacccccuccagagcucaccucccaccccugucccaggccagcaccccgaguggcagggaggguuccugccacauugucccacaggaaguccccacccucacaccuagagaggcccgcccacuuucuucccucucccgaggcucaucgggacucccuucucccaaaugcuaaacacauagacggggugaguaggugccucucccaacagaagcagccgugugaggaagucacaaaaguccugggaggucagagucugcagcuucugaccauuuucugagaugaugccuggcagcccucgguuucuccugguucaucccagaggccaaauuccccuucccuuagcccagcgaggggcccuggcuucuccuaagaugucagagcuggaaggugccagggagacuacuaagucugucuguguuaacugaggccagaaacgggaagggacuugcccaggguugcccagcaagccaguggggaaaugguacugggcaccagccccugugacucuaggcccaagcccaggugggccuuggacacacaggacccaaguggaggguggcuugaaaggucgcucccugccugauucagggacaguggggauggaggccuggaaagagaccaaagcccagggauaggauuuccuaaaggcugccugaagcuugucuagugugggacgaaugccccccgaccccacccagugggaacagaguccugucccuggugcccgggggcucccccagauugcucccauggaacacaaacagugagacuuauuagcagauauccccaaacagaauagucugcagggacacacugcaaaacccagcaucgcucugggugaccuagaagcacugaagucugagggacauccugucaugaaggccccuggcuuacgugggugggcccaguguuuuccaaaugcaucugugcauguugugcgaugcaggcagggcaggacccgggcacccaugcuggggaagccgggucugcacagcucugggguuagcagacccaacccaggcaggaaggcagagcccuugagaacaggccagcagcuaccaggacuggggggcuggggggucuggggcuacuguccggcucugccuuuuugaggacacaggggccugggccuuaccccugaaaacguguuugaugucuucccaggcgucgauccgacucccgucacaguacaacuuugccaugaacgugcucggccggguaaaaggccggaccgggcugagggugguggucaaggcuguggaccccacaucggggcagcuguauggccuggccagagaacucucggaugagauccaaguccagguaggaggcagguggaaaggccacagggaagggggagaggaagugccagcugcccaaucuuccuucggggccacauguugcaugggcaggggcugagagaccugagaagcucucaguccguggggaugacagugguccaucgcagugggguaaacauccgggugugauuggugcuaugggagcccagagguggggccaagcaaaggcuucacagaggaguaauguuucaggaugggaggggcuggcaaaggccuggaggugggaacucacuugauguguggccaaaagagcaaagaauucugagcuuggggcucacugugucugaguggcugauaauuuaaucguuuguguuuauuuaacacacauagagcacccaacagaggcuggggcgcccuugcacguuuuucaguauugcugccuccaguccucaggugaagccugcggggcaggggcugcaggggcugccaccugcugaugccccugaggcggggagggucaaggucacaggguaaguuggggguggccucaagaggccuggggacugugcccugucugcauuuggaaaacagccucagagagggaggcgccuuguucagagccaggggucaggacugcgucuagugguucuccugccuggggugcagcccugugucuguauccagccugucccugcuacuuauaggaugggcugugggcgaguuccugccccucugggccccucugcaagguggagaguuggcaaguuggcucugaagagcauuuuugucuucaagggccucguucugcuccucugggccucaguaaccccugggugcuccuaagcuguaaagaaaaacaaaaaguguuccuuauaugucccaagaaaagaaacaguuucuaguccccgccucaagaagaaauaaacuaugucuaacccaagcaccucccugaucaggggcaaagaagcaaacuuuucaagaaagaaacacccacaaaaaaacccccaccgaucugccaaccccucaccccugccugcacaugcacacacacacgacacacaugcacacacagacacacauacauagagacacauacauacaacacagagguacacaugcacauccccacacucaccaaaugcauguucuuuguuaaaaggaaguaaguccuggagccuaucauggaauuaaaggcaggguuuugcagcuuccaaauucuguaaccucaguugggucacuuggcagcucugugccucuguuucccuaucugacagcagguagaguuugaguaaaucagaaacuagagaaucuggauccagccuacaaacguguuuuauuuggcucacucaggccuuugagacagcuuguugucauguaaagauaggaagauuccagguaaaaaucuaagaugcagcauguccuaaagauauggugucugccacagcaaaaucagcaggcaaugagaagcaaccuugacuccauuagagcugcacucuccaguuugccacaggccccgccacucccuguuuucucccugacagugauaucaaguaucaguugccauuuaccauggugcucaugcuguugcuuuucuuauaguuaacaggaaagugggaaauaucuuacaacucccccuccaucuaaagagagaaaauaggaaugcaugguuuaaaaaaaaauagaaggaauccuauuuaugaauguauuuaccaggcaguaaguguguccgagucagacucagugagguggcuuccguguggaugccggaagggggcauccgagucagccucgucucaccugacgccaaaaccccacccagcucccaaaggcuguuucucaccguuugggaaguguuguuccuccugucaccucauauggagcccacaacucucaagacaggcauggagaggacguuaguuguggaccauguuacacacaaggaaaucuaggcuuacguggacagagcacagaggagcugggagggguggaaucaggccaucuuccucucagagaaucacucgucagauccgaugauauuggccauggcccagggcucaggcccgagggguguccaccuggucugaucagaggccaguggagagcucagggcacagcuuuaccugccagcgagugguugccccugagccaggcugggaggccgaggaggcagcagcccugaggggccugagagaggggacuuacacaggugguggacacaucugaagucuugcagagaaggggccuggaguucccagguaagugcuguugccaugggcucggggagccaccagggccuuggagcacuugggcgucccaggaucagaucugagccgaccucaugaggcugaucauuugccggacugagcuccucaccaggccccugugugugucuauguggauccugcaagaacauggccagagccagccagaggagccugggagguggaacggggguuguucugagaugguggcagugaggagcaggaugucucugugagagaagggagcaguucgguggcaccuugcccaggcucaguccuggcacaguuauccugagcaaacccuggugcuggaguugugugugcugcccuccgcgcucacauccuggcagguaaaguucuuccucacugggcacggagggagaggccuguguuuccaggcuccuugaaggagcucccauuagacuacacaaacaugagccugccugucuuuucucaucauaucuuuggccaugugugugugugugugugagauagggucuugcucuguugcucagacuggagugcaagccucagccucccaaguagcugggacuacaguugcacacuccaugccuggcuaauuuuuaaaauuauuuuguagagacugaggguuugcuguguugccuuggcugagcuacucuacccggccacaccuuuggccucuuaaaggucagcccuucacaucaugucaucagugaccugacagacgagaaagccgcuuuucuccucucuggccccuccucggcucuugcugcuaggagagaagcagacaucuggccugaaugugacuccagugccccaucggaagugaaacuugcccucucuugcagguguuugagaagcugcagcugcucaacccugaaauagaagcagaacaaauauuaaugucgcccaacucauauauaaagcugcagacaaacagguacgugacucagcucuuguuuccagcaaaguugugcggcugugcuugcauccgacaccucaugugucaacacugucaggagccauggguacuuucagggagguuuucuccugcugugcuuggaaugggugaggccucugccugcuccuucucuucucuguggugcuccucugcuucuugaaaucacuucucacugugggucucuuuuuccuccuuguagccuagaaacauuuuuaugcgagguacuaaaauucagucuuuaaaagggaaaaaaacaccagcuuagaaauguuguguuucaagacuugccacucagaguguagcccaugagccagaagcaucagcaucaccgggaagagaagaugcagcucucaagccccaccccagaccugcccagggagaagcugcacccuagggagauccccaggcgagggggccgcacaguaacgcuugggaaaagcuguuuaaagcucuucugcaaaccuaauuccuaccuuugauuccaaggggaugccuuucguaacaguggcuugcauuugaauggcaguugccaagcgggagacuccacgggccacaggacacuuacauguugcaugaaacacauacauguuuucauucagccaaaaguaacaaagugccaggcuccaugcugggcuccaggaacacagauaugggugacauagggugccccggaggaggguagcaggagaaggcuauuaaaaagcaagguguaguauucaaaccagagcccaaagaagggugcuguccauggggauuuaggggaggcaugucccagauggagaugcucgggcugcaguucuugaaggaugaauaagaguuccccagguuaagaggaagggguuggugggggaagaauguuuaggcagaggcaauaacauuugcuccuagucaucuauagggcuguggaagagacagagaugauggaaacuagccgugggagcuggaggccuuugcuuccuggguuucuuuauuauauuaauaaauauguaaaaggguaacagauacggcauaauuugcuuccuacccaguacauaguaucaguaguuugcuaacaguuuucuuagcggguagucuguuuuuauccuguugacaguccuuagaaauaggacaagacaggaucauuacacaccuuuuaccaaguaagaagucaacgccgagagaagaggggacauaaugugcacacagcugguggcaggacauguugggaccggcuuuggauucugucggacucaaagccccauccuccacuaugccaggaugccuugcuucaguaaauugagaacaauuugcugcagaaaugauauuuuacaguagaugucccauggagcugaugaaagaaacugcccucauagucucucccucccugcuggcugacccacggcaggcacugcucugggaagagugagacgccacacuuugcucggaaccauuggauuucugaauuacuuuuccgugggugacugaugaagccucagacaacugacggcacgugguccugagguccguggggccaagauugggccuuuuuuccucccaggagcaugaggagccacagacucuuagaucuccuggcauuguauccaggcccacucccacugcugccaucuacaaaaacagcucuguuuuguuuuccaaagggauggugcagccucucugagcuaccgcguccuggauggacccgaaaagguuccaguugugcauguugaugagaaaggcuuucuagcaucagggucuaugaucgggacauccaccaucgaagugauugcacaagagcccuuuggggccaaccaaaccaucauuguugcuguaaagguaggguugcauucuccuccuuuuuggaguaaugaaagcaauagcacugagguaauaugccucucagguguaaaagugaauacguucaccuuccagcuaagaaacuguagacaggcauuuagaguaacucaggggcaaagguccuagguagauaaaaagcuacagcaucuucuggucaucagagccgaagauccuugggaaaucauugauuccaagaacuucauuucauagaugaggcccagcaagguccaugauuggcguaagguuacagagcugggacuggcaccacagcuuccugacuggagugcgggugcuccacccacugugccuggccacugauguuaucaccacccaugguggagcuccuguucugggccagcccagugucuggaacauggucuguucuuaagagcauugaauguugugcucaguaccugccauacaagucgugacauccaguacgugacauccacugugguuuugagaaugagguggcccauuuuccagacaaggagacugaggcucagagugagagugacuugcuuaagcuugcauggggguugagugauggggucugucugguuugggccguguccuucugccauaucauggcacugcccucugccguucuguguuccuuacggaugggaccuucuccaucagcaucccugggucagguccugggguuuugcugaauggaauuuucuuuccaugucucaucaucaccacuugcugaacccuggaugacagaagacacacacucacuuaaaucuuuagacucugccugggucacagaccucuuucauuaauucacaucauuuuguuucaaaaugggugccuggcagcaaaucccccgcucuaguuuuuggugagugaaagugacugacugcucauccuauuucaacaaauauguacugagcacuagcuguauaccagacacugcaccacugaacuuuguuaaagaaauucagaccuuuggagcacuagcuuuugagcgaggauagauuuucaccuggacucagagaaacaagggcugcuguuuauggagcucggguucuugggcuccagaaauccccauuucccuccuuccccugguggccugcagggcaugcuguggccugcuuagcgcugccccugcgaucgaggaggauuucguuucuuuaaaugccccaagagccagguucucugaagaaacuggacauuugcagcccagggggcccucuugcaauguaaauagugaucucauuuauucaagucauggauugggacacuccuggguggguuuucucauagagaggccagucugcuguguugggaaguaagaaccuugucacuagguugggacacucuggggaguguggccuuuacuccucucaggaccccuaaguccagcccugcauuguuccugagguggauccugcugggggcagguguccccuccuugggagguggguuuuccuggaggccagucccuggcacugaauccucaucauaccuguauguugucccuuagguauccccuguuuccuaccugaggguuuccaugagcccuguccugcacacccagaacaaggaggcccugguggccgugccuuugggaaugaccgugaccuucacuguccacuuccacgacaacucuggagaugucuuccaugcucacaguucgguccucaacuuugccacuaacagguaggaugugggcaagggucauuucuccuaugaaguccugucugguaccugguagagacaacuggggauaacacagaaagucugcugcuguugaaggaagauguguauuacuucaguuuccaagagaugugggcaugcugcaccaugcagggccacgaggaaacaccacugcccuugggggauguagaccagcucagaggaagacagacaggcaucagcccccaaaggaggaaacagggcauggggcagcuccagggagugcuccccgaggcacaggaaauuggcccuucagcuucggcugcccacagguccugccacaguuguguuucccuguugcugaaugcauucaaagacaggugucagggguguugccuuauggaaagaacugggguuuagagucaggccugguucuagccccagcucugcccuucgugggcccugugaguaggucaccauccaaaaaucuguuuccacaccucucacguugggcaauauggccuagguuccagggcuuuccuucagcugagggaguggucaugaggaccgcuggcaaaccauggcacuccgugugugcgcacauaauugccauccaucaguuuagggcauguccuggaggaaauggagcccaguucucccagcccuuuggcugcacugcaggucauucuggccuucuuguagcaggagcaccugauagagaccuagucagcacucagggucagaaggugugguggaggcaaggaugcagccaugaucccuaacccaaacugucaccccacgcaguccacacuucugcaccaaagcugccauugccaacauugacugagcaccugcccuguggcaggugccuccccacugcugaccucauguaaugcuuaugccaggccugcgucacggucacgugaugauccccauuuuucagaggaggaaaggggcagaggcugcuucugcagucagguugcauaguaagggcagccuucccuuucuggcauguccaguucccuggugggaagagcgugaggaagcacucuggaucucuuuccccucggggccucagcuuccuuucugaaaugcaggaaugaugcugcugccacuguuuggcugcgagcugcaugugcuuucuggcaugacaagugaggaggucgagccugugccaccugccugcaguggucccucaucuggggccacugcuugguaaccucgaguuggggccacaccugggaccucagucaguugaaugcuuugcucagcagaggacauggauuacguuucucccuuugggaguuggaagcuucuuucccgagacugagagcccuccuuucucuccugugccuagagacgacuuugugcagaucgggaagggccccaccaacaacaccugcguuguccgcacagucagcgugggccugacacugcuccgugugugggacgcagagcacccgggccucucggacuucaugccccugccuguccuacaggccaucuccccagagcugucuggggccaugguggugggggacgugcucugucuggccacuguucugaccagccuggaagguaagauagauccugagcaagggaaccuguggagucacggacgcuugcaaagcugggugggggcuaccugggcaggggcucggcaccagucacgggggccuacaggcagaccugcaggauacucaggagcagugcuccaaaacugcugcccggagaccagauccagccugugccuguuuucugcaaguaaauuuuuguuggcacucagcugugccaugcauuauguauggucaguggcuguugucacccuaccacugccagauuguguggucauagcagagauuguaugggcugcauagcccaaaugcuuauguccgaccuucacagaaagcauuugccagcccuuuucuggaacagcucugccaagucgguggggggguccccugccccuguggggcauccugucucugcauagucucacucaguuccucuagccaggagacacacggaucucugcugcugcugaggaacugaauucaccauuuuagugaauucugugggaaguggccgccauaguggacagcacaggcugggagacuuaagcaaagaaggacacugggcuaaaucaggggcuuccaaauuucagccaugcccaggugaccuguaguacaucuguggaacacguguacaauuauuuacuuagcuuuuauuuucaaauugucuccaccuuuuuuuuuaaccuuacuaaauucauuuuaaaaggagaugaaauacuaccuuuaaggaaaaacaaauauaauuugccauaaauagauuaugguugaguccuuuaauuguacuuauuauauaaugugauuggcuuuuaacucagauguguauguggugaaagcucugagccucacaccugcugucuguugcuaaaaaggaauugauaaggcaacgaagggauggggaggggcugugcuuuggggaaggagcuacagagggcagggccuggcagcagcaccagaccauuccugggcaggagucagcuaaagcuucaugccaggauggucaggagauuccaggcagggaguugugggucagggagagcaggugcuaggggccacagcccuguagagggcgggugcagcaggguaggagagcugauggcuccagguggcuggagucaggagcaugaccggcacuggggcaggcagcguggcugucuccugaggcugcugagugagcccccauggggguagcggcagccagcgaggaagcuggccugucauccaggugagcugggcuuugacuggaguguccagcuauggaaagggggcugacaccugugcuuccucuccaggccucucaggaaccuggagcuccucggccaacagcauccuccacaucgaccccaagacggguguggcuguggcccgggccgugggauccgugacgguuuacuaugaggucgcugggcaccugaggaccuacaaggaggugggcucuaagcagccggaggcacauguggcucaguggccugugaggcgggccugaccuucugggaggauuaugaagacuuuuccuuuuagggaaaagccgucugagggguugggucugggagucaugagucugggacuggccacuugcugacucugacauggggacaagcucccuuuuuuuuccaggcuucagucuccccauguucaagagggugugaugaggacaggcagccuuguaggguggauuccagcucccaugggcuugggucuggcaaccccggagugggcacuuccugggagccggugcuucccugucaccugcaaggcuaagacucccugugcaagucacccuuugagucuggaggcgacaaaaccugcugucucuuccauucaucuccaguugagaaugaaucaguggggcaagucuggcugagauccaaaugcaucucauuuuuagaggcagcaugugcuuuauggaaccuagcaguuuaaccuaauuguuugcauauuuagugcugcggcucugcaguuugggcgagccaguugcagacagaggcauccugugacaauacagcugugcucuccuggaaagagccucuggucaggggaugggguggcauggacaaagguguguaggguucaagggcagagccucgggggcuggaacagagggugugggagaagcauggucuggcuuugugaucagaucagaaaaugcaccagauuccaggcaguuuggugcagguugaggguggggcaucuacagcuagacggucuaggucaaaucccagcuuggccacugcgaggcuaugacugagcaaucauugagucucgcuaugucccgauuuucuugccuguauaauggggaugauagcguugugaggauuuagugaguuagcacgucagaagccccuaggguggugcucagcucauagccagugcucagcagaaauuagcugcugcugcugcugcuguuccagggugaagggguagaagcuuaugccacacucaguggaguuuuuuaaacagugcuauagaccaaggcuguguuugcagagguuaccuggcaccuggaggagcucgagagagcagucgcuacaggguaacuggccagagacugaggccaggcccucagcugggaucacuggguguggcagaaucuaaaggcagguuugggagagacgggagggagggaggcacaucagagcuccaugagcauccagaagugaggcuggaggggaggaagggcuugggaugaccaggcugcuacugguccuuugcugagaggggcacacagagguagguaggccugcagggaggugaggagccugggccggggagcuagagaugucacagcucucccaggugaggcaggaggcacaccugggugggugcggcaggagcacugugaggaaggcuggacagggugggggccucagcccagaaguggccucugaagcccugggagugggugggagugcacgggcacuccaggagugcaggcaggagaggggccaggaagccuugggcacucucugaggguggacagggaggaaggggagaggagggccagcguuggggggucccaggcuagagagugggacacagccucugucagucccuggagguggauggugguaagcccugagcggaggcaccgugaguuugacagugaugccuggucaccuacagcucugcaugggccacaucccugggagcugcaggggcuucaaucgcaucccugcucugaaguucaccuacugguagaaaucagaucuccuggaggcagggagcgcuggugccugcugagagagggaggggggccuucagcugcaggaaguggccuugggccugaaggguggaugaggcugggcucugcagagaagaugggaggguguccuagccaagggagugcagggaggucuccagccuggggcuguuuggguguggccagguacaggaugggcacagggggaacagcugggaaaaucugggcagacuggauucugggugggguguggugcuguacuacagagaagugaucauggcuguccgaacagccaaaauccucagcccacccagaucgauuaaugaauucaggcccgcugcucagcguccagucagcugcugggggaagcagcuuguucaaugggagaacugggcugugaagucugaccagacugggcucaaacccccucucugccacauucuagcaaggcguuuaggcuuugagccucaguguugccaccugugaaacgggugacacuaugucacagacugcagggugagguuguggaaacgcccagcauggaccgggacacaggcggcgcuccaugaagcuuccuuggcucccucucuaggugguggucagcgucccucagaggaucauggcccgucaccuccaccccauccagaccagcuuccaggaggcuacagccuccaaagugauuguugccgugggagacagaagcucuaaccugagagguacuuaaugaggggcuugggcugucuucagaguaccugggagcggggagguggcuuccuguguccucuggauggaguuuaucugcuucuccuauucacacucacaccaacuccagagagggcauuuagcccccacucauccacuccuuccagcguuucugaaauuggaguccuccaaaagcugagccagugaaaggaaucuucauaauggagcccagcucccagaaggugccuguucugcacuggaaaugugacuucagcccgagggcacccuagcaaagaaagccacaauuucccaccgugaaucccagaaacuaaugaauuagcaggacucgucacugguuuuaauuuuuguaaugaccucucccaggucaugcauagaauguugaaccccauccccugcccaugacagcccugaacagcagcugccagaaauaaguaagucaacagggcuguuuucuuaaaccaccucacuggcagagugaagcaccgcccuucucguccugauuaacgaggcagcucuguuccaucauggcagccucugcuccuuccucagcgcaaguggacagcacugugccguugccuaaaugcugcucagauguuaguggagaacuagugcccucugaaugugcagaaguaaauugccguuuccccugcugacagggacagaagacaggcauuagugggccuagcccgucugccgugccccuggaugcaaggucuggaacaaaugcugaaauucugacuugaagcucccugugaugccgauggcauccucuuccauaugauauguccuuggcuuuaccaauccuggcugcaucucaaagcuuugagccgcccuggggcccugcuggaagacaugcaggggcagguggcauuugcagcccagccagccugugcaggccugguggaauuuggugugguggccaucgggccuggcccacacccucucgucucuccccucucuaggcgagugcacccccacccagagggaagucauccaggccuugcacccagagacccucaucagcugccagucccaguucaagccggccgucuuugauuucccaucucaagauguguucaccguggagccacaguuugacacugcucucgguaauugcgaggauuugaaagugaaagggacuuggagacagucucugucuucugggcaucuugcggcuuccacgugcccagcucaccauggccgucuguccagagggcagagauugucaggagcccagccuggggauugacgccagggggacuugggaggacugcuggucacagaggguauccuagcuuggccaaggccuuuauaggggauucccaggaggacuccuggaggaggugacuucucaccugggcuuuggaggaugcauaggaauccccugguuagagaagcagggagaagaaaugacaucagugcacgggcaggagaggggacaagacaauacacccuugucuucgcaggccaguacuucugcucaaucacaaugcacaggcugacggacaagcagcggaagcaccugagcaugaagaagacagcucugguggucagugccucccucuccagcagccacuucuccacagagcaggugggggccgaggugcccuucagcccaggucucuucgccgaccaggcugaaauccuuuugagcaaccacuacaccaguuccgagaucagggucuuuggugccccggagguucuggagaacuuggaggugaguggcaucugcaugccucaggccaggccggagucaggggcaucaggaaggcccuggaggaagagggaaugugguguggauguccugggccagcucucuuuaaaauuuauuuuuacaauuagaauuuuuaaauugaaguacucuuuucuuuuuccauagcacuguugcugucucucaggcugcgugauuguauuaauuguucugaccgcugcuggucuuccccagcuacaaguuaagcuugugggggcagcagugagaaccccagaaaaggugccagugagcguguggugcguggcaucgcagaauucagugcaggagcaucugccacagagcagggaggaaagcccuaaucccugcugggacaaguccccucucuccaggccucacuucccccaugacuaagucacggggugggauuggugggugaaugaucccucaggcccagagccuggcaggcugggaagaguucgggggugagagaaccaaggaguuccucggcauuuccgccugcuccuccugccuugcugcagccagcgugaucgcauguucugcagaggcagggaaugcucagcaucgcugaugagggaggagggccagcccgcuggcggcgugagcagagcucgggcugcuaccuuggagagcuggugcuuggugauacuucauguugguuuagccuuuuuuuuuuuuuuugagauggagucuugcucugucgcccaggcuggagugcaguggcgcaaucugggcucacugcaaguucuaccucccagguucaugccauucuccuaccucagccucccaaguagcugggacuauaggugccugccaccacaccuggcuaauuuuuuuuuaguagagacgggguuucaccauguuagccaggauggucucgaucuccugaccuugugaucugcccacuuuggccucccaaaguuuuuuuuuuuuuuuuuuugagacggagucucgcucugucgcccagguuggagugcaguggcacuaucuuggcucacugcaaucuccaccucccggguucaugccauucucccacccuugccuccugaguagcugggacuacaggcgccugccaccacauccggcuaauuuuuuguuuuuuuaauagagacagggucucaccguguuagccaggcuggucucgaucuccugaccucaugaucugcccgccucagccucccaaaguguugagauuacaggcgugagcaaccgcgcccagccugguuuagccuuuuuguaagcagcaguugauuagaauuaaaugagcuugaauuugauucugacauucauauugauuuguccuucccucaaaaaacacccugaguauggacagggcuucccgacucugcagaguacacgccguccaugagcagugcccaggugucauuaccugcccaugagaugugaccugggcagggguccccaccuguacccuugggccccaggagggaagcccagcaugucaggcugaagcgggggugcuuccagagauggccaugcagagcagcccucccgccucgggguccugaggccccgcucagugguccccccacucugcagaaugugcacccccagcucugaugucucuuccaggugaaauccggguccccggccgugcuggcauucgcaaaggagaagucuuuuggguggcccagcuucaucacauacacggucggcgucuuggaccccgcggcuggcagccaagggccucuguccacuacccugaccuucuccagccccgugaccaaccaagccauugccaucccagugacaguggcuuuugugguggaucgccgugggcccgguccuugugagucacggaacgacaucaucugggacagaccaggauggggagggacaggcaggagugguccuggcuaucaguagaaaccugagguguaagaaauggaggagucagaaaugcagaaugucccucaaagugaucgcugcucauuggggccaugaugcaggcuuuaguugcccagcuuucccaucuguucucaacauggcagccacaggggcugugccccucugcucagcagccugcgccaggagaagaagugccaggguaccaagaacagcugugggcccgggccuccagcagguggccuggcccucugagaccaccauccuuacaucuaagagggaccuguggacugcccuguagacguacaguagggcaggaacgugaugggaugccacagugggccuggugguuuugguaacucaucuucccauugauggcagauggagccagccucuuccagcacuuccuggauuccuaccaggucauguucuucacgcucuucgcccuguuggcugggacagcggucaugaucauaggugaggaggcugccuguaucucugggucuguuccccugccccgaccugcucuaaccaacccugugcucuugcagccuaccacacugucugcacgccccgggaucuugcugugccugcagcccucacgccucgagccagcccuggacacagcccccacugugaguagccccccugcaggcacaaccaggcagagcugcugagaaagagaagagcccugggggaggggucgaggcuccugaacccuaagucucaacaggcccuugccugggccaaaggagccugaggcccagaggacagaugugggagccaggagggucggggcagaggggcugccaguccugguucagcaagagcuuuccccagguagagccaugcuggguggagguaugggcagcaaggagcucugucuaggcaggagugcaugcuaggacuggaugcccaauugcugaggcugccucagaaggcucuaagcugggguuggacgagcugacucacagauggggauucuggguaguucugaugagaaauuucccagaagaaugggcaaagucauuuauuucaauggucuaacugucucucuggugaccccgaagcccuggugacccugcacagcuccagggagcaccucacugugugaauguaguuucucucucaaacaaugcagugcccagccuguacugcuguacgugaaggcccuuuaaugucuccugauucccauuugaggguucucuccccuacacaaagaguccucgagcucgugucugcugacaugggggcccauggaccggcuucaggggggucccugaauuuuuuugaaagaagacccaguuguguggguagaagcacuuuccuggguaaggagagcccacacgcccuugucuucugccugacgacuucucuaccugcaaagcggcacccaggggaggccacgggugcucggccuccucgcggcucugcugccuucugcagcugcucuggcagcaggugccugcccuuucuagcugccucucucagcgugcuccucccuggguuuugggagccacaccuggaucucugcaaggucuccggagcacugcagaaucgcugcuccccucggggucuuuguuccuguggcgcucuugcccgaggcugcauugcauucagaugcacggggccucccugccucaugcccccuggacagaugcugcugugguccugaaacuugagacacguucuccccggaaggcucugcgcuccuggguguuaggguggcaucccaggccucucugugugaaugaggccagcucagcaggugcccguggacuucccucugcuggccggggaggccucggggcaucacugugagaguguccugggugaggcaggcgccugcugaaugcuggcuguaacugaagagugcgccgcuuucccuggcucugcugcuaacaucgucucucuucccacccuagauuucgcugccucaucacccacaucucccaaugcauugccuccugcucgcaaagccagcccucccucagggcuguggagcccagccuaugccucccacuaggccgcgugaagguucccggaggaugggucucagccgagccucgugcacccccaagauggaacaucccugcugcauucacacuggaacaagccccuccagaugagugccccggccccaggccagcuucacugccgucucuucacacagagcuguaguuucggcucugcccauuagcucauuuuauguaggaguuuuaaauguguguuuuuuuccuuucaagucuuacaaagcuaagacuuuuuggcucauuccuuuuugcaugguugucuaggguuucuggacaaugugcuguugcauuuuuauuuuccuagccuugcuaaaaucuuucccuucucaagacuuugagcaguuagaagugcucuuuagaaguugucugugggugauguuacuguaguggucucagggaaaggauuguccaguuacuuuaggggguuuuuggugggguuuuucccccugugaaaacuuacuuugccccuagucuggcugcugcuaggacuucugaggagcaaugggacaugagugucccuguaucugcgccacugccgcaagggaagccucaggaaccagcaccuggaggccaggauagccaagcccugggugagcgagaggcuggagaacacaggagcucacccagggcugcugcccaaccaugggccacugugaacagacuucaguccucuguuuuuguuucauaagccguugagacaucugauggacuuggcuuaggcccugcugggacaucccacgugugaucccuuucacuccaucaggacaccaggacuguccuuaggaaaauguccuugagauggcagcaggagucauauuuucuguguguguguuucggaaagccgcuguguccugccucagcacaaagacccagugucauuugcuccuccuguuccugugccacuccagaaccucagcagaucugagccaccgccugccagugugagaggcggccacuuucauggcagcucaucaggcgcagggccccagacagcuucccagcaggcccuagagcccggccugggccaaugauggagggcggccgccagcccagggccugcccauccagaagggacuccccagggccugggggaggagacccuuggaaaaguccucucuucccagcuccugauucuggaucugagauucucagaucacaggccccugugcuccaggccgaggcugggcuacccucagggagauccagagacucaugcccauggccauccaugcguggacgcuguguggagaguccaggaugacgggaucccgcacaagcucccuucaguccuucagggcugggccaugugguugauuuuucuaaagcuggagaaaggaagaauugugccuugcauauuacuugagcuuaaacugacaaccuggauguaaauaggagccuuucuacugguuuauuuaauaaaguucuaugugauuuuuu

SEQ ID NO: 191661 - RNA, 101545 nt, Homo sapiens
ccgcucccaccucggcgucucgucucucgcccgcugccccgcgagcccgcggcccccgggcucccgccauccgccgacaccgggagcccgggcuccccgcgcccugcccuccgcgccgggggccgcccgccgcagacacgggacccgcuucgaggccgcuuuggcgccaaauccugagguaaaauugaaagagggucgggcgggcucgggccggcggcggagggggcgggccuggcgcgcggacauggaggcgccgcggcggcggcugaacccgacccuuuuaccuuugccacgggguggcggcggcggcgcccggcgcuuugcauagugggccgggccgcuccccuccccuccccgcccgcggccgggcgaagcgagcggguucccccugaccggcccggccggcgcaaggguggggguggagggggaauggccgcggccccgccuuauaguuggcccuccgccagcgccgccauuuuguucucgacggagauggcuccggcugggcgggcucccuuccuccuuauccuccuccuccucccgccugcagucccuucuuccuucucugccgggauuuucaccccuccgcuucuaguccgccuuuggcggccgucgcagcccaaccgccguuuuuucugaaggggaggguaaaagaaaaggaggaaggcgggugcgaggcgcgaccucgugagcgacggaugggcuggcuaauuggcgcccagauaggagggccggggccuguggcaccgccccccuaagcuuugcugauuggcugaggcggaagagggugguccuuauggggcgcgggagcccuggcggggcgggaguagaggccggggcgaagaguggggccgggucggcgggggcggggccgggggcggggcgcgaggggcgcggccggguggagaggccggcgccuggucuugggucagcaggugggcugcuucccuccgccuggaacgcgucucgaaugaguacugaggaacaauaguaauaaaggugaugaagcauuucgaguccacgaugcgcucucgugggaagagguuuucggaaccaggacacuuuucagggcuccugcucguuauuucgcagcggccuuggcgaauccccuaaugaggcucaauuuuaucgacuguaaauggggggcaugcgcauucuugccaggccggaccucccuucugagcauuguuuguggggcucuacucagaaaauggaggcaacgcuacuuugcgagcuucagagucacuugaaaaugguguuauuguuaaaaaugggauuacagccaccaggagaggcaagcguuaaggguauuugggguuugagagagcacaauucgggagugauucucuucucauucguucgcugaauacauguugacuuaguuuuuuaggcacuggggacacaucuggagaaccagcuguacaagaccccugcccucacuagaguugggggcuggggggugaauagacaaauaauuccagagagucauaaguucugugaaagaaaagaagccaaaugaccugcugaagaagaccugaggcguuaauuuagauggaauggucaggguggccucucugaguaagugauguuugaacagaggaacccaagggaggaauggcauuccagacaggacaucccguguaacggcccuggaggaagagcauuugaugugaucgagaacuggcugcuuguggcuggagaguugguuggaacuaguaauuguccauuaucccacuuuguuuccaagccaaaggcugugaaauauagcaacgguagugaggaacaaaucuucaauguaauaagaaagucgaggaaaauacagccuucauaugaauuacugaugaauacaugacuugggaggagggccucagaaacucacuuuacuuccagauucaaauccuucgucagccucuuauauacauuuucaguucaucaaguauuuccugagugcuacgaauacuccaggcacuaugugcuaggcugggaauacaaaaaaguaagacacugguccucaaacaugugaauaugauuuauuuauuuauuuauuuauuuuuugagaccaaggucucacucugucgcccaggcuggaguugaauauaauucucugugugugaguucucucuuucucucucucgagauagagauauuuauacacauacauacacagacauaaaauguuuuaguguugugguuagcaacuccccaacuuuuacuagcagugugauuuuguguaagcuaccuuuccuagccucacuguccucaucuggacaauaauagagccuuccuuccugaacugaagauuagaugaguuaauguaaauaauagagcuuagaaaagugccugacauguagcaaauacuguguaaauagaguuauuguugucauuaugaacuacugguauagacauuggacuaauuaagugauauaaauaaugaaauuuuuaugcagugugguguaggggcaaaaacaauagauucgaacaccgagauucuaguuuuggcucugugcuugcagcuaguuacauggcauccaggacaaaaguuuggaaaacaaaauaauggaacuaaauaguacuaaccaaaguauagggugcuuuaugauuuacagaacucucuuacaggcaguauguuguucaggcgccacuagaacccacguaauggcagaggcuuccuguuccauguuuaaaaaccuuuccaaggcuuuucauuauuuucuuaucugugguaccccuagcuuccugugcucuagacacacuggccuaccuucaacuuccuugaccaguguagcuuacaguguaagcuuaccccccacccccacccuaccucagauauuggcucaagcaucacuucuucagggaaguccuaauucccauugccagucuaaaucagauucuuuuuauucuuuucuuuauaaucuuuaucucacuuuauaauuacacacucuauuaugugauuauuugauuaaugucuguccuuaccacacuguaagcugugagagcaggaauacauuuuguuuaccauuacuuauccagcacuuagaagagugccuggcacuauuuguugaaugaauuguugauaauuuaugaugucacugauaacuaaguugcuguacauugauggauaccuuuugugugagccucuuuggcaauucagauagcacugccagcaauaauaagccuguuacgguauuugguugaauuuagcaagugauuucugacagauaugccacuuucuggagacauaaauauggauaaaaugacccauuucaauaguuuuucccacucauuuuuuuaugauugaauuacaaguuuaagugcaugaaaguuaauaaguucauaugugaagaaauaaauagcccaaacauaacuuauguuauuuacuuuagcugaagaaacgaagcacuaagcuaccaugauuuucuugaaaucaaauauucugauuuuugucucaccaucacaggggauuggagagaaggaacaagccuccaguggguucacagggaauugggaguugaaagucucuguagccauuaauucgggauauuuaucuuucuaaagauaaauugauucauuuaaugaaauuauugaaaaucaccuuuuaauugcuuuaccaagguuaaaagcaaauuuuguuaaguauacaucaaguuucuacucgaaagugugguaaauaaaacauuuguauuaacuuauuuuauauuguaaaacuuuuaaaauaagauauuguuaugguauuuuaaaaauaauaauaguuuaacuguuuauuuuuggguuuuuuuuucugucuugcucaaagauuuuugguaucacuuguucaauuccuuaagcuaauuacucaggguaaccaaagaacugcuaguuuaguaaaacagcuauauguugucuuacaucguuaaguuauuuauugcuuucaguaguuguauucacagugacuuuuaaguuuuguuucgugaucauucuuuuauagaaaaucccugugcguaacaaccuccucacuuuaugaggauggcuggaaguuuuuuuuguguguuuuuuuuuguuuuugggagucucgcucugucacccaggcuggagugcaguggugcgaucucggcucacugcaagcucugccuccuggguucacgccauucuucugccuccgccuccccaguggcugggacuacaggugcccgccaccacgccuggcuaauuuuuggauuuuuaguagagacgguguuucaccauguuagccaggauggucucaaacuccugaccucgugauccgccugccucggccucccaaagugcugggauuacaggugugagccacugcgcccagcaacugggaaguuuuuagcaucugucuccaaggaguaacauggcaagggcagugcagugacagagcuugggcuaugaaggcagaaaggccuggcuucagaaccuggaguugguagccucucugaggcuuauaauuccccauuugucaaacagggaggugggagccagcauugagauuggggccagggauagcggauacuuguugucugaaugacuuugagaacaagggaggugagucuuuguggagcagcccugucuucagccguggcacugagccacuggucugugucuagcugccugagugucuccacauaucgagggcccuccguugggauuuuuauuguugaguucucuuaccuauaagccauacgcuccuuuagucccaaaccaucuccuguacaaguaucaucuuaaaaaauaccacacggggggaguccgugaaggaaucuuagaaucucagaauuggaaguggucuagaccccaaguccagccuugauguaaggauccccugcuagauuuucguuuaccucuuuuuacuuuauugcuaauuaugagggccuuaaaugaugccuuuuuucuucccugugugaucaucaucuuuaacuuaauggauacauuugugcuccuguuacacauuguaaaagauauguucuuccuuauucguuggagguuugcuugccuucaacuuaauaugccagaggcugagauucucugucauucucucccauccugccacucuuuccccauaucccacuauugcuacccgagguagcaguccuacuccccuugcucacuucagguccugagugcuagagaguaaagcagcaggagcucuauaccaaaaggaagaacugcccaagaacaacagcucaacuagcacagcucaacaaugaugaggagugggaaugacuagagggaugaaagccagaucagggcauuggcguaggcauuuguuaaagguacaauaaaugcagaugcagaccccugguaccuggaagucuuagaauagaaggaugggaggugaauuguuaaggacagaaagggaauaggcuagcucagacacuuaacuguuuuuucuguguuacccuuggacuccaguuggccuguaaugaugaaagucagccucagaggcaagugugauuuuuuaggggcaauaaaaaguaccuccuucacuguaauaagaggccugaaguccuuuaauaggaggugaaacuuucuauuccauaauuauuaacaguuaccucaaagauucuaaucccugaaauguuaacauguagauggagaggaauuucauuccaagugcccaaguguaaaagaauauuuccccccuguuugcguuagugagaggugugagaaaaggucuuggggccuggaaaauggggugacugcugcugaaaagugaagagaaaugagaggcugguagggcuagacucaagccugaaggcuuccugguuuuacagggagcugcuuuauuuaccuuuguuguucauauguugauaaaagcuaugcaggggaaaaaguuuccuaccugacugcccacccauguuccuuaaaaagaaagauucacguauggccaggcgugguggcucaccccuguaaucccagcacuuugggaggccaaggcaggcggaucaugaggucaggaguucaagaccagccuggccaacauagugaaaccccaucucuacuaacaauacaaaaaauuagcugggcgugguggcaggcgccuguaaucccagcuacucgggaggcugaggcaggagaaucacuugaacccgggagguggaggcugcagugaaccaagaucacgccacugcacuccagccugggcgacagugcgagacuucaucucaaaaaaaaaaaaaaaaacaacugaggcuggauggcucuugagaaguuacacaauacuagcgggcuucaugcugcauuucccccaguguauuuguuguauagugaaucugauuagguauuauuucuagaacauuuuggauaugucauuuguaccacacucguucuuguccccugucccaccacuauggugucuguaaugaugcaucuuuuuauuagguugauaagaugacuaacccuggaauugaaaaaucauuuuuuaauugauugcuuuaccaagacuaaaagcagaugucacaaaguauauaucagcuuuuaacuggaaaggcuaauaauuagacuguguuguugacuuauuuaauauaauacagauuuuuaaaaauaaaauaaauuuauaauaugucuuuucuaaagaaauaaacaauguacuuucucgagaauaaaaauuaaaaauagauaaaaguaaaacaguuaauuuuuaaaaauaguaaaauuuucaaacgaagaaaagaaagcaguacaucaaaaggcaugugugaaaauguucauaggagcacuaaucauaaggacuccaaacuagaaacaaucuaaguguucaucagcuauagaauggagaaauaaauugggcauagucguacauuagaauacuguacgacagugaaaauggauucacuucucaugguuauuacaaaaauaauguugggcaaaagaagccagacauaccaaaaaguguauuauaaacagugcaauaauauuauaaaguaaugccaguaguauaaaagucaggagagggaagagaaguuauugacuaugggaaggggugugagagggacuuuuggggguauugguaaugucuuguuuucugaucugaguggcauuuacauguguguucuguguguucaguuagugaaaauucaucaaacuguucauuuacgauuugugccuuuuuuuguuuuuugagauggagucucccucugccgcccaggccggagugcagugguacgaucuugguucacugcaaucuccgccucccagguucaaaggauucucgugccacagccucccgaguagcugggacuacaggcgugugccaccaugcccagcuaauuuuuuguauuuuaguagagacagguuuucaccauguugcccaggcuggucuugaacuccugagcucaggcaguccagccaucccggccuccuaaagugcuaggauuacaggcaggagccaccgagccuggcugguuugugcccuuuuguaucugcguguuguaguuaaguaaaaaguuuuacuuaguaaaauuguucucacuauuuuaauuaaugugauuauuguguagguuaaguuuuaagggaagaauguguucaaaguucuaaaagaacugccaugguacuaccuggguggagcagccucagaaauuucuguuagcaauacugaaacauaagucacauauuacgacuuagugguuguguauaucaguuauuaaaugaucuagcuuauugauguaagcaauuuuuguucccuuagauaauucuuuccugucacuuuuuuuuuucauucucuccuugacuuccuuuuuucugggaaauuauuuugaagggcacugugaucuagagggaauguugcgauuuuagagucaaagaggccucaguuggaauccuagcuccaucgcuuaguagcuggaugauuugaaacgaguuacaagugcugagucucaguuuuuuccaucuucauuggugagcuaauauuacauacucagaagguaugcuaaggauuaaaucaugccuaguuugauuuaaagcacauuguggaugucaagagaauuuauccugcuuuccuuccauccaucuacccuggcucuuacugauagauaugaagaaaguccacaucacccuuacacuugggcucuugguaggauaagaaaaaaucauccacaguauguagugacuuuuuuaggggaggugucaacacagaaaauuguagaacugcucugauacuauaaauauguaagaacuucauuuaugugaaagccacuucucuucccuacuagucacucacccagccuugcuacuucuaccauauacauaucauugcugcacuuuuuuacaguugcuuugaauauggaagaaacaacuuuccuauggagggucacaauggaaaggaaauuaccugacccuaaagcuaaguaaacuuggagucuaaauaaauaauuggcuuuccauugacaggaaguauaccuaaacuuaaccuuagaggcaucccagugaguaucuuuucuguugaugaacauuuguauuacacuaaaccugccacuugaauuucauuuucuacuuucaagucuugaucuaugauugcaaguuucaagcuauguauuucuuauuuuuuauccucucucaggcuaucuaaauccuuccauuuuaauuuucccaugaauaugaacagacuucuaacaaucagaauaauuagacuuauacugaaugccuuguaccuaucaagaguucuaugcccaguaguauuuugcaaguaguuauuagguauugguuuauuuuuaaauauuuguaagauuuuguccuaauuuagccccauuguuuugcccaguuguacaguuuaacagggcgaauuacaaaugcuuuguguggguguuuguuuuuuuauuauuuauuuauuuuuugagacaagaguuuuacuuuuguugcccaggcuggagugcaguggcucaaucucagcucacugcaaccucugccuccuagguucaagccauucuccugccucagccucaaacagcuggaauuacaggcauaugccaccaugccuggcugauuuuguauuuuuaguagagauaggguuucuccauguuggucaggcuggucucgaacuccugaccucaggugauccgccugccuuggccucccagagugcugggauuacaggcaugagccaccgccccggcuguguguguguuuacacuacuuccauguguauauaguuaaauuucaugugagccuuaugugaaaaucagaccuauuccuaaucauaauacacauuuuacaguuugaguuacuuucagauuucuuugagaaagcaaaaguggcaccaucaccuuucaccaaugauagcuaccauguguugcauuucuaugucccaagcacaacguauacacauuuaagaucaaaucuucacuauaaccucauauggucaguaucugagagaugagcuuagugccugagccucagaacccaauauaguuguuuagcuaaggaaauaccaagacaguagauacuuugcauguuauauuuauaagccauguaacacauaaauauggaugauuugaaucaguugauuguggagggaaaggcagccucacucauuccuauuaaugaaggcagcgucuccuugucccaggacuuguucauuguuaucugaaacuggagauucagguguuuccagagcccagcuuuucacugcagugaagucugugcccuacuucacuaaagaaacucugguugcaagguuuaguuagcuaucacuuugugagccuggaagagcuaauucaaagucauuguucuguucucugcuucuuuguuguugguggggugauauugauccacuuggauuugaaagaauuucuuauaaaaccugucacauaaggccaaccaaguaugauuuacuacuaucauucuauggucuguauuacaauuuuuuauuuuuuuagagauaaggucucacgauguugcccaggcuggauaugaaauaguuuuuauauacugugcccuguugucauuugugugcuaucgaggaaaaacacacuacuuuaagaaucugccuucaucucuagacuuuacuauugcuaccacuuccuaacuggccucccaucuacagucucugucuuuucuaucauuuccacacugcagucuaaauuuuuuuuuuuaagauccagauuugagugcaucauuuuucugccaaacuccugauaauucucuguugucuacagugucagccucucuccuucccuggucucuguaauaauuccacaccacauugccauuccucaaauaugccacucuuccucauaccugccaguuuuguaugagcuguccucucugcuuagaacucucuugucauccaucugucuuuccuugcuacauuuccauucuuccuucaagaccuaguuuaaauaauuccucuccuguaacguuuucauugguucucacaggcagagagcaaugugucuuccccugggacacucauagcauuugcuuugcauagauacuucaguuuccuucauaaguucaucaaggacaaggacuguuuauucuccucuuucuccuccuuguuguuguuaauucucagcagucaguucauugccuaguucauagcaguuacuuaauaagaacugauggaggugguuggacuugauuaguaaaaucaccagaggaagaucuucuguagcacuuuuuuuuuuuaacuuaagguacucaguauuauacuucuuuuggcagcuaaucagguucuuuccccuaaacauuauuguggggguggggggcaaucuuugaagguuaacaagcugaaugggugaaguacuagccuuuaggacucagguuucuguaccaagagcgaguuuaguguucuguccacagugguuguuaauauaaugccuuguguauaguaaccacuuaguguuaguugcugcuauuaguguuaugcuuggcuccaccagccaagaagguuguuuuuaaaagcuuuauuucuuuucuauacuuuguaguaucaaaacaauaggauuuuuuuguuguuguuguuccagauugguugggugcugcggcuaaugccuguaaucccagcacuuuggaaggcugaggcaggcagaucucgaggucaggagauccagaccauccuggccaacauggugaaaccccgucucuacuaaaaauacaaaaauuagcugggcaugguggcgcaugccuguaaucccagcuacuggggaggcugaggcaggagaaucgcuugaaccagggagucggagguugcagugagccgagaucgugccacugcacuccagccuggcgacagagcaagacuccgucucaaaaaauauauauauauaaaauugugcuagugaagauaguuuuucaaacuacaucuagacacaacccacuguuccuuggagccucuuauucuagugggacaucuccuaauugauaaccauuuucuggugguacuuuuucaaagauguaugaccuucucacugugugaucuuucugucucuaggaccgccuauggcugcgguagcagugagagaagcucucaggugagagucuuauacccugauguuaccuuuuuugucugggugcauuuugguuaaauguccacgcugccccacuuccuuacauuacuugaagauucuguuuuacuucuuacauugugauauccuggaagaaaaagccuuugucuuccuuuuuuauaugagaauaggcuauaugguuugugacuuauuuucaaaaguaauagaaaauauuuuuugaaacuacuucucuccuccucugacuggauuuaagucuuuauugaaagcacuugcuuuaacauaguuucucuuucaauuucucucucacucuuagucucauuuuuuugucucugcuuguuuuuccagaaggugcacauuccuccuuguucauuuuuaagcagcuuccaaagcugcuguugaugaugccugaugcugcuuugaaggcagaaaaccaacagugagaucaagaauuguaagaauucaaguguauaaagaaagguugcugcucaauucaaguguauaaagagaggcguuuaagaugauccaggaaguuggugugggagaacaagguggggggcacuuguccuaucagagagcaagacuuacgcuaacacugcaguaaaaagauagugguggugaccaagagaaagacacagagaacuuaguggaauagaauagagaaccuacaguuauauccacauauauaggaaaaacagauauggcagagauggcauuucagaucaguggggaaaaggauagauuuuccccauauagauaauccauuuuccagaacuauuucuugaauagaaaaugguaaauggauuaucuacaugggaaaaaaauuaguuggauccuuacuucucaucagauucaagaaucaauuugcagauggauugaggaguuacauaugaggggaaaacuggaacauuucuaagaaaauauuuacaguuacauuccugggauaggacaggauuuucauaaaugaaaguacaaacuguaaaagaaaauagggauaaauuuagccuuauuaaauuuaaggacuucuguucaucaaaagacaccuuaaagaaaguaaacagaugaaccacagagugggugaagauauuuauaacuuaucaacaaaaaauuaauguccagaauacuuagcuuuucuaaacuuaaacagauuuacugcugcuucucugugacuucauaucuguagucaccuguuguuagauuuaucuugggauccccagcccuaccugaaguugauugauccugcaaauuuaaagugaauuauuacagaaauaauucuguacuaggccucuauuaaaucagauugucaucuauaaaauccacuuuuacucauaauuugauguaucaagccaccucuuuuagggaacccaauagaaagauacaccuuucuaguacucuguuucuauacuauucaauaauauuuuccuaacaauauuccuguaauaauucaaauucacauauuucuuacauugaacuauaguuaauaacagaggagaaauucuguugacaucuaaaagugauaaaaauuauuaguugcagccacauguuuagauuuauuuuuuaauguacaguaccuauuggcuauccauuucuuuaaaaauucuuauuuucuguuuugaggaagaaucagacucuagacuuuuacaugcaauacuuguauuuuuaacaagucaguugacuuuucugguagacuuaaagacgccuuuuccuuccaucuccauuaguuguaaccaaacuauagcaagaaaaaaagaccaaaagguaucuuuguguuuuuuucuuguagaaacaaguaaaaguuaaguuuuuaccaucuauuaaaacaauaaacuuaucuccucaguuucagaccuaaucauauuuugugaaaaugaguaacugauacugguggucucaugucauuguagaaguuggugcaguaucugcugucacagaauuuugacuccuugaagacaggagccaggucuuucauauuugucagucacaguuucauccuccuguuucuuucucuuagcauucuggcaauaaaauaugaauuagaauuaucauaauagagguggcuaucuaauaauaaauagaaugauguagaaaguuaccagagaguuaaaaagcuucauagagaucagugauuauaauaccuuagauaggaacuacagaaaaauauuuuguaaaauuguauugcaagauaauccacuuugugauugagggagggcaggcaaaugaacuguaauuuucuauauugcacacucaauaauacuguauaguuuuuauauguaaaucuugguaauagauuugagcuuuguucuccuguggaccuugggaccuauacagucaauagugaauguccagaaauugggucuagauuauacugaauucuuugugguagagccuuugaaagggcuuaggaaauauucaggagagcuuucucaugaccagaagagacuggaagucugcuccuucagcaaugcugguacucaaaugucuugacccaggaaacuagcacacucuuugaucuuuaggugaucacucuuuaggugaucuuucucaauuuuuacgaauaaugacaucaaaucuauuuuugcuacuaguagaaagccgaauuaucugguuuuguaauuuaaugaggacuuaauauaaauuaauauguguauggguaccauauucuuguuagcacucuuuaguaaugcagucucuucgcuucuugcuuuguuagugauaguauuugccuuucaaccugugagugagguauguuagcaccaagcaggguuuugcuucucacuuugccacuagcaaaagaaguaugguuaaugauagccaucuagggcucuauccagaguugaucucacaccuuucucagauacccaccuucuuauucagcauacugugacagggaacuauccaaaaaggugugauucccaccucccugagagguaaaccaagcuguuacaacccuggagaccugauaauuaaauuuccaaauucaucuuugucuauauuugucaguggaaguuucuaaauugaaauguuucuacaaauuaauuuugguaccuguaacugaaggaggcggugcagcauauacagauaggucuagcuugcuaggucugucugcuauagagggcaaaauccacacaagacaguaccaaagaugaauuuugauuacuaauauuuuucaaguagucugguuucuccccaccugauagagguugcuacaucuuuccaaacagguucucuaaugaucuugguucaccauggcuacaaauauggaggggcugguucagcacagaguggggacccagcagguggcugaggugagugacaggggcuagcacaguagcuggcacccucacuuucgaaagaaaagaaaaaucagugugcucauuuuuuucaaaacagucccuuggaggucagcaugugauacguccuagggugcugucaugggagaaaaaaaugacaagaacauuuauuuguaacuuuuuuuuuuuuuuuuuuuugcaugaguaggguggccuaucugcuuuuaauaaggugacuugaacuuuuacuuuaaaccgaaaacuaguagaaucugauuauuauugaaccuuguggguauaguuuaaacuccaaaucucuuaguuucucguacgcuugauucuucguuaauauuauggaauaguagaagacgugauuauguccauucagcagucauugaccauuugccauggaccagggauuguacuaagugcugaguuauaugggggugaaugagucauggguuguuccuuuagugaucucaaggccugguuaaggaguuauuauaaaauagguugagaaguauaauuccaugugagggauuugauccuggagguggaucuuccauuaugaguaagcauuugucagacccaaguaagugggguggggaacuuugugguagauucuggggagagcauccuaagucagaaaccuauguaaaaggacguaggcauuaaguagcuugguaugugcaggcaacuugacaugaaaugcaugguaaagcuaaaacacuaauugcauacuuugggcauucauucuguaccaugcccuaugcaagggcuuuaauccucacaauaacuuucugagguugguacugucaguauucccauuuaguagguaaggaaaccaagucucaaaaaauaaguaauuagccaaaggcacuguauagcaggacaagaugcugacgcagguccguucaccuccaaagcucuuccaauuaaccauggguccuacugcaaccaggagccaaaagguugagauucgcauuuuuuauuuuuuauuuuuuauuuuuugagacggagucuugcugucucccaggcugaagugcaguggcgcgaucucggcccacugcaagcuccgcuuccuggguucacaccauucuccugccucagccucccgaguagcugggacuacaggcacccgccacaccacgcccggcuaauuuuuuguauuuuuaguagagaugggguuucacuguguuagccaggauggucuccaucuccugaccucgugauccgccugccucugccucccaaagucgcauuuuuuaauaaugcucauauaucuagggcaaagacacaaauuuacguucaaagagaggauuuuuuuaaacaaaaacuaaguauacauaugccaguuuaaaccgauaaaaauggugagcagauuuuucagauuuuuagaucaaccauuaacugaaaugcaacaauguaacuaguuaccuaccccccuccccacccagcaaauaaugguuaauauuaacugaaaaugaaagaagauagauuugacaaauauuuuauuauuauauuuuugaaugggcuaucagaguuacagaaguauugggauuaaaaugcuuguaaaacaaguccucauuuaacguuaucaguggguucuuggaaaccagcuuuaggugaaaccacauauaacaaaaccaguuuuacccuaggcuaaucaagaguuaaguuccuauggcauauuucuggucaaaaaauaaaaaaucaaauuucuaaauaaagauacagaacaccucuaauauuaaauauugaaauaaaugugagcuauacauacuuuuaagauuaaagacuaauauaaacaaaauuauuuacccaauauuuggugaaucagugagugauggcagucaugguggugaauuauauuaaggaauaauugcaaagcaaaaauugucaggaguaccuccuaccacuaugcagucaaucacaaguaugacaggcccacugagugcuuucuuacugcguaguuuauugucaugcauuugguaugauuacuguggacuuuauuuuuuuuauuuucuauuuuauauuuuuuauuuuuuauuuuuuugagauggagucucgcucugugccgaggcuauugugcaguggugcgaucucggcucacugcaagcucugcuucccagguucacgccauucuccugcuucagccucccgaauagcugggacuacaggcgcccgccaccacacccggcuaauuuuuuuuuuuuuuuguauuuuuaguagagacggguuucaccguguuagccaggauagucuugaucuccugaccucaugauccgccugccuuggccucccaaagugcugggauuacaggcgugagccaccgugcccggccaugaauuuuuauuuuacaauaauuuguauucauuucccaacccacuuauuccaguucagggugauagguggcuggauccuguccuggcagcucagggcacaaggcagaaacacuccuggccaggacaccauccugucacaggguguacucacauacauacccacacucacucagacugggauaauuuagacacaccaagucaccucgcaugcacaucguuggcauguggugggggaagccggaauaccugcagagaacccaugcagacauggggagaacauacaaacuccccacagacaguggccccggccuggaaucacuuuuuuucucaucaacauuauaacaaaacaacauuauuugaggacucccauauuuauuuguugcuuuauuuugugauaggaauaauuaccuugaaaauaauuguuaauuuuucaaauaucuguguuuccaccugaggcugauuuggaaacugcuauguggauugcugcccuaagaggccaucauucuuucuuuuucuuucuauaucacaagucgucaggcaacaucauuaauucuuuaggaaagagguuaauauaggcuaauguaaguucuuuguaugcauucaagaaguuugcuagcuaaaauuuucugccaaauaccuuauuuccuucaggcaguagaauuucauguauuaacuuaguacaacuguuguuucccauggcaaaaaaaaaaaaaaaaaaaaaaaagcauuuuuagagacucaaaauaaugaaagucagucucaauuuugagugcaaaagcaauccuccuguuuaaaauauuuccuagauuuccuugcuguuuuuuuuguuuguuuguuuuuguuuuuguuuuuuuuugagacagaguuucgcucuuguugcccaagcuguggagugcaauggcgugaucucagcucacugcaaccuccgccuccuggguucaagcuauucuccugccucagccuccugaguagcugggauuacaggcguggggcacuaugccuggcuaauuuuuuguauuugucguagagacaggguuucgccuuguuggccaggcaggcuggucuugaacuccugaccucagguaaucugccugccucagccucccaaagugcugggauuacaggcgugagccaccaugccuggccccuuaguguuauuuugaggaauaaguauguauuuguguccuuugaauuuuugagcuuaguaauuuuaaacugcauauaauaacuauauauaauauuugauuagcuaaaugaguaagagggccuacacuuuaucauuuuaaugcuaaguaguaauggagugggaauaaaguauccaaauugagagauaauuaauagucaguuuuggauaauuguuuacucaaucagcagauaaugaaggagcauaccaguuuccuucccauaggccagggaggauaugcugguggauaauaggacagggcuuuugcucucccagagcucucuaacgggauaagcccgagauaggcuacacuaguugaauaggaaagauaggaucuugguagaaagagacucuaucgagugagauugugagccgugagaucagacagauugggguuuaaauccucgucucuauuauaaacaaucaaaaaauuuagcuggacgugguggcgccuuccuguggucucagcuacucuggaggcugagguuggaggaucacuugaucccaggaguucaagacuacagugagcuaugaugucccucacugcacuccagccuggaugacagagugagaaccugucucuaaaauaagucuuuuuagaaaugagcuuuaguaagugccaugcauuuuugcuucaugaaauacagcaacauuguggauuauguaaaugauguucucuagaguacccauucagcuuuuuucuccauagaccaucuaaguggcaaauaccaagguaaacuacaaaaguugggugauaugaaauaacuugauguccuauaaugugcucaaauuuaguaauucagagagacaguugaauauaguggucaacaguguagacucuggagccagauugccuagauuuaaauccuggcccugccacuugaaagcugugugaccucucuguuuuuugaaauuguuuauaaagaauugauauuaacuuuucuuuaaaaaucuuguagaauuagcggagaagccaucugggccuggccuuuucuuuucagguaauuuuuggauuacuaauucagucuuuacuuguuacaggucuguucauauuguccauuucuucuugagucaguuucaguaauuugucuuuuugggacuuuguucauuucaucuaaguuaucuaauuuguugguguacaguucuucauagcauuccuuuauaauccuuuuuauuucuguaaggucagugguaauuuauccucuuucauuugugauucuaguaauuugagucugcccucuucuucuuggucaaucuagcugaagguuugucaacuugauuuuuuuucaacaaaccagcuuuuugguuuaauggauuuucucuauuguuuuucuauuuucuguuucuuuaauuuuuguuaaaaagcacagugagauacuauuucacauccacuagaauggcuagaauauaaaaaucagauaguaaacacuggaaaggaaguggaaaaauuggaaaccucauacguugcuggugggaaugucagccaaauguccauuaacaaugaaaugacugugaaauuugauuuuaaaaaacaaugugguucauuuuuuuuuaaaaaaaggaauagcugagaaugggagagauaagguggcagaugauaauugguaaccaaagcagugagagcuugaaucaugucuaacacuggaauuaauuuugcuuuucauauauuaaaggaaugaaauuuucuaaaggggcuucaguauuuuuuaagcauuuaagauuucccaaacuauacuacaaggcuacaguaaccaaaacagcaugguauugguaccaaaacagagauauagaucaaugcaacagaacagagcccucagaaauaaugccgcauaucuacaacuaucuuaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagacuuaaauguuagaccuaaaaccauaaaaacccuagaauaaaaccuaggcauuaccauucaggacauaggcaugggcaaggacuucaugucuaaaacuccaaaagcaauggcaaccaaagccaaaauugagaaaugggaucuaauuaagcuaaagagcuucugcacagcgaaagaaacuaccaucagagugaacaggcaaccuacaaaaugggagaaaauuuucgcaaccugcucaucugacaaagggcuaauauccagaaucuacaaugaacucaaagaaauuuacaagaaaaaaacaaccccaucaaaaagugggcaaaggacaugaacagacacuucucaaaagaagacauuuaugcagccaaaaaacacaugaaaaaaugcucaccaucacuggucaucagagaaaugcaaaucaaaaccacaaugagauaccaucucacaccaguuagaauggcaaucauuaaaaagucaggaaacaacaggugcuggagaggauguggagaaauaggaacccuuuuacacuguuggugggacuguaaacuaguucaaccauuguggaagacaguguggcgauuccucagggaucuagaacuagaaauaccauuugacccagccaucccauuacuggguauauacccaaaggacuauaaaucaugcugcuauaaagacacaugcacacguauguuuauugcggcauuauucacaauagcaaagacuuggacccaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuaucgcaagaacaaaaaaccaaacaccgcauauucucacucauaggugggaauugaacaacaagaacacauggacacaggaagggggaacaucacacucuggggacuguugugggguggggggaggggggagggauagcauugggagauauaccuaaugcuagaugacgaguuagugggugcagcgcaccagcauggcacauguauacauauguaacuaaccugcacauugugcacauguacccuaaaacuuaaaguauaguaauaauaaauuaaaaaaagaaaaaaaaauuucccucuauaacuggaaauuuaaagcagacauauagauacauauacuauguauuucuucauugccuaaauaaagauucuuuuuuuuuuuuuuuuuuugaaacagagucucacugugucacccaggcuggagugcagugguguggucucggcucacugcaacaaccacuuccguucaagcaauuuucccgccuuagccucccgaguagcugggacuacaggcacgugccaccacacccagcuaauuuuuguacuuuuagcagagaugggguuucacuguguuggccaggcuggucucgaacuccugaccuugugauucacccaccuuggccucccaaagugcugggauuacaggcgugagccaccaugcccggccaauaaagauacuuuuuaaacuccauauuuugagucaggagaaauuuaggaguuaacuugcugaaguauuuugagugcuuacugauuggcagaaagaaaucacucauacaccuaaacuauaaguugcauguauguuuaugcaauagaaaugaaguggcuuuacaacccuuuuccuugaucccugggcuauguaaggggcucucagccaucaaauaaggccugccauggcugagaaaauagccaaauucuuaugaccucuuuauucuuuuuaucaacaggauuuacaucauuauugcagaaaacuuacacuaacauuuccauguaagggaauguuuaaaaacauagagcucucccaguuguugaacaaaaugcaguauuggcaaggccguguccucaaggagggaaaagcaaaguuggguuuucagugugcuggaaugccuaacucacuaggacugaauuugauuaauccugcccucuaacuggauguuuaaauuuucauuuucuugucaaaguaguacauauacauacauuuaaaaguugaccaauacaauauuaggcuuaaagcagaaaacagcagguuucugaaccacucuuacccuuuaucaccaagccuccucuaaauuugauuucuucugguauuuaacuucaugcuuuaaaaaauguccuuaccccacuauuucuaauucuugauuuaucgggcuuagauacugucuuuuuugggggccggggguggggggugggggggugguaaugaauucuuuuuuuguuuuguuuuguuuuuaauugcgguaaaauauaaaauuuaccauuuuaacuguuuuaaaguguggaguucuuuggcauuaaguacuggucacauuguucuguaaccaucaccaccauccaucucuagaacuuuuucuucuuuccagacugaaacucgguauccauguagcaccagcuaccauuccccucauuccccuagccuuuggcaaccaccauucuuuccaugucucugaauuugacuucucuagguaccuuauguaaauagaaucauguaauugucauucguuacugggcuuauuucacuuaguauaauguccucaagguuaauccauguuguagcaugugucauauguuauaguauaugucaguuuccuuccuuuuuaagacuaauauucuacuuauguaucacauuuuaucuguucaucugucagugggcauuuggguugcuucaaccucuuggcuuugaggaaugcugcugugaacguagguauacaaguaucuugagucccugcuuucaguuauuuuggguauacaguugguacucaacuuaugaugguucaacuuacaauuuuuuaacuuugcaauggugcaaaagccauaugcauuugguagaagccauacuucaaguaccuauauaaccauucuguuuuucaguacaguauuuaauaaauuacaugagaaauucaacaauuuauuauaagcuuuguguaagauaauuuuguucagcuguaugcuagugugaguguucugagcauguaagauagauucggcuaagccaugcuguuugauaggcuaaguguauuaaaugcauuuuuuuauuuuuuauuuuuuugaggcagagucuugcucugcgcccaggcuggagugcaguggcgcaaucuuggcucacugcaaccuuugccuccuggguucaagcaguucuccugccucagccuccugaguaggugggauuacaggcacccaccaucaugcccugcuaauuuuuguauuuuuaguagagaugggguuucaccauguuggccaagcuggucucaaacuccugaccccaggugauccaccugccuuggccucccaaagugcugggauuacaggcauaagccaccgugccuagucuuacaugcauuuuugacuuaaugacauuuucaacuuacaaugguuuaucaggacauaaccucaucauaaagagcaucuguauacccagaaguggaauugcuggaucuuagguuucuacauuugauuuuugagaaacugcuauauuguuuuccacagcggcugcaaccauguuacauucuuaccagcagugcacaaggguucuaguuucuccacauccucaacaacacguuauuuguuguuuuguuuuuugauaaaagcuacccuaauggauguaaagugauauuugauugugguuuugacuugcacuucccuaaugauuagugauguugaacagcuuuucuuuuuuuguuguuguucacauuaaaaaauuaauuuaccuaaauuucuuuuuucuuuuuuuuuuuuuuugagacagaguuucacucuuguugcccaggcuggagugcaauggcaugaucucggcucacugcaaccuccgccucccagguucaagcgauucuccugccucagccucccgaguagcugggauuacaggcaugcgccaccacgcccaggugauuuuuguaguuuuaguagagacgggguaucuccguguuggucaggcuggucucgaacuccugaccucaggugauccaccugcuuuggccucccaaagugcuugggauuacaggcaugagccaccgugcccagccauaaauuucuuuuaauuaagaaaaaaaaguucucauucucucucuuuuuuuuuucuuuuucuuucuuuuuuuuuuuuuuuucugagacagugucucauucugucacccaggcuggagugcaguggcaucauuucggcucacuguaaccuccgccuccuggguuccagagauucccaugucucagccaccugaauagcugggauuacaggcgcacaccaccacaccuggcuaauuuuuguauuuuuaguagagacagaguuucaccaugauggccagguuggucucaaacuccuaaccucaagugauccaccuggcuggggcuccgaaagugcuggauuacaggcaugagccaguacaccaggcugagcagcuuuucauaugcuaguuggccauucauauauuuuuggagaaugucuauucaaguacuuucccacuuuuuaauuggguaguuugagguuuuuugucauugagcuguaggaauucuuuauauauucuggauauuaagcccuuauuagauuguaguaguccauucuugcauugcuauaaaggaauaccugaggcuggguaauuuauaaugaagagagguuuaauuggcucacgguuccacaggcuguacagagagcacggcagcaucugcuucuggggaggccucagagagcuuuacucaugguggcagacaaagcaggagcaggugucuuacauggcaggggcaggaccaagagaguggggggaggugcuacacacuuuuaaacaaccagaucucaugguaacucacucacuaucaugagaacagcaccaagaggacggucuuaaaccauucaugagcacuccauccccaugauccgaucaccucccaucaggccgcaccuccagcacuggggauuacaguuugacaugagauugguugggggaacagauccaaaccauaucacagauauaugauuugcaaguacuuuguuccauucugugggcugccuuuccauucucuucauaguguccuuugauguaaaaaaaguuuuaauuuugaugaaguuuaauuuauguucuuucuuuuguugcuuguacuuuuagugucauaaucaagaaauuaucgccaaguccaaugucaugaagauuuuccucuaugauuuuuuuuuggcagggucuugcucugucacucaggcuggaaugcauuggcacaaacauagcuuaauccagcauagacuuccugggcucaagcaguucucaugccucagccuccugaguacugcugggacuacagguguacacuaccaugccaggcuaauuuaaaaaaaaaaauuuuuuuuaaagacagggucuugcuaugccgcccaggcuggucuugaacuccugggcucaagcaguuuucccaccuuggccucccaaagugccaggauuacaagcaugagccaccgugcaugucuccuuauaauuuuagaguuuuagcucuacauuuaguacuaaauuuuagaguuuaggucuaugauccaguuauacgguauuguauaaggagucugacuucuuucuuuugcaugugaauaucuaguugucccagaaccauuuguuaaaaagacuguccuuucuucauugaauggucuuggcaugcuugucaacaaucauuugacauauauucacagauuuauuucuggcucucucuccuuuuuuuuuccucuaauauugguaaaaccacauaacauaaaauuuacucucuuaaccguuuuuaaguacggauguuccuugguuuacaguggagcugcauccagguaagcccaucacaaguugaaaacaucacaagucugaaaugcauuuuauaacccaguaaaccaaucauaaagucaaaaaauuacaagucagaucaucaagucagagaccgucucuguauacaguucaguaguuuaaguauauucauacuguuguacaacagaucuucacaguuuuuucaucuugcuaaaacugaaacucuauacuuauuaaacagcaacuccccaaugcccccuucccccacccucacaacugcucuucuacuuucuaugaauuugacuauugauaacuacuguaagaauuauacagaaccugucuuuuugugacugguuuauuucacuuagcauaauauccucccgguucaggcuauuuguuuguaugucucucuuuaugccaguaccacauuguuuggauuacuguagcuuuguaguaaguuuugaaauugggaaguacgagauaucuaacuuuguucuuuuucaagguuguucugguuguucagggucccuugagauuccauaugaagguuaauggauuuuucuauuucuguaaaauacaucauugggguuuugacagggauuacauugaguuuguagauggcuuuggauaguguugacuucauaacaguauuaagucuuucaauccaugaacacaggauguuuuuccacuuauuuauguugucuuuaauuucuuuccaugguguuuuauaguuuucgguguauacuuaugguuuuuuuguugguuuuuuuuuuuuuugagauggucucacuguuucacccaggcuggagugcagugguacaauuuaggcucacugcaaccuccacuucacagguucaaguaauucuccugccucagccucccaaguagcugggauuacagguaugugccaccaugcccggcuaauuuuuguauuuuuacuagagacaggguuucaccauguuggccaggcuggucuuaaacuccugaccucaagugaucugcccaccuuggccucccaaagugcugggauuacaggugugagccucugcguccaaccaguguauacuuacguuuuaaguguauacuuaaauguuuuaagaauuuugcuuccuugguuaaauuuaauccugaacauuuuauucuuuuuuaugguauuguaaguggaauuguuuucuuaauuucccuuaugggaugugcauuguuaguguauagaaacguuacugauucuuauuucuaauaacaugcaguuuugcugaauuuguuuuauucuaaaaguuuuuuggucaucuuuagaguuguacauauaagguucugucgucugugaaugagggauaauuuuacuucuuucuuuccucuauggaugccuuuuauuuuucuugacuaauugcccuggcuaggacuucuaguacaaguggcaaaaguagccauucuugucuuguuccuuaucuuagaggaaaaguauucagucuucuaucaaugaguguuucauugaugaaacaggugguuuucauaugugaccuuuauuauguugagguaauuuccuucuauuccuauuuuguuacguguuuuaaucaugaaaggcuauugaauuuugucaagugcuuuuuuccaucaguucagaggaugauguguuuuuuuccguucauucuuuuaaugagagguacguuacauugaucaguuuucauauguugaaccacucuugcauuucuuggacaaaccucucuugguaaugguuuguauuuuuuaauaugcugcugaauucaguuugcuaguauuuuguugaggauuuuugcaccauuguccacagggaagagaauaauuuauaguuuucuuuuggugucuuuggcuuugguaucagugugauaauacuggccucaugggaguuuggaaauguucccaccucuucaguguuucuagaagaguuuaagaaggauugauguuaauucuucuuuaaaugcuugguagaauuuagcagugaagccaugugguccaggacuuuccuuuuuuggaaaguuuuugauuacuuauucuaucuucuuacugguuauaggucuauuuggauuuuguuucuuuuuuaaaaaauauaauuuuuauuuuauuuuauuucuuuagagacaggguuucgccauguugcccgggcugaccucgaacuccugggcucaggcaaucuucccaccuccaccuuccaaagugcugggauuacaggcaugagccaccacacccaguccagauuuucuguuccuucaugaugcaguccugguagguuguguguuucugagaauuuguccguuucaucuagguuauccagugugucaguguguaauuguucauaguacuaguuuauaaucuuuucuuauuucuguuaacauuuguaauaaugcccccacuuuuauucccauuagaugaagagacuuuaguguucguucagugccauauacucccacaucucuucccucccaauaaaauuauauccuguuuguauaaaucgguguucugguuauauaauuaugauacuauuacagauacuuccuagugucuccaacauaguuguaaaacucuccagauacuauuuucuauucaaaucagaagcauuuuuaguuuccuuuuuuuccugugaaaacauuccuucuaaaagccucugaccuccugcuguagucccuacugauugcucuuugaacuuacugugcacagcugucauccuuuacuucucucuuguuuggagucuuuguuuucuugagucugucuuccuuccuuccuuuuuuuuuuuuuuuuuuuuuugauggacagcaugcuguauuagcuuccuaggaaagggugcaucagaggugauuuucaaaaaucuuauaugucugaacauauuuucauuuacauuacauggcuaauugauaguuugaugaggaauagaaaucuaaguugaaaauaauuuuaccucagaauuuugaaggcaucauuuuauugucuuccauuuucuaguguugcuuuuguguauaauagucagugccacugucauuccuuaucuacaugggugaccucucuuccucucccucccaaucugguuguuaagaucuuuucuauucuguucugaaauauacagucauguccuguaguauauauauuuuuucauaaaugauaccgugcacucagaggguucuuucagucaaaguucauguccuccuguucugggaaauuguuuuaugcuaguucuuagauaauuucuucccucaguuuuuuucuagucucuuuucagaacaacuaauuaguuggauuuugggucucuugaacuaauccuuucauuuccucucguuuucucuuguguuuccaucugccuccagcuucuacuuuuagugagauuuccugacuuagaaucugucuucaucacugacuagugcuugaguauguuacuuaaugucuuuugcuaguuucuccaacuguaggauuaauuauugaacucauuuuagaggauuauugugagaauuaaaugacuuacugcauguaaagcauagcacauagaaaguaauacauuguggcagauggcuuucagcucuggcuguuauugcuucuucaauuuuauuuucauuuuugauaucuuauuuuuaauuuugggaacucuuucucccucuauuuuuauagcaacuuuuucuucauggguacaguagcuuguuguaauucucuuugaguguuaauugcaguuuuuuauucuguuuaguuuucuucuuucuuacauaguugcuuuuauccaaauucauuuuuguuucuuuuaguuccuuucuuuccuauggaagcuuuccucaaauggcuaaugauccucauuguugguccauauuuaagaguaauguagccgggcaaaauggcucaugcauauaauccuagcacuuugggaggccgaggcgggcggauugccugaacucaggaguucaaaaccagccugggcaacauggcgaaaccccgucucuacuaaaauacaaaauauuagcugggcaugguggugugugccuguagucccagcuacucagaaggcugaggcacaagaauugcuugaacccgggaggcugagauuguaccacugcacuccagccugagugacagagugagacucugccucaaaaaaaaaaaaaaagaagaagaagaagaagaacagacuucagcucagcugcagggaaauaugaucaugccauugcacuacagccugggugacacaagaaauaaaaauauuaaaaaaaaagaaugaaggacuuaaaacugaaaacaaaaaccccaaaaaaguguuuuuguacauguguaagccucaucagcuagcuugauuuuacuguggauugauuggauaagcacccacaccguaagcuucaguacaaauguuccuuaacuugcagugggguugugccccaauaaacucauuauagcuugaaaaucuguugaaugcaccuaaccuacagaaccucauagcuuagucgaacauaccuuaaacaugcucagaacacuuauauuagccuacaguugggcaaaaucauguaacacaaagccuauuuuauaauaaacuugaauaucucauguagcaugcuaguauuaaauacuguucugaaagucaaaaacagaauggucaucuagguauuuaaagcacuguuucuacugaauguguauugcuuuuguaccaucauaaaguaaguugaaccauuguaaguugaggacuguucguccauagguuuccuuucuggaaaccuauucaguuuuuuccagcaaaaauucuucaguuuccuaucugcaggguaccacaugucuuguugccagucuuuuuguccuugcuuguuuuaaaacuauggcacaggggauaggguuggcagcauggggguuggagguucacuuugcaauaccgauacuuucacuugguuuacuucugugaaaaccgaagaacagggccgcccuccuucauaugaagauguguuugaugucucagggucugggaccucuuugguucacucuuugguucaaguuauccacagacuauaccuccuuuuuucugcagugauaugagaggugguggugauggugaguuuaccuggcuguaccacauucaaccaguccucugguuuagggccugcuucucaacccagguuucugugggaccaggggcugagccuuuccaagguucuggggugaaaauuagcuugcuucucauuaauauccccccauagucauuuggggcuuuguccauuuuccuaaauuaguuuccacuucaucaucugcuuucuguccuccaaaaguaugucagcaucugugauccacuauaucuccuugacuauucuuuuugucuuuguggguuuguacauuuuuguuuuuguuccuuuacucauuguuuaagguggcuugguaaagggauagagauaaaugcgugaguauuuucuguacuuaacuggaauucagggaaaguauuacuauuaguaaaccaaauugaaauuguucauugauggacugcaagguauuccagaaauauuucauuaauguauccauucagcaacuguuuaaggagugcuuacuguguacuaggcauuguuauaguuuucaagauaaauauucuguucgcaugaagcuuuuauucuaucaggaaacagacaauaaacagcuaaacaaaaauaaaaugugaagagagcaguaaaugcuauaaagaaaagggaagggaucaaaagugacaggaauuacugucuaagcacauucagggagauuuuuuucugagggcaacauuuaaacagaaaccugaaugaagugagagaauuauuugcgugagugucuggggguuggggguuacagagguggggaacacuccagacagggaagaaguggaggagcaugcuugguacaauaaaggaauaaugaagaguccuguguggcagcagugcagggagggagggaggaagaaggucauaggagaugaggucagagugggaggugcggccagaucauucuggguauuauaggccauggucaagaguuuguauuuuauuucacauaaaauauauuuuggggagguauuggagaguuuucagcaagagaaugaccuaucuuuggggguugaaucacaagccuaccgauaauguaaacugccacagucaguuccugcccugacagaccaagcucucuuccuugauggugggcaaauuugggguugcucccuauuuuaaaaccauugccacccguaguccccacuguagaauuuccuuagguggccauauuauauacuacgugaacucuggcuuccuugguuuuauaccucaugggcugaguuguuaagauuccuacucuuuuccggcauugggguuggggguguuagggaacagggucucacucugucaccuaggcugaagagcagaggugugaucacagcucacuguaaccuugaacugcugggcucaagcaguccucccgccucagccuuccaaggagcuaggauuacaggugugcaccaugacccagcuaauuaaaaaaaaaaaaaaaauguuuuuuugguagagacaggaacucacuauguuguacaggcugcucucaaacuccuggccucaagccauucuccugccucggccucccaaaguguuaggauuauaggugugagcugucgugcccagccuaaaauucuuacucuuaagaaugggaaagcaagugcuucuacuauuaugugauacauguauuucugaaaagucucguacuucuacccacuaaaaauaagaaagccacauggaaaaauggggcuuggaauagaccagagaacuaacaaaaauaauaacaguccuaauaaaaauacuaguuaaauaccuaguuaacaaaacauguuaaauuccuaauaaacagaguaaauacaggauuucaucuuaaaaaugaagugaagguagcuuuauggcagggguugugaagaaagguuaacgaugcugaguaauugcauaaauggauaaagcuuugggagaaaugcauaaagauagaggggaaccaugcaaugagcauuuucaagacagcacacggccagacugagaaaagaggaagaaccugguugaauaggcaucaugugugacacgguucccuguagcuuucuggccaguauacuuugcauucuguggcuguuacuuagugauacaaagcauuaaggaauugggagcuaucaccugugaaucagacugauuucuacuguuacacuggcaucaggucucuauugacaauuuuauagaaucaaauucacguugcagaacuaacuuugcaacagaucauaccauaguaacaauaauagcuauuaaacuuugugccuuggcacugcuaaacacuguacauauaucauccuauuuagucuuaacauaaagccacagggugcaauggcucacaccuguaaucgcagcacuuugggaggcugaggcagacggauauccugagcccagaaguucaagaccagaccggacaauauggugaaaccuugucucuaugaaaauauuaaaaaguuaggccgggcgcggugccucacgccuguaaucccagcacuuuggaaggccaaggcgaguggaucacaaggucaggagaucaagaccacccuggcuaacacggugaaaucccaucucugcuaaaaauacaaaaaauuagccaggugugguggugggcgccuguacucccagcuacgugggagacugaggcaggagaauggcaugaacccaggagguggagcuugcaguuagccgagaucccgccacugcacuccauccugggcgacagagcgaggcucugucucaaaaaaaaaaaaaaaaaaaaagaguauugauucacaugaucacaaggugaagucccacaguaggccaucugcaagcugaggagcaaggaagucaguccgagucccaaguccucaaaaguagggaggccaacagugcagccuucagucgguggccaaaggccugagagccccuggcaggccacugguauagguccaagagucugaaagcugaaaaacuuggaguucgauguucgagggcaggaagcauccagcacaggagaaagauggaggccagaagacauaggcagucuaguccuuccauguuccucuguacgcuuuuauccuagcugggcuggcagcuaacuagauggugcuuucucagauugagggugggucugccucuccuaguccacugacucaaauguuaaucucguuuggcaacacccucacaaacacacccaggaauaauacuuuacauccuucaguccaaucagguugacacuuaauaucaacaucacacugucgcccaggcuauaguacaacgacaggguuguagcucacugcagccucacucuugggcucaagcaguccuuccaccucacccuuccaaguagcuaggacuacaggugugcgccaccauacccagcuauuuauuuacuuacuuaguauuguagagauggguucuugcuauguugcccagaguggucugcaacuccugggcucaagcaguugugagccacugugcccauucuaaauuuuuaaauuagcuuguuaggguuauacacauauggaaacaaaaaccugcugacugcugacuuuucagaguuggaauugcaaauacuuaaaugaaucaauuuagagagaguugaucucuucaucauauugagucuuccgauccaucauggaaaaucuuucaauuuauuuaaguuuucuuugauuuuuuuucugcaaaaauuaagcacgucuuuauuucccaauguuuuauguucuaugaugcuauuuauaaauaucuuauugaaauuuuauuuucucucacugguauauagaaauguaaaugauuuuguuuauagauuuuuuuaacaaucuugcucuuacgaauucuaauaaauucauuuagauuuuuauguuaucuaugauuuaaugacagucuuaucuuuuucuuucuaauccuuauguuuuugucuugacuuauucuggcagagagcuccaguacaguguugaauggaaguguugauagcaggcauccuugccuuguuccucaucuuaaaaggaaugauuucaacaauuugcuaugagccuuuauucgauuaaggacauuggaauaaaaguuguuauauucagcaaauacugaauuuuaucaaaugcuauuuuuaaaaauuuuuuuaauuuuuaauuuugugaauacauaguagguguauauauuuguagggugcaugagauauuuugguacaaguauacaaugcauaauaauuacaucaggguaaaugggauauccauuaccucaagcauucaucauuucuuuguguuaugaacauuccaguuguacucccucaguuauacugaaauguacaacuuauugcggacuguaauuacgcuguagugcuaucaaauauuagaucuuauuuauuguaucuaacuauauuuuguacccauuaaccauccccgccacuacccuuccuagccucggauaaccaucauuccauucucuaucuccaugaguucgauugucagaugcucuuuuuuuuuaugaucugagaugaucauaugauuucucuuuuuugaucagguaaugugaauuagcuugacuuuguaauauuaaacccaucuuguauucugcaguuaaucucaacuugauagguuaaucuggauuauacucuuuauacacacacacacacacacacacacacacacacauucuuaguuugcuaacauuuuguuuagggauuuugcaucuguguucaugagugagauuaacuuuuaauuuuucuuaaauuuaugcuagccucauaaaaugaguugggagaagguucccuuuucuccucccuccuauaauaauguauauaaaaugagaauuauuugguccuuaaaugcuuauagaacacaccaguaaaacuguuggugccuggaaaaauuuuuaacuacugauagaauuucuuuaaugguuaagacuauucggauuuuuuaguugugauugacucaguuuuaauaaguuguaccuucuucaaagaauuuguucauuuugucugaguuuucaaauuuauuggcaucuaguuuuuagaacauccuuguuuuguauuuuuuuauuauuauauuuuuuuauuuuugagauggaguuucacuccuguugccaagguuggagugcaauggcgcgaucuuggcucacugcaaccuccaccucccggguucaagcaguucuccugccucagccucccgaguagcugggauuacaggcaugagccaccacgccuggcuaauuuuguauuuuuaguagagaugggauuucuccauguuggucaggcuggucucgaacucccgaccucaggugauccaccugccucagccucccaaagugcugggauuacaggcgugagccaccaugccuggccuuguuuucuauuuuuaauguuugaaguaucuccaguuauagucuccuuugcaauccuaguauuauuugucaucucucuuuuuuucccuggucauuuucaccagaguuguuuuaucacugauuaauuugucuuuauuauuuucuuccuucuacuuucuuugcaccuauuuugcuauucuuuuuauaaauuuuuaggauagauacucagcuuauugauaucucagccuuucuucuuuucuaauauaagcauuaggcuguauauugucuucugaguauagcucuagccacaucuaucccuaggcaaccacugaucuucuaauuguuuuagauggauuugcguuuucuagaauuuucuauuaaagaaaucauguguccacuuuuuuugucuugcuucuuucauuuagcgaaguuauuugagacucauccguauuguugcauauaucaguauuuaauuccuuuuuacguuguauccauuguauagauaugcuuaauccauucaccuguugauggacauuuggguuacuuccaguuuuugacuauuacaacuaaaguugcugugaacauuuguguaugucuuugugagaacauaugcuuuucuuuuucuuggguagauagcuaggaguggaauugcuggaucauauggugguuuuuuuuuuuaaagagacugccaaauuguuuuccaaagucauuguaugaguucauauuccugcuugcagugcaggagaguucuaguugcccuacauccuugccaacucuuaauauugucagucuuuuuacucuuaggcauucuaauagauguguacuagcucuuaauuguaauuuuaauuugcauuucucugaugacuaauaauguugaacaucuuuucaugugauuauuugccauccauacaucaucuuugaugaaguguuuuaucaaaucuuuugccuauuauuaaaauugaguuauuucuuuucuugaguuuugggaguucuuuauauauucuggauaagauacauguccuguaugagcuauaugguuugcaaauguuuuucucccaaucuauggcuuauauuuucauuaucuuggcagagucucuugaagaauagauuuuuuuauuuugauagugguuguuuuaaauuuuuaugaaucaugcuuuuaaugucauauuuuaaaaucuucgccuaauccaaggucacauuuuucuccuguguuuucacuaaaaguuuuauagcucuagguuuuacaucugugauuaccuuuuuguuacguuuuaauuuaaucacaauguaaucagaggaucugaucuuuaugauacugauucuuugaaauuggcuuaauuuauuuuuaguuuauguuuucuuccagaauuuuuguuaaguauuuacauccauguuuauguagcuauagaaauauauagguuuuuaaaauuuaaacuaaauggaaucacacugguuaugauguucugaaagcugauucuuuuaacugucucagauuuagagauacacauaauuccuuuuuacucucauauuuuauagauuagagcuauauuuauuuagcuacuccucuaagaugugcauuuaaguuugcacauugaaguauuuuccaauuagaugcacauuuaaguuuuuuccagauuuucucaagcauaaauaguacagugauggacaucuuuauauaugccuccuugggcucauaugugggaguaucucuguagacuagaaguagaauuugaaauuaaaagcuaucugggucaaagugugucuucuaaggguuuuucuuuuuuuucccaacaguuuuuuaacagucacauaacuucauaugcaagaaguagcaccauuaacuagaucaguuauuaauucagcagguaugcaucgaguacauacugugagaaccuuccucuuagggguuuccaauuccuucagacucagugcccccuuuuuaaacaguauuuuuuuaaagacccuuuuacuguaccaaggugauacucauagaaaauaaaagcauucauaugcaaauaacuuacaaaaaucaauauauaauaauaauuauauucaggagaaauaaaaggaaagcagccuauuaugaaauaauguguauuucauguaaaugcuuaggaauaacuaccaaagaugauaugacaagucacauacuucuuaaguaaguacauacuuaaauaaggguacuaagaagauacaauuguuuuguagaugaaauguagagucagcuggaauaaauguuaaauggaauuaauguuagaauaagugagacuagacuuacuuaugauaaaaacgguugacaggaggaguuauuaagaaggagaaaauugaggaaggaugauguccuugcaaaagauccauaccuuauguggaaguguugugccaaaaugauuucuuacgguaugucuugccacagaguaaugacauucugucauagagaacaucuccuuucuugaaaucugugucugagguauaccuuuagugucugauacuuuaaaaaagaccuuggaaagcauauccuuuuauuggucacagaaaauagagaauuagaaaaugaaagcauuuugucuaccagaauaaaaaaucaaaaauuagcaucugcuaugggagaagauaacaucuuauucagggucacagguugagcauugcacuugauuucuucagggaaauuguuaauaggagugccacccaaacgugaacguaauucuaaguguaguguguuuccauguaaucagcugcccaccaggaugauucagguuagcuuuguaauugcagaagcagccuaguuuuuuuaaaucuuuaguagcaauuaauaggcaaggagacugauaauuauguuucacaguagacuuuuauaccucauuuuaccaagaaaaaaaguuucuguguuauuucuuagauggguaagaagaguuuuuauuuauuuuuuauuuuauuugaggcagauucucacucugccacccaggcuggaguccaguggcaggaacacagcucacugcaauuucaaucuccugggcucaagcaauccucccaccucagccucccaaguagcugggacugcaggcacaugccaccacacccagcugguuuuuuuauuuuuuguagagaugaggucucucuguguuacccaggauggucuugaacuccggggcguaagcaauccuuccgccuuggccucgcagagugcugggauuagagguaugagccaccaugcccugccaaguuuuucuuuuaaaagugaagaaaaauaugaagaacaccaguaauuucagaugugggguagaaaauaagaucauucauacugcuaauuucuagcaauauuugcugguuuuaaaagguagccuuguauuugaaaguuuuuuuuaauuauaaaaguuguuaauuucuuuauuaccacacuauguaaaaauagucauuuccaccucuaccucugucacuucuuaaucuccuuacucguacuugucuuccuccauaaugcuucucauuaucuacaaacauauauacuuaauuuguuuaucacauuagaauguagauuccaggaagaccagaacuuuauuucauuugcuguuguguucccagugccugaaauacagugccuggaacacagugagcaaucaagauacguuuauugaaugaauaaaucuuuugcucuuuucucacgugcauaucaucugguuguaaucacagugugcauauaacuuugugucuuguguuuuuauaaaauguuauuacacagaauaaauaucaucuuuuccccagguugccacauaaccugcuuugaucauuauuuuucuguaucccggaaacauagcauaauuuacuaacccgucuccuaguuugggacauauaaauugcuuuugaucuuucuguauuauaaauuaauaguauauucaugugaggaugaaaagaugcacagauggacagacagauguauauauagacagacagguaaacuuuacaguggaagaacuggagaaguagcucugcagcuuggaacaacacccagaaucacacugcagagccagucucgugaagcuauggcuguacagccaguaccacaaagcuuggagauggaccuccagcuuccagugccaagucucucagaccagugaaucuuauugacccccugcucuccuccaagggaagcaggacugcaaauaucugguauugucuguuuuuacagguagagagaggcacugccucacccaaaccacugggagaaggaauucuuauauuuccuagaaaaauaauuuaggaccacacacugauaaagccauuucuauauuuaggauaauuuauauaacguggguucccagaaguauaauuaucaggccagagggcaggagcaaauucugaugaugaaggaccagaucucuugaccucaaugguuuagucuuggaacuuuuugcuuccuuuauuaaucuuuccuuuuacacauacguaaagcacauuuauuggcuguacuuauucacuuagugaauagaguguuuuguuucuuagaacuuuaaauaguuguugaggugaagggacuuauagucaaaggagaaucaucaucucuuuuuuuuccccucuugauuaauuuuuuuucucuuuuagauagcggugccuggguuugugcuagaaucugaaaauggaugacauauucauccauucaucacauauggugaauuuauuucaccauaaauuguuuuauguuagugcacaugcaaacuucuguuuguauguguggaguggaaauuucaucauuuauagcagugugaauuuauucucaaauguuuucuuucagccuccuucuccacccuauguaaaaguaaauauccguaauaccucuuuucuccuacucuuccccuaggcuuuuguuuuguuuuugcugauuggucagcauucacuucauaucaguuguugagguauaaaaaccaaguaaugaguccccauguccaucagggggcuacagccugccuuaguggcaggugcucuugucucaaagccagagaaccuagguguuaguuucagccucaccacuaaugcacugugacuucaggagcucccuccccucaguggcuuuggggaaggggugggacuuagaguugaagucauucuguggaccuauuacaguguucuucauuugcucugacuacauuugcguaucuuccugccagaaugggaggcuucugaguccagaacucaaucuuguauucaugugcccggugcguguuggguggauaugguuaaaugagcccaguuuuguuguucuugugggucuuuucuauguaacacaguccauauauucuugccuacacuuuaagugaaagaggaacuuguaaagaccuccuaucuuuaagaauauuagggccaggcaugguagcucacaccuguaauuccagugcuuugagaggcccagguggaaggaucacaugaguucagguaucagucugggcaacauaguaagacccugugucuacaaaaacuaaauuaaagaaaaaauuugacugggugugguggcucacgaccuguaaucccaacgcuuugggaagcugagggaggcagaucacaugaggucaggagcuugagaccagccuggccaacauggugaaaccccaucucuacuaaaaauacaaaauuagcagggugugguggcaggcaccuguaaucccagcuacucgagagguggagauaagagaaucgcuugaaccugggagauggagguugcagugagccgagauugcacuccagccugggcgacaagagcaagacuccaucucaaaaaaaaaaaaaaaaaaaaaaaaaaaaauuacugggugugguggcacauaccuguaguccuggcuacucugagaggcugaggcaggaggaucacuugagcccaggaggucaaggcugcagugagccaugauugcaccacuggcacugcagccugagugacagagccagaccuugucuuuauuuaauaaaaagaagaauauuagauuacugcaccguuagguugaagaugcuauaugcagaacaugguguuucugggcucuccaggucuuuccuccucuccuuguagguuuaaaaauguuuugaguugguuggacuccaugguaacauucuugugaacuuucaguugaggaaaggugaucuuuaaggggaaagggguggagggagagagaguuuaacaguggcagcaaucuaggugaagggagaacuuuguaaagcagaguacaucuucccuagaagcaauuagucauauuauuagacaaacuguuucagcagcuggcaaaacagcaggaacaugucgauuuugcuuccuugguuacaggcagugauaguguacuugaccuuccgcagagcugggucacagagagggcaucuuuaaacagcccugucugguuugggugaauggaaucugcacuggcaggguuugaaagcaaaugccugugaguucccucaaccaaccucuggccuuuuggguuggacucucuuuggccugggagguugcugaggaaaaauauaaauaaagcugcagggagccauuggcaugguaagugugaguguccuaaagaaaacaagacugcaguauugaagucuauucucuuucccuguguuucugggggagaagccuuguaaugcaauguauuucaguagucacuuauuuuuacagcaguuaguauaauagcaguggauuuagacaccuauuguauauuugaagaaauucaauuuaaugucuugcuaugcuaagcucuuagcaaaucguuucuuaauaggaacuuguauuugaauaugcuggcuaaauucagguggggcaaaaguuguuuguuguuuuuggcagguuacucugccugugaacaguuuaugaaccauauugcucuuaaauaucucauuguuuuacauaauuguggggagugguuguugacuugggauuuuuguuuuuuugugacaagaaauuuagcgcuaaguuuuaccuuuuuaaaaucucuauugccaacuguaaaauucaaaacuggcuaaugaauucugauauaaaugaugcugguuuauaauauuuagguuucauucccucauuagcuuuacuguaaagaagagcuggauauauaugucaucaagagaaguaguucuuuacuaacacuguuauuguaagguuccaguccuuugaggacuggaacugcacauaaaagucagcagccuccuguggauucuucucgcugaugcaaguugcugcacaaaggggguuaaucucuuugcccauuggcccuucaacacacuuacuauuuaaugguccuuugaaauaaacuaaaggaggguaugugguacauuucaguucaagcuggagguguccccugccuaacacccuuuacccuacuuaaggguuuuacauuguucaugauuucacugaaguguugagaaguacugaguuccuguuugagauuuguaacacuagaucugcacaauguuuuuucacagaguguaacucuguuauccuauuaguaacccaugagaauuuuuguagccaaaauccagaauaaguuauagauuuggaaacucuuaauauugcacauuuaauucaaugaaaugagcaucuuuuucucuuuuuuaaucccuuuuuucuuuuuuuuuuuucuuuuucuuuuuuuuuuuuuuggagauagggucuugcuaucucaaaggcuggagcacaguggugccaucauagcuuacugucacuguagccucaaacuccugagcucaagugcuccuuccgccucagccuccuaagcagcugggacugcaggcaugcgacaccacgccuggauaauguuuuuaauuuuuaguagggauggggucuugcaaugcuguccaggcugguacucaaacuccuggccucaagugaucuuccuaccucgcccucccaaacugcugugauuauagacaugagccgcugcaccuggccugugagcaucuucuucaaccuagauguucauuuuucagcaagugauuccauguaaacgucagaaauuuuuccugacaauuauuuccuuauaaaacaaacaaacaacaaaaacaacaacaacaaaaacccugcugccaaagcaaugucaugccauuauggaauagaggagguucucauuccagggugaagauguaugaacuuccucagcagccucauaaaccccccugugucgguggaagccaguacuccuugguuuauauaaugaacugccagggcagguguugugcuguaccuccaggguguguaauuagcagacaggcacaagaguagaguaaagcaaagcaaagucuaggcagagucccaggaucaaaggcuuaagacagagacugcuuauucauccccuaagguauucauucccuaaguguucauucacuaagcauucauugugggccuaauaugugccuggccuugggaauaaacagagaaauaggaaaugugguguucuguggagaguacuaaggugcagggacugugggaacccagaggagggcauuuguauuaaccugaggggugucaggaaaggcuggccagaggagcauggcuuuuauuaaauuauuuaguguuuaauaaaacauuuguguguucugcaagcgugguuaccuuuacaaaggaugugaaauggaacagaugauuuuacccucuaaguaugaguuuggagaccaagccuuggaaggccugugucuaaagauauuucacacccagcuugcccaugguuuuaauugaguccuuuggacuggcaguuuuccugucaagguaaaaugcccuaaccaagguauaacacacaccuggguguugucaggcauuuauacaguguaaacuaagugauccuguccuuugcaacuugagcagguugaaaggguagaaaauaggauaaggcagaagccaagacugacauuaggcacugaggugugggcaggaaaaaauagaaaggaaaugcuucaacuagucagaaaugcaucuaauauuuuuauauccuuuuuaccaaacugacuuuuuauugcugugcugaugagucucaauaaaauauuucugggaaaaaaggccaagcaugguggcucacgucuguaguccuagcccuuugggaggccaagacaggcggaucaccugaggucaggaguucgacaccagccuggccaacauggugaaaccccgucucuacuaaaaauacaaaaauuagccgggcaugguggugggugccuguaaucccagcugcucgggaggcugaggcaggagaaucgcuugaaccugggaggcggagguuacagugagccgaagcugcaucacugcacuccagccugggcgacaggagcaaaacuccaucucaaaaaaaaaaaaaagaaauguuucuggaaaaaaaguaaauuuccuuccuugaugucuauucauaauuaucagacuguaaauucauacaacugcaagaauuucuuagcggucccaucauaacaucacuuugccuucaugcaagaccauaucucagcugccucuggugccacuagaacauaccuuuuuucuaauggcuucaggaguaggggaucccaaacauuuucuguuuaaccugucacuuccagaguuagucgucuuuucacugaaucucagggcuauucacucaaucuaaauuuauuacugagccuacagggagcccauugccagugugacccaugcccccucucagguaaaaggucuuuugggcuucucauaucaagggaauaaauaaaauuugcagauguaucccugaacaggugaggaagccaaaauccagggaguuuaaacuguaccucaggcaagguagcaaagccaagggacagcagucucagcgcccaaccugugcuuuccaguaacuguuuguccuccacagcagcuuagaggcagggccacaucugguugcccugugcgcacaaccccaacauggcacagaguaagugcuuaccagguuccgguaaagcauagaccacugucacuuuguuuuaaugacauagaaaacuuucugagauaugugaaauacuuuuugaauaguguuuuuaaauuuuuguuuuuuuauccacucaucugcguacugauuuuaaauaaacuuuuuauuguaguauaacauaccuaaguuuaaaauucaucagcuuaugaugaauuaucacagagaaaacauuucuauauacucaccacccaaguuaagaacagaauagaaauuuccugcagcccagaagcucuccuuaugcccccucccaaucauuaccugcaccuucuuccuuaaagaugaacucuaccccagccccuuauaccauggguugaauucguuguuguuguuuauucauucuuuuuuuuuuuuuuuuuuuuuugaggcagagucucacccugucgccaggcuggagugcaguggugcaaucucagcucacugcaaccucugccuccuggguuuaagcgauucuucugccucagacucccgaguagcugggacuacagaugcgcaccaccacgcccagauaauuucuguauuuucaguagaggugggguuucaccauguuggccaggauggucucaaucuguugaccucaugauccgccaaccucggccucccaaagugcugggucugcagaugugagcugccacacccaaccuauucauucuuuaaaaaaaaaaaaaaaagccagcugugguggaguguaccuguagucccagcuacucaggaggcugagacaggaggaucgcuugagcccaggaguuccaggcugcagugagcuaugauugugccacugcacuucagccugggugacagaacaagacccugucucuaaaaaaagaaaagaaaaauucacagcucuauuaagauauaauucauauaccauacaauucacuuuuuuuuuuuuuuuuuuuuugagauaaguucucauucugucacccaggcuggagugaauuugcacaaucauagcucacugcagccuugacccuccggucgaguugaacccucuggguucaagugagucucccaccucagccuccuaagcagcugagaccacagacacacgccaucacgccuggcuaguuuuuuuaauuuuuuaauagagaccaaguuucacuauguugcccaggcuggcaguucaccuauuuaagguguagaauucuguggcuuuucguauauuuacaauauugugcagccaucgcuaauaccuaauuucagaacauuuucuuuacccccucaaaaaaaaaaaaaaaaaccccacacuccuuagcucucaccccccagcccuaggcaacugcuacuuuacuuucuaucuuuauauuuguucuggacauuucauauaaauugaaucauauagucuuuugugacuggcuucuuuuaccuagcauaaugucuuuaaggcuuauccauguuguagcauguaccaguacuucguuucauuauugccaaauaauaugccauuguauggauauaccacauuuuaucuauucaucaguuaauggacuugggcguuuuuacuuuuuggcuauuaggaauaaugcugugaacauuguguaccaguuuuucuguggacacguuuucauuacguguguguguguguguguguguguacaccuaagaguggaauugcuggucaaauaguaacuauuuucaaacuuuugaggaacugccagacuguuuuucaaagagacugcaccauuuuauguucccaccagcuguguaugaaggaucugguuucuccucaaccuugcuaacauuuguuauccugcaucuuuuuuauuguagcaucccuagagggugugaagugguaucuuauugugauuuuuauuuguauuuccagugauauugaauauuuuuucaagugcuuauuggccauuuuguauaucuucuuuggagacaugucuguucaaucccuuugcucauuuguaauugguuuuugucuucuuuucauugaguuauaaggguucuucauauauucugaauaaaagucccuuaucaaaugugauuugagaauuauuuucucccauuguaucaguuuucuuuuucacuuucuuaccgucuugaagcacaaaagauuuuaauguugguaaaacccauuuuauguauuuuguuguuguugcuuuugcuucaaguguaauacauuaagaaaccauugccuaauccaaggucaugaagauuugcaccuguguuuuuuaauuuuuguauaugaguuuggauuuaauauuuuaaaauaaaauacaaagaauuuucuguuugagagacacauuagcacauuguaucauguguagcaaagacaguuauauaguuuuuauaacuuagguuuagaaaaauuuucagguuugugacaguaucaguuaucauuugcugaauguaacugauguuuaacuuacuauucauuaaccuucacaccagugccauaaaguaguaacaauauguccauguugaauuugaggaaauuuugaaguuucacguuuuagcuauuagaggguuuauuuguuuauuuauugagacggagucucgcucugucccccaggcuggagugcaguggugcgaucucagcucacugcaagcucugccucccagguucacaccauucuccugccucagccucccgaguagcugggacuccaggcgcccaccgccaugcccagcuaauuuuuugguagagacaggguuucaccguguuagccaggauggucucaaucuccugaccucgugauccgcccgccucggccucccaaaaugcugggauuacaggugucagccaccacgccuggcuagaggguuaaugacuuguuuaaggugacaguacaaguuucagagcccaggucugucagauuccauagccuguggguacuccaauaauguugauggcuuuaaaacuucuugcaaauaaaguaaggaccugagccaaaauuuggccuguuauucugccagugaagaauuuucaauacagucacaaaccaaaugugaaccacauaaugacgguucugucagugcuugagugccuauaggaaggaagguagucccauaagauuauaacuguauuuuuacuguaccuuuucuauguuuagauacacagauacuuaccauucuguuagagucgguuauaguauucaccacagucacaugcuguacagguuuguagccuaggggcaauaggccauaccacauagccuaauguguaguaggcuaugccaucuagguuuguuguaaguacauguuaucauguucacaugaugaaaugaccuaaugacacauuucucagaacauauuccugucuuuaagcaacacauaacuguaucuaaaacuggcagaauuaacuugcagacuaauagacucaaccaaaauuuuaaauguucauuauuaaaggaugcaaugaauaugcucugauaaagugauuggccagccuuuucuuuucaguuauaaauaaacagagcuagcaguuauguguacauggauccugggagacauaccuugcaggaucucagccucaccauaccuccuauaaaaugguugugcuuguccugccuauuucuuagccaagagagagcuaauccauauuuuuuaagcuaaaagucacuguaaaaauacuggauucuguugacuucauuguagugaauuuguuguuaaaauguaugcuuaugaaagaaaaaaaaauuuaauagcccaguaaugaauuaauugauaauauuuuaucaaauugagauauaauucacauaccauaaaauucauuuuuuaaaaauauacagcuuaguggguuuuaguacauucacaagaguaugcaaccaucaccacuaucuaaauccagaauguuuuuaucaugcccccacuaaaaaacccacaucucuuagcaauuauucuugcuaccccuguuccccugucaccuggcaaccacuaaucuacuuucuguccccauggauuugccuauucuggacauuuuaaauaaauagaaucaugcaauauaugguggucuuucguggcugagucuuccauguuguagcauguaucagcacuucauuccuuuuuauugccaaauaauacuccauuacauggauauaccauguuuuauuuauccauucaucauuugggagauauuugaguuguuucuacuuuuugccuguuaucacuaaugcugcugugaacauuuguauacaagcuuuuguguagacauguguuuuucuuugucuugaguauauaccuaggagugaaauuaugggucauauggcaacucuguguuuacccuuugaggaacaaccagacuguuuuccaaaguaacuguaccauucuacauuacuaccagcaauguaugaagguucccaucuccacauuuucaccaauacuuguuauuguccauguuuaacauuguagccauccuaguggauaugaagugguaucucaucauggucuugauuugcauuucccuaacuaaugaccuuggaacaucuuuuccugugcuuauuggccauuuguauaucuucuaggagaaauuucuguuuaacucuuugcucauuuuuaaauugggauuuuugucuuguuauuaaguuguaaugauauaugauuugcacuuuuuuuuucccccauuuuauagguugucuuuucacuuccuugauggugucuuuugaaacacaaaacucauuaauuugaguucagguacgcuggcucacaccuguaaucccaacacuuuggaaggccaaggaggaaggaucacaugagccaggaguuggagacaagccugggcaacauagggagaccucaucucugcaaaaauauuuaaaauuagguggcgcacgcccauagucccaguuacauggggggcugagguagggagaucacuugagccugggagguugguugaggcugcagugagccaagauugugccccugcauucuggccugggcauccaggagugagaccgugucucaaaaaacaaaaaaaaaauuuuuuuuaaggccaggugcaguggcucacgccuguaaucccagcacuuugggaggcccaggcggguggaucaccugaggucaggaguuggagaccagccugaccaacaugcagaaacccugucucuacuaaaaauacaaaauuagccuggugugguggcucaugccuauaaucucagcuacucaggaggcugaagcaggagaaucacuugaacccaggaggcagagguugcgaugagccgagaucgcaccauugcacuccagccugggcaacaagagugaaacuccgucucaaaaacaaacaaaaaaaauuuaaauuggcccggcaugguagcacacaccugugauccuagcugcucaggaagcugagguugggaggauugcuugggcccaggaggaugaggcugcagugaaccauaauugugcuacugcgcucuagcacaggcaacagaguaagagaucuugucccccccaaaaaaaaaguuucuaguuuuaaugauuauuuucuaauuuuucuugugcuauuuuugcuuuuggugucaucuaagaaacaaucaccuaauucaaguucacgaagauuuacaccuguguuuucugagaguuuuauaguuuuaacucuuacauuuagaucuuugauccauuuugauuuuuuuuuuuuguaauagugcaagguagguguccagauuuguuccccugcauuugauuuccacuugucccaucaccauuugucgaagacuguucuuugccuauugaauuaucguggcaccuuuaucaaauuugaacauauaggugaggguuuauuucugcauucucuguuauauuccauuggucuguaugucuugucuuuaugccgguacugcaauuuuuuuaaguuacaaauugaguuuauauugcauauauuuacaguacaaagugauguuaugauccgugacuacaauguguaaaaauuaaaucaagcucauuaacauauccaucaccuuaaauacuuauuuuugccaugagaacauuugaaauuuacucuuagcaauuuugaaauguacaauaggcuauuauuaacuguauucgccaugcugugcaauaggucuaaaaaaaaagaaaaguauuccuccuaagauuuuguaccuuuugaccugacuuucaucuccccauucccccugccccucagccucuguuaacuaccauuuuacucugguuuuaugaguuugauucuuuuagauuccacauuuaaguaagaacaugugguauuugucuuucugugccuggcuuauuucacuuaccauaauguucuccaguuccauccgugucaucagaaaugacagaauuuccuucuuuuuaaaggcugaauaguauuccauuguguguauauaccacauuuucuuuauucauucaucuauugauggacuuguugguugauuauguaacuuggcuauugcaaacagugcugcagagaacaugggagugcagacaucucuucaacaaacugauuucaaaucuuuuuggguaaacacccagaagugugauugcuggauuccacacaguuuuaauuaccguagcuuuguaaauaaguuuugaaauaaggaagugugagaccuccaacuuuguucuuuuucaagauuguuuuggauacucugggucccaugcauucccauaugaauuuuaggaucauuuugucaauuuaugcaaaaaagcaccugaaauuuugauagggauuacauugaaucuuuagaucaauuuggggaauaucaccaucuuaacaauauuaagucacaaaugucuuucuauuuauuuagguuuuuuuuuuuuuuuuuuuugacggagucuugcucuguugccaaggcuggaaugcaguggcacaaugucggcucacugcaagcucugccucccggauucacaccauucuccugccucagccuccugaguagcugggacuacaggcacccgucaccacgcccggcuaauuuuuuguauuuuuaguagagacaggguuucacuguguuagccaggguggucucaaucuccugaccuugugaugcaccugccucggccucccaaagugcugggauuacaggcgugagccaccgugcccagccuauuuagguguuuuaaauuucucauagcaauaucuuauaguuuucaguauucaaaucuugcauuucuuuuguuaaauuuauuuuauuucuaaauauauuauccuuuuugaugcauggucagugggauugcuuccuuaauuucauuuucagauugcucauugcuaauauauaaaaauacaauugauuauuguguuuuuguuuuggguuuuuuuuuuuuuuuuuuuugguuuuuuuuuuggagacagaguuucacucaugucgcucaggcuggaaugcaauggcgugaucuuggcucacugcaaccuccgccuccuggguucaagcaauucuccugucucagccuccugaguagcugggauuacaggccccgccaucauacccggcuuauuuuuguguuuuuuaguagagaugggguuucaccauguuggccaggcugguccugaacuccugaccucagguaauccgccugccuuggccucccaaagugcugggauuacaggugugagccacugugccuggccuuguuuuuuguuuuugaaagucuugcccaggcuguguagugacacaaucauggcucacugcaaccuagaacaacugggcucaagcaauccucccaccuuaaccuacugaguacccgggacuuacaggcacguaccaccacacacaccugauuuuuugauuuuuuuguagagaugggucuugcuuuguuguccggacuggucuuaaacuccugaccucaagugauccuccuaccucggucucccaaagugccaagguuacaggcuugagccacugcaccuggccaguuuuuguguuuugaucuuauauccugcaacccugaaacucgucuacuugcucugauggguuuuuuguggauucugugggauuuuuuucuauaugagaucauguuauuugcaaacagagauaguuuucuuccuuucuauucugaauguuuuuauucuuuuucuuuccuaauugcccuggcuagaaccccuagugcaauguugagguagagagaauggacauccucaucuuauucuuaaccuuagaaggaaagcuuuuagucuuuuaccgcuaaguauacuguauagcugugaguauuuuauagagacccuuuaucagauugagaacuuuccuuuuauaucucguuuauugaguguuuuuuucaugaaauguuguuagauuuugucaaaugcuuuuucgccaucaauugaaauaauuauguggcuucuguccuuuauuccuuuaaugcaauguauagaacuguuugauuuucauauuugaacaagcuugcuuuccugggaugaaccccaguuauucgugguguauaauccuuuauauaccacuggauuugguuugcuagaguuuuguagaggauuguuuguguuucuauucauaagagauauuggucuguaguuuucuuuuccugugaugucuuugguuucaguaucagguaauauuggccucacagaauugggaaguguuuucuucuaauuuuaggaagaguuuuuugugaaguguucacaauauacuuuuuuuuuuuuuuuuuuuuuuuuuuuuuugagacaaaguuucacucuuguugcccaggguggaguacaauagcaugaucuuggcucacugcaaccuccgccucccggguucaagcgauucuccugccucagccucccuaguagcugggauuacaggcacgggccaccaugccuggcuaauuuuguauuuuuaguagagacaggguuuuaccauguuggucaggcuugucucuaacuccugaccucaagugauccacccaccucggccucccaaagugcugggauuacaggcgugagcuaccgccgccgacccacaauacacuuuuuuuuuuuucugucacccaggcuggagugcaguggcacaaucuccgcuuacugcagccuccaccucccugguucaagcgauucuccugccucagccacacgaguagcugggauuacaggugcgcaccaucgugccuggcuaauuuuuuuuuuuuuuuuuaauguagagauggaguuuuaccauuuuggccagcuggucucgaacuccugaccucaagugaucugcccaccuuggccucccgaaugcugggauuauaggugugagccagcacacccagccacaauacacuuucuaucaagaaaaaauauaucugccugcuucagauacccaggugaccacucagcaccuuguaccuugccuuugggauagguauugacuaaauuucagacccugugguccugacaggcuuuucccagcuccaucccauuggggcugagaaauuaccaggacgcuuuuauaaguacuaaucccaguagguuucaguguaauguugguuuuguuugucauccccugcuguguugugagagccuuucucgggaaaccauauuaaaggaauguuuuacagguggcuuuggagacagggauaacauucaaagaucaucuuuaaaauguuguuuugguagguuuuuacuuuauuaaagugugcagagcacaacugcaaauuccuuugguuucuucuuacauuuucaacauuugaaacagcuguuuuaagauuguauuuuccuggggggcauccuguagcaacaucucauugauugcuuugucaucauccuucuggguccauaccucagaaccauacaaguucaucacuccaggccacagugaaagcaagaggcguggucuucaggccaccucugggcaucauucugaacccccuugugauccagcccacuucucacccacagguaacacguacacagaccucucggccggaaucuccagggaugaccagccccuccccacgcauccagauaaucuccaccgacucugcuguagccucaccucagcgcauucagguaccugcaaccugccaauggcaacccugccuuuccagaagaacucuuuccaaaaacaaaccuuccuaaggguuucacuaaagaguugugccuuuugggcaugaaauacaguacaacuucaucaauucuuuaaaaaaaauaaagaaaaaaugcuuacauuuauuuaaccaacuuacauuuaaagcaaaagccuaaacuguuguuucaaaccauugagauaaaguaccauuuuauuacuuauuugcuucuaaauugagaggcaguaugucuuaguacuguaauuaagagcaagggccccuacuugaagucaaauccagugccccacuuagcuuuguugaccuuggucaauuaacuuuuuaaugccucacuuucuucauuuggaaaauagacauaauaguaguauuugccucacgaaguuauuaugaagaaucaaagggauauugcuuauaaagugcuuagaaugguaccuggcacauaauaauguucaauauuuacuaauuauauaauaacuuauuacuaauauuguuauuaacuaaucgauauucacuuaugggaaguugucuucccuagggcucugaaccugccucuggcccauugaguguuuucacaucuuugaacaaagagaagguagguguaucaagcuugaaggcaaaaagcugggaggaagggauaauauauugaugacaaagauuuauuguuaucucaacaagcugaaucaaaaagccaauuauaacgguugauuucucuguuuuucuucuugcaguuuuaucaguuuuuuuggcucacuuugaugcucuguuguuaguugcauauauguuuuauauuguuaugucuuuuuggagaauuaacccuuucuugaucuuagccaaaaggucgagaagcgauggagaauuaaccccuuucuugcuugcuuucuugguugcuugcuuucuuuuuauuuauuuauuuuugagacagagucuugcuauguugcccaggcuggucuugaacuccugaccucaagugauacuccugccucagcuucccaaagugcugggauuacaggcaugagccaccaugcccagccaccccuuucuuauuauguaccauuucccuuuauguuuauuuuccuuguucugaagucugcuuugucugaaauuacuauaguuuucuuuuuauuaguguuaguugcuagcaugguauaacuuucucuauguuuugacauuuuuucuuuuuuuugagacagggucuugcucugucacccaggcuggagugcaauggcgugaacacagcucacugcagccucuaccucagaggcucaagccauccucccaucuacgccucccaaguagcugggacuacaggugcauaccaccaugccuggauacacacacgcauaaugcuuuuuuuuuuuuuuuuuuuuuuuuuauaaauagggaugggguuucaccauguugccaaggugggucucaaacuccugagcucaagcaauccaccugccucagccucccaaagugcugggacuacaggugugagccagcgugcguggccaacuuuuuuuuuuuuuuuuuuuuaggagaaucuugcucuguugcccaggcuggagugcauuuacuauucacagacaggaucauagggcacuacaaccucaaacuccugagcccaagcuguccuuuugccucagccucccaaguaguugggacuacaaaugugcaccacugucagcuucuccaucccuuuauuuugcaucugucugugucuuuauuuauaaaaugggucuccuguaggcaauauguauuggggucuugauuuuuucccauuuuuuuccuacuuccuacauaauuucauaagggucuuguuuuuuuacccagcugacaaucugucuuuucauugguggauguggaucaauucauauuuaaagugauuguugauauauuuggauuaauauccuccauuuaggcuggguacaguggcucauacuuguaaucccagcacuuagggaggcugaagaaggcuuauuacuugagcccaggaguucgagaccagccugggcaacaaagugagauuguaucucuacaaaaaaacuaaaaaauuagccagacauggugaugcauuccuguaguccuagcuacuugggaggcuuuggugggaggauugcuugagcccaggagguugaggcugcagugagcugugaucaugccacugcacuccagccugggccacagagagacccugucucaaaaaaauaaaauaguaauucagaacuauucauaugagcuaaaauuuauacuuaaguaaaagauuuauuuaccauuuugcaaaggucaggauuuauuuaccuuuuugcaaaccuuuuuuaaagcagguucuuuuuacccuuuuuauuuuuagucaauaaucuuugcuauuaucuuuugguaugcucuaauauacccugaccuaucuuauaaacuuuauauauaugcuauauguaaauucuauguauacuauaggaaauuguguauauguagguaugugagugggcagguggguauguguguguauauaaauaguauaggaaaucugaagagcugguuuuggguugagggacaaacccuugaagggauucucauuguacucagaaagaaauccaaacucgcagcagggccguuccaccucccucucuagguuccugggccaugcugguugucugugggccugauagcaguucccaagaaacuguuccucccagggcuuuccauauaccagaacauuucucuuugcugggaacacuaaacauuuauuuggcugcugucuccucagccuugaaucuuuuuuuuuuuuuuuuuuaaaggcauuucgcucuugucgcccaggcuggaguacaguggcacaguguuggcucacugcaacuucugccucccagguucaagcaauucuucugccucagccucccaaauagcugggauuacagacaugcgccaccacgccaggcuaauuuuguauuuucaguagagacagaguuucaccauguuggccaggcuggucucgaacuccugaccucagcugaucagccugccucggccucccaaagugcugggauuacaggcgcgagccacugugccacccagcccaaaucucaucuuaaaugucaccuugucacagagguuuucccugaccucucuuuuuuuuuuuuuuuuugaggcggagucucgcucugucgcccaggcuggaguguaguggcgcgaucuuggcucacugcaaccuccgccucccggguucaugccauucuccugccucagccugccgaguagcugggaauacaggugcucgccaccacaccuggcuaaauuuuuauauuuuuaguagggacgggguuucaccauguuagacaggauggucucggucuccugaccuuaugauccgccugccucggccucccaaaauucugggauuacaggcaugagccaccgugcccagcccccugaccucucuuuuuaaaguuaaguacuuuuguuauucaggguuaccccaaccugaucuuuucccucauaacauguaccauaaauugaaauuguuuacugacugguuuguuuccuuguguauugccagucucuuccauugaacuaaaaguuucaugagggcaggagccaucuucauaugccacugucuaacacagugucugacagaguagccccucaguaaauauuuuaggaaugaaugaaagaaugaguaagccaugguaaaaagucuugacuuuuuccucaggagcgauuugauaagaugaaagggauaagacaagacugagugaggaaaggaguaugugagagcuuagagggaagaaauacuuuaccaagguccugucauguucugggcaguguaccaaacaguuucacacacaucguaucauuucacuuuccuagucauccuuuuucauagauauauaaauggagcucaagggcuuauguaacugcuccaaguugacacagcugggaaguagaagagcaagcauuccuauucaugucuguagcuaccaagcccuuucucggguguuuacagugaaagagguggcaagguggauagggauaaacuggagaggcuaccucaucuaaagagguagccaacccacacccgcuccagccaccuggcaccauggggagaacuugagcccaggaugaccugagcuuccaguuugucaagagaacuauaaauuugauuuugauuaugggaaauacucaauuuuuagauguuagcaaacaguuuuuuuguuuguuuguuuuuuuuuuuaaauuagggggcugagugcaguggcucacaccugugaucccagcacuuuggaggccgauguagguggaucgcuugaucucaggaguucaagaccagccugggcaaccuagugagacgucaucucuauaaaaaauacaaaaauuagccaggcgugcuggcacgagccuguagucccaguuacucaggagacugagaugggaggaucacuugaggcugagagguggagguuguaaagagccaacaucgugcugcugcacuccagccugggugacagaauaagaccuggucucaagaaaaaaaaaaaacaaaaacuuuggguacucaaacaaaaguuauccaguggcugguuuuugccugcaggccauucauuggcaggcucuucuuugcaacagagauguugaacuggcuggaacagaguggguaacaugggggagaauggugguguaugagaucauuccaggguccuuugggauuagaacuagagaggaccuuagcuuaguaaagucaguucugcuauaaugugauguguguuccugaaaauucccacacuuugccaaauugugugaugaaaaccacaggacugauuggaaaaaaugaaauuagugacacucaaaaacuuugucaguaacguauuaaaaaacagauagugaaucuaauaaaaccugcaagugguuaaauacauagugacuauaauaaauaugguacuuggucgggcgcggcggcuagugccuauaaucccagcacuuugggaggccgagguggacggaucaccugagguugggaguuugagaccagccugaccaacauggagaaaucccaucucuacuaaaaauacaaaaaauuagcggggcauggugacgcauaccuguaaucccagcuacucgggaggcugaggcaggagaaugacuugaaccugggaggcggagguugcagugagccaagaucgugccauugcacuccagccugggcaacaagagcgaaacuccgucucaaaaauaaauaaguaaauacggcacuuuaccuagaaaaagccuuguagauucuuuguggagguagguguagggaggauugcgucucaugaguuacugugagugguggacauggggugaccugaaaucaccagauggauugaaugugacucauaccaugugcacugaguaucccugcauggaucacuucaccucaguguuuauucauggaagaaaccaugcauaaacacaaaauuugcauuauacucaaauuauuuacuaacauaucaaucauguucaaacaaauucaucuuuucacaacaagcauuauggcagcucugaguguauagguaggcuauugagggccuuaaaaaucacagaaaacaacacauaucuucuuaacguuacuucauuccccccaguuuguuauaguuuacagacaggaauuuaagaacuuuuguuccaaguaaagaaauaaaauuugccucuuguauuaguuucccagggcugucacaauaaauuaccacaaacuuaguggcuuaaaacaauagaaauuuauuuucccaaccuucugguggccagaagucugaaaucaaggugucagcagggccaugcucucuuaagguucuaggagaguguccuuccuugccucuuccuaccuucuggugggugccagcaguccuuggcauuccucgcuugcuugcagcugcaucacuccaaucucugccuccauugccacauggucuucuuauaaggacaccagucauugaauuagggcccacccuaaugcaguauuaccucaucuuauccuaauuacauuugcaaaggcccuacuuccaaguaagguacauuaauagauacugggaauuauggcuggaauguaucuuuucaggggguacaguucuaugcacaauaccucuccuccacagccgacuuaaauuuuaaugagcuuggauauauccuugcaauuugauguguccucuaggucauuaaauaggaaucuaucuguguuuguuaacaaggucuugccuaauggucacccuuguguuccaauaggguauuugggagauuuuuuuuucugccugcauuuuuaguuuuuucaugggcgugaucucucuaaauggaggauacggaugucuuaggagggugaagauaaaaaaaaaaaacccaaaauuauaaguaauucauugaauuuuuauaagcgugagucuuugagaaaaaaagaaaagaauaaucuagccaggugcauugguucucaccuguaaacuccuugggaggcgaaggcacgaggaucacuugagccuagauguucaagaccagcuugggcaaaauaguaagaccccaucucuagagaaaaaaaaaaauugccaggcaugguggugcuuaccuguagucccagcuacucuggaggcugagaugggaggauugcuugagccuaggaggucgaggcugcagugagccaggaucgugcuacugcacuccaauguggguaacagaacaagacccugucucaaaaaaaaaaaaaaaaauucugagccuugagguauguuauauacugccacuaagagcugcuguccuugucuggaaccaguaacuucuacuucccaacauacccugaccucauacuugccauaccucaaccacaaugacuggagaagagcauacaagaaaugacaugcugguuaucugugugugcucugguacagcaugugucaucccugaacacaaaagggcaaaggaauuacuaguguugccuugguuuuaguugguaauugaagaccccucucaaucacauaacugucauuucuuaacagggaaaacaguuuaggaaggaaacaaaaauugauagacaugagcugggcuugguggcucaugccugaauccuagcacuuugggaggccaaggcggcaggaucacuugagcccaggaauuugaggucaccugggcaacaaaaugauacuccaucuccacaaaaaaauuuucuaaaaaauuagcugggugugguggcacgcgccuguggucucagcuacacagaaggccaaagcagaaggauugcuugggcccaggagguugagacugcggugagccaugcucaugccacugcacgccagccugggugacaaagcgagacucuugucucaaaaaaaagaaaaagaauugauagacauaugacucacagagcucagguuaugagggcuuccaaaggccaucuucuuuaucuaaggcaagaaucccuucuguggcagcugagagaaguaugugucaaccagccugugucugcaaucuuucaguugagcuguggguaggaaaguuuuuuuuaaagauaauucuuuucacaagguuuucugucucauguuuuauguuucugggggacuccgggcaugccacagauuguaaugaugaaaguuucuuccuuucauucccuccaaauccauucuccuugagccuuaaacaucuuuugccccuuuaguuggaaaugaugauauacugggguuugucccauaaucagcugaguauucauucuuggaucugucauccuauucugcugccucucuggucuugcacuuggcugugccguguagcacacuuugccgcauuuuugcaguuuacuguuguguuugauucaagucuuuguucagugucacauacucagagaugucuuuccuccuaaaguugcaucccugucuccuucccaaugucaugcuuucucuguuuauucugcuuuuuguuuucuccagggcauuuacacugacugauauuauuuauucagaguucauggucugcuucccccaauagaaguuuaguucuaugauggugggaccuuuuuuuguucacgucccuauuccuaguaccuagaacaguguuugacucguagugggugcucaguaaacauuuaagugauugaaucuuuucuugccuaugucauuuuauuuugagccagccaacauugucuuauuuuccguauugcaguuagccaagcuguuguguuagacugugugaguuuguugucucaaccuugaaguuccauuucuuuuuuuuuuuuggagacggaguuucccuuuugucgcucaggcuggagugcaguggcgcaaucucagcucacugcaaacucugccucugaguucaagcgauucucgugucuuggcauuccaaguagcugggacuacaggcgcccaucaccacgcccagcuaauuuuuguauuuuuaguagagacaggguuucgccauguugaccaggcuggucuugaacuccugacaucaggugauccucccaccucggccucccagaguguugggauuacagacaugagccacugcguccggcuggaguuccauuucaaaagugugguacagaugcuagaccugcccauaaguguacugugcuguaggaaacugaguuccagccagagacauagcauguuuccccucacccaacacagcagcagcagcucaagagucuucuuugcaguaagggucugcuggugccuggagggagagguggcagugcugcuagccaggaacaucuggucuagaagagaggcaggacggggauuagaacaacuucagagaacuucaugagcaagaauaagagaguucauucuugucauagcagcuguuuuuguugugacugaugcaauuagacaaggacugugugaagaaguggagucuugacagcgagacuccugaagagugagaacucccagaggaauaagggucaagacuucuccagagucagugcccacuuccuucggugcauccuaggaucuuuuauugucgucucucuauguggcaggccuugugcuggcccuggggauauagcagugaaucagauguagucucuauccuuaaagaccucagagucaggaagugggagugaaggagguggguggucaauuagugguaaguugagugugugucagcaggggucucccuguauucucucaaccuaaggcaauauuauuuacaggaccuuuuagaaagaggcugucuuugaaacagucauucccaaguuuuuggcuuuuguggaucaguagcauuucaaaagaguuaggauugccuacauuuguuauuaggugaggacaaggacuuuucaaaaaguuaaaccuacuauuuauuauugccuucauuucauaaaagaaagggcauuuuaauucuaaaaacaguaggaaagauauaguccuagacuaaaauuagcuuuaugaaaauuuguuucugaaaagcucacuauuguguuuuauuuuucucaguucaccguggacuggugaaaaugcauguuagacagcauuaauucaaggacugguuuuuggcagucaccacuuugagcaccaccugcaaaugcaugggucuugugacacuccaugagagcagccuccauguugugucuuauagauugucacagaccagcagacaggacagaaaauccagauagucaccgcaguggacgccuccggaucccccaaacagcaguucauccugaccagcccagauggagcuggaacugggaaggugauccuggcuuccccagagacauccagcgccaagcaacucauauucaccaccucagacaaccucgucccuggcaggauccagguaaggccuuuggacagguauuuguuucagcacuucugcuauugaacuuguuccugacuuguucuuacaucugccuucgaggccaaauccaucccuggaagguuccuuggggaccugcaaacauggcagguugcugcuuuggccaaaguaauaaaccagcaauccaguggcaaggcccagaagacagucaacuauaacacucagagaggauggaaguagaaccuggaagucaguggccacaggagacugacaugagcaagccggcacugaggcuacuggagaauuguucuuaccuaaggccaucaaguggcagcccuugauauuuuaaagguaccaccuagggcugacuacagccaggcgagaaccgacuuguccagaucaucaggucuguggccccagcuuuucauucugucuuuacuugccacuguguacuacucgcccugggccccucaauucuugucucuaucucugcccugguucuuccugcucuguuaaggcaggaugggguugaggacaguccacagcaaggaaaagagcagacauugaaggaaagcaggguuguugcuagcaugagucugggaaguauagaaucuccaaacccaacaauuagagaacagaaacucaaggucaguaucccaugauggcugagcauggagcaugcuucgucaggguuguguuucauuuuuuuuuuuaauuuuugauaaaauacacauaauauaaaacuuaacaucuuaaccagcuuuagguauacaguuuaguggcauuaaguagauuuacauuguuguaccacuaucuagcucuguguaacucuuuuccucuuccuaagcugaaacucuguacucauugaauaguaacucuccucucccccucccccagccccuggugaccaccauucuacuuucugucuccaugaauuugacuacucuagguaccucauauaagugaaaucagccuuugugugacuggcuuauuucacccauccauguuguagcaugugucagaauuccauuccuuuuaaaggcugaguaguauuccacucuguauauagaccacauuuuaucucuucaucuguugguggacauguagguugcuuccaccuuuuggcuguugaauuaaugcugcuuagaaucucuguuuuggguggggagguucuacuaugaagaaacuuaaagaagggaagacuuuuuuugucuucugauugagcugggaucagaacgccaacauguucagcuuucagaacuguucuuuuagacaccuuacgcuacacuuacuaaaugcugucucauccuuccuuucccggaguacauugugaucaucugaaaucagaauuccuuccuccuccuuuagaguacuccuugucugugaaagaauggcuguugauuuuguugcauguuucacaagaggugauucuacuuaaugauuucuguauguguucccaccauguauaaaucauuuuaaggcuuauuguuggcucaaguucaaguacauuuuaaaauaacagcuauuuuucacuuucuuauauugauaucaguuauaguauucucccagaugaauugcugucgccuagaaaaucaccacaaaugaggggaagauagcagguuucaaaggucauuuguucucgucaucagcucaccaccagcugccucagucggaguccuaguuauuuaauuaauaaaguuugguuauuucucugccaauacaccucuuugcguacauucaaguuguuacgggaagaaucuuaaauaucuucauuuugaagccucugugugugauuccccacaugggccacaauuuugggugguuguaguagccagauagaguagaucaguggaaaccagcgccugacccugggaaaccagccagcugaugagcaguccggaugaguggcagagccauucugggugucagauuaaguugucuucuggaauuuugccaguucuguccagaguucugcuuaaaaacccaacauugagaauuuguaauuaaacauuacuuugcuuagugaucuggguuuuugcuuguuuguuuuugagauggggucucacucugucacccagccuggagugcaguggugcgaucucggcucacuacaaccucugccucccggguugaagcaauucuccugccucagccuccagaguagcuggggauuacaggcacccaccaccacauuugacuaauuuuguauuuuuaguagagacaggguuucaccauguuagucaggcuggucucgaacucccgaccucaagugauccacccaccucagccucccaaagugcugggauuauagacgugagccaccgugcccggcagugauuugauuuuuaauuggcaccccuguucguuuccugauuucucucagauugucacggauucugccucuguggagcguuuacuggggaagacggacguccagcggccccaggugguagaguacuguguggucuguggcgacaaagccuccgguauguaguuccagguuaugcuggcacuuauaaugggccaacagcaugaaguaacuguugugagguggggugguaguuaauuuagaaggaccauuuuauguacguuuguagguuucacaugugaauucuacuuuucuuauugggguaaugauguaaauaaguaagguaguuugucagaaauuagacaucaaaaggaaaagucaagaaauuauuucugugauuuguaaaucuugguugaguguguaguauuuaugugcugcuaagaaaguacucauugucuaaucuuguuaacauuuguacagcacuuggcuauuuuacaagguguauaauuuguauaaucccccuucauccuaacuguaacuaucucuuaacauccccucacuauaacccacuguaaauaacugcuguaaugaagcaggaggaggcaugugauuccagcuagugucccagggucaggaaaggccccacagaggcagucgcaccugggagccuugguaauuguguacauguugguuggagcaggaggagggcauuccagcaaguggagccagggccuagaguuuaagaucaauacccaugguauccuugagagagagcucauaggcuucugugauuacgauuggguaaagugagacugaagaagaugucuggcccaaaaauucaagugcuggccugcuuguacuggggauccauagaagguuagugaggcagacaggaaggaauggagaaguauuuuacaagaacacaguaccaggaaugccaggggcacaggccuguguucugugauggcugcuugguuccacuuucuucuguggucacaaaauucacaggaacuuugggcacuguaguccugguuuuuguuuguuuuguuuuuuaaaaaggagguuggaccaagccucuuaggaagacagccccaagcaagcaucuacagaagaucagaagcuccaguuucccuuccaugcuggugacaccauuuaucugccaauggugccugccucugcucccgcccuuuguccugguaaacccaacccauccuaucccuucucugaagcccucaccuaccccaguaggcagauagacagugcugcuugugauucugauugcccuuuccuacagauuaaucacuuguugcauacucauauaauucacucuuuacaggccugucuuccccaucagaaugucagagcaaaaaccaugucuuaccaucuaucucuguauuccugucuucuugcucagcaaggaaaggcucucuacaaacuucugaacaaaugagugaagcaugaacguaacaaaagggccauagaaucugcuuggcuuccccauuugucagucuucuucugagcuuaaaggaaaggccuagucacaggcucuuggugccauugucuccugauauuagugucacucaaagggauagagaacucaaggaaauauacugcaaagaaaggaaaaacaauauuauagaaggcacuuuaccacaacuauucuuaaaagaaaaagacugaguuauuccagaugcacacuugggaaaugguuuugcauacuagagcuuagaacagugggauucucuguagccaccauaaaugguaauccugugaaauguauccuccuuggcaauguagcuaugaaauuggauuauacaaacaagacagaaucagaagagcauguccauggucagucucagcuggaaacaagugggcauaauguaugugaaaguacuuugugaauaagaaagcuaaacugaaggaggggccgcuuuuuuuuugagauggagucucacucugucccucagguuggagugcaguggugugaucuuggcucacugcaaccuuugccucccagauucaagcaauucucuugccucagccucccaaguagcugggacuauaggugucugccaccacgccuggcuaauuuuuguauuuuuaguagagacuggguuucaccauauuggccaggcuggucucgaacuccuaaccuugugaucugccugccuuggccucccaaagugcugggauuacaggcaugagccaccuugcccagccaggggcacuuuuuaaugucauugauaauuaaaaguuggagauaccaugcaaacuguacaccugacaaaggguuacuacccagaacauauagcgaacuuaaacaacucgacagcaaaaaaaacaaguaacccaauuuuaaaaugggcaaaauaccuuaauagacauuucgcaaaagaagacauucaaauggccgaguuauaugaaaaaaugcucaacaucacuaaucuucagggaaaugcaaaucaccacaugagguaucaccuccaguuaggaugucuauaaucaggcugggugcaguggcucaugccuauaaucccagcacuuuggcaggccgaggugggcagaucacaugaggccgggaguucaagaccagccugaccaacguggcaaaaccucaucucuacugauuuuuguauuuuuaugagauauauauuuuuuggcagggugcggugucucacaucuguaaucccagcacuuugggagaccaaggcagguggaucaccugaggucaggaguucgagacuagccuggccaacaugguaaaaccgucucuacuaaaaauacaaaaauuagcugggugugguagcggguuccuguaaucccagcuacuugggaggcucaggcaggagaauugcuugaaccugggaggcagagguugcaguaagccaagaucgcaccacugcacuccagccugggugacaaaagcaagacucuugucuuaaaaaaaaaaaaaaaaaaaaaaagauuuuauuuuuauaaaaucuuauaaaaauaaaaaaauuagccuagugugguggugcacaccuauaauuccagcuacucgggaggcugaggcacaagaaucacuugaacccaggagguggagguugcagugagccgaaaucauggccacugcacuccagucugagugacuaagacucuugucucaaaaaaaaagaaaagaaaaaaugucuacaauuaaaaagacgaaaagaagugcuagggaggauguggagaaaagggaacacuuacacauuguuggugggauuguaaacuaguacagccacuauagaaaacuguauggagguucuucaaaaaauuaaaaauagaacuaccacaugauccagcaaucucaguacuggauccauauccaaaggaaauaaaaucauuauguugaagaaauaucugcacucccacgcuuacugcaugacuauuuacaauggccaagauguggaaucagcuuaaguauccaacagcggaugaauggauaaagaaaaugugguauguaacacaguggaauacauaaaacugaaugaaauccugcacuuugugacaacauagaugaacauggaggacaucauguuacaugaaauaagccagacacagaaagacaaauacgaucucacucauguggaauccuuaaaaaaaaaaauugauaucauagaaacagagaguagaauaauggcaccaagacucaggaggggaaaagugagagauaguugggaaagacugaccaacugguacaaaguuacaguuaaguaguaggaacaaguucugguguucuauugcacuguagccauagcuaacaauaagguauuauauauuauaaaauaccuagaagaaaggguuuugaauguccuuauuaacaaagaaaugauaaaugcauaaggugauggucacucuaucugauuugaucauuauacaacguggauauauugaaauaucaaauuaugccucauaaauauggacauggacaauuacaauguaucagaaauaaaaagagacaccaaaguaaaacaagauuagaaaaauggacuguguuuaauaaaugcauuccuagaacuguguuucuagaaggcuuugaguggcuagcccagguggaaccauaugguaauccucuuuugcugugggcuucggcagugacaguccccaugcuucucccugugacuaucccgcuuccccaggggagguuucgggcccaggacgugaaucagagaggggcuaaaugcaggagugagacccucugugccaaagccacacaugcacguguuugcuaugugccacucguggcaggacaggggcccugagccgcaucacaagcccagaucuccaggaauaggacccagguguguucaaguggacaguagaguucagccgucaccugugagcuccuacuguauguuagaccauuuguauacuaagagcacuaaggucaugccaucugccagcugucauauaaccugucugaguuucaguauuuccaucaugaauucauaaggcuacuugaaagaugguagagaaauuacgugaaggguguggccaguaugcuuaaugcucaggccacguggcuguuggcaucuaacaguguauggcacccaucacuucaaugagacuugcacaggaacugacagaucaccucuuuggugaauccacaaauauagucacaaaauauuuguguauucuuucuccuguuucaggccgucacuauggggcugucaguugugaagguugcaaagguuucuucaaaaggagugugaggaaaaauuugaccuacagcugccggagcaaccaagacugcaucaucaauaaacaucaccggaaccgcugucaguuuugccggcugaaaaaaugcuuagagaugggcaugaaaauggaaugugaguaacaauauuuaaaaaccacaugaguuaauguggagggagacaguaaaugaguccauuaaauaagguuucuauaccuggccuuaaaauacuuuaagaaaaaaauaugcacucaggcuucauuuugguuuaccucaugggucagccaggugauugagagccaacgcugcagggguuggucucuuccugcuguguguguggaaagccuuauuacagaugcaucaggaggcagcuuaguggaguggguugaacacaggcuuuggaggaaagcugauaccaaaucuaccuccaggugugccacuaagagagagcuaugaugccugaggauacacguagccucucagccacaggguccucaucugugaucuacuuaaucaccuuacuuauauauugcuccugaggauuacaugagccuacucccugucuucuuagccccucuacuuucuuuugggauaagguccuuugccaagccucuguguagcugggauucuaaagagaaagcuauugcuccuggauguguggggcagccagggaaggucucaggccccuccuuuccacucccauagacagaauuuuggggguuuucagggaccagucagcauggaggucacuucccuagcuaguggugaaaacaugaagaccaggacucaagaugggcagcacaaagaaauccaaggagaguggaguuaggcuuaagccacaguaggaaaauggagcuuagcagagcaaggcaugcaacuugcaugcaacuugcauggcaaggcugguggccgaggacccaggacugcaggcuuccgcugaguaugcugcaugguucugucaucuuuugcauaguuuucuaggaacucugaaaaccaauauauuucaguauugcuguugacguuucugggaacaggaauccacaaaauucacuggagaauaaauggaaauguauuuuuugagaaauuagaaauaucaaccuaauuucugccuggugugauguuuuuauuuuaucuaaugauacugcucuuugcccaaagugaauaaauaaaucacugacuuggugugggacuggcccacauugccaagcuguccuuuuucucaaugaugaauauuuuuacucagagcaaugacugaaaucaguuuucuugugaacacagcuguagcugcaaacacaauauucaacuggauagcaguuugauuaguagcauaucugaauauuagucccugaccuucaucaguuuugucuuuaaaaagcuuucauuuucuucaguugcuucuaacaugcauaucugcucuuacauuagacugcuaaaaggagaguuugcuagcauaauauaaaauugacacccauuaaacaguuugcagaagcuauucagacuugaguuggaaauuagaaggguuccucuacaaauuguggcauaggaaaugcauucuauuaagggcccacuugaaggugggcauuucuuuuuucuuuuucuuucuuuuuuuuuuuuuuuuuuuuuugaggcagagucuugcucuguugcccagguuggagugcaguggugccgcgucuuggcucacugcagccuccgccucccagguucaagcaauucucccugccucagccucccaaguagcugggauuacaggugccugccaccacaccuggcuaauuuuuguguuuuuaauagaggccggguuuugccauguugggcaagugauccacccaucucggcuucccaaagugcugggauuacagacgugagccaccacccccggcccaaagaugggcauuuuuuuauccuugaaagagucuauuuuguuagcagcaugaaguaaaaaccagcugggcacgguggcuuaugccuguaauuccagcacuuuggcaggcuggggcgagugguuugcuugagcccaggaugaguccagacugggcaacauaaugaggcuucaucucuacaaaaaauaauaaaauaauaacauaaaauaauagcauaaaauuaauaaaauggcccagaaggcucaugggugcuuccauaggccacauaggugcugugcugcaguuuuuuuuagcagggaauaccacccaucgugaggucuuuuuuaugccucuagauuugacauggcaugguuuggcuuuauuccuucucucuggccgaaaaguccacugugaaagcugagcuagaugaaccuagcaccagagucauccucccugcaguaauggauuugggguuuucccuugugguuuuuauugauuggaauuguuucucuaaacacaaauauuuauguugugauuuaagcugugcagagugaacggaagcccuucgaugugcaacgggagaaaccaagcaauugugcugcuucaacugagaaaaucuauauccggaaagaccugagaaguccccugauagcuacucccacguuuguggcagacaaagauggagcaaggucagucccuuguucucacugcaaucagccuuugcagcugauggaggaggcacagacgugucccacagcaggcacuguuguggcuucccacccaucugccauagccuccagcguuguguugccuaauucugccccuucuggagcugcucagucacaccucuggacaggccugaggaugccugauuuaugaaggggucagaaauucuccuagccuugaauucagauuauguccugcaauuuaggcaucauucauacggaagacaauuauuuuaugauucaagauuggggcauuucugcaguacacacaaaaggcccaaggugagauaaggucucagugcuacaguuaauuuguauauucuuuuuaauauaaucuauugaacuuacuuuaaaaggaacggaaagaggggaaaacaagcaauccaaaauguaucagagagagagcuggaguugaggaugccuugcugauuuucugaaaaucaaguuaacuuuucuaggcagaauggccacagucugcagucauccuggaaagcccugggggaugcaucugcauuucauccugucucaagcuguaaaccugacuuuauguauaucucauugcagagagacagggguggggguucugcuuagucacuaagcggcugagucuacuuagagcuuuucuacuauucagacagcuucacaaauguggaaggacagguaaaugcagcaugaucauacugugcauaaaauguuggaagcuacucugaguuucuuuaugucuuaaauagacaaacaggucuucuugauccagggaugcuugugaacauccagcagccuuugauacgugaggaugguacaguucuccuggccacggauucuaaggugacguucucuacucaugcucucucucauccuuuauguugacauugcaggcugcuucucuaacugugugcaccacuuucuuccuggccuucagagaccacaucaaaagcaugaccuaugucucggucuccuuauuguugugauagcuaucuugugauuuguuuuagagaugcugauggcuucucagaucagagcuggcuggucauaaucacuguaacaugucagucuagaugucaauuugguggacauucagugguucucuuuucuguuauaguuuucuuuuucucuuauacacauuggcaaacuacuagccaaggaaagaaauacuuaucagauggccuuuuugcaaaagccccggguuccuuuuuauuagaugaucuucaggaggaagcucagccaggaaucuaucaguuccaaaacuuugcuagagcagaucagucauagggauuuaacuuguggacagagauguucgucaguccaaaagggggagacuugcuggcuccugugaagauaaccaaggagggggauuuuuuccaggccagggaacucacuguuugucucauccuggugcuccugauguaaaccaaguaaugaggaaguaguagcagcaagccacaacucuaagagggugacuugguaauugagaacacuggcauugcugcaaccauuagaaccagagcaaggccugcaggcuuccuccucaucuguucacagucucauucauggguguacucagggcauuacagggcauccucuuuugggaaagagaagacaaaauuuagagcccuugccugucauggagagcugcccugcaugccuugguccucaggcugggccuugcaccuucugucuuugggcaggggccacaugcaugaugggagcugauggaucacgcaucgugggcuuagcuuaucagcagcacacauucuagaacaguggcucugacugcauggucaaaugcagagaaagcguaagccugaaaguaaggcccagauaaccuuaaaaacagauuaccaagggauucacagcaaccauucuauugggccauccacacacagacugggaaugagaaccaagacuccagaacuggcuagaacuggguucagagucugacagugcucuucguagccacaugcuucuuuccugcacuuguaaauuucuugguacacagugagcauucaauaaauguuaaugguuaggaauuaguuauugucacuuuggaggagaaugaccacaaagcuguaugguauuucaggaaucaagagaaagagcuucagaggcagacuguguccuaccccauuccuuccuguguacaauggaaacaacaauaccccccacagaaguuugauacgaauaauaaaacauaugcaaagcacccacaggaagcuacuuucagaaacuguuuuccaauuuuacuuugaaguaauuauacauuuaaaauaauuuacuaugaaggaaguacagugcuauuacagagcucccacauagccuucgcccagguccucccagugguuaugucauacauaccuacgguacaguaucacaacgaggacauuggcuuugguacaaaccauauguauuguucugucuuuuuuauauuucacucuucuucaacuucauuuccuucaacauaccuuucuguuaaugaggaucuuacaguagcugcacaguauucuaugugucuguugugauuuaaucauuucuguuuaugaccuuuucuacugauucuaguuuuucauuuuguaaucaagacauaaccuuguguguacauaucuugguuugaguauaucucuggcuuucuuuucuuuuucuuuuucuuuuuuuuuuugagacagggucuugcucuguugcccaggcuggaguacagugguaugaucuuggcucauugcaaccugcaccucccaggcucaagcaaucuucuuaccucagccuuccgaguagcugggacuguaggugcacagcaccacgccuggcuaauuuuucguauuuuuuuuguagagacgguguuucaccauguugcccagucuggucuugaacuccuggacucaagcaauucacccaccuuagucccugcagagugcugagauuacaggcgugagccacuaccccuggcuuucuuuuuuaauugaaauauaauucacaugccauaaaacucacccuuuuaguguauaauguagugguuuuugguauauuuacaagguuguacaaaccauccccacuaucuaguuuuagaauauuuucgucaccucagaauaaaccccaaacccuauuauguagucacuccuccuuucccccucuucucaaacccuaccaaccacuaaucugcuuucugacucuaugguuuugucaacucuguacauuucauauaaaggaaaucauacaauauauggucuuuuguggcuggcuucuuucacuuagcaugauguuucuaagggucaucaugauauagcauguaucaguacuucauuccuuuuuauugccaaauaaugcaccucuguuuuuuuuuaaagacaagaguuucgcucuuguuuccuuggcuagagugcaguggugccaccucggcucacugcaacuucugccugcugaguucaagcaauucuccugccucagccucccgaguagcugggauuacaggcaugugccaccauacccagcuaauuuuguguguuuuguuuugagauggagucucgcucugucgcccaggcuggagugcaaucgugcgaucucggcuuacugcagccuccgccucccgaguucaagcgauucuccugccucagccuccugaguagcugggauugcaggugcgugccaccacacccagcuaauuuuuguauuuuuaguagagauaggguuucaccauguuggucaggcuggucuuaaacuccugaccucacgauccgcccgccucggccucccaaagugcugggauuacaggcgugagccaccgcuccuggccaauuuuguguuuuuaguagagaugagguuucaccauguugggcaggcuggucucgaacuccugaccuuaggugaucugccugccucggccucccaaagugcugggauuauaggcgugagccaccacgcccagccuaauaauacaccuuuguauggcuauaccacauuuuauuuauccauuagucaauugauggacauuuguguuguaccacuuuacauucucaccaacuguguaggaagguucucauuucuccacauccuuaccaacacuuguuauuauccaucuuuuugauuguagccaucccaguggaugugaagugguaugucauugugauuuugauuugcauuucucaugauguugagcaucucuucauaugcuuaugggcuguuuauauaucuucuuuggagagaagucuauuaucuuugggguuuuguuguuucauuuuguuauugagacagggucucacucugucugauaggcuggacugcaguggcacaaucauggcucacugcagccuugacuuccugagcucaagagacccucccaccucagcuuccuaaguagcugggaccacaggcacacaccaccacgccuggcuaauuuuuuuacuuuuuguagagacagggccuugccauguugcccaggcuugucucaaacucuugggcucaagggauccuucugcuuugcccucccaaagugcucuuuuuccuuuuuuuuuuugacauggaaucuuacucugucacccaggcaguggcacaaucucagcucacugcaaccucugccuccuggguucaagugauucuccuucuucagccucccaaguaccugggguuacaggcaccugccaccaugccuggcuaauuuuuugcauuuuuaguagagacaggguuucaccauguuugccaggcuggucuugaaccccugaccucaggugauccaccucccuuggccucccaaagugcugggauuacaggcaugagccacugcauccagccucuuuuuccauuuuuaaauuggguugucuuuuuauuauugaguuguuagcguuccuuagacauucuggcuacuaaaccauuaucagacaugauucgcaaauauuuucucucauucugugaguuguccuuuuguuuuaugggcuuuuacuuucuugacaauuucuuuugaagcacaacaguuuuaaugaagucuaguuuaucuguuuuuguucugucauuuugucacauaucuagauuuguguaaauaccaccacaccaagauacagaacuguuaaaucacuaaaaagaucuuccucguguugccccuuuguagucacacuucccucuccucgaagcuguuuuugaaccagcauuauaacuucauuggccugagagucauuugcguaucuguguucauuuuuaaugucaguauuuuuuguuuaauaggcugaaacaagccagggagcucugggcacacuggcaaauguagugaccucccuugccaaccuaagugaaucuuugaacaacggugacacuucagaaauccagccagaggaccagucugcaagugagauaacucgguacgagcccaugaggauggagucuccccuccucgccuggacacccucccucuauugugaggguggaaaacagcauuuugguaccugugcuguauuuaacuaaggaugauaaaauuguuacaaugacccugcucaucugucuucuuugaaauuuuaacugugggaacauagacccaccuauguuauacaguauaaaacaaucaaaacuucuuuucauucccaaccauggaaaaggaaauugaguaaaucaguagacauaggaggaaaacucuaguggacagcgguuauuuguauuaauuacuguuuaauaaugcgucugcauauuaagaguucauucccuuuccuacuucuauuuuaaccuauuuuucucaucuauauuuuucuuuuuucuuuuuuuuuuuuuuuaauagagauggagucucaccauguugccuaggcuggucuagaacucuugggcucaagugaucuucccgccucagcaucccaaagugcuggguuuacaggcgugcgccaccacccccacccagcccucauguauauuuuuucugaguaaugaauucagagcuuaaauccaccaggguaacuagagugauaguggcugauagauagugauaguaugagcuaaugccagaugccgauaacugcuacuaaggauguuucuucucugcaguuuggcucuugugcucugcuccuaacaugccagaccagccagauacaaagcuggagacuauacaaguguuccaguccuuuguucacuuguggucugauaacaaauaagaucuagguaccguggaaagugggugggauuugaauuagguagaauucugguucuaccacuuacuauauggauggucuuggaaaaguuauuuaacaacuguaagcucagcauucacaucuguaaaauggaagauaauuuuuaacuuuggaggguacuugugaaaaauagaaauugggccuaggugcaguggcucacagcuauaaucccagcacuuagagaagcugagacaagaggaucacuugaucccagggguuugagaccagcugagacccaucucugaaaaaguaaauaaauaauagauagauagauagauagauagauagauagauagauagauagauagauauagauagaccccaucucugaaagagagaaagaaaaagagaaagagacaaagagaaaaggaaggaaggaaggaaggaaagagagaaaaggaaggaaaagagagaaagaaaagaaaagaaagaaauuguccaugaaguuagauaauacauagcucagugccuaagaugauguguagauaauacauacaaguuuucauuguuugccggaugcaguggcucacguguguaaucccagcacuuugagaggccaaggcagguagaucaccugcagucaauaguuugagaccagccuggccaacauagugaaaccccaucucuacgguagaauuuaauuaucuuuucccacuguaguuuuucuaaaucauagcuagaauucuguucccccuaaaagcuguagauucacaacaauuacaugcuucauuuuugcucacagggcauuugauaccuuagcuaaagcacuuaauaccacagacagcuccucuucuccaagcuuggcagaugggauagacaccaguggaggagggagcauccacgucaucagcagagaccagucgacacccaucauugagguugaaggcccccuccuuucagacacacacgucacauuuaaggugagugaauucagccuaaccaugugcccccaaccugcugggggauagguucuguaccaaagccgaucugcaguuuuaaaaaucaaaccuuggggccaggcauaguggcucaugccuguaaucuuagcacuucgggaggccaaggcacguggaucacuucagcucaggaguucaagaccagccuggccaacauggugaaaucccaucucuccuaaaaauacaaaaauuagucgggcauggaggcgcaugccuguagucucaccuacucaggaggcugaggcaugagaaucacuugaaccugggaggcagagguugcagugagccaagaucaugccacugcacuccagccugggcaacgagugaaacuccaccucaaaaauaaauaaauaaauaaaaauuaaaccuuggagugagcucaucuucaaucugguauuuaacauuaugacuucaaacuggaucuuguauuccagaaugauagucccauuaugaagcaucuucacuugucuuuugcucacagugccauuugguucugaagguaaccaugaagcaggcguggcccaucauuacuaagacaggcugacauagugguaacugcugagggcugaaugcucugccucugccucucugugacugccuggcugccccaugggcucaggcaggcacuuuugucucuucucugugucauagaaacccucauauaaaaucuacaacaagcaggcagccagccauugauccugacugcucugcccucuagagccacagaaaguagaucccuugaagagugcuguuaaggccucauggguguuccccgugcugucauucacuggucucacuuuuucuacaggacacucagaggguaccugaagcccucucagucucuaggucuccagacugcugaguccuccuuuucccccaguauuuuuuuuuuuuuuaaacaaauacauaggcugaagcguagugaugugauuguggcucacuguaaccucaaacuccuggucuugaacuccugggcucaggugauccuccugccucagccucccaaguagcuaggacuauaggcaugcaccaccaugcccaucuaauuuuuauuuuuauuuuuuguagagaugguguccuugauauguugcccaagcuggucucaaacacuuggccucaagcaauccucccaccucagccucccaaagugcuccugucacaugagcugcuuagcucuuacuuacugcuaccuuaagaccaucucccaaaaugccugcuaguccaugaaguuggccccuguuacccagauuuuuuuuuuuugagacugagucucacugucacccauacuggagugcagugguacaaucuugguucaccacaaccuccaccuccuggguucaagcaauucuccugccucagccuccgaaguagcuggaacuacaggugcaugccaccacaccuggcuaauuuuuguauuuuuaauagagacaggguuucauuauguugcccaggcuggucucgaacuccugacaucaggugaucugccugccucagccucccaaagugcugggauuacaggcaugagccacccgcaccuggccccuguuccccagauuuaauuuagaccuuaaccuauggcucaaaauggaauugccauagaacaaauaacaguuuagcugaggcaagacuugaggaguauguuuuugugggggugggcugggaagauccccuuaggcuuauggaccacauuccaaggcccauuagacccuaguucacugagcaagaaaacauggggaguccgugcaagccccccgacugcaugggacuucagaaucagacagcaacucuagaugccacugcuauugaagcaugacagggauacauguugacagacaaagccauccccuguccuuccuucaccuccugugccaugugccuccucuuuuccagcuaacaaugcccaguccaaugccagaguaccucaacgugcacuacaucugugagucugcaucccgucugcuuuuccucucaaugcacugggcucggucaaucccagccuuucaggcacuuggguaaguggccucuugcugugcauguauccucgggcaggagccuuccucucccuaggaaugaccuggaagaacucugagggccugucuaguuugacuguuucuaugaccucauucaaaggacccugaguuuuuuauuaaauauaguuaguggacugguagcaggauuaccaguugccaguucugcaauguuccucuaaacuuuauggagccuccuagauacaccaaggauuuggugcuaggagcuggggauggagaagaauguagaaggcaaggguaguccccagcacugugcuaugcacagugugacucaacaaacugaagccaggccgggaacugugccuaggccuuaauaaggugaaugugaaucagcuguuuccucaaacauggauuuacaaucucacacaagccacagugccaauuggcacauugaguaguacagaaccuggugucaucucuacaggaaaccccccccccuuuucuugcuuucuugaguaccacuuguguauguuucuccucuaaauaccagcaucggcucugccagugugccaagugcugugcagcuggugcagcugccaccgugccaucagguggcuggcagucugguugaaagauaaguaaccauauaaaaauggaaauacaaugagagucauugcauauugcagaguaaccauccuuagguaauauguggaaaacacuagaauggagggcaggguugucuaguaguugacacuauugucuuuggggcaaacagaccugguugucgggccauaagaauagugcuugucagcuguguggccuugugcaagucacuuuaccucucugagccuccaguuucucauuguagaauccucgcguggguuucagaucuauaaagcucuuaacccagugccuggcaugcaagggacucagcagaaggcagugugguucugugggucagguggugugggauguguccugaguaguuguuagaauggucaccucccuccaugauuaaaggaaaggcagucagaauugucccauucuccagggagaauuagacagguagugacugcuaaacaaguauuaggaguuucauuguuagcucuuugggagaauggccuaccccuugcuacuaucugguaggugguguaaccucaggcuuuuuuuuuuuuuuuuuuuuuuuuuaaauaacaccacaguccacaguuaauaguacugauagguaccugagauuuuuuaaaugagguuaaaacauuguuacccacugcccugaguguacuuuuucuaguuggguaauuuggaaccuccuccacagaguuucucaguccgggcuagauaaaaugugcuaccacauuuaaagugguuucauuuacauuucauguacuguuuuucauaaguuaguguucagggcagugaucauaguaaaauacuagaugugcaucuggggcauuugggaaugacccagugcaguagcccugguucucacugccuuccuguggcugggccacacuuaaggcaacuggaagaaacagcuuugucaagacagcccaguuucuccggccuccugaaaucuugagacaggugagggaaugcaauuuagggguuucugagaauaaggauguauuguuuugugaugugccaacuuugcugacuaacugaguagaaguuagccagggcaaggcuggaagcggccuuagcuggacccucauccucccugcuucagucucggauccagcacaaagccugccuccugcccugcaggguugcagggcauguuucugcccuucagaaucuguacucaucuccgucuuuugguccccguagccucucaugaccuuggcugcaggaccuaaguaacugauaccaucucuugggacagucaguccaggaugcugaggcuuuugaaggcuguagguaaugaugguuuggccauaccuauuaacauuuuuuuauuauuuaaagaauguuuuuuaagagaauaguugaucauuagaaggauuuuaguuaaaacauucauagacuuauucauagacuucauccuuuucuugaagaaugauccuggauagcacuucaauaaacacuugcugaauucaccuguuugggaaaugcugggacuuagugccuggaugccccacaaccuuggagaaaugccaacacacaccacacucagacuccuuucuauauuccuaggcaggacugcaacaccagccuugugcgggccugcuggaaugagcucuucacccucggccuggcccagugugcccaggucaugagucucuccaccauccuggcugccauugucaaccaccugcagaacagcauccaggaagguagggcacagggacuuggggcuggggugugucuugguucagccugguggccauggagcagagcccagcccccugguuggaggcucaugucaaagacaccuuuguugacccaggcuggcaacauagcaaauuggauagccucaguuucccacagcauccauaggcugagagaaguuugacuguuaagguauggagccuuugggcugggcaugguggcucacgccuguaauccuaacacuuuguuaggccaggcaggaggaucacuugagcccaggaguuugagaccagucugggcaacauaacgagaccuugucuuuacaaaaaguacaagaaauuagccaggccugguggcaucugccuguagucccagauacucaggaggcugaggcaggaggauugcuugagcccagaguuugaggcugcagugagcugugaucauuccagguacuccauccuggguaauagagcaagaucccaucucaaugaaugaaugaauguuaggaggcuuaucagucagaauauguaaauuucugccagacugcccucuucauacgauuaauaugaagaaaaaaauggaaaaggucaacuucuugauaggcauuuagugauguuuucagaauaaucacagcugauauuuucaucuucauugacagguuacuuuucucauguauaauaguucacagauccucacaacccuauaaaguagggacuauuaccucauuuuucccuauggaggaacugaggcccugauaaggucccuggcuugccccagaugaaacaguaaguacaaaaacuagggcacaggcugggugcaguggcucacuccuguaaucccagcacuuugggaggccaagacgggggaucacuggaggucaggacaguccagcuuggccaacauggugaaaccccuucucuacuaaaaauacaaaacaggaggcugggugcaguggcucacgccuauaaucccagcacuuugggaggccaaggcggguggacugccugagcuugggcguucgaaaccagccugggcaacauggcgaaaccucgucucuacuaaaaauacaaaaaauuagccaggcgugauggugggcaucuguaaucccagcuacuugggaagcugaggcgggagaaccacuugaaccugggaggcggagguugcagugagccgagaucacgccacugcacugcagccugggcaacagagcgagacucugucuccaaaaaacaaaaauuagccgggcaugguggcgcaugccuguaauuccagcuacucgggaggcugaggcaugagaaucacuugaacccaggaggcagagguugcagugagccgagacugugccacugcacugcagccugggugacagagcgaaacuauuucaaaacaaaaacaaaaaaaaaacuagggcacaaaccugcaccaugcugacccccuaguccaggacauacguaccucacccaggcugcuccuuaagagugaacaaacaacuuuucuagugagaucuguggcaacuaucuaguauuugguguucaaaacaccagcagugucaggaauaggaggcagccauuguagucucuccauguguagcaugucugcaacacucugaagaccacugucaugcccaggauucgaaguaacacugaaaaucuacacuuguagcugaaguggaaguuuuuguuguuguuguuuuguuuguuuguuuuuugauacagucucucuguguugccaggcuggagugcaguagcaaucauagcucacuacagccuugaaccccugggcucaagugauccuccugccucagccucccaaguagcugggacuuacaggcaugugccaucacacccagauaauuuuuauauuuuuuaauagagaugagguuucgcugugcugccuaggcuuggaauuucacuuuuaauugggcauuccagguguuugauaucuaggaaugugagugacauagucauacauuuguuuuucuaguuauuuccuuggaauaguuacauaagggugaaguuuaaaagacccuauaacaggcugggugugguggcuuacgccuguaaucccagcacuuugggaggccgaggcagguggauaacuugaggucaggaguucaagaucagccuagccaacauggugaaacccugucucuacuaaaaauacaaaaauuagccugacaugguggugagugccuguaaucccaguuacuugcuaggcugagguaggaaaaucgcuugaaccugggaggcggaggcugcagugagccaagauugugucacugcacuccagccugggacagagugagacucaaaaaaaaaaaaaccccuuacaacauuuuauugaaguuaagauuuguucacaaaugagcuuuaguuuuguuuuuuguuguguuauuguuuuuuguuuguguguguguguguguguguguguguguguuuuuguuuuuuguagagacagagucucaugauguugcucaagcuggucucaaacuccuggccucaagcaggccuccugccuuggccucccgaaauauugggacuagagaggcacgagccaccacaacuggccaguuuuauuuuuaacugaguauaauacuaauacugccaguaaaauauugucaugaggauuaaaugaaauaacauauaaaauuguucugaagccaggcauggugaugcacacuuguagucccagcuccucaggaugcuaaggugggaggaucacuugagcuuaugaauucaaguucagccugggcaacauaguaagacacccaacucaaaaaaaauuguuuugacaacuaaaaauuaccagcauuuaauguucaggugccugcagagacuuaaaaaaccuaaccaaguauauaagcugugagucuucagaauaaaggaauuauuacucagguacacaauaaaagaaauucacaauguacaccuacaggccagcugccuggcagcagggucagggagaaucacuggucuagggauuuguuauugaggcagaacccauauuggagcagaauuuggguaccucuugucacuucaucugcagcuggaaaaugaagcucuuguucaccuugagauuacugauuuuucauuaaaaagugaaauggucccauuucuuuccauauguggccccucaaauaagcugguuuuauuguucuuaccagccuuucucaggaucugugauguugguuucuagauaaacuuucuggugaccggauaaagcaagucauggagcacaucuggaagcugcaggaguucuguaacagcauggcgaagcuggauauagauggcuaugaguaugcauaccuuaaagcuauaguucucuuuagccccgguaagauaugcgguggggaugcaugaccccuuuccaccuguaucuacugauguuucugaacgugaacauguugucaucauugguguagaaagagcccugcagauuguaugugaccuaguguucuuaugauagguguuuugcuagauaaauacauaaacgcuuuuaaauucuugccuuuacagccccaaagaaauaugcugcagugccugaugaugucacgcacugaauagauuuaaucuguguccuaauuaaaccauuggccaaacaagacuacaccauacaaaagugugcugccacccgauguccuuucuuuuuuuuccggcccuuugccaguuuccaaguuuuguuagcgcauauaauccaguacacauugaaguuccacuuguuugcccacagacuguguauagcacugcagagcaugcuaaaagguauguucgcaggagaugaagaggcagcaaucacgaugccugggcuggccucacuccccuuauuaacuguucucucaaguccucuggaaaagucacuuaggcuaauuguucaccucacaguaagggguuggacacagcuuaaccuuuuugucuuccuucccagcccuucacucacaaacaacaaaauagcuaauaaaauugggacaaauuauauaauuauuuagaaaguaaaugacaauuuguaauuuuaugugauaguuuuuaaaacuauguguuuucuaggguaguaggaagccagauguccagaaccaaucauguggggcuguucagacugggauccacucaggguccccgacccgcucccaggaacuucaggccugggcagaaaacagaggaaaagccaguguucuaauaauacccaaacuagaucagucuuugaguucaauuuguuguacuuaagaaguuugcagaaguuugacuaaaaguacuaagaagucuacaagugagacuuuucaaauacagagggaacuggggggggguacuuuucuguuuucagaucauccagguuugaccagcacaagccagauugaaaaauuccaagaaaaggcacagauggaguugcaggacuauguucagaaaaccuacucagaagacaccuaccggugaggcauucaggcauaugcgcucuugcuuggggcugcaaggaguguggcugagucugcaguuucuaauauaaauuauguuaaccuuuccauuuuuagcagccugauagagccuccauuggaucacacucuaauucuugaguuuucuuuguuuuuuccaagcucccaagagcuagagauaauucuugaaugcuagaggugguguagaguguagacagugccagcaggagggccaggacuguggcugauuccaguuuugcugugugacugugagcgaggccucagauugcuacucuuuaauuggaggaguuggaacagaugcuguguggccuguucuggggcuaacacuguacaugaggcuugaguucucauggagauuccuuuguccagaauaguuugaaaggucugcuccucuggucagcauccauugaagaggcagugcuagaguacuugacagaaaagugcuuauugacagaaaauucuuauugacagaaaucaaaucugaccccuauaaaggaguggaugaguuauauaaagucauuuuacccucagauaaacuaauggaaaaaaguuuguuugggugcaaauuagugguauuauuuguaauuaaugugcaguaaaaauauguguauaaaaauuaggaccgggcacgguggcucacgccuguaaucccagcacuuugggaggcugaggcggguggaucaggaggucacgaguucaagaccagccuggccaagauggugaaaccccgucucuacuaaaaauauuuaaaaaaaaauuagccaggcacggugguaggcgccuguaaucccagcuacuggggaggcugaggcaggagaaucucuugaaccugguagggugggcagagguugcagugagcugagaucacgccacugcacuccagccugggugacagagugagacuccuucucaaaaaacaaaaaaaaaaacaacaaaaaaaaacccuuucucgugcagcuuuaggcaggaaaauuguucagaucugccaaaggucagaaugcauuggcaggcuuuccagccaaggauggaagagugcugcuuuccuaugacaacuucugaccuaccagaagcuacaugaauuucugagacccuuucaaguaaaguauuuccuguuucccuccccaccaugucccccuaaaauaaacauuggaacaaaauugacagccugggaagacacacaggcccaccuucccgacauguguccucugcacagaccucagucuccaggagccccauggaacacagaugccccugggggcuaccccuucuggcccagugcuucucaaaugauuuugccccccagcaggguaaccagcucuuagucuuucagcacuaaaaccaggacagucccagucauuucucuggugugacugggggugucuuauggcuggcugguccugcugguagacaagagccugcuucuccuuuuggcgcacuucuguugcccagauguggcuuuuacaaaagcaagauccauuuucuacuggaaucauugaagacuucaucaugaaucuagaauaacuucagccucaauacauagagaaugggacugucagggaaugcauccacacccagaauuuauacauccagccagguauacagucagguuguccuccuaggaggccacaggccugcucccccacaguucccauggccaaaagauggcuggaaauggcccucuggggcuacuggcagagccacagcacacucgagaaucacuuugacagcagugauucuguggccuuggaaaguagauacaaugugucugaaaacaucaugagucacuccuguccagucagggacccaggguuggguagggugacgacagguuacuuggagcccaaaaugauaagggaggcuuucuuauagggcucagaaauucacucgagauaguucucaaagaaaagggccuagaguguuuuacauccuguuugcauauucauuuuuucuuuaucuugauauuuacugucuggaauauccauuuuuuacucuuccccauccuugugccuuuucucauauugauuauuccuccugaaaugccucccaucccuccccauucuuuguaucucugcugauagaaaucuuagccagccccuaaggcccagcugagauggcaggucccuuacaccuucgugugcccugcaagauuggagcacagcgacucauuguggcugagugaauggaugcuggugcuggaaugcuaccugcauaguaugaauacauuuucccauuuuaaaaauaagcaguauucacucuagaaaaauuuagaauguucuagaaaggaaaaaggaaaaagaaaacuuuuuaaaaagcacuauccaggggcagggcguggugacucacaccuguaauuccaacacuuugggacacugaggcagcaggauuguuugagcccaggaguuugaaaccacccugggcaacauagugagaccccaucucuaugacaaaaaaaugaaaaauuagucaggugcgguggugugcaccuguagucccaguuacucagaagucugaggugggagacucacuugagccugggagguugcgguugcagugagcugugaucacaucacuccacugcagccuggaugacagagcaagacacuaucucaaaaaaacaaaaacaaaaaagcacuguccagauaccuacuauuaacauuuugcguauucacuuccagaaauuuuuuauguauuguaauugggaucauaaaauaccaaagguuuuguaaccuuuuuucauguaauauacaauaacaauacguacucuucuucauuuucuaugguuccuauuucccugcuaaugaaaagguaggguguuuccgguuugggcugucacacauggcacugcaguagaguccuggcacaugcuccacuugcucaccugagauccaguccuggcuggggaauggccuggucacgugggacacuugagauacacaguguucaguggcccuccagggcagcauuguggugcacccuccaccccaaguuucuucaaaaugaaagcuauuuuacugcuuuauuuauaaugcuaaaugaacacuggaaauuagagcaguacaaaaaauaagaaaaaaucaccucaaaucccaauacccagagcccaacuguuagcguggugaacauuuucccaauacuuuauauacacaucuauacuugcuguuuuauaaucuccuuuuaaacuuuuauugagcaauaugucauggaugucuuuccuggucaguaaauacagguuuguauuaucguuuuuuaaaugagucucuagcaguucaucauaugaagacuccuacuuuagucuguccucuguugaugaauuuccagguuuucucuugguggugggggugaggagaguuggaauaaacaagagugaagggaacacaucuguacauacauuuuguacucauuugguuuuuucucaugauaaauuucuauaagaggaacuguugaaaucagaaaagagagguggguggaugguggauccguuugguuugauucugugcaauacagacgggaccccaggagccuuugcugagcugugguugaagggcaucaaacagucuccuuuucuaaugacacucccuuuuauagauuggcccggauccucguucgccugccggcacucaggcugaugagcuccaacauaacagaagaacuuuuuuuuacuggucucauuggcaauguuucgauagacagcauaauccccuacauccucaagauggagacagcagaguauaauggccagaucaccggagccagucuauagcgcaaaccacacaccugccaaggagcaacagaauccuuccaggaccguucacauacaaagaaaaguagugguauuuugguaugugcaaauauuuccauauguuagccauuuccugucugguuucuccuuaucuguuaaucccagacaauagcaauuaaaagacuaguaggauccuuuccugacauaagaaauguuuuaaugccuuuugaugaagcagcagauuuuggaacaaucuuuuaacucaauuuguauuuagaaauucucaaagggcaaaaaacaaaaaaaaagguuuuauaaugucagagacuaguauuaaagaaaacugaaagaaccugagagaauaguauguguguauauauauauauaaaaaaguccuuggaauuauagauacuaauuaccaggguaauaauauuagcacuuucuaagcacuuaucaauguguaacguuagcaacaucuugccugugggcagggcaaauggaaaacuguguaugucuuuugccgaaaugcuaaugauuucugugaaaacucacuaggguacaggagacaaucauuuauguuuaagaaaagaaggcaucauuccuaauugugugcacauguuguggaguugagcugaauucugugaauggaaacguggcucauuugcaucaugcaguaagugggagugugguagcacagucgguggugacccaguucagaagcuucuagccauagagcagacacuugucagguucccugacuacuugguccuggucucugaugggcaucugcagacuccucuagaaccugggguucuccuuugaugacugguuaucugaauuggauugcaacuagucagacauuaacugccaaaugagauguacaguuccuccagcaagugaaaacauccccaagucacauccgccgcucguggcagauggagccuugugaccaaaaagugcaaggugggcauuuugagcucuugacaguacuuccaauacaauugggggugcuuguguguuuguccagauggaggaguguggccuuggagugugagcguuaccuucccagggcuuuccacuccaaaugcccccuugaaaagggcucguguuucugcagcuccaucauaacugugaggcuggauuggggcugggcaggagccugcugccgccuggcgagagugguuagggccugguaaagcuggauggaagguuucaggacaauuucuuccuguugaccuuaaauaccagagauuuuaaaaauguguauagacucagcaucucuguuggcaagucuguuaauguuaccagcacacugugcacuuugguucccccaggugugugccagccgaccaccccggagcauuuuaaaugcaggcugcuugcuccuuaaaaacaacccucaauuuccagggugauagucuuucuccucauaaauuguagcaaccagaguuuacagcaagaacaguaugcgcuuaaaaggaaguuaugucuaacuucaaacacccguaaauucccacggaugugaauauauagcaagcuuuuccuguuugagaacaguggcauguggaagacccggucaauugcuuugucuuuugcuuuuuaaauaguccagauuaagaaaauacacccuguuggguuaaauuugccucucuugauuuguuaaucagaugauauccaaaaagaucccuggacacuccccugacucacaggugcucugaucuggcucaggcuggcgccacaugugcuccacaggggugcagucuggccagcuacagacgccccuguggugccacauuggacagaauggaagcugcugcaggcucaaggcagaacaggaugcuugauccugaaggguuagcagcacuuuacgcaagucaguguuaguaggguaagugggaacaguguuuccaacuucuaaauucuuguuuggauuuaauuauaucauuuuauaauucuugccuuggcagcaaauuuuggagaguagugggaguggccauuauaaaaugauggaaaggauuuaauuuugccagcuuaaaguaauuuuuacuuuucuaacccugauguguuuucaguuucaaaauuaagacaaaaaaccagcugagacaauggaauuagggcagguuuguuucauuucugcuugugaaggcuuuuaguagcaggcauccugcagcucaguggugccucuaacacagauuguugccugccuuccgucguuuugauccuugagagugaccaugagggccauguugcaguucccugggaauacaagcauaacagcuuucagaucccaguucuugguguuggugaaaaggucuccaccagccccuccucucauucccaggucauucaguggcagccaguaggcugcuuagacucaggcuggauaaggaaguguugggcuguggugaaacaaccuugcagaaaacgugauuuugcuuggaaaggugcugauucuaaccugguccugcucuuuaaguccccuugcuggugauggcugauuccagggacuguuuugggcuuugaacaccucuugguugguuucugagauccucuuggccuuacuuugaaguggccuuuucuuuaaggaucauguccacguaaccuguauucuugcugcuuuaacucauuucaagccucugacugcagguccauuucaucuccugucagguugguuaaguaaagucagcccaaagucaagaauuacuuaaagagaugcaaaccaaauauuugggcuccaacuuucacagggcuuauagcccuuauuagcaguuugugaaacuuuggguuucaugaagugagaccuguccucuggcuacugaacuccauggagccacguucaugcucccucuucuacuggccuggcugcuccucccucaaugaggagaggcagcuggcucagagaggugggacagacacaugcugucaucaguuaagugagcucuuuuccagaaguaucucagauaauguuggguuaagacagauagauguugaaaaugguggagaucauuacacauuagcauaaaacaggacaggaagagauuuuuugaaagaccaaauuaguugagcaaguaauacuuuucaaguuacuccuggaagguguuuuuaaggaaguguguuaccuaccauacucuccuaauuugacauuucuguguccugaggaguuacauuuauugucuaacccuugccauaaggcugugguuugagguucuuuugcuguucugggcuuuauauuuaauuucagguguagucacuucuaagauguguaauugcccucaagagggacugauuuuuagcuugucauugucaguauugaauguggacucuucugaggcaguuaggacaccagccaugguguuaacaguggaugcguuaggcuccuuaaucucaaggcaauauccacgcuacacacauacuuauuagcugucuuacuuguuugggggauaguuacggcaaggagcaaaaaauucuaaggacucuagcuguuucuagugcuuuuacuuucauaguccuuugaggacauuuccugcagagcacucuugcucacagcccgcccucugcagggcuuccagccccuggccgcaaucagcaguucaugccacauguguacauccauguucugggaccugaucucauuggaguccagaagcuuguugcccacuuuccaguguaaaugacuuuaugugcaauggggucauagguaacauuuuaacucuuuucuuaguccaggucauaggaagucucaucaucugacagccacuuuucucccagggaaggcggugcccacugggcccugggaaugccugagccagcagagcagaugccccacgugcuuccuuuauccagcuuccauucucucaguuaugaggcucuuugaaaaugucuuaacuuugauguaaauuuuuaaagccaaccccucaucaagacaggguugguuugggucuuuuguacacagggucuggaccuucucauugugugccucccaccagcgugcacuucguauguccagcccugggucccuucagcagcauugugcguguacagguuucuaggcuguaagacugaaugaauguacauguguuuauauccucuccauauguacaguguauauaguguguguauguguacauagauguauauuauguauacagacauguauccaaacuuuccuuuaaagagaguuuuucauaaaguugcuaauguaaacugauauggguguuccaaggucccucggcagggaagauuugcuggugauuuucuucacuccauuuuccuuugggugagccugccugggaagggccaugaagucagaaucuccacucugcaaaaggaagaauuccaggcagaagagguucugacagggugacauuuccguauauucucuagguucggacaagagccaggaagcuggaagacaguuuaucuuaauauccaaaacuaagugggaauuuuuaaccuuuucaugcaccuauucauggcccuaccuggaaggaacuuggcaguuggguugagccaucagccuucccagcuauucagcucuguugaguagcccagagacaggcgucacggucagagauucagaacggucugugucagugaggccugacucccaaagaugguagcaauuucccaggcuugcgcugugcucagucagcaagauguggggcacuguccuaugacugaauaaauaguaauucccaucuuucuaucgccaguuaaaaauaaacaaccuaccaaguauuauucuuuaaaacuaagcauggauguugauggcuaacuucugcggcauauaagcuacagaucucaaguuacuucucuaacuguaagcauguaaaugacuuuaacuccuuucuauaaguuaugauuuuaaauuuucagauaagaauugcauuuuaauauggauaugugugcccuuaaaagcuacagauaccaaauuuuccucguccaggucuacucggacgaauuuucccccuuaaucuggccuuaaacugagacucggcccuugagagccagggccuggcccagcaguaguugcucauagaccugggaagcaggggccugcuggaaggaaucacuagauugcugcaaaaacucacauaauccacaguuuccucuuuuucuuuuuaaaauaaguuaucaaaauguuuuaaaaacacuuuaugagaccauaguacucagugccuuuugugagacagugggucauuuagccuucagcuucccuguuuuugauguagagaaagcuucuauuucacuggccucaucccacaagauugugcgaccuuuccccgucauagccugucgugacaaucacgcuauugaaaguggcuuucuaguuaaaaugcaauuggaaacuugacagucucuaaaugaauuaaaaguuuccuuuggggcuauuuagcuuaacagcagucuacaaauaauuaaagugugagcuuaagaaaaguaucuuugcggggagaaaaaugucagauauuuuuaaugcccagcuauaaauaauuuuggugucuugauauuuauacaugcaaaauagaaaaaaaauguucaacauuuauugauugauagacuguuaaaauuuaauguuuggaauaacauuuggaaguaguagacuuugcauuaaaaaauggcuuuucuuuaggaaaguauaaucaauuauuuuaaugaccauagcauucauggacucaaaugcugcugccacacacaacucaagugcuggaauauuuuucuacagucucucuguucuacggauuaucuuguaaaccaguguucaacuaguuuuauaacugaaaagcugcacauuuuucacaguacaagccguaguuuuuaccuguaguuuggacuucucuguuagaauguaacugcauuaccagcccuuuuaaaggcaucuaucuaucaaaggaaaauuuggguguuagauuuucuugggaccguuucuguaaccuuugcccuucacaauauagaaaauauugguuuugccauuacauuuuaaugccagguuuaaaaccuguugaaagcugcagcuuuauacagcuuucuucucccugugaaaucacuuuguuuaugugauggcauuuaaaaaauagcauguucuuuuuaaacugaauuuuauaucuaaucaaugucuucagucuugaagaagaauuugcauuguuguguuuguauauagaguauugcagugcaugaauuagcuuuaugcauuuuauuaaaugcuguuucaauguggcauuauuguuguggcuuaauacuacuaccuaaaugagguuuauacuauuaaaagugaauuaaagacuaa

SEQ ID NO: 191662 - RNA, 158184 nt, Homo sapiens
uucagaaucacgccggccucauucuaccgcugcucucuccuggaucucggccacggaucuuuugcucgcgaaaguuccuccgucuagcugcacacaacgcugcugcaggaaaccgagguaagggauuugccgagacuuagcuccaccacacuccccgaggccccgccccuccucucuggcccuccccuaggcccaggugucucgcguugcacgugcaguuguugugguucuacgucacguggucccggaaguucaagacagacccgccucaaacauggcggcgcccagcgcgcgaggacgugauccgcuucugcuccggcuuggauuguagccuugacgaggucugagcgaccauggaccggccgggguucguggcagcgcugguggugagugcggggcggugggguggguugcucagagugccggcguccggcauuggagcccgcggggguucucugcacugguuuucuuccgguuuugcgggcuggacuguccucggguuacuggcagccaggucugagagggagcacgaggcucccaggccaccggcgggccagguguuaaggcuaugucuguacugccaggucauaagagccaggugggggaaggaaggugacucauugucuuuugcacccucauuuacuuaaaaaagagcuucuauuauacacuguuaacuacucuuucauuaaauaguguaacuacucuagagaucuugggaauuaaagaaauguauguaacacaacaacaaaaaccuuacucacaucgcucccagcccuucuauucaauaccacguuucucauuuugcugcaucucuuuucagucuuagaaaaugacauguccuucuguucauucaauacauaaucugcuauuucugcuccaagccuaggcuuuggagaaauauugaugagcacacauagcucaucgggaacgcugcggagucaauaaacaggcuuaguauuuaauuccguagcagaaaacuacgagaaucaacaugaauuaacagaaaaaaaaguccuuuaccaaauauuuuggagcgucugguagaggauacuagauacagcaguuaacaaaacagaguuuggcugccuacguuuucauuguguggaaugggcagagacagacaaauaauuuuuaaaaugauuuucauagggaaaauggaggcccacagugauuuagucacuuaauuaucgaauuuugguguugcagguguugaggauaacauggugaacaagauagaccugcuccuaagggucagguguuagagacaaaauaguaaaaugacuguugggauaaauaacaggugggcuagauucaggguguuaggggaauauauggaaguagggaugucuuagccagacuuguaggaugauagcuuuaaaucuagauuuguugaaacuuguauaagguaggucuuagaaauauaaagaaauaauguuacugauuuuuuuuuuuuuuuuuugagaaggagucucacucuucgcccaggcuggagugugguggcgcuaucucggcucacugcaggcuccaccucucggguucacgccauucuccugccucagccucccgaguagcugggacugcaggugcccgccacuacgcccagcuaauuuuuuggguuuuuaguggagacgggguuucaccguguuagccaggauggucuugaucuccugaccucgugaucccgcccgccucggccucccaaagugcugggacuacaggcgugagccacggcgccuggccaauguuaccgcuuuuaaggagcuuuccugucuagcuggugacacagcagcaguaguuugucagcuaacauuccugugccaggaacugggguaagcucuuuacauacauuaucccauuuaauucucacaauaauugaacucuuauccuaauuuuccaaaugagggaagugggauaccaagagauuagauaacuaguucaaaaucacacaagugagauccauuucgucuguguaaguauuggagcucauauuccaacccaggugaugucaccugggagucgugcccuuaucugcuucuugauacucuccgaagucagcaaagguugcaauugcuaaaacacaggugagugcugcaguuaacaaaagaauggauuuaguauauacuuaauuaaaguaugauacacaugcaguaaaguauacuuuuuucccaauguauuuauagaggguaaaauuagaaucaauagguggaaguuucaagaaacuagauuucauuccagguaaaggaaaaacauuuuauuuaugcauucagcacacaauuuuucuuccaucuauucugcccacuggguauugugguaggcuuuguagauacaguggcagauaaccccauuucaaguagggaagaaaggccagcagauaaaacaguugcaaugaauaagugcuaugaaagaaaugaacugaagaugcgacagaguaggcaaauauuggugaaccucuuagauggagugaccaaggaaagccacgaagugguaacauuucagcuaagaccuaaaagauaggaaggggcuugaauuuuugaugaucagagugggagguucagucauggggaauggcucaaguggaaagagcuuagaguuuucaaguggugaggccuaauggguaaggauagcauggcagggguugguaugggagggguaggcaaagccagcugagguggggcuuuaugggcuagggaaaauaauuuggauuucauuuguaguguaauggaagccauugaaauguuuuauuaucagaguaguacggaaauggaguggcuacuuuuaaugucuuggagugcguuugagacucagugaacacuccugagggaguuugguuuugcuuacgacucuuuuaccaguaccuggcacuagguaagcacucaguacuacuuugaaugaaaagccuagaugauugcugaagucuugaaacuuggauuugaagaauuaaaugagguaacauuaaacacacagagcagagccuggcaaguagcagacauugaaaugcucccuuccuaaagcuucaugaagaggauugaauaaguggagagccucugggauguuaguuaucauuuggagcacagagugggguauccagaaacaaaauccucaaagaguacauugaucagugcauacuuuuaggaaagcaacuggaacuauguauuagcaaccuaaagauauuuauauaaauaacauuuaacucagugaagacaguaagaagcugcuaaaacaugggacagaggggaagaauuagacaaacaaugggaaacccauuucuuggacuagucugcagccauaaaaaauagugcuugugaagagaauguacuauaauuacauggaaaaugcuuaugagauaaaauuaagagaaaaacauugcauguauguauauuugcuuguaccuaauuaaagcuauguuaaaaccuauuccauucauggggaaaaaaagccagauugaaauacuccaaaauagcacuaaguauuuuuggugguaggauuacaucguguuagucuguucucaugcugcuaacaaagauaccugagacuggguaauuuauaaaggaaagagucuuaacugacuuacaguuccauuuggcuggggaggccucacaguuguguggaaggcaaaggaagagcaagucaugucuuacauaguggcagacaagagagcaugugcugcaggggaacuccccuuuauaaaaccaucagauccugugagacuuacucacuauuaccagaagagcaagggaaagaccugcccccaugauucaguuaccuuccaccaggucccucccacaacacauuggaauuaugagaguuacaauucaagaugagauuuggguggggacacagagccaaaccauaucauuccaccccuggccucucccaaaucucauauccucacauuucaaaaccaaucaugccuucucaacaguccccaaagucuuaaaucauuuuagcauuaacucaaaaguccacaguccaaagucuuaucugagacaaagcaagucccuucugccuaugagccuguaaaaugaaaagcaaguuaauuacuuccuagauacaaugggguuacagguauuggguaaauacacccauugcaaaugggagagauuggccaaaaugaaggggcuguaggccccaugcaagucugaaauccaacaggguagucacaucuuaaagcucugaaaucaucuccuuugacuccaugucuuacauccaggucacgcugcuguaagagguggguucccaugguggcuuugugggauauagcuccccuccuggcuguuuucaugggcuggcauucagugucuguagcuuuuccaggcacaggguucaagcugucaguggaucuaccauucuggggucuggaggacaguggcccucuucucacagcuccaccagguggugaccugguggggacuccuuacuggggcagccacauuucccuuccacacugccccaguagagguucucuaggagagccccaccccugcagcacaccucggccuggacaucccgacguuuccguacaucaucugaaaucuaggcagagguucccaaagcucaguucuugucuucugcacacccacaguaccaacaccauguggaagcugccaaggcuuggggcuugcauccuucgaagccauagccugagcucuaccuuggccccuucuagccacggcuguaauggcugggacacagggcaccaaguccugaggcugcacacagcaagggggcccuggacccaguccaggaaaucauuuuuucccuccuaggccuccagagccugugaugguaggggcugccaugaaggucucugacaugcccugaagacauuuuccccacugucuugucaguuaacauuugacuccugguuauuuaugcaaauuucugcagccagcuugaauuuuucuccagaaaauggguuuuucuuuuuuaccgcaucaucaggcugcaaauuuuccaaacuuuuaugcuuugucaccucuaggaugcuuugccacuuagaaauuucuucugucggauacuguaaaucaucucucucaaguucaaaauuucacagaucucuagggcaggggcaaaaugcugccagucucuuugcauagcaagaguggccuuuacuccaguuaccaagaaguuccucaucuccaucugaguccacuucagccuggauuuuauuguccaucucacugucagcauuuuggucaaagccauucaacaagucucuaggaaguuccaaacuuucccacaucuuccugucuucugagcccuucaaacuguuccaaccccugcuuguuacccauucugaagucgcucccacauuuucagguaucuuuauaguagcacccuacuguggguaccaauuuccuguauuagucuguucucacacugcugauaaagacauacccaagacuggguaauuuauaaagggaagagguuuaauggacuaacaguuccacauggcuggcagaggggccucacaaucaugguagaaggcaaaggaggagcaaagucacgucuuacauggcugcagaugagagcauaugcaggagaacuccccuuuaugagaucaucagaucuugugagacuuauucacuaucaccagaacagaaugggaaagaccugccaccaugauucaauuaccucccaccaggccccucccacaacaugugggaauuaugggagcuacaauucaagaugagauuugguuggggacccagagccaaaccauuucaugugcguucuuuucuuuuuuugagacaaggucuuccucuguugcccaggcuggagugcaguggugcugucucugcucaagugauccucccaccucagccuccugaguagcugggacuagaggcaugcaccaaccacgccuggcuaauuuuuuaauuaaaaauuuucuuguuuuguagagacagggucuugcuguguugccagggcugguuuugaaguacuggccucaagcaauccuccugacucagcuucaaagugcugagauuacaggcaugagccacugagcccagcccauguuguucuuacaguuuuuagaaaauuuuuuuuguagagagaggugucacagguaugagccaccacaccuggcccacccuaagaauuuuugucaaaacauuaaaaacgcuuugguuguaaauauauaggggaaaaauugcaaagcugauguuuauuuaguacacuguaauuaaaaacauuagaaacauuaauaacuuaauuuuuuggacaaaaccuuaucaacaguaguuugaacauuugcuuguguucucauuauguauuauagaagaagcaucuuuuuaugccuuggcaaguugucauacugcuuucucaguuuggaucaacuucuaacauuuuauuuuuugugcuuucaauguugugaguucguuuaaugcgaagacuugcugacauaacuuagucugggacauuuucauccuuuucaucacaacuacuuuccuuauuuauguuaaauuugcucucacuuauuuuuucuaguuacuuaucuagaguaaugacagcagugugaauauuuccauggccagcuguuuguucucuaauaccauuuaugucugauuuuuguuuaacuuuguguuaccacuuuucauuuuuuuugcauuuucaucuuuguucaucaguuuucugucuauuuuuauaaaaugucgugugcauuuauuacugggagaugagguaacaacuauuugcugucugugcguaaacugaguaauaggcagugauuucuguuaauuguauugugauuuguggacugaacaaguggugaaguuuacacuuuauccaguuacucauaguuaauaugcugugguaacugaaauuugaccugggucauugggagauucauguuauuuaaguaaaucaugguaacugaaauucauguauguagguaccaugcaaagugaggaccgcuuguaguuuuuguuuuccuguuuuuagugaggugauuuuuggcuggugcugucaucuggggagcuuuuucgugauacuugggugucuucucacuggaccugcccuucugcugagaaccaccuuacaggcaguaggauacuugaggggaacaauguggguuaugauggcagggguucuuggguggagugaagaaagguaauacgaaugaaguauuggguauacuauuaaaagagguuuucuguuuuguuguuuuucuuguuuugccucuuaucuuuucuggauagugaccuccuaguuuucaauuuggaguaaagggcaucuuuaaagauuaucuccaaauuuauaaaaaauugagaauuaugcuucucuuucucaggacuugugugacuuguuuauuuuuggcauuuacgucagagugagcaggucuucccuuuuugcuugcuuuuguguugagcaagaaauuaucuaaacacaaguauauuccaaauuuugcucagcccguggagcaugcaaagcacugcuuggagagcaccaaucaugcaaggaccacaacugauaaccaccacugugauggaggcauuuuuuugugcaucucuacuacccacagaugggacuaccuuucuuuuuucauuuuucuuucuguuuaagaaaggcauacuuggaaaguuuuaguauuugauaacuuagcuguaagugacuuguuaaugugcuuuuguuaccacuuccaaacccuacuacuacauguugaaaguugcucuaaauauuaaaucuuuuguaauacagacaaaauuuggguaacauuaauuaaauuccaaauaaaggaaagauaaaaguuacacccacaguuaucucaccuccccaaaucaggugucuuuuacaugcuuaaccagauacauuuguuggccuuugcuguguuauuugggguugaaugccugaaaaauauggucccccaccuucagggauuuagagucuaguaggaggcagaugcuaaacgaaacuuaauuauauaauuccaaguggugguaacacuuaacuguuuacugagcacuuuaaaagugcuuaugcaacuuuuucauagcugaggucauauagguauaauuuuauauucuacuuuaaaaaauuaacauguaaguuugaauucaagaaucauaaagcaauuugaacacuuauauuucucuuuaaguuuuugaaguugaugcugaauguuccugucaugcaucacaugauuugguuucuguugagucaguucacuggggauucuuguccagagagcagaauuugagaagagcuuuuaauucauuauugcuagugaaaaacuugaauuuacagauuuuaauauaugaauuugucaguugaguugaauauaggaaugucaucuucaguguuugguaaaguacucuuuaggcuuuugcgugguuuuuaguauuugcaugucaguauugguaccagcaaacuuugaaggauguuuauaguaauauaauucuaaaaauaguaguuuauugauaauugauuaaggccuaggcauuuugcuaaccauauaacagguucaucugauuguguuuaguucucauuuauuuuauuuaauucucaaaaacucuaugaaguauagguacucuuuucccuguuucaugugucaagaaacaaaggcuuagagagguuaguuucccuaagaagacugauaugguuuggcuggguccccacccaaaauuucaucuugaauuguaauccccauaauccccaugugucaaggacgaaccaaagguggagguaauuggaucguggggacaguucccccaugcuguucuccugauggugagugagucucaugagaucugaugguuuuauaagugucucgcauuuccccucuugcacucucuguguccugccgcccugugaagaaggugccugcuucaccuuugcccucuggcaugauuguaaguuuccugaggucuccccagcagugcggagcugugagucaacuaaaccucuuuucuuuauacaugacccugucucagguauuucuucauagcugugugagaacagacuaauacaaagaccaaguugaaaccgaagcuaaaucuguuugauggcaaagcuguguucuuaggcaauacuuaauuugaaagaauuccuggagaaauggaagaauaaucgagucagauucuagaaccauuauuauuguauucuugagaauagccucacuaaaaaaaaaacugaauguacacaguucuuuccauuaggagguaauauuaagcagagauuucuggagaagucccccugaguauuccacaaaguggucaugguggcugaggaaugcugcgaagaauagcagcagauagcugacccugacuuuugauugucacacaugcuguggcagaccagaacagggaccaccaagcagugcuugacugcaagauuuuuucugaacauuuccucuuuuuacaaaguguuaucucaucaucccacguuucuauuuuagcaccccugcuauauaagaaacacucgguuagauauuuaggaaggcaggugacugaucugguuucuacucugaaggaucuaaacgucagacaugaugguuaguaccaaaaggaaauauaaacaacauuauauacuagagugaugguuaguaccaaaagugaaauauaaacaacauuauauacuagagucaaggacauagcauuuaauucugacuggaaaauugggaaaggcuuuaugaggaauguggcauuggguugcagcuuuaagaacggagaggauuuugucaggggugugugugugcauguauguauguagggggguggaggcgauggugguuugcuggcugcaauaggcaggagacaaggauaagaagggaauuuuaggccgggcgugguggcuuaugccuguaaucccagcacuuugggaggcugaggugggcggaucaccugagguuuggaguucaagaccagccugaucaacauggagaaacccugucucuacuaaaaauacaaaaaauuagccgggcaugguggcucacgccuguaaucccagcuacuugguaggcugaggcgggagaaucaauugaaccugggaggugaagguugcagugagccgagaucgugccauuguacuccagccugggcaacaagagcaaaacucugucucaaaaaaaaaaaaaacaaaaaaaaaccagaauuuuagacugagagaaaaaccuaagcagaagcacaggaaugagaaguuuuaggaaacaacugggugcaguggcuuaugccuguaaucccagcacuuuggaaggccaaggcugguggaucaccugaggucaggaguucaaaaccagccucgccaacagggugaaacucugcuucugcuaaaaauauaaaaauuagccagucaugguggcaugugccuguagucucagcuacuccggaggcugagucaggagaaucgcuugaaccugggaggcagagguugcauugagcugagauugugccacugcacuccagauggggugacagagugagacuccaucucaaaaaauaaauuguuucaggacguguuugagauguucgaguagucagauugguugaacacuccaaggucuauagagggugaagcuucaugaagcugcagaggagguagcuuagggucaguagguugagguucuuaguuaccguuugcugaguggcuucuauauaucaaguacaaccaguaaauuagagauuuuuuuuuuccccaggggaagcaugaauuuugaauggcuuagcuuuuauauauuuguaauauucauuacaaaacuugagcaaauaaaaaauuaacaagguuguuuaaaaaauuaauaauucuuguuauuuaaaauuguuaaaaauuauuuaaaaauuaauuguuaaaaaauuaacaagaaauauuauuaacaguaguauuucucauccugaaucucuuuccacagaggcaauaauuucuagcaauuuacuguuuauguuccagacuucuaauuaugcauauacaaauaguuacacauuuuaaaagaugggauuauauagcauauauuguuuuauagcuaauuugauuaauuuaagaauauaguguauguuucugugccaauaaguauggguuuaccucauuuuuuuuuuuuuuuugauuagagacaggaucuugcucuguugcccaagcuagagugcagggcaguggcgugaucauagcuuacugcaaccucaaacuccugggcccaagugagcaucccaccucagccucccagcagcuaggacuacagacaugagccacugcacccagccuaccuuguuguuuuaaaggcuauguagcaauucauuauuuguguauagcuuaauuuacuuaacagggccccaguggauggacuuuuagguuguuuucaauuuuuuauuauuacagaaaugcuguaguagacauucuuguauauuugugcauuuauuucuguggaagaaaugcuuaguaauaacuggaucaaagguuugauaauuuaaaauguucauuuugccaaauuguccuccaguagauuaugguaauguuuucguuaacagugccuguacccauucuucauauuuuuaauuuuuuucuaauugggaaaacauuuuguuuuuauuugauaaugacagagaaucauauuuucauauuuuuguuagucauuuauauuuuucuuuugggaauugccugguccugucuuuugcuauuuuugaaaaaaauucaguguaccuuuuuaagguugauuuguagugccuucuaaaauauagauaguaacccuuuauuagagccauugaaugccuccuauuaauaugugcuggugcuggaaacauauuaguaaacaaaacagauauagaucuugugguuuaauuggacugguacugaacaaauggucagaggcaaaacuauguaauuaaaauuguguucagugcuuggaaacaacaagaucuaaaccugaacuggagauuagggggcaucuguacaaacuccuugaaaugaggaagaucagaugauuuagaggaaaagauccagguggaaagaaaggacugaacaaagggcacauagugcgaguuuugggaguuggaggggcuccagaaccuccagagccuggaaggcugugcuaggauuuucuucuucauccucggggcuguuggaaaguuuggaagauuuauaggcuggagaguggcaagaugaaauuuggauuuuaugaaaaugauuaguacagagaggcagcgagcacugcagggagaaugaaugggaaguggggaagacgacagguaugucagaaagcagagguggcaguucugcagugaggaagauggugguucaagucauggguggcaacuucaugguggaggaaaccgagacugucgggaauguuucccuugagaagccauguuaauguuauggcuggcucuucuuagcugucguuuaggccaguggccucuauuaauuuugcuuaguuacauuacacagaugguuugguuuugcccuagaggggagcagcaaugcuguuuuuauggugugcccuccuccuuuugagaaaaaaaguuuuauagcauguaauucugaccuauaacuucucagaguaauugcagagcacuaauugggcacuuccucucuacagucugccaacacuucauacguuuauuaacuuaagguagagacauguauuuuaucuauaagauauugaggucucgauacauugugaugcuguagcaagguuugcugguuaucuggguuauguccuauuucuuuggauuuuuuucuaguuagaacuuuucgguauaagcuaccauaaauuaugaaaugaaucacuugccugauaacuuucugauagaugauuauagcaaaauaacauuuucaggcuaaagaauaaaagaguuugauggaguucuuuauaauuagguuguuacuggcuuauauauuuuuuacauaauuacauacaaaacaauauugauauaggcauuccuuaaggauuuuguuuaaaucugaaauaugugguuguguggauaaauauauagguauucuuauucuucagguucucuguuagcuguuuuucuuuuuuuucagucgcaugaauuuaaaugacauuugaguuauauagaaguuugaaaucgauagaagcguuuaguaauccuugagugauguuuuaccagacaaguaaauugaaucuggucauuuuuuuccucagaagauaauaauugugaugaaagaaggguuagagaaucaauacauguaagguagccaacuagauugaaagaguaauuauugauuaaaauuuagcaguagauagcacuucucugaauucucuccuaagauuaaagagaaaauuagagugaagugcagcauguuuuuaaauaaucuagucgcacgagacauuuucgccaggguucuauucucucuguauuuugagaaaacgaggaggcaugcaaaauauuugccuaccaaauuauuauuagagaugagucucccuguguugcccaggcaggagcgugguggcuauucaugggcauaaucauagcucacuguaaucucaaauuccugggcucaagcgauccuccugccucagccucccagguagcugggauuacagguacauaccaccaugcccggcucuacuuacugaauuuuauaaaaauccugaaacaagaauuaagaagaguuuugacaauuggccuuuuuacuuuccuacauuacuugugaacuuuuucccaugacuuagggaaggccaccuuuauauccagaaagaaaucccacguuauuggauauucuuuugguacuacuugguuucucuacuggcacaucucugugcccuuuugggugacgucuucuuagguaauuugcagauuagaacuucagggucuuugggcuucuuuaaugucuuugggcugaucaugaaguauaguauuacuauuuauaguaauguacuugucuaguguaaauuaauuuuuaauaauuaaccugugcuaguuaauuugaaaauagguauuggauuuaucauuaaaguauuucauuuuucaaguuaacuccugggaugguuuuauggugagcgguaaguaaagcagauaguauuugcuagguaccaagcuuuguagcauugcacauuuuguaaacucgaaggauggaaacaaucaguuugaaguucaauuguauguuugaauaauacugaugaucuuuuuuuccuuugucaugaaauguauaguuuaaaaauguguauuuuuacuuuuugaauagguaauguauuuacaugguucugauuucaaaauauagcaaaaaauagcaauuuaguuaaaaaauuacuauguaggaaaguuuccucuuuauaaugccucugccugccugcuguaaacugacuuugacucacaucuuuaaaugaugccuuuagaucugggugaucuuuucguaucagaacaaacguuauguuuuugucuuuuucacuaguaaguagugcaucuguauugacauuuuugagacccacauuuugaaacaacuaaugauccuugugaaucuagaucuguauuuuaauaaucacacauguaaggauucauauguauuagccuuucuuugaugcucuucguguucauauuuugucaauuucuguuuucuuugacuaagguguaacgaguuuaaaaauauucuacauauuugucacuauaaucaugagguacagaguuaguucuuaaucaguuuuuuccccccaaaauccauuuagcagaaauuaaucaguuuuuaaaguacagcuuccccaaagcaacaugguaucucuugggagaugacuaguuugggccagauuuuaauuuccuuuaggaauuuagcucuuaaaaaaaucaauuuauucacuugauuuaaaaauuaucaaggaauuuucaaauacauuuaaagcaaagagaauacuguaugaguccuuagaugugugauuauuaaaauacagauccagauucacagagauuauaagcuguuucaaaauuccagucugaaaggagucaauucggauucacugcuuauuaguuaagacaacaauauaacauuuggucugacgugaaaagauaaaucguuaaaaaaaguacagaauagugcauauuguacaucaucuuuucuuuuuaaagaaaaugagacuauauguucauacaugcuuauauauguuuaaaguaacuuuggaaggauacagcaagaaaccaauaaaagugguuuaccugaguuauuaggaacaagauuggaaggagacuuugagcucuuuaccuuuuuucugaaguuuauuuguuguucuuguuggcuauuuauuuuuaagagacagggucuugcucugucaccugugcuggagugcaguggugggaucacaucucacugaacccuugaacuccuaggcucaaguuauccuuguuccucagccuuccaaguagcuggaccuacaggcaugugccaccaugcccagcuuaauuuuuuauuuuuuguagugaugaugucucacuguguugcacaggcugguauugaacuccuggccucaagugauccucccaccucugccucccauacugcugggaggcaugagccaccacaucuggacuuuuuuuuuuuuuuuuuuuuuuuuuuuggcuuuuugaaccaugugaguacuauauuaacaaugaauuuaaauuuuguuuaaaaauuuuuuuauuaaaaauugauuuaaaaagaaaauauaaaauuuacaacuuaaaaauauagcacaauaauggcuauuuucccaggaaaacuuguagauuuaggcugacgguccuuugugccgcagaaguuguggacugaaaggaaugagaaaugugcuuuaaagacugucuuccuaucuucgcccccaaguggccgagagcuuauuuuguuguaaccuuuuuuuuuucuuuuucuucccucuuuuuuuuucaaaggcuggugggguagcagguguuucuguugacuugauauuauuuccucuggauaccauuaaaaccaggcugcagaguccccaaggauuuaguaaggcuggugguuuucauggaauauaugcuggcguuccuucugcugcuauuggauccuuuccuaaugguaaaaaauuauauucucacuucuguaaagccaagauaagaugggauuuucagaaugguguguggucuuacccccauagaauuccuuguguguugaagcuuaucuucugaauuuccuucuuuaaccuggugucauuauuauuuuuuauuuauuuuagucacggucucacuuugucgcccaggugggaaugcaguggugagauaauagcuaacugcaaccuugaccuccugggcucaagaaauccucuugccucagcccccuaaguagcugggacuacaggcgugcaccaccaugcccagcuaauuuuuguacuuuuuguagagaauggguuuugccauguugucuaggcuggucuugaacuccuaggcucaagcaaucugcccaucuugggcuccccaaagugcugggauuauagucggcaugagccacugugcugggccuaacccauuauuuuugaaucagauaguguuauagauuccauuucaauauauuuguaguagggaaaaaaaaagcaaucuuuuaaaaauuguuucuguuguuaaaauuuccaacuagaauccuuaaaguguuauuuuaaugcugugauucuucagaacaaucauucucaacuuugccugcacauuagaaucuacugggaagccuuaaaaaauacugauguccugugucauccuagaaguuuaauuggucuaggcuucgccuggguauuaggaguuuuaauaacuuccaaggugacuccgcugugaagccaaguuugauaauagcugcuuuggagcaucuuagagagcaggugaaccuaagaggcauuacacauuucuauccuaauuaaauugcucuuacaugaugcaaguguuucucacuaauguucuccuggauacuguccuuccaaugucuuuuguuuugguucugaagucaugugacuuaugacgcucuuacucuuuagucaauguaaucuguuuuguuuaaucugcuucuugguauacuguuugcagauacuuauuuuaauuguuuacuguuggaugccucuaguggcauuugaaaguaaacuaaagcaacaaaacaaaaaaucaccauauauaagacacacccacaaaaccacagcucuagaagauucuuaaauucuggggauugcuuuuguuuuucgcaggaugauucaugagaauuuuuuucucuuacguuaaccugacauuuaaauguucauucugugagcauagcauucacauaaagguuuguagugcaaagagaaaaacaguauuucuguuucuuuuuuucuccugcccuuccccaucccccagccaucauuagaauggcaaacuguuuuggucaucuuucgauuuuuguguauguuaauacucugaguaauuguaacaaguuguuaagugagcauccacuccaugccaagcauaguuuuaaguacgugagaggggcauggguuccccaauuuguccacuuuggaaucaccugauuacugaagagcuuaaacaaauacaguugacccucgaacaauuuggcaguuaggggugucgauccccugugcagucaaaaaucagaauauaacuuuugacucccccaaaacuuaacuacugauagccugcugcugucuuaaugauagcauaaacaguugauuaacacauacuuuguguguuaagauauguauuaacacauguuuauguguuuuauuauuauuauuauuauuuuuugagauggagucuugcugugucaccccccaggcuggagugcaguggcgccaucucuggucacugcagccuccaccuccuggguucaagcaauucuccugcuucagccuccugaguagcugggauuacaggcacacgccaccacaccuggcuaauuuuuuuauuuuuaguagagacgggguuucaccauguuaucccgacgucacgugaucugccugccuuggccucccaaagugcugggauuacaggugugagccacugcgccuggcaaauguuuuauauacuguauucuuacaaucagguaagccagagaaaaaauacuaagaaaaucauaaggaagagaaaacguauauucaguaaguggaaguggaucaucauaaggucuucauguugaguaggcugaggaggaggaggaaaaagaggacuugguuuuggugucucggguggcagaggcagaagaaguagaggagguggaaggggaggcaagagaagcaggcucacauaguguaacuuuauggaaauuuaucauaguuucugucucaccuuuuugcuguuucauuucucuaaaaaugauucuuuaugguaccaauccuuucaccauuugcuuuaguuucaaugcccauauuguauagaaggguccuugucauaaaggaagucaaaagcagucuuuaauaaucagaaccuuucugcucgauugucugaugucauuuucuuuucuggcauuccuucuucuacaucuucucccuugucauuugacacugguuuggaagcacucaucuccaccaaguugucuucuguuaauuccucugguguggugucuguuagcucuugaauuuaagaucuauguuuugaaacccuucauccccaaccuuuuuuuuuuuuugccacauccacaaucucuuuuaugguuuucuugauuggcucugucaugaauacugugaaggauuugccuacuucucuucuuacugauaaauguccuuggugacauuuuucuuuucccagaacagggcacucucaucuacauuagaaaucuauucaggcagauguccuuucugcucaauaauuuacuuaauggcagcugggaacuuguuuacugacucauggauggcagaagcugcuucuccuguuaucuugacauuuuaaagccaaaucuuuuucuaaaauuaucaaaccauccuuggcuggcauuaacuucuucagcuuuagaucuuucaccuuccuuuuguuugaucuugucaugaaaugacuuugcuguuucucaaaucauuuuagagacaguaaguaugccuuuauuauagcaacccuuuacccacaugaaagcugcauuuucaaaacaagaaaaaagguacuuugcaggaagugugaaguuuucaugccugcuggcauagcugcagcgauggguuaaugaguuuccuuucuuucuuuuuuuuuuuuuuuuuuuuuuuuaacaguggauuaagcuggauucauucaucuugaaauggcuggcagccacagcuucagguuucagucugugguaccuaacaagcaauuugacucucucuuguaaugucaugacuccuuucugcuucuuaggagcuuucuugaaaugucaucacuuccagcaucacuaguggcacuucaucuggguccugugguguuauucaaaguuugugguauggcacuaaccacgacaaaaaauacauaagaacugggagagauccuuuugcucugugauaggcaauuuauugcggccaugaacugcuccuguggagauaauuagugucacguggcauuuuaaguggauacuccgcaacaccugaacucacuauaauagcaagaggagguggcaaagagguuacuacaguaguauaguaugugcuacaguuaauuuugugcaguuaugauuuaacacuauacauuuuuuucccccugagaccaggucucacuccguugcccagacuggagugcaguggcaugacguuggcccacugcaaccucaaccucccaggcucaggugauccucccaccucagucccaaguagcugggauuacaggugugggcaaccacaccuggcuaauuauuuauuuuuuuguagagauggacuuucuccauguuguccagucuggucuugaacuccugagcuuaagccucagccucccaaagugcugggauuacugaugugggccacugugccuggcccaucuuuacauuuguuuacauuucucuuaacuaugaaugaugugcuauaugguuuguguuuguaaguuuugaugaauuuuaacuuuuuauauuuuauguuaguaaaugauaaaauaggcuaguaucuaaauauauuuuauguauucaugacagggcuagccuuuucuuuucuuuuuuuuuuuuuuuugagacagagucucacucuuucacccaggcuggagugcaguggugcgaucuuggcucacugcaagcuccgccuccuggguucaugccauucuccugccucagccuccugaguagcugggacuacaggcacccgccaccacacccggcuaauuuuuuuguauuuuuaguagagacgggguuucacuguguuagccaaggauggucucgaucuccugaccucgugauccaccugccucguccucccaaagugcugggaauacaggcgugagccaccguaccuggccaccuuuucuuaauuuuuugguauuucuaggcuaugugguucaucuauaaguuuguucaaauuaucacgaaucuccaaaaauuuuuccaguauauuuauugaaaaaaagccauguguaaguggaccugugcguuuaaacccguguucaaggaucaccuguacugcugcuugucacccaacccuacacauugugacuuaauuggucugagguguggauugggcauuggauguuauaaaaaaaaucccaggaugauucuuaaauucagacaaguuugagaaccucugaacuagggaauugcaaagaaacaugucacaaagucccuaucuuuuggucaccauuuuuuauggugucucuacacucauucuucuaaagauccuuuuaucuuacauauugcauagaaagauuauuuugggaagauguacaauuagcuguagugcguagguuacauagugaugucauuaagaucacagguuuuacauucuucccucgggaguuuacauauauaaugugguuuugaauuauuaguauuauuuuugccauccaugaaacuucagugaaugggagaugcuagggaaaagucagaguaccaggguucaaaaauagccuuguuuuacugccaaguuugaaagaauuggacuuuuguguguggugucuuuuuucuuuugcuauugguuacgguuuuaaucuaaguacagaacuucacuguaguugaucaucaguggauguggauguuuuuguaaaccuaugcugcaggagugagggguugggguggggcuagagggaaacaaagauggaaagaggugaagagaagaccauguuuaggagccuuagucccuauuuugaagggaauguagagaaagcauagcuuuuuuuuuuuuuaaagagccagaaggaacuauaggcaucagcuagcccagccccuauucuuugcuuuaacuuguucagcccccaacuuggaaccugacuguacugacauuugcaguuaguagaggccuucuuggaugccaccuggaggguggagggagguuuggaacuuauauucuuaaagaaccuuuuauguuacaaaagaagccauaaagucagaugaaguugaggugguuaaccaugaaauggaggaaguuuuaccacugucucucucccuuuucuuggggguuaggaggguaggauguagaguggcagaacuuaacagcugaaugcaauuagagguauuauagcugcacauuuauuaagugggcugaagugggaaaaaucacaugaagaaacacaaaugggaauagacuuguguuaaccagguaaaacuaccugaacuggucauuauucauucauggacagagugccucuucauuuagccuaguguauauuuguuagcacgugaagauccuuuacaagcuuuuguugacuuuggagaacugauuuucaccaucaagcuguuuuccuuaguguuucagaguuagugacauguucagaugcccuucagaagaugaauuugucauuccuuuaucucuugugccuuaucuuuuauccaacugauaaacauuuuuugguuaacaguacauagaaaguuuuaaagccgucauaugcagcuaugauuaguucauugugauagggguagcuuuuuagagguuuuuagagauuuuaauuaaauggcugauuguuuucuugauguaaaagugaauucaugcaguaaaaaauagccaugauuauuuugaguaaccaguaauaaaacauuauagaauagacauuuucuuuaaaguauguuugcaauuuuaaccuguuuauucaucaauguaguugauuguuuuauggccauccauaaugauauuuuggaucacagaaauucauauccuuuucuaaaguugacuuuaaaaauguauaaguaauuugucaguacaacacgguaagugcuagauuagcacuugugcuccuucaggguagguguuauauuuucugcauuuuuguaagucuaagaucaggcauauaccauggcgucaguaaacucugaaagaguggggguaggaagaaaagauaugugcuuaucaccuuuucucuuaucucauaauuuaauaauuauugucauacuuuuugagaaacauguuucuuaacagugugaauauauguuuaaacuuugugaaagacuggcuuguuuuaaauuucagcugcugcauuuuuuaucaccuaugaauaugugaagugguuuuugcaugcugauucaucuucauauuugacaccuaugaaacauauguuggcugccucugcuggagaagugguaaguaacaaguuuuguguauaaaauacuucagaaaugcacaucaugcauauauuuucaguacauauuuauuucauuuuuuaaaaauuauuuuuaaauuaugaaagucauaaauggcaauaaauguaaauggauuaaauaugacaguucgaagauagagccugacaacuaaaagacagagccuuauauaggacagaagaagaauucuagcuauguguaauuuacaagagacagauguaaaacauaauuauauggaaaaaagacaaagaguggaagaaaauauccauucgaauugugacagcuuuguauugugucgguacaacugagcuggaacuacuuuuccgagaauuuccuuuccgaaauaguuucaguuugggucagccacaagagaaauuugcauguucuuuguaagguagaagugaagagcuguauuucugcucagaagguugguauauggucaggcacuguugcagcucacacacccugucacugacuuggcuguaucaccauguugacguuuggcuuccagcuccuccagcucccacugguucuuuuccaucagcuucuccaaauucuaggucagauuugugggcucugucaugaagggugccagcuuauacugcaaauucucugucacagauuggugagaaauaaaugugacuuccagucuguccuuguucuuccccaacuucacauccaucuuuccuucccuguugccugcccuuugauuucuaucccaacacuagauggagaagcaacagcccuauacaaacugcuuaauuagcucccauaauuacuggucaaaucucuauaauccuuaucacucauagugguuuugcuucugugaugaaacccuaauacuaauugaaaaauaguuuguggaauaauauuaauauuaggaaaaaauacguaaggcaaaaaacaaagagaccagugcacaaugauacuggaacaguucuuucaggagauguaacaagcccgaaccugcacugaauaacauagucucaaaacauauaaagcaaaaacugacagaauuuuauggagaaaugaagaaaacuguagucuuaguuggagauagucacaucucucucucgaaguaggcauaaacuuacuaaggccauagaagauuugaacaacacaaugacaagauuggucuguugauacauguaaaacuuugcacccaacaaguaaagaagauagacuuuuucaagcauaauuggaacuuaauaacaauagcccacagggccaguuuuagugaauacugcagagacauugucauuacagaucauuaguugugucauuauaaugaaguaaaauuggcaacagugacaaaaaauaggcagucuguuccuaccauguguuuaaaaaccaaacucuuggccgggcacgguggcucacgccuguaaucccagcacuuugggaggucaagguggguggaucaugaggucaggagaucgagagcauccuggcuaacaccgugaaaccccgucucuacugaaaauacaaaaaaaaaaauuagccgggugugguggugggugccuguagucccagcuacuugggaggcugaggcaggagaauggcaugaacccgggaggcagagcuugcagugagccgagaucaagccgcugcacuccagccuaggcgacagagcgagacucugucucaaaaaaacaaaaaacaaacaaaaaacucuuuuguaaauaauuucagucaaaguagaacacaguacuguaagugguaaguguaagugauauuuauuuuuuguuucuauuuuugaagagaugggggucucuuuauguuuuccagacuggucucgaacuccuggucucauguaguccuccugacucagccucccaaaguacugggaucauaggcaugacccacugugccuggccaaaauugauauuuuaaaccgaaaucguaaacacaguuaugauuaaaaaaaaaaaaaaaaacaaaaccucaaaacuaaugcagaggagaaauguauaauacaaauaaaaguuucuucauuccccucauuaacuuaucuuucucccuaccccuucugcacaaugcugagggacagccuuuuauguugcuuauuaguguuauuuucaaaucacacagccugguauucaugcagucuuauuaaacccccauccuugugaugggcauaauagaaauggacaacacagugaagauaaaggucuuaaguuuguaagccuuuuaucaaaucacacuuuucuuuguaauuagaaaaguaauggcauauguuuacauaggaaacuugggaaaugaauuaaccuuuauaacauuuacauuaaaaauuguguuauauugugaauuuguuuuugaugcacuuuuuuucuuuaggaaguuugaacaagaaucuacaaacuguuuaguaaccuaauauuccuuguuuaagaauaagugaacuggggauauggaaagagagguaacacaaaaguaaaaguuaacaugaagaagauuuuuuuuuaaagaaaccagcuuuauugagauacaguucacauaccauacaguucaccccuuuaaaguguacaauucagugguuuacaccauauucacagaguuguacaaccuuugccagcguccauuuuaaaacaucucuccccaaaggaagcucuuacccauugcagucacaauccccauuucaccccaacccuccccacuccuaggcaaccacuggucuacuuucuaucucuaugaauuugccuauuuuggacauuugauauaaauggaauccuacaauauguggucuuuuguuacugacuuuuuucagcuaguguaguguuuuccagguucauccguguuguagcaucuguuaguaguugguuucuuuuuaaaauuaauuuaggugauuauguccugacacacagucucguuacaugcaguuagucuggaguauguauacuuacauuuguugguacauuguugagagcaagcaacaaaaaaagaaccuggccacuucauuucaccuggggccaucuugccugaaaguuauuuugccauguugaagggcaggcuuuccucaguuuauaaacuuucaguccaaaaaaauagaaagugauauaauagguagggcauauaguagcuauuagauuucucauguuaaucauacaucuuuuuauuuguagaaagucguuuauauucugaugcuccuaguaucuguaacuaauauuuuuaaaaaauuggagccuuggaaaaggcucuaaguuucuaagauuuacaaauauuaugucauaacauuugauauguggacuguuaggcaugggaggugggguagguagauuuuagaauuaggaaacaaguauccaugagacuggagauacaacagauaaggacauucuuaccuacauugugucuuuuggggguucuguggucccugagcugguaaggccaauuaucaaacaccuauuuauaguugcuauggagcugggcucuugguaauuugcccauguuggcuucagacucuuggccucaagagauccucaguagcugagacuacuggugugcgccaccaggccuggcaauuccuagagaaucuuuguuuuuauuuuguuuaagacggagucuugcucuuucgcccaugcuggagugcaguggcgcgaucucggcucacugcaaccucugccucccagguucacgccauucucuugccucagccucccgagucgcugggacuacaggcacccgccaccacacccggcuaauuuuuuuuuguauuuuuaguagagacgggguuucaccauguuagccaggauggucuugaucuccugacuucgugauccgcccaccucagccuccuaaagugcugggauuacaggugucagccaccgcgccaggccccuagagaaucuuaagaggacaauuggucagcaguggguacauagauuuaggacuuuacacaugaaauacuucuugauguuggcuauuuaaauauaaauauaaauauauauauauaugcacacacacacacaaaugcacacacacauauuuacaaaugaaugaaugauggggucucacucugucaaccaggcugaagagcagugauguggucauagcugcuguagccuguaacuucugggcucacgugauccucucacuuuagccuccugaguagcugggacuguaggcaggugccacuaugccuggcuaauuuuuuaaaacaauuuuguaaagauggggucuuacuauguugcccaggcuagucuugaacuccuggcuucaagcaguucuuccacuguggccuuccaaagugcuguaauccagacaugagacacugcacccugccaauauugaccuuaaauggacuuuaaauucaguuaugguuuaguaugcugagaaguuugccaaauuuaugaaguuuguggaaauauugguucugaugcucuaauaaucuuugaucuuaaacuuccugaagccauucaguaugaauuuucucaauaaaugcuuauauacauauuacgccuuucuuuuuuuaguaaccuguuuuagucucauagaagauaaacuuuugauuucagauucauggaaguaugguugccaagauuaagagaaaccaacaggugaauuuagaggacauaaauuuucauuuguaaaauaaaaagaaauaggaauagaaaacauuuauagcugucaauggucagaaagguauaguaaccuagagauuauaagaaauacuuuagugcaaucauuauucuguaacacauuugcuuugauagauuauuauguuagacagauugguuagaaacaauaacauauuuuguuuguguugaauauagccacaguuacuuucuuguagcaacuauuaaggaaacuuagaaacaaaagaacagugccaaaauaauaaccauucccuguagcaacagcuugauuaaaacuuaaugaugaaucagugaaacuauaauuacaaccuucuaccuuauguuugcaauuuagaauacaguaaaaucagucaaauaagauuuaacauguaacaauagcaagagggguccugcuugugccguuuuuauuaggaagauugcugugccaaaucucuaaaucucuaccucaauaauuuuccagcucaguuuucaucacacacagaaaaagcccuuugggaaguagaaucuguaauuagaucaaagguuggggcagguuuacuuuaacgguacauaugcuauaacauucuaaugguagugauuuucuuuucuucaaagguuuuaagauuugacguguuguaucuuauccuacuuuugucuuuauucauauugucagaaaugaaaaaaacauugaaauuucuucacccuugaaagcagcaacacugugaauguaauguauguucauaggugacauguacauguccucauacacuuagaugcugguagaguguccuuuucaaguguccuuuaugguccuguucugacuugggauugaaaaagcuaggaaauaaaugauaucauguuuuguaaauguuuuucugacagccucuaacaguacuuccccaagaaggcccgaugagcaucuccccauacuucaccaucaguugcguagguagcuaguuacaaauggggauuuuuggagaugacacuaggguuccuguauuuuaaacacaaucucuagaugauugugcaacucaccaauauuuaaugccacugaucuaggcacauaaaacaucugaacuuacaccccaguaguaaauauuuuuacugaauuggcucaguaauucccuacauaauauuuuaguaggugcacaacacugggugugguguaccacuuguagaucaaauguguuauucuuucuguucuccucaaaaugacauauuuuagaccuaaaaaggcuaguuuaauaaacugguuauuuuugagugugacaaugaacucagacauguagauuuggauuuaacuggaguuagaaugagguuuucuccaaggcccaugcugucauagagccucguaggcaaaggcagcuuguuuuaugguuuagcuccuuuaguaacugacaaggccguuggacccccuuuguaccacaguccauuccagggucuccuuugguaucagcauauggggcaaacauguucuuauucagcuuucccacugguuaaaggauuggacgcauagaugcugugugguguuuuucagcuccagagcauggugcacauuuuacugaguuuuucccuaguuguggcuuaagcuguuuuguuuaucuacuuaauaucaugcuuuaaaaaugaguacguaguauucuucaugaucuucacuggccuuuucuaagaagaaccacugagcaagauaauagaagaaagguugacaacuuuugaaauguauuuuaucuuuugaauuaaucaugcuuuugaaauauucaucgaucaauacagauuaucucucccuugcagcuggaauauuuugccacaucucugcacaguuguauaagugagucgugggggauaggugaaguagaagauaacauggcugcccugagccacagugaaauguagcugaugauggcaauugcuuguauauaaagaugaaugaagguucaucaauaguguaugacuauuaccaggaaacacagaagcugaaacagaacugucagauaccugagugcacucaaacaaacacuuuuuuugugugaugugucuaagcacauccauguauuaugggaccuuucacccuauuuuccugucuguugacuuuuucaaagugugucugggagucuuccuucagggcauuaaauacauaaggcaggcagacuuuuaaauuccuucuuagcaacccuaaaccauaagaauuacacaaaaaauuaucucaaccauauaaaaagcaguuuguuuuccagacuccuuuuauuuuguauuauuuccucacuuguacaucuuugauucuuuuuuguaauagguugcuuuuguucagcucaucuuagauuccuucaccacuucuaugguccuuaccuagugauguggauuuagaucugaaguuccuaauacguuccaggcauugaggaugaaaugacaggauaagauacugccuuuuagaggcuugcuguaagugcacuaaaguguuacaggcauuuuuaagaaaaggaacuauagacgguccgugacuuacgaugguucuacuuaaaugacuuuacaauggugcaagagugagaugcauucaguagaaacuguauuucagauuuugcauuuugaucuuuuccgggcuagugauaggugauaagaugcucucuggcaauggugggcagugcaugucccagucagcugugcugguguaaguauucugagcaauuuuagggaggcaaggcuaaagcaaugauguuccguagguugggggguaucacaugcguuuucaacuuaugauggguuuauugggacauaacccugucauaaauugagggucaucuguacaagguagagugagagacugaagggaaggagggguugguuuucuccggacugggguagauggauggguguuaauucagaaaaagccucacagaauagccaggcuuuaagcugcauuuaauuuaauucauuaaaaaaauugugcaucuauuuaagguaucaacacaaugugggauacguauagauaguaaaaugguugccacagugaaguaagucaacauauccaucauuuaacauaauuagucuuuuuguuuuguguuuguggcagggcagcuaaaaucugauuuagcaggagucucaguuauaguacaauuuuauuaucuugcauuuagaauaggaugguuuguuaggugggugggugcaaggagggguguuagaguucugaaaagaccuuguuagguaguuuuaaguuccauauguuuggagcacaguaugauagggucacccugaggcgaagcaggggcugagagcuauagggccuugccugcuauaguaaggaguugggacuuuuuugaucagacuuguaauuuuaagaaaguccccuggcagcuguguggagauaaggagacuauuaaaggaauccccaggagagaaccacagcuggggcagagggaugcagagggagagagugaguucaagagauguuaaagagguagagcugguggaaagaugaucauucuuucaggagcccuuccagcgacauccuucagugcguuuuucaucauggaugccuuuuaguuuguugugucuauguguguugugcaccuacuugaauucuccaauggagucuaccgagcuaaguugaauaagcaugccccaucuugccagugggcccagccaucugagucugagcuaacacgcagagagggaaagaagacgaaagagagagagggucagaacgggagggucagggcuuccccuggcuuggcauuaucugugugugguuaugaccuugcuuguaguuauucaucuauaguacaggcaugaaugugcugaagagauuuaucagugaggccuguagaaaggaacauuguaccccaucugcauccucacccccaguuucucgaugaguuccuuuucuaacauauuucagauuguuuucuguuguauggauuuucuuuuucuaauauaguaugcaguguuaguucagaugguauugauucaugaccugggagaguauauuucauugauuuuuuuauuuaguuaguggacaaaaaggaagggaagcucuguuaacuuuuuauuuaagagcugcaugaguuuauagaacacaauuaaguugagcuuuauaggcacaguaugauuuucauauagguugaugaaguugaagaaacgauucugagccacaggaguguaacuuggucaguuauugccacugcauuguaaauggaaagacugaauacuacucucaaaggaccaaaauaccaaaggagguuaggauuggccacuuccaagcgagccugaacucugucagugacaaaccuuuauuuccuaaaauauugccuuguuaagauuaggguucuugaauuaaaugcaacugucacuuauuugcuuugguuugugauugugugcuuuucaauauuugaguuguauagcuaauacuauuaauaggugcuaagagacaccgaauaagaaauuugauccccguuuuugaggagcauauaaguaaguuggauccaucuguuaaauaacuagggaguauuugaggaugucuguagggagguagcaagguauggaccaugggcugucaaguuacacagaucggggucagauuugugacuuguccacuuauuugucuguaggccauuuacuugccuucacugaaaugcucuuuuccucaucuugaaaaaauaggauuaaugccaucccagucacaguucuuacaaggaugaaauuauacagcacuuaacaaaguguccagccuagcaucugacacacaaaauauugaauaaacauugggucuagccccauuucacacaaguugcugaaugcggcacguuuuuagaauuuccuaguuuugggaaagguaucuauucagaaggugaaaaaauugaaauucaaagaaguuuagugaugugcuccaaguuucccagcuauuauuauucccagcuaauaauaaaacaccacuguagaauaaguaauuagauaaauauuucucuguauacuuccaggagcaccucuguuuucuuuuucauguaguauuuaaaaaauggcagaaguagcgguaaguauacuacuugugcaguaaggauucacaucacugguuucuuaaaaggucagguuccaaaauuugccguugguuacugugauaggcaaaauaaugcccccccccccccauaaauauguccuaguccccaaaucucugaauguguuucuucacacgggaaagagauuuggcagauaauauuaagaauguugagaugggggccgggcgcaguggcucaugccuguaaucccagcacuuugggaggcuaaggcgggcggaucgugaggucaggagaucaagaccguccuggcuaacacggugaaagcuugucucuaaaaaaaaaagcaaaaaaaaguuagucgggcauggugguggacgccuguagucccagcuacucgggaggcugaggcaggagaauggggugaacuugggagguggagcuugcagaucgcgccacugcacuccagccugggugacagagugagacuccaucucaaaaaaaaaaaaaaaauguugagguggaaagaguuuucuggauuauccacgugggcccagucuaaucaguaggguccuuaggagaggggagcgggggucagagagcugaagaugguauacugcugguccaaagauagagcgaggggccacaaaccaaggagugcaggggagcccuagaaagcaggaagucaacauucccuugcagcuuccagaaggcauacugccugacugacaucucucggucuuagcucaggaagacccauuuuggaauucauaccuucagaauuauagauaauaagcuuauguuuuaagccacuaaauguguggugauuugucagagcagcaguaggaagcaaauacagucaccauugccaccuccucaacguucagauuuuuguauuggugggaaucuauaaauccauccaugggauguuugucaccuccugugaaaucauggcucauuucuguuauggaaaaauacaaaagcaaaaaagccauuugaggcuuaucuuuuggguuguauaaaauucugugaacaaauuguagacacagggacuaaguguugauagaguuauuuucuuugagaagacuuccuuguguagucuguauuacccgugacagcagucuugucaggcgagggaagacuaauaccuacaacgauugaacuuauuugcgugauuggaaagagucuuauaagggggaaagguuugaugaacauaggucccaaugcaaguagguaaaaauuaaaaucuaaggaguguaaguuaggauuuguaaauugguuuugucaacagcuguaauuccauuuaucaacagaagauggcagacuugacacacaaaugaacuguuguagagguuuuugauuuuuuaaaugaugguauagaaagagauguaaaauauucuuaauuggaaaccugcuuucuaaagagaauuuugggaauuacaaagagaauguggaaaugaaauacacguaagcaaauugcauuucaaaaaucuucauaguuuccaggggucucucccugacccccugucuuacuaauuugccacuuugaguuugcucuggaaaguccaaagcagcuuuugcuuugaauacgaugaagcuuugaguggcucuguucaguguauuguuaaauuucuguugaauugguuauagaguugccuguugaaacaugaagcauuagcugaaauuaaaccuugaaccucuaagugcauuagauguguguaaguaugacaucuuuauugaaaaauaauucuggagaugauagucagaacacuuggguuucacccaugcuuccugagcuaaguagcucucugaccuucagcaacuucuaugaucucagauugauuuauauauaaaauggugacauaauuagcuucuaauaucagaggaauauuugcagguaguugauggaguuucuuggagaaaaaucuuaaaucagaauuuuuuuugugaacuauguugaaauaguugcgaagaagauguaauguuaauaaaagguauuauuggggauacuuagggacuuugaagagcauuuccagaacuagaggacagggugcaguuguaaaacccugguggugauguguugaaggaagggaacuuggcuguggcaaugaaagaaccagggguuuuagcagcauccaucucucuuuuccuccacucaguaccuaaagugaggccgaaguucacuggaauuuuuucccuuucaaauguuuaguuuuaugauuuguagucuugcaucuuggguuuuuguuuuuguuuaaagagacaggaucucauagguggccuaggcuggcuccaaacuugugaccucaaguuauccuccugucuucaccucccugaguagcaggggcagcaugcaugugcaccugguucuugguguuucauuuaauaaauaucaaaaggaaacauucaguccuuagcugcagcagucaauuaaaaacaacagaaaauauuuuauuuaugccaaaggaagaaaaaucuugguagcagcaucaugauuuaaucaacauuuuaaucuaagguuucauauuuuggcauauuuaaggaggccagcauugcauuuugauuuugauaaaguauggagggagcauguuuuuuuuuuuuuuccuuuauggaaaaccuuaguaguucuuguuuuuagauagaacuuuaacauuuaaaacauucuuggauuuagugaaaaugccaccauuccugugucauggauucauacugaaccucagauuuauaaggaaagaaugcuuuacagaauggauuuaccaagagacccacagaugacauucuguuuccuuucauagaaccauaauacuguaacauguuuuuguucuugugcagugaaauacuuuguuguagcucaaauucaaaucuaagaaggaucagaguuaauagaaaaccaaauggaaggcuccggagguacuggaggaagcagaagcauuacuuuguagcaucucucaugccacaguugucacccagcagaagucaggaagccaugcugggugcuuuguaccccucagcuaguuagauugauuuuuuaucggagaggcuuuucaaaguuuuucuucugcaucuguauuuuuaagaacuaaaaacacaauaguaagaacuuggaggguuaugaagcaugaaguuccauaaauauuuauaccaaaccacagaaguagacaguuccuauuuucuucacauauuggggucggauuucacucuugaccucuugaauugaaaaauacaaggaguuaguauacccuuuucuuucucuuauuuuuucuuauuuauuuauuuucaguucuuuaaugaguuuuagaugcugggagcuguccuguuagguucauguagguuucguuggacuuauacccaauuuuaggccuuacugguaagcuguuuaaucuguuuuuguggauuuauugcuacuaaauuuauaauauguccuuuuuaucaaggcugauagguugccaucuaaaagcauauuuuaaauuagcccuuuuauuuuauuuuucuuccucacuuaaaaucuuugguccauaauaaauacuuuuuuccuuugaaauuauguuaaaaacuugugaaauaauaauaaaugugaauuguagagaauuuagaaaauauagguagguagaaaagaaacaccuguaauucuacucuguuuuuucccuacucuuuacauaaguauauguauaggcaauaaauauauguagaggcaaaacaaaaaaaauuaggcuggacaugguggcucucgcuuguaauuccagugcuuugggagguugaggcagguggaucauuugaggccaggaguuugggaccagccugggcaacauagcaagauccuuucucuacuaaaagaugaaaaaauuagcagggugugguggcacacccguagucccagcuccgcaagaggcugagaugggaggaucacuugggcccaggacugaggcugcagugagcuuugaccaugccaccuuacuguagucugagugacagaacgauacccuguuucuauguauauuuauauguaaauucuaaaguauggagaagucauuucuguggaauugaugauuauuuuuuugcugauucauuuccuccuggcuaguuucauuuguuuucaacauaaaauaauacaccagcugauuaguaaguuuggugcauaccaucuucuugcugucagggugcuuacaauuuaguagaagaggaaauauauuucacaaacuauaugguguaagcuaguaaguaaaaaacgucagauaagaaagcuuauuugggaauuaagaauacagagggagggaaucuuuugagguuagauaagguauaauuuuggaaaauuaagaauuauagaaauaaggaccuaaaaagauaccauaaagauuucugguccaagucaaguaagaaaaauuauacauauaugcaucuaauugcauaaauauauacauuauuauuugucaauuuucuucauuuuaaaaugaauuaaaaaaaaagaaaagacucuggaaggccagggaaacaccugggaauucacuugcagaacuggggccacagucuagggccgcagacccucagccagaccacugcucauuccucccuggaguugagcccugaaccaaagauccagguuugaugcaggagugaccccgaggcugagggaugggccugguaaagggagguagucauagacggagagucaugggcucgggccucugacucuaccuuuuuucauuuccuguggggucuucauguauuauuucacuucuuugcuagauuaucagccuuucucuugcugauagcacuuucccccaucguaugugcaaauauugacuguguuaaaaccacacuauuccuugacccuguggcccucuuaacucugaauccaucuccuaacaccuagccaucuucacacgacgguaguguacacuugcucaucucccucaaucccuuaugaauugaccguaauggaucucccaccccagccacucuauggaagcaauaccggugaacucuguaaaccuucauaugugcgcugcucgagacucuugaugcguugcucugccagucuccauuugaggcuucuggcccccuugcacaucaaguagggugcuugguugcuugccaucaacauugauccuggcuaacuuauggaaugaagaauauuuuuuggaagauuggcagacacuguugccuuccacuucuccuuugcccacagaauacugauuugguuugugucucauguuccuaacgcuuugcuagaucuagauauccuccaccucccuaacaagggguggccaugucacacaacucuggccaacacaugcaaggagaugucugcgggggaaaucugagaaaagggaggaggccuguucuccuugccuucaacucuguugugugauaggguggugcuggaggacguaagagcugucuuuuaucugagagucaggaugcccaggaugagaggccaggaagcuggguggcuggguagaaggauaggaagagccuggcaucuuguucacuuugaaguucuggacuaaaauuugaacugccugucaccaaauaacuuaagugacuuaaugucauuuguagucaugguccuggcacuugcaucuaaaaaagcaauuauuucuguaaaugaauguucagcucucccgcuugcuccaaacagcacuguucaauggagauauaauguaagaugcaggugaaauuuuauauuuucuaauagccacauuaaaaaaggugaaaacaucugcugggaugaauuuuaauaacauauuuuauuaaaccacacacauccaugguauuuagauuucacuguauaauuaauguaaaauaauuauuaauugggcaugguggcaccaccuacucaggaggccaaggugggagaauugccugagcccaggaguucagggcuagccugggcaacauagugagcccucaucucucucuuuuuucuucucuuuccuuuucuuuuuuuuuuuuuuuaauuauuaacaggauauuuuacauuaauuuuuuauaccaaguuuucaaaaucugucauuuuaacacuuacagaacaucucaguuguacuagccacuuuucaagugcuccauagcugcaugggcuaguggccugcauauuugccagcauagcucuagaaucagaccccuggacgggaguguuugauuagccagaccuaacucaccugauugugguccuccugccaggguaggaggggagagacugacucccuuuguuuuuccuaacugggaagccccccacacgugagagucggaagcugggcugccagagaaggcaggugugcccugcaacauuauguaccgccuuccaguguugcuugcucuuuagaaauuuauguucccaggguuccauuauuggcuuugaucuuccuuuuugguucucucuuuggguguuacuaucugguuuuagcgaucaccuguaugcugaugacuuccauaucuguauucacauccaagaaaaaguuacuuucuaguuuuauagccauauauucauuucuugacuggacauagccccuuaccugucccccagacuucaacucagccuugccuagucugaacuuaccucccuucuucccuggacugcuaaucucauguuuugggaccaccauaugccuauuauccaaaccagaaacagaagcaucuuacugucucccuacuucuucacuccuuaaccuccugucagugaccagguccggugcauuuuacuccuuuuuccucagauuugaccuucucugagccauauucauuuccagaugucuuuuauagaacugcuauagcagucucguaacccaucuuuugccuucuggcucguggucccccuuugcuucuugccuuccuccccacccuccagcuguccugugcauugcagccagagugaucucccuaagcacacgucauuccucugcuucagcuuuuucaaguguucccacugacuauggaaugaaguuucagccccuuagcaugguauacagggccuugucuguccagucuuacuugucauuacuccugaccuugcacuugcugcuuugguaauacggaauggugugggcagcugccagcuuuggaauacuguguuggugggacugccgcugauuccccugaacacccugcuuuuguauuuauguacuuccuuuuauuguucauucuucccacugugcccuuuccaccuuucuugccagcucauuccggcucauccagaagguucuauaaugguguaaucuugggcaguuucucugaaucuggggguuggacuaaauaccccuccuccacauuucccauaaucuuuguccaugcgccccaccccccuuuuggccauguuuuauugaaauuauuuauauguauuugcggguucuuugaagccagggcaucaucuuagucuucuuuaucauggaguggcuugugugguaucuggcuccauauguauuucuugaacugaauuagauaaguuugaagggagacuggguggaaaaauauguuggcccaaguuacagacagcuuuauacauaagaagcauucaaauguucagugaaugaagaaauggaaaucagaugauaucguuuuguaaaucuugucaguuuugguagaaaaauaacuucagguuaugaauccuuuguuaacauaaccauacccuuuguuguaaugcaucgguaugaagcauuguuacuucuuagcuuuagaggcaauaugcccguguuagcugacuucaugacaucuaaaaucacaucacauggugucuuugucccacuugucauggggugcucgggcuuauaucuguucugugcccagucugcucuugccaaggcuaauucccuuggaguaggaguuggcaagcugucaccuguuuuuguaaauauaguuuuauuggaacauaggcaaacuuuuaauuuauauauuauuauguauagaugcuuuugugcuaaaacagcauaguugaacaauugugacagagaccauguggcuugcaaacuguaaaauauuuccuauuuggucuuuuacauuauaaauuugcuguagagccuugccuuagaaccauuuaauuuuggacaggcaaagccuuaugugauauccaaauugaguacugaucucugauuaggaaucaggagaauacggaucauaaagggcaaaccucuuugaguuguguacucuauuugguggaaugguuuucuuacauuucuugcaggcuggucuugaacuccagggcucaagcgaccuuccugucucggcuucccgagugccauaacuuucauguucaagguuacauaugugaaaucuaaguugcagaaaaaguuuguauauuugcagacugcuaggugcauagcggcuuaaauacaggacuuucauuaaaauguuuaaaauauuuuuacacaucucccucccuguaccuugccaccccuucuccaaccuugccuucuuugcuuuugugggcagaguuccuuuggguuugacuaauucuuuauuguuucuauuucugaaaauaaguaaauuaccuuaauauaggguaagguaaaauccuggcaguguggauuugagaugacauauacccggccucagcaugucaccaagggugauauuagaaucauauauuggcugguagcugugaggaugacucaagucugcuggaaugcuggaggagaguguaugagagugcugggagucccuuuucaguugcugcaugaucaagaggucuaggggcuggaguuggugaaggguggaaggcuggguaccagcugauggucagcuugccucuacggauguaugcauuacuuccaguaaagcagagguuccucugguucauuuuucaucacacauguuugaaaugucaugugccaguugcaguucugggcguuggggauucgaaaugaguaaaugugcuucuugccguugggaggcuuguagacagauguucuuggaacaucuggcgggagguggcaggaucuauauaggacaagccaggaaagguucugggcugacaaaacaauguacaugcuuuaaggguccaagaguuuuagguuaaaaaaaaaaaaagaaacuuuuugacaucuugcaguaagccuacauauuauaccuuuuuacuacaauuuuugcuuaccaaaaaauuucaauuuuuauagcaguuauuuacuuuuuaggauauaaucaaauuugucuuuuagguugccugccugauucgaguuccaucugaagugguuaagcagagggcacagguaucugcuucuacaagaacauuucagauuuucucuaacaucuuauaugaagaggugagauggguuuuuuaagcucuucuuuucuuuauuaagauuuuauaguagcuaauacgaacacuguggauuucauccuaagagccuuagagaaaacuuuagagcuaaauuuaauguccaguuauaguaaauuuuugcuaagauuaucuuugccuuuuauugguuuuugaauauuuucauuuacauguuuuucaaauuucugagcauaacauugaguguccugaauuguaaucuuccugcaguucuucuggaaucagaugugaaacaaauuuuaaauauguaaaaugaagaaagauauuauauuaaaacaucaguauaguauuuuagguccauggaagagauuuaguacuggacugauaacagugaccaaugucauaacguuuauaccaaaauguagcuucuuuuacagauguauuugaagcugucagucagaaauuauucuuccugaccaugugacuagagagcauuuagcugcuuuccuuuauaguuuuuauggaagccuuuuuuuaaaaagacaugagaaucaaucacaugggaauuuucaaagagucuugauuuuagaaaaguuauuuguaaugguguguuacauaggugaggagacauugaauaucuaauuguacaaaugagaugaagcuaguauaacuuccccguugaacuauguggaugguuaauccaggguugucuggaaauacugaccacuaguuugagagauuaugaaugaauuucugauguuugaggcuauaaauauaauuguuuuuauacaaaaggauaauuggcauuuguaggcauuugcuuuuggaaauguauuuaaagcaucucaaauguucuuuucaagagaacacauguuagagcaauuaaguacuauauaauuaauauuuaguagaauaacagcaacuaaaacuaaguaaauauguagucaguuuuauuguuagagauguuccuguuucaaagagagcuaaucugagcucccuuaggagcuaguuauagagguauauaaguuauauaagguauaguuauguaccuuaggacaguuuagaaucauuaaccucuuagagaaguguggcaauugugaauguucuagaacucaaacaagagcagguagaucugcuguauacagaauguccuucagaaaucucugccauucuuucugaacucucggcuguguguuuguuucaggguauccaaggguuguaucgaggcuauaaaagcacaguuuuaagagagguaagucacuuacuuuccaauauugaaguacgaaagaaugauguccuuuguucaguaaauuuauacuacuuaacaauuagaaauauauuuggagaaacuugguuuaaaaaaucaaaaagggaaauuaucgucacucuucuguuaaauuuucugaguuuuuauauuuaaaagaaugaguagaauggguuugccggaagagcaauuucaguggucagaaugacccauguuguuacugacuuguuauucuaggguggcuaaaugucucuuauaguugaaguauuuuuuguuuguuuuuuugaaaugcagucucgcucugucacccaggcuggcgugcaguggcgcgaucucggcucacugcaaccuccgccucccagguucacgccauucuccugcgucagccucccgaguagcugggaccacgggugcccaccagcacgcccaguugauuuuuuguauuuuuaguagagaugggguuucaccauguuagccaggauggucucaaucuccugaccucaugauccucccgccucggccucccaaagugcugggauuacaggcgugagucgccgcgcccggccucccggccucuuauaguugaaguauuaagaaguaacuucgggucaggcgugguagcucacgccuguaaucccaacaguuugggaggccgaggcagaaagaucaccugaggcaaguucgaaaccaaccuggccaacaugacgaaaccucgucucuacuaaaaauauaaaaauuagccaaguggugggcaccuguaaucccaguuacucgggaggcugaggcaggagaauugcuugaacuugggagguggagguugcagugagccaagaucgugccacuggauuccagccugggcaacagggcaacaagagcgacucugucuccaaaaaaaaagaaauaacuacuaaggguaagauaucaaguuuauuacugaauuuugaggaacuaaugaaaaauugguaaugaaauaagccuucuaagacagggaccccaaccccagggccguggacguguacugguccguggccugguacuagucuguggccuguuaggaacugagccacacagcaggaggugagcagcaggugagugagcauuaccaccugagcucugccuccugucagaucagcagcagcaucagauucucauaggaacacgaacccuauuaugaacugcgcaugugagggauuuagguuguguguuccuuaugagaaucuaaugcaugaugaucggagguggaacaucuuagguggaacaguuucauccugaaaccacccaccccaccacugguccauggaaaauuuucuuccacaaaaccugucccuggugccaaaaagguuggggaccgcugguuuaagagguggaugucucagaagucuguaucaggcagugagcccuuggcuucuugauaacaaaauaugagcugggaaguucagucuggacuggaguccuggcacugcaggugauucacagagcaguguaucccaggggaagccacuucaccucucuuugccuucuaacucuaaauuucugugauucaacacaugggaaauuuucuuuuguucuguuugguugaaagagcaaaaguuuaccaucacuaaguaguuucaguauauuacugcaagaacaugguaugggccaggcauggugacucaagccuguaaucccagcauuuugguagguggaggugggugguuuguuugagccuaggaguucaagaccagccugggcaacauugugagacccugucucuauaacauacgaaaacuagcugggcaugguggugccuguaaucccagcuacuugggaggccgaggugggaggacugcuugagccugggaugucgaggcugcagugagcugugauugugccacugcacuccagccugggugacagagagacccugucucaaaaaagaaaaaaaauaaaaauaaaaagaagcauguuauaaucuuugcuucacauagaagagacuaucuugaaaaaguuaguuuuuucuaaguucaaaaguucguuuucagauaggugagauauaagagaagucugguuugggacacaauucucuguuaaagaaaauacaagugagaaccugcauacaucugcucugcaucugcguuuucuauuuggagguucugguauacugaaacauaauaguuaaauauugccguauuugaccgaauacugaaauucauugaaaucccaaauuuuauucucagguaguuuuuuguuuuuaacuagagauaacaaucuucuuuaugacauaccaacacuguuacuugugacuuaaagcuuugguuuucauagcaaccuaguugguguagaucuuugaagaacuucuuuuuaaggcaaacuuaauguuucaaaauuaguuaauuguguggagaugacuugugccuuucagaaauagcacccauacuguauauucacucuguacuuaguuucugacucacuaaacauguguuccuuacucagauuucaccugggugcaggacaaagagaggcaauaagccuuuuuuauuuuucugagagaugcugaauaaaugaauauuuacaugccggagaauacugguuuuacauacaaacagauaaaacacauggucgcaacugcuuucuguucuuuaaaaaauuuguuuugacauauguccugcuaguaauuaauuuguagccugcaauccuugaaaguagugugaccucacugagaugacuuuguuuacucaaaauggcagcguuuuguuggagauuuaauugaggucuucugcauuaugcauauuuauucagaguugauuuuaguugagguauugcuuuuguacagauucugugauagaaugagagaagaauuauugccgaaugaaacauagcuucuucucaaaaugagaaaaauaagaagugauacaucugcuuuaagcagaauuuuaugcauuauaaauaguuuagauucuuacuuuauucuggcaccaauauaaaaucuuuuugccaagagcgugucuguuguuucaauaagaaaauacaucaaaaucuuagugagaaucaccuggaaacguauacauuuauucuguaugcaauuuuuucuuuaaacugguuuuaucucccuagcaguugcccauuagaaugagauugaaguuugaguccaugcauuauaagauagauucgguguucuuuagauugugugaauguugucacacuuuuuuuuuuuuuuuuuuuuuacugcauuugauguuuguggagauugcaugcuuaucccuuacauucucugaaauuauuuuaguuacugugaauuuuagauggagucuaaacaaggucagcagauuacacuaccucauccuuuuaguguucauuuuucucaugaucuuugccaaaugagauguggucaagcaugcuggugcagugauauuacugcaguaagaugaaaguggggagcaaaaucauagaugcuuucauauccaggaugauuugagaugcuauuggccugaaaauuuuauggagagcagccucauacucuuggaugugaauuagaaggacuuuuuauagaggaagaaagcagaguaaagcagauuguuucaaaagaagugggaauuaguuaaacuuagcagaugucuuuuguccacaaauuucacucagcuguccuuucuggagugccuacugggucuuggggcacuacaaggaacauuucugcccugaagcauucacuuucuggcggggaaacaaacagggaaguagacacuuuacagugcagugucauaagcacuguaaugauaaguauauacaagaugcaggugggguuacagacgaagcaaugcuugaguggugcucaguuagcauaaaacgauucuuaauuguugaaggaguggcaguuagaaguaguuaagguuauaggcagauggaacagcaagagcaaagccauaagggugugaaaguacauguguguagcuugcuuauugaagcagaauugggguuuucaugaccauagaagagagugcaagccaagggagggccuucaagagagcacgaagugggguguuugccuggaggagaaguugaacuucuugcccucagcuguuugccagggacuggaguggagaauuugggaaaagcccuugaaagagccugacauguguccccuggagucuggaggauaacuugcugguaucugacuccugucugcagaaaccugaaggugagaagcugguuggagcugucccaauggcaagauguagccauuuuaauaacaaauaacuccugguuucuuuucgguagaugcuaguaaagagauuugagauaggugaggguuauucuccccacccuaguuuugcuguaagcagucaacaugccaaacaaguaauucaaucuguucaguaaguucauugaagcccccagucuuuaggugcaaaaaucaucacucuuaguaguuuauucaaaaguggauauggcagcuuuucagacuuguuuucccuuaauauccauguuaggcaguggggauuccccuaaauccaguggcuggaaacgggaaccuucagcgaucaagcgucaaggacugcccuccaaagucuccuucccaguucugcugucugccuacucagugccuuucccccgaacacucauguuauauaagucuccuuaguguuuuuccagagacacucuauccuagaucuucuguauuuuuuguugcugcuuucuaaccuacuuuguuuuggagaucauuuauaucacuucauuaagagcacuaucuuuuauaaugauugcauaguaguccauuguauaaacaaaccauuguuuauuuaacauuucccaguugguggacauuacagacaugcugcagugagugaugcuguuccuguguuauuuuauacaugguugaauguuugcagguuacauaccacaaguagaauuacuucgugaaaaguaucggcauuuguaauuuugguagauaaugccaaauugcucuuuagggaaguaccaauugacacuugccaacaauguaggagccuucuguuuuccccugccucaccuauggacuagcagucuuaaagacaaaacaugaugucauuguaguucuaauuuuaauuacaaguaagacuggacauaauaacauauaucugagaacaguuuuauuuacuuuccugugaacugaugauuugaaacuucccccaaauucuugugaggauuaaaugaggggauccaggcgaagugccuucuguaaugccugucacacaguacgugcucaggaaauguuaacuaggaugauugguacucugguaacugaaagagcuuuaacagugaaggacaccugauaugguuuggcucuguguccccaccuaaaucucaucuugaauuguaauccccacguggcaggggagggaccugaugggaggugauugcaugggugguuucccucaugcucuugagacugagagaguucucacaagagcugaugguuuuaaaaguguuugcaguucccccuuugugcucucucucuccuucugccauguaagacgugccuugcuuucccuuugccuucugccaugauuguaaguugccugaggcuccccagccaugcaaacugugagccaaaccucuuuccuuuauaaauuacucagucucagguaguaucuuuauagcagugugagaauggacugauaaaacacccaaguguggaaugcagcucugucccuuaccagccaucugcuccugacaaguuuacuuaaucugaguccagguuugcccauuugugcuaggaacuuugcauagacucuucucguugauaccuuuauaccuuuacagcaguucuaaaaggcggcugugauagcaguauagccugcuaggagauucggaaauuaaaccugcuuuuagguuguuggguucuuuaacagggcugcaaccuugauaugucugcauucagacauguugaugacuaacaauugcuguguuugaaugagaggccagacaacuguuacugcuuguaaagcucuucagcuauaaugagaguguuauauccagaugucuuauugagagacaucuuuauaauaguaaaaaaauugcaaccugcaguugauuuuguauucacuggcuacuuauguaggaaaaacagcauauugguauaaaaaguaaaguuacccuaauugaugauugagcugaucaagauuccuaauggaaguguguugggaaaauuccaugauuguucauuuuuggcuuauucuuauggagauugcaccaguuggauguuuuccacugaaaaauguuaccaagcaacuaucgccagaacuucuguugcaucuuuacuguccuuaaggcucuauauacuauuuccugcuuaucaugauuguaaaagagaaaaaaaauaguccuagcucauaagggagaauuuucccccuucuuguaucagugcuguguaucugucucuguguauguuugugugaaauuguuuucuuugauuuaccuuguucucuuucaguuuguccuuauaguuggguuguuccuuaucuuuccagauagcguguaaauccucuugaaaacagccacuggguuuuuaccuccuuguaggaugcccaggcucuagcauaauaucuucuacacagugagcacucagugaauacuugucguuuuucacugcuuuaaguuugacuuauuuuuguucagaugcugccugacgucaugaucauuucagaaaggugagggagcucuaagggggcuuggaguuauguaggguagugaaucaggcuuuugauauacuacauuacuaugaucuuugcaugagacaggugaugaaauaccaaagcguauauacuuuucuaagauuucagucuucuuaaaccuugaaaaaguaguuuuuauaagucugguuuuauuggaaaagcaguaagugcuauaauuauucauuuacuuucuucaucuuagcacuucuacugaaaaggaaaaaaaaugauucaaaaucuuuccaaacuucuaaugugaaauuguuuuucaguuaaaauccaaugcaaacauauugaacccuauuuuaauccuacauaauucauuuuauuaacuaugaccaaauagaacaucuguuaaaauuccauaaugcuagcuucaugggaaaagaaaaaaaucccuguuugcucuuggaaguuguccauuguuuuauuauucaggcuuucaguaaauguguaaugagacauucuuuuugauggaaauauuaaacaaaugaaaaugaaauuuccucuuuuaucauagagguuuauaaaaugagucacuuaauugcauuuacauuauuauaacuuuaccguagagauguucuaugaagaaugaaugcugguucauuugauucauucuuuaauucaagaaccuaaaauuauuacuccucaaaccuggacuuuagccuuuaguuuuucaucaucucuuaaauaagcaaauauuuuuaggaagaacaauugaguaaaauuaucuuaauguggaaguauuacucuagcccuucagugcauaguuucucauguuucguuuacaugaaaccagcugcuauuuacuuuuuucauuccuuggacaaauuucauuuacgcugugaagugacuugaaaaugcuacauauuuccauuguugcauguuggccauguuguccugaaggggcaccaguuccuguguguaugguuuaugggauguaaaugcaauaauaugaugcuucacuguaaacacauuggaagcuauuggauacagguggaaauuaucuguuaauucuuuauuuaaacguugugaccauaaaccauaguguugaaguagcucuuuguuguuguuccuuugugguuuucaucccaugugaaaugucaucuuucuucgucuucgugaguccauuuggauugcauuuaggcuucaaauaacagaaaauuugacuacaaugguuucaccaaaaaaguuuucuguuuuucccuuuuguaacaagaaaucugaagaugaucauucuaaggcugguguacugguuagaugagggcaaggagaauccagucucuuucauuuugccuggcuaacuuuaaugcucuggcuaauugacucauggucacaaaauggcuguucugcuuucaggcaucauaguucuauuccagaacuaugaagaaggggaagggcaugaggcaguacuaacuuuaucuguccuuuuguuuaucucgaaaacaaaaacuuuccugggacagaugguaucucagggccuuuaugaguugcguggggauugggaaguugaguauguagcuuuucacuguaguagaugaagucaggcaaaggguggacugggggcagugguacuaccguuacugagucaccccauaggaucugccguauucugucccuucaaacccuuccagcuaaaguuucaucucuucagaaagaagaccauuucauacaucucuagcuucagcccacaugugggcauccaucguuguuaagauccaugaguaauugucuguaccacuauuuuuuuuuuuggucauucuccucuguaaauggaaaugucuguucguuuucuuuuucugccaccuuuguucuuuugggcacuaguguagaaacucaucuuuaaaaauuauuugguggucucacugaaauugaagacaugaauuuacuucugauuuauuuacuuuuauauguaguuuugauuuuaaaguuaaaaucugagaauacuucuuauauugauauauucauauguaaacaccuaaaaaaugugugucauuuuagauggaaauaaacuguuuacauuuaccaaguacuuaaaauguuccagucacugugcuaaguuguuuacauacauuauuucacauaauccucacagcagcccaaaaugcgaucccuacuugacagaaacuaaagcuugguaaguuugugguuggcccagggucucauaccaguaagggagagaucagaggacuccagaauccaugaacuuaaccuuuauggugagcuguguauuuuacauuuuauaaacagauaaauuuuuucuggggaggaaaauauguauuuaaaaugaguaauccauauuuauaucuguagucuuuaagccuuuagauaggcguuagugccaggaguuuggggaaacuggaagucuacaugauauuaaaaauaaauuaauuagaggaaauaagcaaguguaaggaaucuguguugauggaaguguucaugaagaacuguggcuuguaagugcauauuaucacguuugcgugauuuuccuuuaucuagguguuaguuuacaugccccuucucugagggaccuccugugaucacuccagcuaaaauagaccuaccccaucccugaucacucaccuguuaccuuugcaugcacugauguuugaaauuaccuucauuucuuguucaaaaauuaauuacugcugcaaacagggacaauuugacuuccucucuuccuauuugaauacccuuuauuuguuucucuugccuaauugcccuggccagaacuuccaacacuguguugaauaggaguggugagagagggcaucgcugucuugugccaguuuucaaagggagugcuuccaguuuuugcccauucaguaugauauuggcuguggguuugucauagauagcucuuauuauuuugagauaagucccaucaauaccuaauuuauugagaguuuuuagcaugaaggguuuuugaaucuugucaaaggccuuuucugcaucuguugagauaaccaugugguuuuugucuuugguucuguuuauaugcuggauuacauuuauugauuuguguauauuggagcagccuugcaucccagggaugaagcccacuugaucaugguggauaagcuuuuuggugugcugcuggauucgguuugccaguauuuuauugaggauuuuugcgucaaugugcaucaaggauauuggucuaaaauucucuuuucugguuguaucucugccuggcuuugguaucaggaugaugcuggccucauaaaaugaguuagggaggauucccuuuuucuauugauuggaauaguuucagaaggaaugguaccaguuccuccuuguaccucugguagaauucggcugugaauccaucugguccuggacucuuuuugguugguaagcuauuauugccacaauuucagauccuguuauuggucgacaugauuguauaucuagaaaaccccauugucucagcccaaagucuccuuaagcugauaagcaacuucagcaaagucucaggauacaaaaucaauguacaaaaaucacaagcauucuuauacaccaauaauagacagagagccaaaucaugagugaacucccauucacaauugcuucaaagagaauaaaauacuuaggaaucuagcuuacaagggacgugaaggaccucuucaaggagaacuacaaagcacugcucaaugaaauaaaagaggauacaaacgaauggaagaacauuccaugcucauggauaggaagaaucaauaucgugaaaauggccauacugcccaagguaauuuuuagauucaaugccauccccaucaagcuaccaaugacuuucuucacagaauuggaaaaaacuacuuuaaaguucauauggaaccaaaaaagagcccgcaucgccaagucaguccuaagccaaaagaacaaagcuggaggcaucacacuaccugacuucaaacuauacuacaaggcuucaguaaccaaaacagcaugguacugguaccaaaacagagauauagaucaguggaacagaacagagcccucagaaauaaggccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaauuaauucaagauggguuaaagacuuaaacguuagaccuaaaaccauaaaaacccuagaagaaaaccuaggcaauaccauucaggacauaggcaugggcaaggacuucaugucuaaaacaccaaaagcaauggcaacaaaagccaaaauugacaaaugggaucuaauuaaacuaaagagcuucugcacagcaaaagaaacuaccaucagagugaacaggcaaccuacaaaaugggagaaaauuguugcaaccuacuuaucugacaaagggcuaauauccggaaucuacaaugaacucaaacaaauuuacaagaaaaaaacaaacaaccccaucaaaaaguaggcaaaggauaugaacagacacuucuccagagaagacauuuaugcagccaaaagacacaugaaaaaaugcucaucaucacuggccaucagauaaaugcaaaucaaaaccacaaugagauaccaucucacaccaguuagaauggcgaucauuaaaaagucaggaaacaacaggugcuggagaggauguggagaaauaggaacacuuuuacacuguugguggggcuguaaacuaguucaaccauuguggaagucaguguggcgauuccucagggaucuagaacuagaaauaccauuugacccagccaucccauuacuagguauauacccaaaggacuauaaaucaugcugcuauaaagacacaugcaaacguauguuuauugcggcacuauucacaauagcaaagacuuggaaccaagccaaauguccaacaaugauagacuggauuaagaaaauguggcacauauacaccauggaauacuacgcagccauaaaaaaugaugaguuaauguccuuuguagggacauggaugaaauuggaaaucaucauucucaguaaacuaucgcaaggacaaaaaaccaaacacggcauguucucacucauagaugggaauugaacaaugagaacacauggacacaggaaggggaacaucacacucuggggauguugugggguggggggcgggaggagggauagcauuaggagauacaucuaaugcuaaaugaugaguuaaugguugcagcacaccagcauggcacauguauacauauguaacuaaccugcacauugugcacauguacccuaaaacuuaaaguauaauaauaguaaaaaaaaaaauuaauuacugcugucuucccuucacuagaauguaugcaucaggagggcagaugccucccguuuuguucccuacuauuaaucuaacaccuagaagaguguggcacauagcacacucagaaaauauuuaacaaaccaaugacuuaaucauacuugcuucucaaaagcagaccaguuuuaaguacuuagguauuaagaucuccagauacauuuagcaagaauuauggaguucucacuaaauuccuaggcaagcuaaugguuuucugccagauaaacugucuguacuuccauugagauuaauuuucuuaucauauuuacugcugucuacauauagcucuuauuuuaauuuugucuuuucuaguuacaguuacuccuguaacuauuucauauauucaaaacaguuuuugaagugacacaugaaaauaauaaaacuuaugaagaagauccuucauuaggugugugcgaauuaucuccagugaauaccgugugggucaagaauuacccuugauguucucauuacuguauacugucuuauugucugaauaaacaccaucuuauauggaguauuaagagacuauauauguaagaaaacuaaauuugaaggucaaauguaguuuuuuagauguguaauuaaaaaauagcaauuggaaucauucaaaggaaauuaaaauguuuaucuguggguucgacuaccuggcuacagauuacuuugggaucacauaaugaaaauaguuaaaauuugaauacuaauuaugauuguuaacuuuacauauauuuuccuaauccuuaaacuguaagacaucagccuguuuguacagaucauaagcagaggcuuagaaaaauuaaguaauacaacuaggagguggcaggacuggaauuggaggucaaguuuguauaauuccaaauccugugauucuuauuacacuuugcuuccuguuugugucuugcagauaaauucacugauagaauuuuucaguaaauccuaagaaaauaaugugaugggggaucuacaagacuugaaccaaaucuugaccugagugagaguggagcacaauuucugaguguuagaggauucuaaaggauagaaauggaacuguuuguaugggcagaacacaaugagaugcuucuaaaacagccauuaauauugauuucagcauccuuuuucgucuggccuuugugaggggugcuuaaaaauguuuugacugauuguagucuguccuuuuuuguucccugugcugcaucauauguucugagaaacaguagaguaggugggaaaagguugauaaucuuuggccuugaagugguuuugguauacauagccaaguaacuagcagauaauuuauugacuaguggagaagcagaaauuuuugugaggauuuuuuuuuuucccuuuuugaauauacucugcuuuuuguuauucaacuugucagugcaaaacugacauuauagaagaacgcacuagagggcgcacaaugccuguauuuuaaauguugguggcaaaaaccucagcaugaacuuggaagcugcuuccuggcacuguuugaaaaaaaaaaaaaaagguucaaauuagaaaauguaaauuuaagcauaauaguguuuuccgaucaagauaccugaauggauaaauuuguguuaucuuuugauacauauguacauggaguuguauuuauuuggguucuaauuuuuuaaaacuuuuaccauggaaaaauuuaaagacacacaaaaaagauuacuaaaaugaaucccuguagucucaucaauuaccagcucuugagcaguauuguuccaucuauaccaaacccugcuucccacaugucuguaugauauugaagcaaauaccagacauucugauuucauccagaaauacgucacuaugcaucucuaaaagauaacuguaaauauguauaauguaucaaaaaugagugucauaacagaaagacaaauauuguauuauauguguaaacuaagaaaguaaaauucauagaagcagagaguagaaccaugguucucggguguuaggggguggguaaauggggagauguuguucaaaggguacaaauugucaguuauaggaucagcagguucuggguauuuaagguacagcaugaaaagugauggauguguuaauuaauuugauugugguaaucauuacacauuguguaucaaaucaucacauugcucacuuuaauauauauaaucuuuauuugucauuuauuuuaaaaaacgaauaucauagucuagaaguauuuccccaaagcuauuuaucacuuacaaaggggaaaauaguaauuuuacaguuggaaagacuggcagucacuauuuuauccaagugaucaagauuagcaucaccaguaauaagauuauauuaacaucauacaucucuaauauaaugcaccaagaaggacacaaugucacuucuuuggucuucuugccaaagaugcauaaucucagugugaucaugagaaaacaucacacaaaccgagauugagagacauuguacagaauugucaaaguuaugauaaagaaagaugaaagaacugccacaaauaagagaagacuaaggagacacaacaaguaaaugcaguguaggauccuggauuugauccuggaacagaaaagauuuugggaaaaacugguaacauucaaaaucuguaauuuagcuauuagcauugcagcaaaacugguagcugguuuugauaaguguacuguaguuaauuuauuaacauuagagaagccagcauauaugugaacucugcuauuuaugcaacuuuuaugagaguuuguuuuuaaaaaacaaacuaaaaugccacauuuggacauuguaugaaguacuuguuuuuagagucaucuucuaaaauaaugacaaguuaaauuuaaaauuuaauuucuuuuauuguuaacuuguauuaaaauaauauaugcaauuaguaacaacccaaauaauguagaaggacuuaagaugaaaaacaacagucuccugcccaucccucuccauucugguuccacucucuagagguagccuuuauuuuuuauuuuuuaaaauuuuaacuguuuuauuuuuaguucuuauuucaucggugcuuucagauaauauauuauuuaaaugucuguuuuaaaauuugucaguagauaaaguuuguugagucuuugggauggaagaugugauuaagcucacauuauguucuuccccaacccugucucauccuagcauuccaguuauauaaauuucauuccucuguucauuuuagaaacuuuaaguuauauauucguuucuuuauuucuuauccuacgaacuuucugcaucuuacaacuuucucuugacaugaugaggcuguugcuuucuuuuugccaccuuguccuccuuaaccugcaaauuucacuuucuggaaagacuucucucaacuauacuuucauuguacauugucaagaggguugacaauuucauccugucuuuuacccucagucacuucuuucauagcucuucuguauugauucuaaaaguggaguaccggugaacuaguguuuguauuauugagaagacuucaugaaugaucagaccauguagugugcuaaggcuguauuuuuuuuugugugugggacuuacacccugagagaugguuucagcaucagaaucaaauagaccuucuugcacucuaucaguugcuaaaauuuaauuuccaacauuuggggcaugagcuugucuuuuuuucuuggaguuucuaauugccuuuucuguaugaaaaaggcauuauuugcauuauuuuuagguaugacaacuuugaaaacauacugucuuuuguccugaguccccuuuuacccugggaaucuuggaaucuuucauucuccuguucuaauccuguguuaauauucacuguguuugggcuucuauucuugggucagauuugcuguuuccugaaggccgcauagcauagugguucagaccagggcuuuguggucaggcagcccagguuuugccaacagcucugccucuguuaaacuuacaccuggugcuacaguguccucauugaaugaaaaugcuuucagauaugaaaaauauaagaauuuaguccauuuguuugaaggcuuuuauuugauucugauuuuuuuggggagguggggucagguaauuaucuuucucuagugccuauuauuuuacaaauaucucauuaaagacagccgaugauaaccauucucaugauucuuuggccucaaauguguuucacugguuuguuuuuuauaguaggaaggaauuauguuaauguuaugauucuuagaaaaguauuuugaucuuauuaguuuaguguguauccugauuauguuuuggaaauaagugguuaaauugaucugugggagucuuacaaacugauuaccaaguuucugauacagcuugccugugucuugauccacguauuguaagucuuuccuauuaucagugaauuuuuccauacuucuguuucagagaauggaaugaugacuaaguuaaaaaucacuucgggacaaaauuuauuauccuucacaggguaaaugacaaacaugucauuuaccugguagaggauaccaauaguaucuguguucacagucagcuaugcuauguuucauguugacuaacaaagaucuugugauaauuagacucugcugauuuaucuuuuuguucacacaaugguuuuccaagguuuucucauccuuuuagacauuuaauauuaguuugaaaaaguagugagaacaacacaucucaaucauuaaguuuugaugaagugaagacaccaaaggucugguauauaguugccucuugguaagugauaaguucuuaccacauuauuuuucuguauuugaaggagaaaguagguugaauuuauccagcaucugccauaugccagaugagguacuuuucauauauauuuuuuucauuuaaucuucacaguaauucucaaucauuauugccaacugaguaauuggaaaguaaguaccucuugaauaccuugucaugauucccagucaaucuguaauguucaucuaccuuguaaaccauuuuauaugcuaacagacauuucucuguuuaauaccagugagaaagcugaccuuuggugguguaacuugaucuacauaaagcacgaaacacuguuaguggaaggcagaguuggucucugaauucuuugaacucuuaacgcucgucuaguaacagcauauuuauuuccuuucuacucuuugagguaugagugaggaaguuugaaaugcauaguaacaccaccuuuuucuuuuuuuucugccuuuccagcuuuuuugaaaaauuacaauuuauagaaaagguaaaacguguauuuuuuuuccccaggauucaccaguuaacauuuugcuuaaucugcucugcuccucuuucuuccucuuuuuuuuccugaaauauuuuaaguaaguagcagacaauuugacacuuaucauuuaguauuucagcaugucuccuaagaauggaguccuacuucucauaacuacaaugccauuaucacacccaagaaauuuaauauucacuaacuaauauuaucuaauauguggucaauuucccugaugucccagugauaaaagccuuacagcuucuuucucuacucaggauacaagugaacaaauacauugcauuugguugucaggguccccaaccuuuuuuauuuccuccaugacauagacuuuuguagaguccgagauauuuauccuguaaacggucccauaaucuggauuaucugaguuccuuaugauuagacucagguuaauugguuuuuuuauaugaauaccuaaguauuuugggguguuucucauugaguuauaccaggaggcacaaaaagucuuacacuuggugaguuuaaugguuugauuaaguuguuuucguuuguuauacacuaaagguucaauuauccuuugauguuaagaggcaaucuaugcgguaauauuuugagaacaagugauuaucccauuccccaauaaauaguuuuaacaucuguggauacuucuugucugaagcauuuguuacauuggugauugcaaaauaaugauuuuccuaauacugucauuuuucuaugaauuuguuagcuggcauucuucuguagggaagaguuuccucccuugcccuccagauccuuuuuaaaaaauccccauggacucauggauuuuaaaaaaauagccuaauugaguuagaauucauguaccagacaguuuacucguuuaaagugacaguucaagggauuuuacuauauucauaagugugugcaaucaccaccauagucauggauucuuuuuuuguucgguaauuauagucuauuaccauuaguauuauucuuuugauacuuaaacugucccauauuuguccaguggggagccucuucagccuacuucuguguucaugugacauuuccccguuaguccuuuuuuuuuuuuuuuuuugagauggagugucauucuguugcccaggcuggaguacaguggcaugaucucagcucacugcaaccuccgccucccagguucaagcgauuuuccugccucagccucccgaguaacugggauuacaggcacgcaccaccacacccaacugauuuugcauuuuuuuuuuuuuuuuuuuuuuuuuugagacggagucucgcucugucgcccaggccggacugcggacugcaguggcgcaaucucggcucacugcaagcuccgcuucccagguucacgccauucuccugccucagccucccgaguagcugggacuacaggcgccugccaccgcgcccggcuaauuuuuuguauuuucaguagagacgggguuucaccuuguuagccaggauggucucgaucuccugaccucaugauccacccgccucggccucccaaagugcugggauuacaggcgugagccaccgcgcccggccugauuuugcauuuuuaguagaguuggaguuucaccauguuggcuaggcuagucucgaacucccgaccucaagggagucgcccaccuuggccucccaaagugcugagauuacaggcaugagccacugugccaggcccccauuagucuuugagaaccuccuugcugguguagcaagguaucuuagucuuaccuuguacucucccugccccaguccuguaaucagccccuccccaagggggccuugauuccuucugguggggagugguauuuagaaacuauagguguaucauugcaucuaggcucuuuuauugggcagaaaaaaaaauuaaauuauuucaucuuucccauuucauauauuuacaucaggcaagaagaacacagaauuaugauuuauuuuaagaauuauacuguaaacuucuuuccgguguucagugcugugaauucagcguacguauagauuuguauagccaucaucacaaucaagauacagaacauuuccaucaccccaaagucccuucugcuagccgaugcauacccauuucccugcuuccuacugcuggcaacuuuagcgaucuguucuccaucacuauaguuuuuucuguuugagaaugucauuuaaauggcauuacagaauauacagccuuuacagauugccuucugucacucagcguaaugccuuugagauucaucccaguuauugcauguaucaauaguuucuuccuuuuuauugcagggugguauuccauuguuaggacguauaguggaauacaaaaauuaugguuuauccuuugaucuauugaaggacauuugacuucuuuugguaucauuauuaagagaauuccuguuaauagucauguauaaguuuuugugugaacaucauuuucauuuuucuaggguagaaaugcaggaauggguuugcugggccauguggugaguguauauuuagcuuuauuagaaacugugaacucuuuucuuuucuuucuuuuuucuugagacaaggucucacuguguuaacccaggcugagugcaguggcgcagucuuggcucacugcaaccuguuucccgggcucaagugauccuccuaccucagcuuccugagaagcugggacuauagacauguaccaccauaccuggcuaauuuuuguauuuuuuuguagagaugggguuucaccacguugcccaggcuggucucaaacuccugggcucaagcagucugccuaccuuggcaucccaaagugcugggguuauuaggccacugugccuggcccaaacucuuuucuguaguggcuguacaauuuuacauccccaccagcaguauaugguuagcacuugauuacugucaggauuuuuauuuuagccauuuuaguagguguguaauaauaccccauaaugguuuuauuuauuauuguuuuaaucuuaguugacucuugaaucacaaaaguuaaauaguccagaaaauaaauuuauuugcaaaaaagaaccacacauauuuaugagagagaaacuuucuauaagacucuaaguuuagaauauugagacuucuaucucuugaacaugguaucuccauuuacuuuaaucuccauuuucuuuaauguuucgauaauacuuuauaaauuuguugaccguuuugaauuuucuuaauuuauuccuagguaauauuuucugaugccacugaaauguuaucugugucuucacuuuuuuaugcuaaaauauuuuaaagucaauuaauauuacacacuuaaauauuucgggauagacugggcaugguggcucaugccuguuaucccagcacuuugggaggcugaggcaagagggucacuugagcccaggaguuugagacuagccugggcaacauagugagaccauguuccuacaaaaaauuuuuaaaaaauugcugccugugguggugcacacccauagucccauuuacuugggaggcugaggugggagaaucacuugagcccaggaaguggaggcugcaaugagcuuagauuaugccacuguacuccagucugggcaauagagcaauguuagaaagaaugcugagugcuggaacucuaauccauugcuaucagagagggaauaaaguccuucugaaaaaauaguuucauaugauacaguaaaacugaagauccauauaagcugauuuucuccaccacuggcagguguauaccuaacagaaaugcacaugugcaccaagagacacaugcaacaauaugcauaucaauauuguuuauaacaggaacaauuugagauaaauguuucucaauaugagaaaaaauaaacuaugauauguaagugcauggaauaauacacaguaguguaaaaagaacaaacugcagcucuugcaacaacauggaucaaucucaacaaauuucauaacaagagaugcaaagucauauaggguaagugcucauacacaguucagaagcagugcuugccacauuuucaaauggugcagcaaauauauauuuauauccaucuauugagauaucaagaaaacacggcgaaagguuaauaauauuugggaaucugggugaagaauaugcaaaaauucauugagcuauuuuguuaccauuuuguagguuugagauuuuucaacauaaaaggauaggaaagaguuaaaaaucagauuaaagcuaauuuauaugguuuuggaguacaaacauggguaguaaaaugauaagaaaauaccacaauuaaggauaguaccaacucugggaagaaggaugaacuuuugcugaggaagagccuaguaggggucuucuggugcuggucauuucuuuaccugaguaaaugugugagcuuuccuuuauaauuaucuauuaaacaauccauaugaauuauaugcauuuuucauauacauauuucacaggagaagaaagguaaaaacaguguaaugagguauauaaaaauacuuucaaagaaagauugcuauccacuuguuaaacauuauuauuauuuuuuuuaaaaaacccugcauuugcuuuguaacaagcgaaguaaggggauuuuugcuaugugaguuguuuaccugagauaaauuuaucaaaggcacuuacugaggaccaauuuuugaggcuaccaauauaaugucaucuuacuuuuacauaagguaguucuuauacagcuaucaauucugaaucuuguuuaguuugguaauacuagguaauaaauucuuuuaaauaaucccaggcuggagugcagugguguagucauggcucacugcaaccucugccucccggguucaagugguucuccagcgucagccuccugaguagcugggacuacaggcacccaccagcacuccuggcuaauuuuuguauuuuuaaaugagaugggguuuuacccuguuagcaaggcugaucuccaacuccugaccucaagugaucuaccugccuuggccucccaaagugcugggauuacaggcaugagccaccacgccuggcccaaaacuuguuauauuugaagccagauguauucugguguuucugaggccuggaacgaaccacauugcccuucugggagcuaaccacagaaacaagcacccugcccuuacuagaggggaaauaaugcagggaagaccaacaaacuacucccaggaguugaugcuguuucucauagugguuuuaauuuucaguucccuaauggcuaaugauguugaacaucuuuucauaugcuuauuuggcauccuugcaucuuuuuaucgugaaguaucuguucagucuuuuucucauuuuuaauuguacgguuucuuugggaguuucgaaaguucuuuauauauuuggaaugcucauccuuugcccuuaggugauuugcaguauuuucuaauaaucuguaacuuguaauuucucuaaacaguauuauuugcaaaguuaaaguuuuaaauuuugguaaaguucaguucauuuuuucuuuuaugaauuguacuuuggaugucaucucuaggaacucugccuaacucuaagucauuaagguuuucucccauguuuucuucuaaaaguuuuauagcucuauguuuuacauuuacaucuauaauccauuuugaguugauuuuuauuuaaggggugagguuuagcucaaaguuuguuuuuugcauauauagaugucuaguuauucuaacagcauuuguugaaaagauuuuuuuuuuccucacugaaaugcuuuugcaucuuuuaaaaaaaucaguuggccagauuuguaugggucuguagcuggaagaaauauauauauuaaggaaucuguauauauagguuccaagcaaugucuuuauuuuucuuuauuuagguguuuguuuucauauuuuugaauaucccagucuugaaagaugauguuuugauuuucugagaccuuucccuucguuuuuuaauuuaauuuucuuuuucucgagacaaggguguugcucugccaccaaggcuggggugcaguggcgugaucucagcucacugcagccucccuucuggauucaaaugccaccugaguagcugggauuacaggugugcaccaccaugcccugcuaauuuuuguauuuuuaauagaggcggggucucaccauguuggccagucugguguugaaccccuggccucaugugaucugcccaacacagccuccugaagugcugggauuacaggcaugagccaccgugccuggccuguuuguuuuuuuuaauugauaugauggcuaucuuaaaaaagucucaaagcaggcugggugcgguggcucacgccugcaaucccagugcuuugagaggcugaggugggcagaucacgaggucaggagauugagaccauccuggcuaacacggagaaaccccaucucuacuaaaaauacaaaaaauuagccaggcgugguggcaggcgccuguagucccagcuacucaggaggcugaggcaggagaauagcgugaaccugggaggcggagcuugcaguuagcccagaucacgccauugcacucuagccugggcgacagagcgagacuccgucucaaaaaaaaaaaaaaaaaaucucaaacuguuuucugucuuuucucuccuaaaacaucucuuuguuccuuuuucuuuuuuaagugauagaaaggacugacuuuuuagucacuguuuuuacaguucaauaauucgguaucuuucacuuuuuuucugucucuauuuuucugaacaugccuauuuucucuugcauuacuauacuguuaauauguagacaguggauuagaagcucaguucuuccucuuuuuugauucauaauauaguuacuauuacuuccuuauauagauugugccauuaguuuuuaaaauucuugcuguugcauuaucauguaguaaaaauaauuucaacauucaccuacgggaaugaggaaaaggugcuguguauuuuguuuuauccaagcacgaaggaucuuugcuuugaguugucuuccuuacaauauccuauaaaauacauaaucugaagugaguugcuaagauuacuguuuacuuugugcugaaauaaaccuagaaccuaaauuauuugcuucuuauuguagcacugccuucuuagaauugaaacucuaaaaaucauggaauuaaugugaaguuuuuaaugcagaggacagauuauagaaauuuucuuuguacacuaucacucaaacguuugcuguaguuuugagaauaauauuguuacugaaguggugacccaguaauuuuuaguucaccagaaaacauuuauagaguaaguguaggguacagagguguagaauuagccauguguggaugggacagaggagagagauucugccccuagacagcuucuccuauuuguguguggaaauucauggauauuuguaaagcaguucauuaguaguugaacacucaguaauuggauauuuuaaaguguuggaguacugacaagauaagaacaaauagacagugaaggagugaaucccugucucugaaugaguugaauucugggcaguccuuuuagacaacuuagaaaaaggaaggguagaguaaaggaauugauauguugacauuggaaagcauuuuuuuuaaaaaaauuaaacuuuaaguucugggauacaugugcagaaugugcagguuuguuacauagguauacaugugccauggugguuugcugcaaccaucaacccgucuuauacauuaaguauuuauccugaugcuaucccuccuguagccauccccuaccccucgacaggccccagugugugauguuccccucccugugucaauguguucucauuguucaacucccacuuaugagugggaacaugcaguguuugguuuucuguuccuguguuacuuugcugagaaugauggguuccaacuucauccaugucccugcaaaggacaugaacucauccauuuuuauggcugcauaguauucaaugauguauaugugccacauuuucuuuauccagucuaucauugaugggcauuuagguugguuccaagucuuugcuguugugaauagugccgcaauaaacauacuugugcaugugucuuuauaguagaaugauauauaaucuguuggguauauacccaguaaugagauugcugggucaaaugguauuucugguucuagauccuugaggaauugccacacugucuuccacaaugguugaacuaauuuacacucccaccaacaguguaaaagcauuccuauuucuccacauccucuccagcaucuguuguuuccugacuuuuuaaugauugucauucuaucuggcaugagaugguaucucauugugguuuuaauuugcauuucucuaaugcccauugaugaugagcauuuuuucauauguuuguuggccacauaaaugucuuuuuuugagaagugucuguucauauccuuugcccaguuuuugaugggguuguuuguuuuuuucuuguaaauuuaaguuccuuguagauucuggauauuagcccuuugucagagggauagauuacaaaaauuuucuccuauucuguagguugccuauucacucugaugauaguuucuuuugcugugcagaagcucuuuaguuuaauuagauccccuuugucaauuuuggcuuuguugccauugcuuuugguguuuuagucaugaagucuuugcccaugccuguguccugaaugguauugccuagguuuucuucuaugguuuuuaugguuuuaggucuaacguuuaagucuuuaacccaucuugaguuaauuuuuguauaaagaguaaagaagggguccauuuugaguuuucugcuuauggcuagccaguuuucccaacaccauuuacuaaguagggaauccuucccccauugcuuuuuucagguuugucaaagaucagaugguuguagauguguggcguuauuucugaggccucuguucugucccuuggguuuguauauguguuuugguaccaguaccaugcuguuuugguuuacugugccuuguaguauaguuugaagucagguagcgugaugccuccagcuuuguucuuuugcuuaggauugacuaggcuaugcaggcucuuuuuugauuacguaugaaauuuaaaguaguuuuuucuaauucugugaagaaagucaaugguagcuugaugggaauaacauugaaucuauaaauuacuuugagcaguauggccauuuucacguuaaugauucuucuuauccaugagcauggaauguuuuuccauuuauuuguguggucucuuauuuccuugagcagugguuuguaguucuccuugaagagguccuucacaucuguuguaaguuguaguccuagguauuuuauuuccuuuauagcaauugugaaugggaauucacucauuauuuggcuguuuaucuauuauugguguauggaaaugcuugugauuuuugcacauugguuuuguauccugagauuuugcugaaguugcuuaucagcuuaaggagauuuugggcagagucgaugggguuuuccaaauguacaauuaugucaucugcaaacagagacaauuugacuuccucucuuccuauuugaauaccguuuauuuguuucucuugccugauugcccuggccagaacuuccaauacucuguugaauaggaguggugagagagggcaucuuugucuuaugucaguuuucaaagggaaugcuuccagcuuuuggucauucaauaugauacaggcugugguuuugucauaaacagcucauaauauuuugagauacgucccaucaaugccugguuuauugagaguuuuuagcaugaagagauguugaauuuuauugaaggccuuuucugcaucauuugagauaaucaugugguuuuugucaugguucuguuuauguaauggauuacauuuguugauuugcauauguugaaccagccuuguaucccagggaugaagcugacuugaucaugguggauaagcuugucggugugcugcuggauucgguuugccaguauauuauugaggauuuucacauucauguucaucgggguuauuggccugaaauuuucuuuuuuuguugugucucugccagguuuugguaucaggaugauguuggccucauaaaaugaauuacggaggagccccucuuuuucuauuguuuggaauaguuucagaaggaaugguaccagcuccucuuuguaccucugguagaauucggcugugaauccgucugguacugggccuuuuuugguuuguaggcuauuaauuacuuccucaauuucagagccuguuauuggucuauucagagauucaccuucuuccugguuuagucuugggaggguguauggguccaggaauuuauccauuuccucuacauuuucuuguuuauuugcauagagguguuuauaguauucucugauaguaguuuguauuucuguggguucaguggugauauccccuuuaucacuuuuuauugugucuguuugauucuucucucuuuucuucuuuauuugucuggcuaguggucuauuuuguuaaccuuuucaaaacaucagcuccuaaauuaauuguguuuuugggggguuuuuuugugucucuuucuccuucauuucugcucguaguuauuucuugucuucugcuagcguuugaauuuguuugcucuucucuaguucuuuuaauugugauguuagcaugucuauuuuagaucuuuccugcuuucuccuguuggcauuuagugcuauaaauaugcgucuaaaacacugcuuuagcugugucccagagauuccgguacguuguguauuugcuuucaucaguuucaaagaacuuauuuauuucucccuuaauuucguuuuguaaccaguagucauucaggagcagguuguucaguuuccauguaguugugcgguuuugaaugaguuucuuaauccugaguucuaauuugauugcacugugaucugagagacuaugaugauuuccauuuuuuuacauuugcugaggaguguuuuacuuccaauuauguggucaauuuuagaauaagugcgauguguugcucagaagaauguauauucuuuugauuugggguggagaguucuguagaugucuauuagguccccuugguccagagcugaguucaaguccugaauauccuuguuaauuuucugucuuguugaucugucuaauauugacaguugguguuaaagucucccacuguuguugugugggcaucuaagucuguuuguaggucucuaagaacuugcuuuaugaaucugggugcuccuguauugggugcauauguauuuaggauaguuagcucuucuuguugcguugaucccuuuaccgcuacauaaugcccuucuuugucuuuuuuuauguuuguugguuuaaagucuguuucgucagagacuaggauugcaaccgcugauuuuuuuugguuuccauuugcuugguaaauauuccuccauccuuuuauuuugagccuauuugugucuuugcacaugagaugggccuccugaauacagcacacugaugggucuucacucuuuauccagugugccauucugugucuuuuaguuggggucauuuagccuguuuacauuuaagauuaauauuguuaugugugaaugugauccuguuguuacgaugcuaggcaaaauaaccuauuaauugaugcaguuucuucguaguguugacggucuuuacaauuugguauguuuuugcaguggcugguaccaguuguuccuuuccauauuuagugcuuccuucaggagcucccauaagccaggccugguggugacaaagucucucagcauuugcuuguccauaaaggauuuuauuucuccuuugcuuaugaagcuuaguucggcuggauuugaaauucuggguugaaaauucuuuuaagaauguugaauauuggccuccacucuccucuggcuuguaggguuucugcagagagaccugcuguuagucugauggcuucccuuuguggguaacccgaccuuucucucuggcugcccuuaacauuuuuuccuucauuucaaccuuugugaaucuugacgauuauguugcucuuucucgaggaguaucuuagugguguucucugaauuuccugaauuugaauguuagccucucuugcuagguuggggaaguucuccuggauaauauccugcagaguauuuuccaacuuuguuccauucuccccgucacuuugaggugugccaaucaaacguagguuuggucuuuucacauaguccuauauuucuuggaggcuuuguuuguuccuuuucauucuuuuuuucucuaaucuugucuucacauuuuauuucauuaaguugaucuucagucucugauauccuuucuucugcuugaucuauuuggcuauuaauacuuguguauacuuuaugaaguucuaaaaauguggaaagcuucacgaauuugcaugucauccuugcacagggcccaugcuaaucuucucuguauuguuccaauuuuaguguaugugcugcuggagccaacgcggaaagcguuauuuuuaaaaagugugcuuaacugccuuuaaggaguauuuuuuacuuguacuuugaaugguacuaaaacauugagccugggcuuucuucaugaaaucauauacaccaaacaccccuuugggguugggauuuuuguuaauucuuuuuuuuuaaaauuuaaauuuacuuuagguucagggguacauguacugguuuguuauguagggagacuugugucauggagguuuguuguacagauuauuuugccacccagguacuaagucuugugcccauuaguuuuuuuuuuuuuuccugauccucucccuccucccagccuccaccguccgauaggcugcagugucucuuauuccccuccguggaucuauguguucucaucauuuagcucgcaauuauaaaugagaacaugugguauuugguuuucucuuucugcauuaguuugcaaaggauaauggccucuagcaucauccauauuccugcaaaggaagugaugucguuuuuucuuacggcuguauaguauucaugguauauauguaccacauuuccuuuauccaguguuuuauuacgggcauuuagguugauuccaugucuuugcuguugugaauagugcugcagugaacauacgugugcaugugucuuuaugauagaaggauuaauauuccuuuggguauauacucaguaauggaguuguagcccuguaauagagcuugaagucugguagugugaggccuuuaaguuuguucuuuuugcuuaggauuaccuuggcuaccugggcucuuuuuuuuuguuccauaugaauuuuaaaauaguuuuuuucuaguuccgugaagaaugucagugguaguuuaauaggcauaggguugaaucuauuauauaaauugcuuugggcaguauggccguuuucacaauauugauucuuccuacucauaagcauggaguguuuuuucauuugcuugugucaucucugauaccucugagcaguguuuucuaguucuccuuguaguaucuuucaccuccuugguuagcuggauuucuagguauuuuguucuuuuuguggcaguugugaaugggaguucauuccugauaggucucuuggcuugccgguguauaggaaugcuagugauuuuuguacguugauuuuguauccugagacucugcugaaguuguuuaucagcauaaggagcuuuugggccgggacuaugggguuuucuagauauaugaucaugucauuuacugaguuuuuaacaugaagugguguugaauuuuauugaaagccuuuucugugucuauugagauaaucauguaguauuuguuuauuuauuuauuucaugcauaacuccucaaguuagagggagaaaauaaaauugcgagucaagguggaauuuguuuggaaggcucugugugauguucucauauaaauuauagaaaugaguagucuuagaauaucagcauuaaauagaacuuuuaaaaaaauucauguagcaguaggacaaaagaaaaagguguaauuagcuaguuaacacucugucuacuauguaguaaccuauuuacuaugggucauuuacugauuaccacacguaauuguuaggaaagucuuuguagcaaaaaugaccaugaugcuccaguuuguggacaguaaagaauccacuuugcuuuuggcucuuaguuguaggauuacauuuaaaagaucucaaaugaauuuacucucauugcaauuaaaaaauauaaacuguuaacuucuuaucaaaaacacuuuacugcuguucuuuauauuaaaauaaaguuagacguaugcugaaucucauaaaaacugguuggauacagaauaaaaaaaguugauuuaucucaugcaaaucaaaaaccccaaaacaguuuacaaccuauuuuguaacucagaggauguuaaacaggcaucacucauguuuugaggcaucuugaggcauuauucaguauauaugauuuugccaacuuggauggccuuugcauuuucucaaauuugcuuguguguuuuuuuugagacggagucccgcacuuuuggcugggcuggagugcaguggcgcgaucucagcucacugcaagcucugccucccggguucaagcaauucuccugccucagccuccugaguagcugggauuacaggcgcaugccaccauaccugucuaauuuuuuguauuuuuguuuuuuuuuuuuuuuugagauggagucucgcucuguugcccaggcuggagagcagugguacgaucggcuuacugcaagcuccgccucccggguucacgccauucuucugccucagccuccugaguagcugggacuacaggugcccaccaccaagcccagcuaauuuuuuguguguuuaguagagacgggguuucaccauguuagcuagaaugcucuugaucuccugacuucgugauccgcccaccucggccucccgaagauuuuuuguauuuuuaauagagacgagguuucaccaugcuggccaggcugaucuugaacuccugaccucgugauccgccugccuuggccucccaaagugcugggauuacaggugcaagccaccgugcccggccauguguguguuuuuaaaacuauuuuuuaaauuccauuucuugucugggcacgguggcucacgccuguaaucccagcuuugggaagccgagauggguggaucacgaggucaggaguucgagaccagccugaccaacauggugaaaccucaucuuuaauaaaaauacaaaaauuagcugggcaugguggcaggcaccuguaaucccagcuacucaggaggcugaggcaggagaauagcuugaacccgggaggcggagguugcaaugagccgugaucgcaccauugcacugcagccuggguggcagagcaagacuccgucuuggaaaauaaaaaaaaaauuucuuaaagaauuggagccaucaaaguuggcaagcauuaagcaugcuaauuaguucaacauacugaccaauucucugaauuauuaguucaaagaagcauguggacagggaugaaauuaaauuugggaauuuuucacucuaguuguuuuaggauacucagguuugcuuugaucuguaaauaacagaugcuuuuccaugcaugguuuagaguacaucaaacauguucaaaacuuuaucucagauacuuaaaaucaaguuauuuuauuuuccugauauacaugcauuugcuuuauuuuuaaaaauaaacugucauaaaauaguuguaaggccauacauaaaauuuacuuuauuaauugcuaaaauauauugcuuauuuaaauaaucaguuuuaagaguaaaagcuuuggcaacuaugaaagcauagggaguauguguucauaugugaauguauuguguguguaugcauaguauacuuuuagguaucuaaguagugaagauaaaugucugcuuuacuuuuauuagcuaaauauuauauuuaacuuaauaauuauuuaaucacuagaaugaaaauaaaacuuugaacagaagcauuguuuuuaacuuaaguuucauaguuuacuaccucuuuuggcucuuaaccauaauuuuaguacugggaagaauuuuuuuaacgaauggcauaaaauggauugcagaugggaugagaaaggugcaggaccaagaggguaagaacugagaaguccucgauucuguuuuccacacucccugaacagaaggcuugacuggcguaggcccugcuccaaccuaguguaggcugcaggaagccaugugacaagaguccagauuguuguccaaugguggaagccucccauuuauaaguaauaauaagaauaagaauguuuggcauugagcgaggugcgguggcucacgccuguaaucccagcacuuugggaggcugaggcggguggaucaccugaggucagaaguucaaaaccagccaggccaacaugaugaaaccccuaucucuauuaaaaauacaaaaaaaauagcugggcaugguugugggugccuguaaucccagcuauucgggaggcugaggcaggagaauugcuugaauccgggagguggagguugcagugagccaagaucgugccauugcccuccagccuggucaacaacagugaaacuccaucucaaaaaaaaaaaaaaaaaaaagaaugucuggcauuaauucuagaacugagaugcucuuuugcuuaguaaagucauuuuuucuuuuugaucauuaagcuacaugagguuuuguaaugcauuccauuuguggcuguucuuuaucaaaauauuacuauaacaguagcuuccuuaguacaucagacaucaggacacugaaggucuaguugcaguuuugccacucgcuaucuugugccuuuugaaguuguuuaaucucucuggguauugauuuccuuuuuuaaaaaauaguugguaaacuaugaccugugggccuaauccagaucacagccuguuuuuguaauaaagcuuuauuggcaugcagccacuuucuuucauuuauguauugucugucugcuuucacacaacaguggcagaguugaguaguuguaacagagacuguauggaccauaaagccuaagcuauuuauuaucugacucuuuacagaaaaaguuuucugaauccuagacuagaucaucuuugagggcugugcugugccuuagauuagauuuccuuuuugucaauuucucuuuaauucuaaguucucaaaagaugucugucuuuaaaggauauagcauaucauuuccucguuaucaaauuugcaaauuaugaaaagaaggaaaauacugaguagaucauugguucccaaaguacagucccuccacgaauagcagcugcauucccuaggaacuugcuagaaaugcagaaucuaaguccccacuugagaucuucugaaucagaaacuuggggugaggcccagaauuuguguuauacacccucugcaugauucugaugcauucugaagugugagaaccacuggacuaggugauacaaaguucaguuaacagauuuucuucuguuuugaaaaaaagaagagcuuaaauaccaaaaccauuugauagguauaucaggaggaaaaugaaauguuggauauuauuacuaagcuggugaaauuaauauuuucucuaguaaaacuccuugucauaaauuguggauaaguuuuaauauaaugagaaauuucugagagguacaucugugucacuuucagcauauuuuuaauggacagaaaaguaaauaugauuuauuucuuugugggguuuucuuuuuuuggugggagaucacuuugaauuauuucaaaacugaugauuuguaauaaacaguuuucagaauaaaagaauuacauuaagaauuaauuugcuugugaagaaagugucuuaagaaaagagcauuuaaggggcacagcagccucugcuguagcuggauuucuuacccauuuuaagugacaucaguguugaauugacuuuuuccucagugcuaaaagcugcuagaaaugagcaccagucacacuacugaucuguguuaggaaagaucacaaacacaguacuuuguaauaaaugucagaggaauagcaaaauuguacaugucaagaaagcauuacaggaugacguugcuauuuggagaauugcuuucaucuuugagauaucucacaccugcuucauuuggcauagguuguuucuauuucaugaaaaacagucuuuucccucccccagaucccaaguuacauagaaacaguaugcuaacaagggaaaaauuuuaacauaaaaacucacuugaaggugccaucuaaaaacucaguguguaaacuuaguuaacuaacuuuauuuuguugaaaagggacccuugguuuguguguguguauguguguguacacaugaauacguaccuauguauacauuuguuacuguguguguguuuauauauguauguauacaguucauuugaugugcguguauaugcacccauuuccauguauguauuuaaaagaauacauacaacaaacuuuuuuuuugaggcaaaguuucccucugucacccaggcuggagugcaguggcacagucucgacucacugcaaccuccgccuccuggguuccaagcgauucucaugucucagccucccgaguagcugggacuacagaugugugccaccaugccuggcuaauuuuuguguuaguagagacuggguuuugcuguguuggccaggcuggucuugaaguccuggccucaagugaucugcucaccucagccuccgaaaaugcugggauuauaagugugagccgaugugcuuggcaaacaaacuuuuguauauauaauccuuucauacuaauauuuaacuacuuguaaaaacuauguuaacccccagucacuaacacaguuccguaguccauauuuauuauugcuucuuucacuuuucuccuuucuucaugcaugaaaauauaaugugauccaaggggguaugugugcaugagguguguguuuauagaguaacaguuaaaugucucgaaauaaacugauuuggauuuuuagguuauagauguuuuuguuuuuuauuaaacgucuugauuguuugacugucaugguuguuuguauaacuccuugagaaacuuccacaugcggguaguuuuugaaaaagaaaauauuuauuugcuucaguuuuucaggggaugguaucauacugcuuuuucacauuuuaugggugacauauuuggcuaucucugggcaaaaauccaguuaaaaauaauaguauuuaauauuuaauaaacuaccaggcuuuugagccaucuggaacuuuauuuucuuugcacgcagcaucugaguuucagcuguuagcguuucuccuuugcucugggaagggucaauugcuuuuaaagucuuugaagcuugcugugucagcccuuuucauauuuucaaaaugcccguguaaaaggguuuuucauccauucaugcugauaagucuuuugaacuugagguuugaaccaagcuaaucaaauuuaauuauagcuuaaaucccguuacagugaacuccaguggacuucuaggcuaggguuuuuuuguuuuguuuuuuuuuuuuuuuuugguguuauacuggaauuuagccauuaccaauauuacuugaagugagcaggccauugacugcaguuugggagaccuuuuguaauggucagauuuuaguuauagugacauuggcaauaugauuugaacuuuauucuuuuccaaaggaaauaauugaauuagccacaaguaaaauuucuuguucuuugcauauauuucaaauuaccuuuuccuauuugucuuaaacaauuuugaacaauuaaaaucuuaaaaguacuuucuuaaagaguccuuuggugguggugucgcugaugcucguuuuuuguuuuuaagauccauaacagaauaaggauuuauauacauccuccuagggauaaugucaugguuucugcauauuugcauagcauuuugagagagacuuuuuccuuuuugcuucaugaaaaaaaguuugagcaguauaauuuucuagaaagaaggaaauauaaauauuuuagacuguagcauauacuaaagggagguggacuaguacugauauuuuuagugcuuucuucaaaaugauugcuaacacguguauuauauuuuaguaucuuguugcauucacuuguuaaucuguauuuaugcuucuguauaugcagaguuuuuuguuuuuuccaacacaauuuaaaauucuacuuaaaaauuacuuguuuggauuucuaagcagauuugggaauuacggcauugaaaauacuuuguugcuuuuuaugucucaauaaagucuaugcauuuuuauaauauuggaccaguguuugaccugccagaauaaaaugaugauagaacucauuguguccucaaauaauuggauucugaaauggaagauaggguucaugaagaauaaaaaauaguagaucucauguaaaggugaaaauuuacuuuucuuuuuaguauucaacucaaaauugccaguuucccugaauuuauuauagcaauuucucuuguuuuaaaaugaagugaaaugugaaguuaauuuacauacuagcugcuuugaaguguaauuuugcuugccaaguuguuacagauuuuuauacagacuuuuuaaggaauuuaguaauaaugcugccacaguguguaggacaaguucaugccuugcaucuuugaugggcguuagaauuguuugccacaguucccacucugguuggagggcacaaccaauucgucuaugccuuuugacuuccaugccggagagugugacuucugcaucuguuuguuaguauuuuuauguaagcagaagccaagaaugucauuagaaaguaaaacuuuaacaagagggacugaauccuacuaggccaacauaauuuauagagagcaggggcuaacauuuucauuugggaaaaaugcuuccauuucuauacguguuuagacggaguaccuuaagcauuguuuuagucuuuuccuaucuacauguuaccauucagaacuuagguggaugaaacacauuuuauauguaguuacagagagauacagaauuaaaagccuacagauacaagcauuagaauugugacggggguaauuagaaacauggagucugaagguagccuaucuggauucaaaucccagcuccaguacuuagccauguggccuuaggcaaguuauuuaaacugacuuauuuuguuccucuguaagaugagaguaacaauaauaccaaccucauaagguuguugggaaaauuacauguguuccugcauaugaagugcuuaggacagugccugaaauacaguccuauauaaauguuauaauuuaugauuauuguugugaugauaaugaugauaauaucacuagcagcuccucugaaacuuguuggccucauccaaggccuaucacuuagcuuuauccccagugucucuaauacuccaucuguugugcagaaguauauccugaaccuuccucccucugaauuugcccacuuggcaccucuucauuugcucuuacaaucucuagaccauaaauuucaaagacguggcccaaaauguuggacucaagguuuuugcaaacuacaagcuaacauguuaaaauugagugguuucauauacaacuccaguuauccaaguuuucuuggacaaucuggguaucuggucauagugggccuacauuucugcauggcaguaauugucuagaacagaguagcggcugcuuguuuugacagaaacugcucuccaugucaucagagucccugccacuuccuguuguuuugacacuuuucucauucuagucaucgauaucauuuuuuugggucauguaauacuuauuugcugccagcaguuuagaguaagcagcgguucuccaccauguguucugcacacucauacuccacuaggccuuugcugauaggucaccagauuuugauucauguguaaaacauacauuaguuaaaaucaaguaugcauaauaguguuuuggcuuugucugucagaagcaacauugagcugggcaggugugcuuguguauuagagcuagauacaacuuggugaaaagguuagcccauauuuaaguucaaaccaaagaacagugauuaaagcccaagccaaagaaaauugagauaugggagagcuuugccuucugaguguguaagggagcacagguggugcacgccauguguucagugucucagugcuagggagucagcagggauaaagaaagauaacugaugccuuagagcagaguuuaaggggcuguggauuguguccauggggaccccccuuugcauuccaggcuguguagcagcaucccuggccucuacccacuagauaccaggagcaccucccgugaguagugacaauuuaaauguccccugggagguugaaagaugcagaagacauuauaauauaguaguuaucauggucuagucacuguugacaucuuuaauacugcuuuuagucuuugaauccuuugaaauauuggcuuuguacuccacuuuucuaaagcauucaguauuuauuuuauggccauuuuacuacaguaucagagaggagauauacuucucucccccucucuagucaagcacaacugcaaguaucuuuaaggcgcagccaccuuuaaggaaagacuucugggaacagcuaacuguguuggaggaacugggcuguggcucguccucugcugcucguuagcccugugaaccuggggaggcuagcucccucucuuagucuuggcuaaaagugagguggcuggaucagauaaucagcaagaugccuuccagguaagauuaggcuguaagucagaaaauauuguaggacuucugaaacuuuaacugccagucaagaucacuuaacuagaaugucccacauuuuucacuccauugaaaugaguaacuucaagugucauguaacaucaggaucacuuaggggaaugucuagaggugcaguagaugauuguuagcuuucuguugcuguguaaugaauuaccacaacuuuagugguuuaaggugacauauauugaugaucucaugggucucuacagcagcagucugaggaccgcguggcugaguucuccauucacuguuucacacagugacagucaagguguugcagggacugugaucucaucugaggcuaggguccucuuccaaaugcacagggcgguuggcagauggcauuuccuuguggcaguaugacugaggauccuguuucuuguuagcgauuggauggugaccacacuuuacuuccagaggcugcucugagguccuugccauguggcccccuccauaggcccuuuuacaacaugaaauuuuauuucuucagagccagcaggagaaucucucacacuucagaucuuguuaggaaggggcugguuuuucuaagaacucaccuuugaagucaagcccauccacgauaauuucccucuugauaaacucagaaccaacugaugggggaacuuaauuaaaucugcagaauccauucauauuucugauuaaauguaacuucgucacaggacuugucuuuguccuguucacggucccauccacacuggaugggggaggauuauacagggcggguacaucagggagugggaaucuugggggccucccacaaugccucuugauuuaaaaagauucuggagcauacuuuuucuuaugucucauaucuaagcuaauaucuucccuuuucuguucaguuucaguuuuguguucacaugucuguugucauauuuuuucuucuauuuuugcaggaggaggauuagagucaaagguguggggaggcuugugagcuucugugaguuguuguguguggcuuguauacaugcuguuauacugguaagcucuguaacaaccccugauugcugaacaugcuaacugggauauacgcuacaugguucacuggugcuuucaggaaaccaucgaggugucaggcauugaggauucguuguucacuaauacauucuuuaaaaugcuuuuagaaucauuauauccaguuuccuuucucucuguacaugggacugauuaaccaccauguggguggaaaucuaauuuguugcuggcucagaacuuugcaauuuucaauacuuugcagaauuauccuguuuaccaaaugaauugugauaaaaauugauacauuaguauuaagaggaugacuuauaacauguacuaugauuuauagggccaaaaagaccugauaaacucacaaccauuuuaccccauaauguuaagaaacucaaaagauuuugucaccaaaaaguguaucuugugauuuauuuuuuaugacacgguaguaucacuuguuagaguucugagauucuuuauuagcaacugacaguuuucuaggaacugaauuuuuacacuuagagcugcgaaaagccaaaagcauuucuaaaugaucuccaucccauuccccucaaauaauaauguacacgcucauuauaguuuguuaguuucucaugccuuucuuugguguucucaugguugugagaaguugggagaagcagcgucuaaauuuaggaaauggauuucuuuucuguuacuaaguacauugcuauaauuuaaagacaacaggagaacaugucuuuuaucucaaaugggucugcuauuuuucuucuaagguguuucucuaagaguaacauuauguaauuuaaucaguguuauaaaaaauggaauuccugguuaggauuuuaaaaggugauguuaacagauaucaaauuuuuuauauuagggauugaaggacuuuuauuuauuuauuucauuuuaauuuuuaagcuccaggauacauauguaggauaugcagcuuuguuacauagguaaauaugugcuauggugguuugcugcaccugucaacccaucaccuugguauuaagcccagcaugcauuagccaucuuuccuaaugcuccccuuccccccaccccacccugugaaaggccccagaguguguuguuucccucccuguguccauguguucucauuguucacuuacaagugagagcaugugguauuugguuuggguugauuccuugucuuugcuauugugaauagugcugcagugaacauacaugugcgugugucuuuguaauauaaugauuuauauuccuuugagcauauacccuguaaugggauugcugggucaaaugguauuucugguucuugcucuuugaggaauugccaccccaucuuccacaaugguugaacuaauuuacauuuucaccaauagcguaaaagcauuccugucuuuccucaaccucgccagcaucuauuguuucuuucuuuuuuucuuuuucuuuucuuuuuuuugagauggagucucgcucuguugccuaggcuggagugcaguggcacuaacaugacucacuuuaaccucugccugccaauuucaagcaguucuccugcgucagccucccgaguagcugggacuacaggugugcaccaccaugcccagcuaauuuuuuguuuaguagaaacaagguuucaccaugcuggccaggcugguuucaaacuccugaccucgugauucacccaccuuggccucccaaagugcuaggauuacaggcguaagccacugcgccuggucuguuucuuaacuuuguaauaauugccauugugaauggcgugagacgguaucucauugugguuuugauuuucauuucucuaaucagugauguugagcuuuuuuuucuuauguuuguuggcugcaugaaugucuucuuuugagaagugucuuuucauguccuuugcccacuuuuuaauaggguuguuuuucuuuuucuugucucucucuuuuuucuuuucuuuuuuaauacuuuaaguucuggggauacaugugcacaacgugcagguuuguuacauagguauacaugugccauggugguuugcugcacccaucaaccugucaucuagauuuuaagccccacaugcguuagguauuucuccuaaugcuauccauccccuugcccccagcccccaacaggccccagugugagauguuccccucccuggguccauguguucucauuguucaccucccacuuaugagcaagaacauaugguguuugguuuucuguuccuguguuaguuugcugggaaugaugguuuuuagcuucauccaugucccugcaaaggacaugaacucauacuuuuuuaugguugcauaguauuccaugguguguaugugccacauuuucuuuauccagucuaucauugaugggcauuuggguugguuccaagucuuugguauuguaaauagugcugcaguaaacauaugugugugugugccuuuauaguagaaugauuuguaauccuuuggguauauacccaguaaugggauuggugggucaaaugcuauuucugguucuaguuccuugaggaauugcugcacugucuuccauaaugguuaaacuaauuuacacucccaccaacagugugaaggugucuguuucuccacauccucuccagcaucuguuguuuccugacucuuuaaugaucgucauuguaacuggagugagaugguaucucauugugguuuugauuugcguuucucuaaugagcagugaugaugagcuuuuuuucauuuguuuguuggccgcauaaaugucuucuuuugagaagugucuguuaauauccuuugcccacuuucugauggggucguuuguuuuuucuuguaaauuuauuuaaguuccuuguagauucuggauauuaacccuuugucagauggauagauugcaaaauuuucucccauucuguagguugccuguucacucugaugauaguuucuuuugcugugcagaagcucuuuaguuuaauuagaucccauuugucaauuuuggcuguuguugccguugcuuuugguguuuuaaucaugaagucuuugcccaugccuacguccugaaugguauuaccuagguuuucuucuaugguuuuuaugguuuuaggucuuacguuuaagucuuacaucuugaguuaauuuuuguauuagguauaaggaagggguccaguuugaguuuucugcauauggcuagccaguuuucccaacaccauuuauuaaauagggaauccuuuccccacugcuuguuuuugucagguuugucaaagagcagaugguuguagaugugugguguuauuucugaggccucuguucuguuccauugguuuauguaucuguucugguaccaguacccugcuguuuaggguugcuguagccuuguaguauaguuugaagucagguagcaugaugccuccagcuuuguucuuuuugcuuaggauugucuuggcuauacgggucuucuuugguuccauaugaaauuuaaaguaguuuuuuucuaauucugugaagaaagucaaugguagcuugauggggguagcauugaaucuauaaauuacuuugggcaguaugggcauuuucaugauauugauucuuccuauccaugagcauggaguguuuuuccauuuguuuggguccucucuuauuuucuugagcaguaauuuguaguucuccuuuaagagguccuucacaucucuuguaaguuguauuccuagguauuuuauucucuuuguagcaguugugaaugggcguucacucaugauuuggcucucugauugucuguuaaugguauguaggaaugcuugugauuuuugcgcauugauuuuguauccugagacuuugcugaaguugcuuaucggcuuaaggagauuuggggcugcgaugauggaguuuucaaaauauacaaucuuguuaacugcaaacggagagaauuugacuuccucucuuccuauuugaauacccuuuauuucuuucucuugccugauugcccuggccauaacuuccaguacuauguugaauaggaguggugagagagggcagccuucugcugugccgguuuucaaaguuaaugcuucuagcuuuuccccauugaguaugacacuggcuaugaguuugucauaacuauuccauaacuauucauaacuauuccauaacuauuccauauauuccguaacuguuccugguuuauuggguguuuuuagcaugaaggggugguuagcaugaaggugaauuuuauugaaagccuuuucugcaucuguugagauaaucaugugauuuuugucauugguucuguuuaugugauggauuauguuuauugauuuguauauguugaaccaaccuugcaucccagggaugaagccugcuugaucaugguggauaagcuuuuugaugugcugcuggauucgguuugccagaauuuuauugaggauuuucgcguccauguuuaucagggaucuuggccugaaauuuucuuuuuuuguugugucucugucagguuuugguuucaggaagaagcuggccucauaaagugaguuagggaggaguccuucuuuuucuguuguuuggaauaguuucagaaggaaugguaccucugguagaauucggcugugagccaucugggcucuuuuugguugguaggcuauuaauuacugcaucaauuucagaacuuguuauuggacuauucagggauucgacuucuuccugguuuagucuugggaggguguauguguccaggaauuuauccauuccuucuagauuuucuaguuuauuugcauagagguguuuauaguauucucugaugguaguuuguauuuuuaugggauuaguggugauauccacuuuaucauuuuuuauugugucuauuugauucuucucucuucauuggucuggcuaguggucuauuuuguuaaucuuuucaaaaaaccagcuccuggauucauugauuuuuuuuuuaaaguguuuuucaugucucuauauccuucaauucugcucugaucuuaauuauuucuugucuucugcuagcuuucgaauuuguuugcucuuacuucucuaguucuuuuaauugugauguuagggugucgguuuuagaucuuucccacuuucgccugugugcauuagugcuguaaauuucccucuaaacacugcuuuaaaugugucccagagauucugguauguugugucuuuguucucauugguuucgaagagcuuauuuguuucugccuuaauuucguuauuuaucuaauagucauucaggagcagguuguuuccguguaguugcgugguuuugagugaauuucuuaauccugaguucuaauuugauugcacuguggucugagagacuguuuguuaugauuuccauuauuuugcauuugcugaggaauguuuuacuuccauuuauguggucgauuuuagaaucagugcuguguggugcugagaagaauguauauucuguugauuugggguggagaguucuguagaugucagucagguccccucgguccggagcugaguccaaguccugaauauccuuguuaauuuucugucucgcugaucuagcuaauauugacagugagguguuaaagucucccacuauuauuguguggaagucuaaguuucuuuguaggucucuaagaacuugcuuuaugaaucugagugcuccuguauugggugcauauauauuuaggauaguuagcuuuucuuguugaauugaccccuuugccguuauguaaugccuuucuuugucuuuuuugauguuuguugguuuaaagucuguuuugucagagacaaggauugcaaccccugcuuuuuuuugcuuuccauuggcuugguaaauauuccuccaucccuuuauuuugagccuauuugugucuuugcaugugauaugggucuccugaauacagcacgccagugggucuuaacucuauccaauuugccagucuguuucuuuuaacuggggcaucuagcccauuuacauuuaagguuaauauuguuaugugugaauucgaucugucaugaugcuagcuguuuauuuugcacauuaguugaugcaguuucuuuguggugucaguggucuuuacaauuuguuguuuuugcaguagcugguaugggauuuuccuuuccauauuuagcacuuccuucaggagcucuuguaaggcaggcccgguggugacaaaaucucuuagcauuugcuugucuguaaaggauuuuauuucuucuuugcuuaugaagcuuaguuuggcuggauaugaaauucuggguugaaaguucuuuucuuuaagaauguugaauauuggccuuuacucucuuuuggcuuguagcguuucuacagagagaucugcuguuagucugaugggcuucaccuuguagguagccugaccuuucucuccggcugcccuuaacauuuuuuccuuccuuucaaccuuggugaaucugaugauuaugugucuuggguugaucuucucgaggaguaucuuaguggugcucucuguauuuccugaauuugaauguuggccuuucuugcuagguuggagaaguucuccuggguaauauccucaaguguguuuuccaacgugguuccauucucccugucacuuucggguacaccaaucaaucguagguuuggucuuuucacauaguccgauauuucuuggaggcuuuguucguuccuuuucauuauuuuuucucaucuugucgucacacuuuauuucauuaaguugaucuucagucucugauagccuuucuucugcuugaucgauucggcuauugauacuuguguaugcuucacgaaauucucgugcuguguuuuccagcuccaucaggucauuuauguucgugucuaaacugguuauucuaguuagcuguuccuguaaccuuuuaucaagguucuuagcuugcuuucauuggguuagaacaugcuccuuuagcuccgaggaguuuguuauuacccaccuucugaaguguacuucugucaguuuuucauacucauuuucugcccaguuuuguucccuugcuggugaggaguugugaucguuuggagaagagguauucugguuuuuggaguuuucagccuuuuuuuggugguuuuuccucaucuucauggauuugucugccuuugaucuuugacgcggaugacuuuuggauaggguuuuugcguggguguccuuuuuguuuuuguugauguuauugcuuuauguuuguuaguuuuccuucuaacagucaggccccucugcugcaggucugcuggaguuugcuggacguucauuucagacccugugugccuggguaucaccaccagaggcugcagaacagcaaagcuugcugccugcuccuuccucugaaagcuuugucccagaggggcacauaccagaugccagcuggagcucuuuuuuaugaggugucuguugaacccuccugggaggugucuccccaucaggaagcaugggggucagggacccacuugaggaggcagugugucccuuagcagagcucaagugcugugcugcgagauccacuccucucuucagagcuggcagacaggaacaguuaagucugcugaagcugugcccacagcugccuguucccccaggugcccugucuuauggagaugggaguuuuaucuauaagcaccugacuggggcugcugccuuucugucagagaugcccugcccagugaggcagucuagagaggcagucuggcuacuguggcuuugcaguggguucugcccagcccgaacuucgccgcagcuuuguuuacacugugaggggaaaaccaccuacucaagcuucaguaaugguggaugcccuuccccuaaccaaacccaaucaccccaggucgacuucagaaugcuuugcuggcagcaagaauuucaagccaguggaucuuagcuugcugggcucuguggggguggagccuacugggcaagaucacuuggcuuccuggcuucagcccccuuuccaugggaguaaacaguucugucucacugggguuccaggugucacuggguacgaagaaaaaaaagaaacaacagaaaaaaaaaaacuccugcaccuagcucugcccaaacagccacccaguuuugugcuugaaacccaagacccugguggcguaggcacuagagggaaucuccucgucuguggguugcgaagacugugggaaaagcauaguauuugggcuggaaugcaccauuccucaugacacagucccucaaggcuucccuuguuuaggggagguaguucccuggccccuagugcuucucgggugaggcaacaccccacccugcaucugcuugcccacugugggcugcacccacugucuaaccagucccauugagaugaaccggguaccucaguuggaaaugcagaaaucacccaccuucuguuauggccuugcugggagcuacauaucggagcuguuccuauucagccaucuugccagaucccccuguuuguuuguuuguuuguuuuucauguaaauauaagguccuuguagacucuggauacuagaccuuugucagauggauggauagcaaaaauuuucuuccacucuguagguugccuguuugcucugaugauaguuucuuuugcugugcagaagcucuuuaguuuaauuagaucccauuuaucaauuuuugcuuuuguuacuauugcuuuuggcgauuuugugaugaaacuuuugccugugccuguguccucaaugguauugccuagauuuucuucuagaguuuuuaugguucuggguuuuacaguuaagucuuugauccaucuugaguuaauuuuuauauaaggaaggggucuaguuucaguuuucuugauauggcuugccaguucucccagcaccguuuauuaaauagggaauccuuuccccauugcuuguuuuugucagguuucucaaagaucagaugguuguagaugugccaucuuauuucugaguucuuuauucuauuccauuggucuaugugucuguuuuuguagcaguaccaugcuguuuggguuauuguagccuugcgguauauuuugaaguccaguagcauguugccuccagcuuuguucuuuuugcuuaggauugucuuggcuguaugagcucuuuuuuuauuccauaugaauuuuaaaauaguuucuucugauucugugaagaauguuaaugguaguuuaauggaaauagcauugaaucuauaaauuacuuagggugguguggccauuuuuguaauacugauucuuccuauccaugagcguggaauguuuauccauuuguuuguguccucucugauuuccuugugcagugguuuguaguucaucuugaagagauccuucacgucccuugcuagcuguauucuuaguuauuuuuuucucuuuguagcaauugugaaugggaguucauucaugauuuggcucucugcuugccuguaguucguguauaggaaugcuugugacuuuugcauguugauuuuguauccugagacguugcugaaauugcuuaaaagcuuaagaagcuugugggcugagacaaugggguuuucuagaaggaguaucaugucaucugcaaacagagacaauuugacuuccucucuucuuguuugaauccuuuauuucuuucucuugccugauuguccuggccagaacuuccaauacuauguugaauaggaguggugagcgagggcauccuucucuugugcugguuuucaaagggaaugcuuccaccuuuugcccauucaguaugauacgggcuguggguuuguccuguauagcucuuauuauuuugagguaugauccaucaauaccuaguuuauugagacauaacaugaaaggauguugaguuuuacugaaggccuuuucugugucuauugagauaaucaugugguuuuuguuuuuggaucuguuuaugugaugaauuauguuuauugauuugcguauguugaaccagccgugcauccuggggaugaagccgacuugaucacgguggauaagguuuuugaugugcugcuguauucggcgugccuguauuuuauugagaauuuuuacauugauguucaucagggauauuggacugaaguuuuguuuuuuguuguuguaugucugccagguuuugguaucaggaugaugcuggcgucauagaaugaauuagggaggagcacuuccuuuucaguuguuuggaauacuuuuagaagaaagaguaucagcuccuguuuauauuucugguagaauucagcuguaaaaccgucugguucugggcuuuuuuuuguuuuuuuuuuuaguuauuuauuacugccucaauuucagaacagguuauuggucuagucagagauuccaauuccuuuugguucauucuugggaggguuuauguguccaggaauauauccauuucuuacagauuuucgaguuuguuugcauugagguguuuauaguauucucugaucauuguuuguauuucuguggggucgccagugauauccccuuuaucacuuuuuauugugucuauuugauucuuuucuucuuuauuagucuaguuaguagucuauuuuuauuaauauuuuuuaaaaacuagcuccuggauucuuugauuuuuuuuuuuuuuuuugaaggguuuuucauguuuaucuccuucaguucugcucugaucuugguuauuucuugucuucugcuagcuuugggguuuguuuacucucaguucucuaguucuuuuaguugugauguuaggcugucaguuugagaucuuucuaacuuuuugauguaggcauuuauugcuauaaauuucccucauaaugcugcaaaucugugucccagagauucugauacguuguuucuuuguucuuacugauuucaaauaacuucuugauuucugccuuaauuucaucauuuagccaguagucucagaagcagguuguucaauuuccauauaccuuugugguguugaguggguuucuucaucuuaaguucugauuugauugcauuguggucuaagagacuguuuguuaugauuucaguuauuuugcauuugcucacaagugauuuucuuccaauugugcgaucaguuuuagagugccauguggcaccgagaagaaugcauauucuguuguuuuuggggagagaguucuguagguaucugucagguccacuugauccagagcugaguucagguccugaauaucuuuguuaauuuucugucucaauggucuauccuugauaguaggguauuaaagucucccacuauacuugugugggaguguaaaucucuuuguagguaucuaagaacuuguuuuaugaaucuaggugcuccuguauuggguccauauauauuuaggauaguuagcucuucuucuugauuugagcccuuuaccaucauguaaugcccuuuuuugucuuuuuuaauguuuguugguuuaaagucuguuuugucagagacuaggauuguaacacgugcuuuuuucuguuuuccauuugcuugguaaauuuuccuccauccuuuucuuuugagccuaugugugucuuugcaugugagaugggucucuugaauacagcacagcaauggaucuugacucuuuacuccaguuugccauucugugccuuuuaauugggggcauuugcccauuuacauuuaagguuacuauuguuauugugugaauuugauuguuucaucaugaugcuggcugauuauuuugcagacuuguuuauguaguugcuucaucaugucacuggccuguguacuuccaugugguuuccuagugguugguaaugguuuuuccuuuccauauuuagugcuuccuucaggaacucuugcaaggcaggcuuggugcugaugaauucccucagcauuugcuugucugaaaaagauuuuauuucuccuuugcuuaugaggcuuacuuuggccagauacgaaauucuagguuggaaauucuuuuguuuaagcauguugaauaucagccccuaaugucuucuggcuuguaggguuucugcugagaggucugcucuuagucuaaugggccucccuguagagaugagcggccuuucucucuggcugcccuuaacauuuuuuuuucuucauuucaaccuuggaggaucugaugauuauaugucuugggguugauauucucauggaguuaucuuccugggguucucuggaguuccugaauuugaauguuggcuuaucuugcuagguugaggaaguucuccuggaugauacccugaaguguguuuuccaacuugguuccauucuccuugucucuuucagguaccccaucagcuguagguuugguuuuuuaacauaaucccauaguucuuggagguuuuguucauuccuuuuuuucuaaucuugucugccuauuucagcaagaugguauucaaguucugauaucuucucuuccacuuggucuauucagcuauugauacuuguguuggcauugugaaggucucauguuguguuuuucaacuccaucaggucauuuauguucaucucuaaacugguuauuuugguuaacagguccuguaauguuuuaucaugguucuucacuucuuugcagugaguuagaacacacuccuuuaucucagcaaaguucauuacuacccaucuucugaagccuucuucugucaauucacccaucucaagccucggcccaguucugugcccuugcuggagacaugcugugauuauuuggaggagaagaggcccucugacuuuuugaguuugcagcauuuuugcauugauucuuuaucaucuucauggguuuaucuaccuuugauuuugaggcugcugaccuuuggaugggguuugugugggucuuuuuuguugaugauguuguuguuguugcuuucgguuuguuuuucuuuuagcagucaggccccucuucuguaggacuacugcagugugcuggggguccauucuagacccuauucuccggggccccucccaucccuggagguaucaccaggggaggcugcagaccagcaaagauggcagccugcuccuuucucugggagcucugucccagagaggcacugaccugaugcuggauagaaugcccuuguaugaggugucugcaggcuuuugucaggaggucucacccagucaggaggagcaggaucagggacccacuuaaauaagcagucuggcugcccguuggcagagugggugugcugugcuguggggaaucccccucauccaggcugcccugacucuccagagccagcaggcauaaaagacuaagauugcuuauccaugauaccacagccgccccuccuccuaggggcuccugucagggauaucagaguucuguccauaaaccccuggcuggggaugcugaaauucccacagggaggcacuacccagugaggaggaguggaucgggguccugcuuaaagaaucagucuggccaagaacugacccagccgcuguacugugauguggggaguugcuucugguccaaaccacccggucuugcuggcacugguggcaggggaaaacagccaacuggagcugcagugauggcggcugccccuuuuccucaggaacucaguugucuuaggcagucucaagucugaugugcuggcugguggggauuccaagccaguggauuuuagcucuugggguucugugggaaugaggucacuuggcucccuggcuuuagcccccuucccaugggaguggacagauguccugccucgcugggguucccagagcuggaguaugcaaauacuccuaugucucagugucugcucgagacaccacccuccugagcagcugccgugauucugcacaguucugugcuuaggacccaaggcccuggaugcaugggcucaugagggggaccugcugaucuguggauugcaagaaucugugggaaaagcauggcuuucagggagggguagcacaaucccucacugccugccuugaccaggggagggagcccccuuucccccugccgccuugugaagcucccgggugggcccuugcuccagccugccuuuccuugcucuccaugggucaugccaacugccucgucagucccaaugagagaaccuugguaccucaguugaagaugcagaauucacucaccauuuuuguccuucucaguggaagccacagagcagagcuguuucuguucagccaucuuggcugcaccugacuuuuauuuauuaaaaaaaaaauuuuuuuuuguuuuuuuugagacaggcucggagacucugucacccaagcuggagugcacugucucaucauagcucacuacagccucgaaauccuggucucaaguuacucaugcuucauauagcugggaccauagauaugcaccaccacauacagcuauuuaaguuuuauuauagagaugguaucucucuuuguugcccaggcuggugucuaacuccuggacucaagcgauccuccaaccuuggccucccaaagugcugggauuacagacacgaaccaccacacccagccucaaaggacuuuuagauugacaaauuugaguuacauugcccguauugugacuugcgcuauacuuaccaacuuucacuugacacugauauuuucuaaaugcuuaaggcuauagaacaaacaguaaaggcaaagucacagccauccuugagaaacuuaguuuugaggugagaaaucaggaguuagcaucacuuaaaucagguuagaguuuguagaaccaaaguuacugaaguagagaaguguauaugauggcauagcucauuacacauuuccuguauauuaggagccucauuauauaauuguuuuuuuuucugucuuuuuaacguacccaaaguauugaaagucgagggagugccagagacaaguaagauuauguucguugggaaauucauauuauggcuacgaaaauaacuauaggcaaagauaccauacuaguauauaaugcauccugcuggucuguuuuaucccauuaaaaaacuucgcgcgcuuuuauuaggagguuuauuuuucuuaugacugggggaaacaaaauuagauaauuuaccuuugaaacagaguugcuuaucuagcauucuuauaccuuccuuaucuguuauuagugagcuuguuuacugugacuauuucugccuuucaaaguugaucugauuaaauuugguuaaaauuauugucuaaucuuccauuagcuguuuuucuuugugagcauguaaauacuguagacaaaacaaaaaaaaugauacaucuucauaacuuaaggggucagcuaaacugaaaucaaaguacugugacagcaauuaaaucuuuuuuuuuuuuuuuuuuuuuuuuuugagaugaaguuucacucuuguugcccaggcuggagugcaauggugugaucuccgcucaccgcaaccucuacuucccagguucaaacgauucuccugccucagccuccugaguagcugggauuacaggcacacaccaccacgccuggcuaauuuuuuaguagagacggaguuucuccauguuggucaggcuggucucaaacucccaaccucaggugauccgcugccuuagccucccaaagugcuggaaagcaauuuaaucuuuagugggcuuuuagacaaauaauugagacuaaacuuugaauuaauuaaacuugagcuuuuuauggugguauuuauuuaaaaauauauaaacuaaaauuugccguuuuuuaacaauuuuaagugccuaauagcauuaauuacauucaguguugugcaaccaugaucacuauuucuaaaauguuuucaucacuccagauacaaacucuguaaccauuaagcaauaacuccccacucuccccucaccccagccccuaguaacuucuaauccacuuuaugucucugugauuuugccuguucuaguuauuucauaucaguggaccaugugauauuuguccuuuguguuuggcuuauuucacuuagcucaguguuuuuaauguuuauccauguuguaguuugugucagaaccccauucccucuuugaauaauauuacauggcauggauauacuuccucuguuaauggucacccggguuguuuccaucuuuuggcuauugugaauaaggcugcugugaacaaugguaugcaagguucugucugaguuccugcuuuuaauucuuuuggguguauaccuauaaguggaguugcucagucauaaaggaauucuauuuuuagcuguuugaggaagccucaaacuguuuuccacaguggcugcaccauuuacacucccaccagcaauguauuaggguuccagugucuugucaccacuuguuauuuuguuuuuucucuuuaaauuauagucauacuaauaggugugaaaugguaugaaccaguugcauuuuuaaaaguacguuuaagauaauuuguuuaugaaauauuuaaacuuugguuaaaagugcccugaguucaacaguuuuaaaaaauugucauauuuuaaaacauuuauauaauugcuauggucugaauauuuguguucccccaaaauucuuacauugaaguuccaacuuucaagaugaugguauuaggagguguauggccuuuggaaggugaauuaggucauggggguggaggccccaugaugggauuagcaucuuuauaaaaaacaccugagagagaaagagagcacaugccagagacccccaccucuuucaucacauaguguuacagugaaaagaccaagagcauuauuagcauaaccugggaacuugauauuaaugcaaauucucagguccuaccuaaaucggaagucuggugcuagggcuuagaaucuguguuuuaacaagcgcuugaaaugauuaugaugcaugcuaacguuuaaaccguucucuguauuuagaguucuuuucuugucuuuuauagcaugaugagaaucuaugcaucuuggcucaguugcaguguuaucccuucuggaaaggcucccccugccccagucaccuccugcacugggcucucagagugcgcuaguauggagugcugauaguugguuugauguuccuuccaguuugagaaacccuuccguguagggauuuguaucucuuuuacuucuuuauaaaccaucaugcuuagcaaacuguagaugucuuuuuaaaguuuguucaguugaauuguguguccagugggugggggacaggguacauaaaguaauuauagggaaguacagaugaagcagguugauacuugauucaugggguugugaaaacaauggcaaaaguugaguuaacauuuuucaaaaguuuucuugggggguuguaucaugcuuucuuguuauauagcuuucugccuacuuuuuuuuuuuuuucuuauuuugagagugguguaugcuaguuagaauucagaauuaucaggaggaacuuuaucuuagucuguuuuguacugcuaugacagaauaccacagacuggguaauuuauaaugaacagaaauuaccuguucauuauccuggaggcuaggaaguccaagacugagggaccaaacucgcccuuuuauauggaacucucuccucagauaacagcauuaagccauucaugaggguggugcccccaugacccaaguaccucccauuccauccugccucucaacacugccacauuggggaucaaauuuccagcacaugaacuuugggggacacauucaaaucauagcaaauuugcuuuaaaaugcuuauaagguaugaaaugaacuuugaagaugaguguggggagguucugagauguuuuuguuuucacauuuaggauacagcaaagugucuuuuaaggaaggaauccuuuguuauuaauucacuaguuugaugcaugcuuuagauuuuuaaaauauaggacacuuuuacccugugaaguuuaaauaugugacuaguuaaagauauuaaaguuuuggcacacauuuucucauuaagcaaugagauucauauuuucuaguuuaugggauaaaaauaaaaauucgaucagugguugcuacaguuucaaucucauuacagcugcaguggaguuuucuuauuaagacaaaccucuuuucaaccacagauacacuuuuuagcuuaggcuucacaaagccucauaacugagguugcauuggcauugaguaucuugccuuuaacagacuuuuaggacuuuauuuguuucccacaauuuucugcauguuugucucaaaugaacuauaaaaugauucagugacaacaugugguuuuaauaacaaacaagcaugggcaaaugaauguagacuuagaauuugaaguuuuguacauaugccauggcuucaacuucuaacugaauuuauagcucagcacucagucagugguaaauuaucaguugcuagauggacuuuuucauucuagacuucaauuauuuugagugccugauauugaagaccacagaucauugauauaaagaauuuucugcaaguuuuuaauaguauauuuauaguuagguuuugugaucaagugggagcaaauuucccccaaucuguuuuuuaccuucuugguuuuuaauuauuacaguuuauauugcaucaaaauguaaauuucaagauaaguaagguauuauaaaacucauuucuuuacaaagguuucuauugaaaaugagucuuuuugaaguaggaauguacuauaguagcugcucugagcauuagaaauaggcauuguggagaugccucuuuccucucugagguggaagagcaugaggcuacuaauguguguaaaugcggucuuucccucagauuggguggggcaauggaaggggugauggaagagagaggguuaguagaugccacauugguauugagugucuugccuuuaacaggcuuugacugaacuaaaaccacauuuuccagucaaccuuauagugauaaaaauaauacucuggucuuaauuaauguacugugucuaaaauaauguauuauaucaguuauuguaaccacccaacaaguucuugccugcugcccaggcagagccaauuuaucaagacaagggaauugcaauagagaaagaguuuaauacacauagagcuggguaaaugggagacuggaguuuuauauuacucagccucagugaaaauucagaggcugggauuuuuuaaagauaguuugucuguaaucccagcacuuugagaggccgaggcaggcggauugguugagccuuaggaguuugagaccagcuugggcaauguggugagaugcugucucuacaaaaagaaaaaaauacaaaaauuagccgggccuaguggugcgugccuguagucccagccauuuggggggcucuggugagggauggcuugagccugggaggucagggcugcagugaaccuuguuugugccacugcucugcagccugagugacaaacugaggcccugucucaaaaaauaaguaaaucaguuaaaauaaagauaguuuugacauacugggugugguggugugcgccaguugucccagcuacuugggaggcugagacaggaggaucuguugagcccaggaggucugggcuguagagcaguaugccaauuggguguccacacuaaguucaguaucagugugaugaccuccuggaagcaaggaccaccauguugccuaaggaggggugaacuggcccagguuggaaacagaguaggucaaaacucccaugcugaucaguagugggauagugccugugaauagccguuacacuccagccugggcaaugaaaaaaaagugugucuuuaagaagacucccuguuuguuaaaaaguguguguguguguguguguguguguguguguguguguguguguguguguguaguuugacagcagggggcuagggaauggggaaugcuguuugguugagugagggauguaauccuaguggauugaagcugguuuucuugcugucuucuguuccugagugggauugcaaaacuaguugagccagauuuuauuggucugagugauaccagcuggucugucagaaugcagagucugaaaaauaccuugaacaccagucuuaggucuuacaauaguaauguuauccaugggagcaauuggggagguuaggaaucuuguggccucuggcugcaugauuccugagccauaauuucuaaucauguggcuaauuuguuaguuuuacaaaggguaucuggucccuaagcaaggagggaguuuguuucaggaaggggcuguuaccaucuuuauuucaaaguuaaacucugaacuaaauuccucccaaaguuaguuuggccuacacccaggaaugaacaagggcagcuugggaggcuagaagcaagauggaguugguuaggucagauuuuucucacugucgugauuuuugcaaagaugauuucauuauuaaaguucuuuuguaagcacagguuuuuuuuuuuggcuuuuuuugccuuauauucucugucuuuugggagaaggaaaaaaucuuuuuucuuuacucucuuacauuuuauaguugggggccuacaaauuauagcgacaaaagacagaguagcaagagaaaaaauagauuugaugguguauauauguacccaggaauucacaaauaaaugugacucaaauaguucaaauuuugggcuuauauacuaucuuauuaggggguggagaggguccuucugagagaaauucagauuggauuuuucuuuauguuggaggauugacaacccuugccuuaucuuggucuccuucaauguuuccacaauucuaguacaagcauuucccucagaagccuucaugcagcuucaguuuaugggagacguaaggcauauauucagugaaaaauaaaagauagccagaauaaaaaucaaauacaaauuaaagaaaggugaggugaugcacaccuaucuuguuuauauaguagcuuaaugagguuuuguagauugauugauggauggauagguggucagcucauggauucauuuacaaaggcauauucaaucuuucauauguaccagguacuaugcauaggggaaacaucuguuaagaagaucagugugggccuugcuuuugccucuugccuaguucacagucugguaaaugaaaccaacauuguuuaauuagaauguaaugagugcuuuauaggcgcuaugagaaugucuaaguaggacaccugaucuagucuggaccaguuaauggcauuuuccugaggguaugcuguugggucugaguucugauuuaugaauaguaaguaacuaggugauaagggggugcagggaaggcccagcagcccaggcagaggaaucauauguaagaaggccccggagauaaggccaguguagcguaaagcaccaaggagggcccgguuaugggaaaugagccagcgcaugcagggccuccaagaccauggaaggacauuuuccuucauccuaaaugcaacagaaaaucacugaagguuuuauaaacagaaggugaucaguuuggucuguuuucuuaauguugcuucuggcucuucuggagaauggaucgugguaggggaauaaaaagagguugaacagagaugagucgggguguugcaguuguccaggugaaaaguaauaguagcuuggacuaggaguacauuagggagaaauagauugaagaaauauuuaggagaucaaauucacaagauaggauuggcugcuagcuucugaagagaaaugaggugccaagaaggauccacagauuucugacacaaccaccuggaugcauaguggccauauuggcugagcucaggaacccaggagaaggauaggcuuuggggguuggggcuucagccuaugggcuagauugccggacauacagagugccugugaaauagcuauguggagauaaugaguaucuacccaaaucgaaaggauauuccuagcacaggaaaaagaggccagaaucuggaagacauuacgaaaaaaaucaaagguggaaaagggggaaaugucccugcaaaguucugaggagaugcauccucccaaaguggcucuucuuccugaggagggguugccugcccugguagaguccgcugcucuccuugaaggaguuaauacgguuguggugacagcuucugccccagaggcuuugcuggccuccugggccagaauugcagccagggcagggaugccagaggcagugaguggaaucuccacaagaguggugucaaguggcaugugcuccacgggagaagucucccugcagacacagaugguuggguucaccuccaguuucaugcuggacaagccuggguucccgagaagcaggaagggagagugagugcacgcacgccucuugcuuccugccuccaauuuuccacccccacacccugcagacaguauguugagccccaaauguguucauaggaacaagaucuucagaagccuccagcggaaaaagaauaccaagaaaaaggacacaucucugguaauuaauggcagaaagcccggacagucgagucuguggugcugcugacaggugaacucugguccucuccacaccuacuuauaggccaugcagacugguggguugcagauguuagccuaagacccuggcaguaccugcugcuuugugguuucagguagagacucucauguuuaaaaauggaaaagcauuuuacaaauuaccauuuaauucuaguuaauacauagaaaaagucauucacacuaccccccuaaaauagaaugacuucugcucuuuuaggugggaacuucuucagcugagcauuggcaacagguugagugaagaaacaguaguuugugucugugcucaauuucccuccucacaauacugguuauuuuaggaguugcuccauuccaacuuguauauuucauaaauuguaaaguauuuuaagucaaagaaaggccguuaauauucucccuccccaaaaugcaugauuuuuaauauucaaaauaauguuuuucaaaguuuucuuaguaaccuaagauuucugugguuugacuccaggauaaaaacacaaggcacuuugucuguauuauuuccacuuauaauuguuuuauauauuucugcuguuaaaaauguuuaagaucgcuucccacucauaaauauauaauacauugaacuuaaaauauauuuguuaaccaguucuccaaaaauaaaaaugaaacguguauauaaaauaauucauuuguuauauuuagggaacuguauucauugcaauguaaauaauuguuaguguucuucacugaaaggauuaauccaaaaaggaugauuuuuuuuucaugauucauuugcuuauuuuuuuguuuauuaguuggugguauggguuggaucauuuguuuuaaaaccacuuguuauaugauugacauacaaaaagcuacacguauuuaauguaucaaauugaguuuaauuuguaauuuuuuauguacuuccuaaauuuguaguccugugagucuuaggacagaucuguuuuucacuuguccuguguuuuaaugucuguuuccaacauugcuuuauuauuacaaguaggggauuuuuuuuuuuugccacuuuaaugaagauacaaaaaauaaugcgcugaaaggaguggcggaauuggaaaauuuguaaccaucaugauauggaauuaauagguuugggaaagaauccucaaaaauauuaaagugaaggaggaaaguuuguuaagaagcaagaugguuuuauggucucaguguuaauaaccucccgccugccauugguuguugguggucagaauuguucaguguaauaaacaauacacacauuuuucccuuaaaaaaguugugcagauuauuuuguguuuuguuuaguauugugaugaugaugcauucuuuuguaaugauaugaaaagagaauaaaaguccuaucaagaugcaaauucaaagaacagguuauuucauacagaagguguuucuuuauaguuagacuucaacuacuuuccccgauaacuugauuuaauaugaaagcugguucugugaggcacuccucacgugaaucaguguuagaccuucauagucauaaacucagaacaugugguccuaacacauuaccuacuaauaaauaggagaucagcuguggacucuagauuuccucaucagcucacauauuuuuaaaugguuuauuuucauccucuuuccuuugaagauaggacucuaaaaggucugucaggugauccacuucuguuuccuauuuaacaguaccuccauucaucgacagcugcuaaagucaucuauauuaaaagaucuuuaaagucucucagcauucaagaaauaacuuaggcaucuuuuuagaaguauuauacauucuuaaucaauaaagccugugugucuugaacauuuccuaguuagcaguaaaacacuuaguuucucuuuauaagauuuuucuuuuaauaaaauuacuugcauuuugacuuaugcccuuaaguuucuauuuguugucuaaauggcaccauuuaaaguguuuuaagaaauuuaauauuucuuuauuggauuaggagaacauaucuuuaaggaaaaauuacccucuuagcaggugauuuacaguauuauuuucuccuggccaaccuuuuuaaaaauccaaaauaugugccaccuagcuuuuuaaaaguuucauuagaauuaguuauguauuaugacguauuugugaaguauguaaagugcuucagacagcacguggcacauugugaucacuaaggguuugccauuauuauucuuaccuugauuuuaaagacgugaaauauggauaugugacuuuuuugguuuuuacauuggaauuucauauuaagucgguggcccuuucaguaaaauaagagcuuacuguaaaguucucugcaaaagauuuuccauuuucauauuuaauuugcaugcauaccauaauuuuuauuucucuccucuuggagucucucuguaaauuucuuuuuaaugugucauacuuaaggaccucuucauuuucuuaaaauucugcauccuucuguuaaccaaacacauuuagaaagucauucaaauuuuaugcuuguaagugguacugaauuggaaaaccaaaggauuguuuaccccaggagcaaguuggagugugugccugcuuaauaaugaaaaacauugugaucaguuugcuuuuaacuaguucucccuuuuuuuucccuauuuccuuaccccuaagaaugaauauaaguguuagacaacguugagaucaguuuccauuagaguuuuaaaagaaauuuuucuauuauaaaggaauuggauauuuauuacauuuuuaaauguaagaaaauugaaagaagaaaggcacuaacagacacgaaaagaccauuaguauuuugugacagauuguuccaauuuuuuuccuccuacuuuauucaauuuuacuuauuuguuuauuuaugagcuagagccuugcuccaucacuguuaccucgaacuccuggccucaauccauccuccugccucagacucccaaugugcugggauuauaggcaucaguuucuccaaugcauuuuaauacugauguagguagagauuauaaauuaacuucuagauuuaaaagcuaugguauugaucuuuauaacugcuuuagcauguuuuuuguagggaucuaauccgucaguaaauaaucacagagaaccuccuaugugccagaugcuguucuaggggcuuugauucauuaggacacccuacugucaccccauccuuaccuuuaugcuuucugcucauuuuucaguacacucuugacaucaggagcuuccaguaaguuagccuggcagauaggaugcaguuugugugagagagcaagcugucaaaagugacuccagggucugcuuuggccuauacaacugggccuauauagucaucuuuaagauggagaaacuguagguagagcagguuugggaggaagauuagaaguugaguuuggacauguuuaguuuaacauaucuauuagacaaccuaauggaaacgcugaguagacagggaaaaacacugauguuccaaucagaugugacaacaggucagccagaauuuugcacaauuaucaggauuauuuaaauguuguauauguuauauauaugugugugcguguuaaauguuaguguacaacaggaguaggauauauauaaaauauauuucaugugugucuguucauaucugcaucuauauauuucuguguauucuaccucuguuguaggcagugugcuuuauccuaacuugugccuugagauauuagcuaacaaugauaauaucuauauaagugauccuuaaguaaauagacaaauggugggguggggggaguggguaggcauuuuuuuuuugucagaauacacgaaguuuguaaacugcugaaacauccacacaaacuuuugcccauucaaaaaguuaaaugaaugccaugaaugauucugucuauaaauuuuuuaaguaacacuuccucaaauaugaaacuuucuuauaagaaaauucuuuugauacuggaagaaccacacucauuugcaaggaaucagauccaagauaaacuaccagccuauagcuguuuguccuucaagaacagaauccaugggaaaaucuugguuacuccuuuucuuggguagugauuugugagaguuuguauaucucagucauuuuuuaaaaccuuagauuuauuauuaauauaauuuagauauuauuuacauauauggaaacuaucucuucuuuuaagagagccuuauuuaaagugcuuauuaauuauuguuuaguuuuuauaucuauauauaacucugguacuaugcuauaucuaaacuucuggguuuucuagggcaaaaguaauuguaugagaguaagaaaaguuuuuucuuucucccuuccucccuuccuuuucccguguuuccaccaaguuauuuuuucuuuuacuguauucaccaguacucuuaaggaauguugauugauacugcaaacaguagacaucccuagguaguuugaauuuguauuucauuuaacugcuguauuuuaguuugaguauugguuugugauauacuguuuucauaaagcauggcuuuuguuguuacuuaauacccuuuaaaaaaaucccauuuagucauuuuaaccuuuuaaaucucauuuccaugccuauccuuuuauuuccaagacuucuuuauuuuguuuuauguguguguguuuuuuaaacagaauauagauaggucuuuuaauggaauaauuuacuuucuucaugugucauauaguuuuuucuugcuuucuuugcugcauauuuuaacuugcaguuuguuauaucugguuuuugcugguuugaucaauuuauuuuggguuucuuuuuuaaaaaaugucuuguuacuuuggaaauucuacuguauauuuccauuccauuaauggugaucuuuucuuucccuguacucagaaauguuuauaugccauuauuuaaaaauaaaacaugugacuuuccccaccaacuugucuuugcuauaauaacuucugucuccugcuuacaucccuccucaguaaggugauaacuuuggaauauuuucacuuuccucuuguucagcuuuccccacacccagccaaaaaguuuuuuguuuuuuuuuguuuguuuguuuguuuuugagacagagucucgcuguguugcccaagcuggagugcaauggcacgaucuuggcucgcugcaucccccgccucccagguucaagcaauucuccugccucaggcucuugaguagcugggauuacaggugcgcgacaccaaaaauuagccuggcuaauuuuuguauuuuugguagagaugggguuucagcauguuggccaggcugaucucgaacuccugaccucaggugauccaccuaccucugccucccaaagugcugagauuacaggcgugagccaccacagccugccuccagccaagagguuuagcaugcaccuacuccuacuguguuuagcccuucuuccaaugcuuugauauuccuuugacaguuucauacuuucaauucaguccuuagcagauaauacuuugccguacaucuguuuuguuucaaguauucuuauuuagaauuuauuacauguugcuauaacaauuaauaguacucauuuagauugauuguauauaacuaccauauuucauaaaacuaaagcacuuuuuuuuugcauuuuagcaccucuggaauugagaugugccuuacaauugaugauuuucuagaauuagacuuagaaguguaauuuggcagcacuuggauuuucuuuuuuuauuuuuguugagaugaggucucacuguguuucccaggcuggucuugaacuccugaacucaagccauccgccugccuuggccuccuaaagugcuaggauuacaggcaugagccacugugcccagccagugcuugaacuuuaguaucuaucuaguggaauagauacagauacaugaaacuguguaucuauagagaaagcagguucaggcacagacaggguuuacuucuugcugcucuugucucuccuguccuuccccagaggucucuaauucauuugucccucaaucagagaucuuuuucagguguuuuucuauaugacauaugugggugguguauuuucugaguauccauacauacacuuuuuuuucaggacaagugacagauguuguguuugggguuugcuacuuuucucuuaguauuuugcuagagccauugcuauggcuuccauugucgcgggugagaagucugaugccucugauuuuuuuuuccugaaguacuauguucuaccuaccuguaagcuuguaaaaauauuuucuuacagagucaggaauuuaguaggaugugucaagaucuguguguagaauaacaugagcucuuuuaaucggcagaccaaggucuuucuuuggcccaagcaaauauucuucugcuuuauuacugccucuccuccgucuuuucaucuuucuucagcugguacugcuguucaucuuauuagaucuguccuccaagucucuuaucuuuucugucgucauuucuauuuuguugcuuugagcuguuuuuuccauuugaccuuccagaccacaaauuuggaucuucgucaugagccauucuuuccuucauuuaaucuacuauaugguuuauuuggaaaaucauguuuuuagaugugggaaagcuucucucugcuguaguuaaaucuccccagugucccuuaauuuuuccgacucauacuggccuuucucucuccaagcaccucuguuugauuugggguuuauucccuucaucuugaccccugucuuucuggaugcucagccucuuuauguguuguuguguuuucuuggucagcuuauuaggacccaggucugauuuuggccucuaaugauucaaggagauguagauguucugccuucccuguuccccacccaagggucaucagaucucugugggccaggcuuuucuuagaaccguuaguuuaugguccuuguucuaggguucaaagaggcuugucuccagauacuuguccagaaccuagaaaaacaaaaaacaaacaaaaaacacacacuccaguucccuccucuguauuacagagagugcaagucuucgcuuccauuuagcugucugcaggucccggggcuguguucuguugcagcagacagauugaaaaugguaauggagguaaagggaggugaguuugugugugacucuuucuggaaucuuuuugggccuagauuuuuuauguuuucauucccuuaacaguuguggaucuuuugucuagacuuaacaauaguagguaaaacagcauuuggcauggaaacuagaagaccuauaggagugauauauuauucucaaccuuuugcuucuuucucucugagaagauugaugauacuucccugucuguugcagugugauuugauuuguugugucucccugucccauagucagacuuaauuuugagacuuagccaauggaguaugaguggauguauaucaguucugaacagaagcuuuguuuguuucuuuguuuuguuuuguuuugagacagagucuugcucugucgcccaggcuggagugcaguggcaugaucucggcucagugcagccuccaucuccuggguuccagugacucuugugccucagccucccgaguagcugggauuacagaugugugccaccaugccuggcuaauuuuuuguauucuuaguagagacaagauuuugcuauguuggccaggcuggucucgaacuuuuggccuuaacugauccaccggccucagccucccaaagugcuaggauuauaggugugaauuacugcgccgggcccugaguggaagcuuuaggagguguagcagguuucugucaucccucuugcuucugccuuuugacuugagaauagcaugucccaaauaugaucuguucuucuggauuggauucuggguaagaagacccucagggcaaaagccacagcuuugagggcagccauagcuaacccagagcuaacauguaaugugacugggaaauacacgugugauguaugccaccgagauuugaggguuguguuguuacugcagcaaagcuaacugauaaaaucugguuuaauuucuuguuucuccuuuuauuagcugauacuuauuuuuccuaccaacuuuaaaaaucuguaucagauccuacauucuauuuucuaucucuccugauuuaucucuuaauuggcugauauaaaugaacuguuguaauuggggucaaacacugauuacuugugguagaguguuuacaaguuauauaauagguuccaaccuguguaacaacuggggaaaaaaacaguaaauugggggcagugucuuguggcuguuaauugcccauuuauuaaaugcccuaaauucugcuccaaauuaugguugugaagcauggcuuuucuuuaaauguauaaagcagauuauuuguagaucucaacaucuggaugguggugcuguuuucuauuaucauaaauaagaauuaauugggaaagcauuuauggagugacuuuacagaguugggaauuccugggauguguaucugugcauauuuaucuggccuguuggauuaacugacgaauaaauguaaagaaugggauuuauuuuuguguuuuauccuuuuuguauauaauugauauucacuuuucuuuggucuuaguauucugcucucaacacacuguucuaacaaauauuguaaaucagcaguagaugaguagaaacaguaauauuauuccuuggaccaugagccacaagacccggguucuccccuaacucuuuuagccuuauccccucccuuuucuucaucccuuucuuugccuuuccuccauucacugauguaagaaauacguaucgaguguccuguuaggugagaugcuggaugugaugagaaguaagccagacaccuccccugccugccuuaucaagcuuacugucuucucuucuauuccucagccccuucugucuuccgaccauacagcaguauaaauugguccaugcugcauuacuacuaagccuccugguugccaucuuuuguuaacagggcugcuuucaaaggugcuuuuaauacuggauuguuaugggaaaguugguggugguggggagggaaggagggaggaaggaaggagaguagaugaguaggcaggugagaaaggaggaagcuauggagcuguucacagggccuuaaccacccaacaagcugcuuuuuauuaauguuuuucaugauucuuuucuaauuguaauuuugcguaaaugcacagaggauguaucuauacaaaugauuugaauauuagaugagaaccuuucuuguuccuggcuagguuuuaaaauguuauuuuuuagaauuugggaaaccaucaauuaaaacaucuuugguaccagaaaaauugcucagaaauagggaaagccuggauaaauaagcauaugccuuuguuaacaaggacauuugauagaauaauaaguaaaauaaaaucuaccuuuuauuguuguguuucuugacgcauuggucauucauuuuuccucuccccucuuuguuaucucaguaaagagaugcuaaaaugugcugcugaaagggaaggaaaguugggggugggaaagacaauggaacuguacacagugaugucauucucagcugcaagaaaaaaaucuuaaggcaaccggauuauauuugauaaaagauuaaaguugcaugcaaauucuaacuaaaaacaucuguuuccugacccugugcgaguucuaacguuuugauaggaauucugguuuuggaauuucugagucuuaaguuuaccuuccucaacuacugccuggcuauuuucuuaaaggacugaagucaguacugcuuaacauacuggaaaugacugugaauaaccaaaaaugaacuuccuggauugcuucuuacauacaagaaguuuucagguuucaugaacaagaaucauccugauugccgagugacaacuuuaaaaauuguggugugauacagaguucauuccaggaagccaaugaaaauaaguggaacauauguauauguguguguguguagaauuaguaauagauuuuuaagaacuuuucaaguguuccugcuuuuauuaagaaccucaacuagcaaaaauuguuccuuuuuaaaacuuuauuuuuaggugagguacaacuuguaucuacugugacaucguauuuuauauuuugcuaaaucagacauguguuggaaaaucuugauaccauaauugcacuguaucaguaaugcuuacagacuccuggaaauaggaugaaaucuaaaagcaaauauugaacauuagcuaggggaucaguuuaaauugaauuuugcauuacagucacucacuucaacugugaaagccaguguaauuuugugauuuuucauuuugauugauuuguuaaacuugauacccaacagcagcagauuucuuuguguucugauauacccagauguucacacugggcauuuucuaaggaugacuguacugugaaaauguuaacgcuuggucuuagccuaccauguuagugugagguauguugaggaauauuuacagacuguaugauacagcuagaauguccuacacauuagaaaugauugauuaaacaaaaguuguguuuuaugaggaagaaaaauagaaauaagccaucaaugagggacaguuaaauauuaugaaauucucugcauuagaaagaaugauagaucuauuaauauauuaaucaacauggaaauaucuaagauauuguuuagggggaaaaaaucaaauuuuggaacacaugcuaauguuuaaaacaaacccccagaaauuaaaaccuaaaacuaaauguguugagauaaaucagaagauuuauuccaaauuguuaaugacaguuaacuuugguugaacuucuguauauuaauuuuaauaaugcaaauguagucaugcuuuacacauacacuuauuuuuuauuauggaaaauuucagauguacagaaaguaaacagaguuuauaauauaaugaaccaugcaguacccaucaccaaccugcaaaagcuaucaauauucugccauuuuuauuucauuuaugucuaugcucauucuucaccuugacuacuauuauauuuuuuacaguacauuuuuagguaaaauucauauauauugaaaugcacaaauuauauauguacacuuuugacaaauguauagucguguaauccccauauccuuaugauauugaauauuucccuauucccagaaaguucucucaucuucagucccauucugccugcccagguuauuuuugccuuuucuggaauuuuauaugaauagaaucauauagucugcacucuuuuuguuucuucuuuugcucaguauaaccuguguaaggguuguccauguuacagcaauguaucaauaauuuuuuucauuguauuacuaauauuccuuuauaugaauacaccacaauuuguuuagcccuucucuuauugauggacguuagcuguugugauuaaagcuguugugacauuaauguauaaaucuuuuuguggacauauauugucauugcucuuggauaaauaccuaggaguaaaauuucucuuucaaaaaaccaccuuucaaaguuguacguucccacuagcaaaguaugaaaguugugguugcuccauauccuuucaguuguuugguuuucucagucuuuugauuucugccauuuuaguggauaacagcaccucauugcggcuucuaaaaaaaaauuuuuauaucgugguaaaauugccacuaccauaaucauaauauuugccauuuuaaacauuuaaaguguaagauucaguaucauuaauuacauucacaguguuguguaacagucauuacuaucuauuccuaaaaccuuuuuaucacuucagacagaaagguuguaucauuaaguacagagcuuccugcuuuccccuuccccuagccaaacuacagcuucuaacgcaguucccacacaaacuacaacuucuaauguagcuucuaucucuaugaauuugccuguucuagauauuucauaugauuauaaucauacauuaguuguucuuuuaugucuggcuuauuuuaccuggcaugguguuuucagaguuuauccauaguguggcauguaucggaacuuuauuccuuuuuauggcugaauaauacuccaucccguuguauguauauaccauauuuuauuuauucauuuauguguuaauguacuuagaauguucagcuguugugacuuaugcugcaggcugggaugcaagugucuguuugagucuguuuucaguuauuuuggcuguauacccgggagcaaaauugcuggaucauaaggucauucuguguuuaacuuuuuaaggaaccaucaaauuguuuuaucaguggauuuuauucagcauuucccugaugacuaaugauguugaaucaggugcuuauguuacugaucuuccuuugugaagugcuucuucaagucuugugcacauuuuaaaaaucaagcuuucuuuuuauuguugagguuugaaaguucuuuuuauauuuuaaacgcaaguccuuuguuaaauacacauuuugcaaauauuccacucuguggcuugccuuuuuauuagguuuauaccuagaaauggaauugcuggauuuuaugguaauucuaccacuuaauuuuuuugaagaagagccauacuguuuucaagugacugcagccuugcauaucccuuguucaccaacagugaacaaggguuucauuuuuuucauauccuugccagcacuuguuauuuucuguuuuuguugcuaguagcccuccuaaagggugggaguuuguaucucaucaugguuuuuauuugcauuucccuaaugauagugaugauaaacaucuuuuuauaugcuuguugucuauuugugcaucuucucuagaaugaugucuauuuaaauucuuugcuuuuuuaaaaucugguuguuuuguugaaugcuuuauauauucuggauauuaaccccuuaucagauacaugauuugcaaauauuuucucuuauuccauagguugucuuuuuaugcuguuaauugcauucauugaugcacauauguuuuuaauuuugauguagucccauuuauuucuuuuugcuuuuguugccuugcuuuuugugucauauccaagaaaucauugccaaaucuaauguuaugaagauuuucccuguguuuucuucuagggguuuugugguuuuaggucuuauguuuaguucuuucauccacuuuaauuuuuauauaggguuaugagguaaggguccaggcucauucuuuuccaucuggacauccauuuuucccaauaucguuuguugaaaagauuguccuuucgcuguugaauggucuggcacccuuuucgaagauuguuuaaccauauaugugaagucuuauuucugggcuguuuuauuucacuggucuauaugucugucuugaugccacuacaacacaguuuuguucauuguagcuacuuuugaaaucagaaaguaugagaccuccagcuuucauugggguaccuugagguccauaugaauuuuggugguggauuuuggauuuuucuauuugugcagaauauuccacugggauuuuucuuaacaguaccuuucgaugagcagaaguuuuaaaauuugauguaaauuaauuuuucuaaaguuuuuuuucuuuugugguuauugcgucuuguggucccagaaauuuccuccuauccacggaccacccguucucacacguuuucuuuuaaaagcuuuauggauugagcuuuuaucuuuaggucugugauccagcucucauuaauuuuuguguaggguuuugagguuggggucaaggcuuauuuuuaugcuguggauauucaguuguuucagugccauuuauugaaaauauuguuuaugaacacucuccucuguuucauuguuuauccuuacgccuuguuacucugaucacuguuuugauuauaguaguuuuagaguaaaucuugaaaucaaauauugucaauacuccaccuuuauuacaucuuucaagauuguuuugguuauuccacguccuugucauuuuuauguaacuuuuugacucagguuuugauaauauuguaaauauaauuuuuuguaaaaaaaaagucguuuuucauuuauuugcugcuacuauuuagaaauucuguuggagagagagagaauguguguguguguguugauuccuuaagauucucagcaaaaacaaucaugucauuuguaaauggggacaguuuuacuucuuuucagucuuugcuuuuuauuucuuuuauauuuuuauuuguuuuucuugccugauugcauugacuaggaccuucaacacaauguugaauagaaguggugaaaauaaacauccuuaccuuauucaugaucuuaaggggaaagcauucagucugucaccauuaagaaugauauuagccauacauuguuggagguauauuuuaucagauugaggaaguuccuucccauucuuauuuugaugagcauuuuuaucauaagucagugucaaauauuuaaauacuucuuaaaaacagugaaacuuguuuccagggcuuuagaaguauagugaauuacagacuaauuugacauugccauuaucuucauuacaaaauaguguuauuuaauuggcacucuaacauguaaagugauacauuaggagccacuuccaucuacacaaaauuacugugaugauucuguagaauguggaaaaagaaaaucuaaucauuaccuucagugauagcauuuaugacuaauguacugaguuguguuuggagauacuccuaaugccccuggccuugaaaucugaaagauuuacuuaacagucaaacuguucacacucaucugcuuuucucuguuagauucuuuuacucauguguuuauuuuauguuuucuuuggaaagaugcuuuaggaauguuaauauguuuuuauuaaccuaaggaguaauucacuuucaauuuuccuccuuuuagguuaauuucuuuuauuggguauaugcucuuuucuuuauguacgguguaaauaaaugaacuguaguuguuaaauuaaaaaaaucagaauguauuuacuauuggaauucuuuccugcuauguuuaauacuagcagacuagcuuugaaugguucuuacuuuuguuguuguuuuuuuaagaauaauuaucacuaugggacaaggaauuuuuaggucuucaacuucauuuguccuugguuaccccugggguugaauuggaaaagguucagaguauuuaaaagaaugguuuuguugucggugggacaguagaauggaaaacucuaaaccacuagaauuuggaaaucaucaugcaagaaaaaggagacccuucugugaaucaccuguagaucucuugaaaauugcaaugggccaguccuuggauccacucugcuauacauggcaggccuaccaauuccaugcuguucuucaacuagaggucuugcacacgguuucuguguuuuuuaaacguauugcuagagaguucuggguuauuucugccaaugacgaaagcuuuuacagcuuuuuagauggccuuucuugguccuuaggcuuccuagaucacccgugguggcauuauguucauugcagcuuacagucaagucuuacuuauuuuuaaaaaauauauugguauuguaauguaauuuuuuaauugaaaauagaauguuagggcuaaaugauaccuuagaaauaauaucuucauaucucuucaguuguauucuaaaucacuuugcuguuuauugaaggaccauuagguuacauuuauuuuaagauuacagggauagaagcauugauuggcuucaaagauaauucuaguccuacacuuugugauaggugaagugugcucauaauguaauuuuguucuuuauuucauuagugaugccuaacaugcccuuccuguuuaccacacccagauuucauuuuaucccuauuucaccucgaauccucacaugcacucuuguauagaauuauugcucuguuuauuacuaaguggaauccauguugaauuuuggcaggcuuuuucccccuccaucugugucuuugaugguagcuggguuuacugccgcucacuuauuagugcccugggucuuaacaaccuuauucaaacaaaacaucuuaaauggaggcauuaaacaggucacaacagugagccauuuuguaacuuuaggugcaauaaaauggguauguuguguuuuggaauauaagagcucugagugcagcuauucauuuucuucaucuauaaaacauuuuagaauaacagccuacaucuguuuggggguauaaaauuccacguuuugaagaaacaaucacuguuauguaacuucaagccagacgcggggagggagcuagcuuucugacgggcccacguucuguagacguugggaaaaguguuuguuuuagcuauggagcuguauuugcuggcagcccaucuuucacauguguggaacacauuuucauuauuguuuguucauauuguaaaugacaacaugugugugauacaauuuugacuugaagaauauuugaaaaauuuucacacaggaauuuaugagggcuauuucacuacuagaagucagaagcaaauuuaauuauuuaggcauuuauagcauauuuaauuacuuuagacugucagucuuguuuuagagaguaaagcugggguuuacugucgcucccuuuuuaaacuaaauacccaguggaauaguauggccauuccaaaugugugauuuuaaaauuauuucuuuaaacugaaggagcagcucaaugaauaacuuucauuagaggaaaugggcaaaauguuuaaugauagaauucaaaaucuaaaguauuaaguaccaaguaagagcagauaacauucagugcaauuuguaggugauuuuaauugagaaaugaaugaugccaaugggauuguuagaguaaauuuuaaaucuuuuuucaucuuaugaaauauuuaccuucuuacuaauccauaaucauacugucagucuuuuggggcauauuuuauuacauauuauaaaguuuaaaacauuuagaaaagcuuuuagaaaccuauuacacagucaaguuauuguuuugauaauuaauuggaaauauaaugcuugaguuucagaauggauaaugucagaugcuuuuauguuuuugugacaauaaaaaacucuauuuaacuacuguuauggaacuucgacauucgggggggcuggcugccuguuuaugaugauaacaaacuucucugagauucuagcuugucaaauuaguccaggcuauugacauugaucuuuucuucucauugacauuuccuuccugaaugguagacagauuuucuuucuguggucacugucugucaaacuuggggccaucauuugcuguagcugaguaagacagaugaugcuaaucuuuaaauuucugauuaaauauaaauauuuaggaaauaacaauaccaggccaaggugggcggaucaccugaggucaggaguucgagaccagccuggcuaacauggugaaaccccgucucuacuaaaaauacaaaaauuagccaggcgugguggcacauaccuguaaucccaacuacucgggaggcugagacaggagaauugcuugagcccaggagauggagguugcagugagcugagaucgugccacugcacucccgccugaccgacaaagcaagacucugucucaaaaaaaaaaaagacauaacaaugcccucaauucacgugaagguaaauacccauuaauuccucugaaacugggacauuuacacccacccacauguagugauaaugauaauguucaaaguccacauuuacuuuucccuugcagcugggcugccugugcagugccaguacugggcccguggcgugugcguguucgugggcaucgccaccaccagcacugguccccugggcugugacuggacauuacuucagcugcugggugggguccacugguguuaagacauuuuuaucuuaggaaauaugacaugggugucuuaaguuugaauuucagaaaauuaauaacagauuguacugugggugaauuuauaugcagauaauuuagaugucuccuggggauaguaguaguuagacaagacucuagagucagauugucugggcuucuuaccuccuaacugccuuuaggcguuacacagcgucuuugaaccucagucucaucaacuauaaaaugaaggaaguaauacucccuaacugucucagcauguguugugaggauucagugaaauaaagcuuacaaagugcauauuugcagaguaccuggcacaugagaaguguugauaguucuagcccuuacuguuagacagcucaucguaaauaccuaacucuaaguguggugauucucuugaccacucauacuucauuacuacgcaugacucuccucccuagcugugccugggacgugaucagugcucagacccacgucccccuguguuuuguuagacccucuccacuccccuagcauugacugauuuggugauucuuccuugaagggugcgagcuucccacuggcugcucuguuccuggagaccuguuucucaaguuugacucuugcaaguagcucugucugcuuccucuuucuuccuugccucuuuuuucccuccaccugcccuugcccucucuccagucuccucccuccucuuuucucccucuccuuuccuucucugccccgucuucugucuucuguccuccuccucucugccccccuacccucuaccucccugcuuucuuuccccuccuuccugcuuccuuuuuuacccaucucuuuuccucucuccacuuucuuuccuuuucuuccacuccuuucucucuccccuucucuuccugcucccucucucugcucuguugucuccccauuccccuaacacuucucucccaccaccccuuaccuuccuucucucuccucuguguuucuccuuuaaauccuaacacugccugcuaaggaguagacagccuuggcucuuaagcacagaaaugucacguccuaaaguguuuuuauuaugcugggaaauauuuauuuugucauuucaguagccagacuauugugcuucuguuuccauuucaaaggggauucacaacaucauuuuaugucccuugggcucaaaaacucagaagaucaccaggcucaguggcucacgccuguaaucccagcacuuuuggaggccaagucagguggauugcuugagcccucaaguuugagaccaaccugggcaacauggugaaaccccaucucuaaagaaaauauacaaaaauuagcugggugugguggcgugugccuguagucccagcuacucugauggcugaggugggaaaaucucgugagccugggaggucgaggguggugaucugucagccugagugacagagcgagacuuccucccaacaaaaaaugaaaaucuacaggccacaguuuaacucuuuuucuaaacauuaugucuacuauaacugugaauuuguuugauauuagcuuuguuauaaaguugaaauaauauuuacaggcucguauagucauacaggcaaacuuggcucuuuuuugccuaauuuauuuaauuuuuuuuuucucucuucagauuccuuuuucuuugguccaguuucccuuaugggaguccuuaaaaguaaguuucucagucuucacauaaaauuugucucuaauuauaacauaccuaauaguuugaguguggaagaguagaacauaauguugacuagaaguucagcaacucaaaccuauuagcaguugaaaauauauuuuaugugugauuuacaugccauuucagccuuuuaaacuuguucagguggcugugcuccuaggaaauaggcauagcagguggcacugaaauccacagauaauaagaaaaaacuuagguuuacuuuuuuccauauugccauucuuucuccaccguuaaauuucauuuugcugugugcguguguguguguguguguguguguguguguguguguguguguguguuuagaaguuaaagacuaacagugaggguaaauggaagaggaaaaaugcaaagccuugaauacuugaagacugagaaggaccagcuccccuagcacccuguguaaggaccacuuggauggggagcagcagggucuuagggcucugacugucccuuccgucuugguugcucacuccagccaggacuaggagccuccagagggaaggagcagaguguggugaguugucagacaaccuuggggaaggucagugagcuauuuaaaaaaaaaacaacauguuuuaaccauuaaggacauggacaugggcaaauauuucaugacgaaaacaucaaaagcaauugcaacaaaagccaaaauugacaaaugggaucuaauuaaacuaaagagcuucugcacagcaaaagaaacuaucaucagagcguucagacuaccuacagaacgggaggaaauuuuugcaaccuauucaucugacaaaggucuaauauccagaguccacaaggaacugaaaugaauuuacaagaaaaaaacaaagaaucccauuaaaaagugagcgaaggacaugaacagacacuucucaagagaagacuuucaugcaggcaacaaacauaugagaaaaagcucaacaucacugauuauuagagaaaugcaaaucaaaaccacaaugagauaccgucucacaccagucacaauggcgauuauuaaaaagucaagaaacaacagaugcuggugaggcuuuggagaaaaaggaacgcuuuuacacuguuggugggaauguaaauuaguucaaccauuguggaagacaguguggcgauuucucaaagacguagaaccagaaauaccauuugacccagcaaucccauuacuggguauauacccaaaggaauauaaaucauucuguuauaaagauacauacauacauauauucauugcagcacuauuuauaauagcaaagacauggaaucaacccaaaugcccaucaaugauagacugcauaaagaaaaugugguacauacacaccacggaauacuaugcagccauaaaaaggaaaugagauuauguucuuuguagggacauggauggagcuggaagccauuauccucagcaaacuaaugcaggaacagaaaagcaaacacugcauguucucacuuauaagugggagcugagcaaggagaauacauggacacagaagaacaacacacaaugacuggggccuguuguggggugcagggggaaggagagcaucaggaaaaauagcuaacacaugcugggcuuaauacuuagcugauggguugauacaugcaacaaaccaccaugggucacauuuaccuguguaacaaacuugcacauccugcacacauacccuggaacuucaacaacaacaacaacaacagcaaaagacauuuuaaaaagccuacauucaaaacaugcagagauguuacauugguuuuucacuuucuggugcagugauacugaaaacugugggccaugauauaaauugugugggucuuugucagcauuuuaaagaccauaaucaagaagaauauaguagagggcaucuuacgugguaagaguaagucuuauuuuguaagaccucaaugaauguuaugcaugcgugcacacacauauguaucuagguugcaauguaaaauguauuucucgcuguggauaaugguccaaaaacuuugaaagcccuuguucuagugaaaaugguucauaaaugaccaggcuauaaaauaaucuagguaggcauuagcuaauacaaaaauaaaggaguuacucucauaauuuuauagauugacuagucauggagugcucauacaaaaugcauuuugaagaguaucauaaaaauuauuuguacuuggaaauaaauuguugagguauauacuaaaggauacuaaauugagaaaaaacauuacucauuaacaaaguaaauuaugagauguuaaguaucaagaaguauuucuuauaagugaucugauuuuaaggcguaguauugcucauuuaauauaguuuuuuggcucuuuuguugucuuguuuguuuguuuuacuguuuccuauguggugcguggugaaaauagaguucucuggcaguguuucagggcaugauguaacagcuauccaaugagaaggucacguuccauuaguauaacagcucuccuuuuuagugugugacaaaagaacaaugaagccaacagcuguccagcaaacaagacuuacuuuauuagugucucaauaaccagcauucacacaguuucugcacacucuaacauccuuaugcccuaauucugcaaaggaauguuuugaggccuaaagaaggaaaaagcauaguguuuauuucuuuucaauauuaaggacauuuguagaauucuagcuaguuaagaaauguccagaauuuuucagaguaaucauagaugacaaugcuaagauuuaaaaauucucuuugagcaaauguuaagaugcugccauuuuuuuuucugucaagucguuucuugaggaacgcuuuacauaugauaaaacucacccuuuauaccuguacauuuuugugaguuucaauaaauguuuauaaccaccaccaaauuuccaucaacccagaaaguucccucaugccgucagugcccuuucuguacccacagccccugugagccacuguucuguagucuucucuuuuccagaacaucauagaaauagauacaggguacuauuauaccaucuugugcuuugcuuuuuuuuuuacuuaauguaauauuuuugagaugcuuuccuguuguugcuuguaccaguaguuuguuuuauuacuuuguaguauuccauauguguauggauaugcuacaauuuauucacuaguuuauauacauugaguuguuuuccaguuuuugaugauuauaaauaaagcugucguaaguauuugcauauaguauugguauggauguagguuuuuacuucucuagggucagaggccaggaguagcaucccugggucauacagaagguguauguuuaauuuuauaagaaacaaacugucaagguguuuuccaaaguggcuguaccaguuugcauucccaccaacaguguaugagaguucuaguugcucuacauccaugucauuucuuguuacuauuagguuaaauuuuuuuuccagccauucuaguacuugugaauuggugucucauugggguuuuaauuucuaguucccucaugacuaaauaauguugagcaucuuuucauauaauacuguuuuuuaaacaucugaacguacaaucacagugcuuuuguagaaguagacaguuuuuggaacuuuuuuauuuuuguguuuacaauuuuaucuauuuaaacuugaguuugcagcuauagaaggagauuguauuauaugaaaggauuucuccacuguguuuauuuguguuuaugugggaauaccauucaggaaaauuuuucuuagccaagacuagcagauugcaucacauggcacugcagggaguaaggggcuggagguggugguggccacuguuaccuuaaauucaacucugucuaaaagucaucaucuuucuuguaaaaucaugucuuccugcugucucccauuucuguuaaucaguauucuccuggccaccuggucucaagucucagauuaaaauuugauucccuucuugcucuuucucuauaucacauuacucaacaaauuuuguugacuucacuguugggaauuuguggccacauuucaccugauucuuaguaccuuauguuuucccacauccuaauaggcucucuucuuauccauucuacauuuuggaugugucugaucuuccuuaaacuuuucuuucaguaacacuuagguucucaggaacauauaacuuucuaaaacucuaaaacauuaaguucuuggcauucaaguuucucaacacccuguccuugacugguuuuuucagcuucugcccuauacucugugugugugugugugugugugagcgcgcgcgugcgcgcacacccacacgcacacacaaaauucuuccccuccagccagaauagccuccuuacugccucuaaauauguucuccccuucucuguucucugacuccuuucugaaguaugcuuccaaggauccaaaagugaugcaucacucaaaucucaauucaguguuugaucuccugcuugaagucuucuaaugaaggccuugaagaauugcccuuaccacagauuugucugugucacugacucguauuuaaucacccaccauauuguguuuaaaacaucuuauaguguucagauaaggccuuaaccccuucaauuuacaaguaaaugauaccugcugucauugcagcucuggugccugucuacucugagcuggauaugguugcaugucacaagaaugcaaagaugaauaagaaauggcuuaaugcccuugaggagcugagaguccgucagaguggcacccaacucguugauaacuuaaauguaaugugucucuuauugcagaauacuugcuccccaaauccuguuacugugcuacaucauuuccuuuguuuuucuuuucuuuauuauacauaugcuuacaaaaguauguuuuagaugaaagaggacaagacaccauaaagagauggggaagcaaaagcgguagauuaucauauccaaagucuuagagaagauaauuuuccuugaagauuuauauuuacuuuggaacuuucuggcagcccaacaagaagagaagcaugauagauuucaugguuuuuauuaucugacaaagaccuguagcuugcuauucuaucuuauccuuugacuuuggauaccaucuuuauaccaacuugcauguuuauagcuccauggcaagccccuuccucugaguggcagccucagaucaccagcugccuaguugacauccucacucaggaugucucugaguggcuaggucagaacagaacugucaguuuuuauuugucuucuucccaaucuguuccuuccuaguugguccacuucucaguaaauagcaaaguugucuuaugcuugcucaaauagaaacuuaagaaugauuccagaguuguauucuuuuauccuucaucaucuagcccaucaacaaguucacuguucuaguucaagccucuaacaccccuuguuugaauugcuacacuggccucuccaguggucucccucauuucacucaggcuuucccaaaauaucuucuucacacagcagccagagugaucuuuuaaagaaaugaauuaggucaggcacaguggcucaugccuguaaucccagcacuuugagaggcauaggcuggaagaucaccugagcucaggaguuugagaccagccugggcaacauagacuccaucucuacaaaaauuaaaaaaaaaaauuaucugggauugguggugcauaccuguagucccaacuaugugggaggcugaggugggagacuuacuugagcucacaaccugggcgacagagugagacccugucucuuaaaaaaauaagaaaaagaaauuagaccauacuauuccuugcuaaaaccugucaguggcaucucguuaaaagaaaaauaaacccagagcuuaagcucuggcuggcaaggcacucuguaaucuggccucugucugccucagccuuaucccgugccacucacccgcugugcccggccacguugcgcugacugugcugcugccuagcgccuccccucguuuuuuguuuuuuguuuuuuguuuuuuuuuuugagauguaccaaggccuuuacauuuguagaucucccugcuagaaauauucuuucuuccuucauucuauauacaucauuuuuuaugugugauaauuuuuuuaauuuugauuuuuuucauauuuuugaaaauugacaaauaauaucuguauauuuaaggugugcagcaugauguuuugaaauauauaaauaguguauaugucauuaccgagugucuauuacgugccaggcauuuuccagggucuggggauacagugaugaagaggacugacacaacugaccccauggagcauucauuccagcucuuucccuaggccucucuccaucccccuuccccauaccucucucaugucuccucuuuccccauuacucaggccuuagaucacaugucaccucagagagacguucccggucuaccccucuccaaaguaggacuuuccccuccucccuccucuguaaucauaacaccuauuuauuuccguacugguauuuuaauaaauuaguuuauuuaguuaugcacuuacaucauuggaauaauuauuuacgacaucaguggugugaugagcagacacugugugccaggcucuggguuaagcacgaugcauuuguuacugucuucuucacaccacagacaacccagagaggugggccuuguuguuauccccaccuuaaaaccagggaagcagggcucaauaagguugucuuucaccuaguugccugagcaccuuuuacugugugcugcguagcagacaggugacucagguuaccaggugauuuuuuagugaugauaacaaccauaauaaaagcaagaacagccaacauuuuucaaagcuacagugugccaggcacuguaguaacacuucccacacaucuccuguucaucuucaugacaguccugugaaguaggugcuggccuggucuuuguucuguagaugugaaaauggaaggagaguuugaacgccuugcccaaggccaugggaguacuaaggaguacagccaggauuugaacucagguucagaucuaacuccagacuugauauucuuaaucacguuacauguaauuaugcacaccgcacaugauguguuucauaacguuuuuguauugucguauacucaaaaguugauaaaaaguugaggucauauuuagucagcucauugaaggcauuucuguaaauugcauugauuccuuaaugaugacauguagcuuaggaaagccuggccagcauauuucuuagaccaccucuccccaguauccguugaaucugcugagcuugggcaaggauuaaacugugcucacuugagucaguucucagagaccaacccuggagagcacagauaaguucacaguuaaugaguucagccagaaccgaauuuuccacgugcuuguguuuaacuccccacaggacggugcuuacuggaggaagaaacuaugucuucuguuuauucuuuaugguucugucuuuuacacagcagguguuuauguaacuauuugcuaauuguuugaagguuagcauucuuuuucaaguugaaugcaaaguuggauaacuguaucuacguuaacuguuuuauuuguacauucuuuuaaagguauguucacagcuauaaagaguuuucccuuuuuaaccauacagaucuuuucuuaucaagcuuuaagucaaaaguaagcauauuaugaaaggauaugauaaaauuuccugugagaaugcauuuuuuuuuuuuucuauuuucuuagugugagacaucaguuuauauugcaguguggagaacuguuaagaauacugucagguccgagugguuuugcuuacagcuacaggguguuacaaagcaauagcuagaugagauguaaucuuuaagcuaagcaguauuuaaagcaaaaugaaaauaaaaucaguuugguuuuguaagacagcaacauuaugcuaauacuuuucuaagaugaaaucauagcuuugucauagaaaucagggaccaaugcauuaucacuucacuuauaucaauaguucaauguauauaauaauuacuuagaucucucuuuuauguuuuauaaguauuuuaaacgugcaguacuacauaaaagcuauguuuucaaguucaagaauaaauagcauuuuuucuuguugauucuuguuuuaauaguaguuaaaaugucuaccaccacccuacccacaacaaauuucucugauacuuuuaguaauauaaacaagaauuagaagaggcucagugcucagggucugcaguuauaccauuucaugagacugggagaaucuggugucggggaggaacccagugggaggggauugaauuaugggggcagaucuuuccagcacuguucucaugacagugaaugagucucacaagaucugauagcuuuaaaaaacaagaguuugccugcacaaggucucucucugccugccgccauccacauaaaaugugacuugcuccuccuugccuucugccauaauugugaggccuccccagccauaugaaacuguaaguccaauuaaaccucuuucuuuuguacauugcccagucuugaguaugucuucaucagcgaugugaaaauggacuaauacaacuaauaagaaccacagauagaaagcucauagaacccccagucagaauaaauauccccccacauaucuaaaaucuagcccagucaguuccaaaaauaucacuguauaaacucuaaaaccuaaauauuacuaagcaaacccagcauuuuaguccaucuugcuuuugcuuaagaauaaucaaugucuuugccuguaauuaccagcacaaucauuaguucaagauuuucuuauaaauucuuaauaucuuuaccgacuuaucuagaaugcaaauaucuaaauaucucaaccagccaacauauauuauugcccaaaacaagguacacaucaacgcauauaaaauugaugcugcuugcacaucccagaacaguuucagucuagcugccuuuauaacccaagucagccuguauaccauaagggauuccuaauuaucaguuagguauauccauuuuuaauuaugaaaaguagugcuauaugaaaaauucauuuuagccuuuuagccacuagcucguauugcaagagcuaugguguggcggaaugaaagccaaauugugguucccaguuauguuugauacuguuuucaguuucagaacuugcuaucagaaaucucuuuuguagacauaguaguaugugaguacuucacagagagaugguucaucugauugaaugauaaaauuauaggcagcuguugcuuuguuuuuaaaaauauaugugcaaaagcuacacaauagcuugaucaacuacaguauggaaaguaugugcacgaaaaucauugucuccugucuuuaaucuguuauaaacuucuggugguaaacucacagcagugagaccuacccagaggaugauaucaagagcaagccuagguuugaaaaaacuaagcauuauccuuuccauuaucuuaaauuuugucaugugauguuacuaauuuggaauugaguagaugauucugugcacauacuuauuuuacuacauguauaaaaagcauauaguaaaauaucaucaucuuguaggguuggaagccauauaacugcuuuugaauagagcagcuaaagaagucccaaguuguaaguauuuguucacuggagccaaaacaguuauuuucaguguguuauucauaagacaguagugcuuauuugggugggucuuuuaaaagugaaaaacaaagccuucucuucaggcuauacuuuaaauagaagacacuuggucugggguuggacucccagccacuucauaguauugugccugguguuggcuuucuggccuaugacuacuggugcuaauagcuauuaucuuggggugggggucggggagccaaacuacuucaugcuauucuuccucugauaggccuuuagcauuaagugaagaaucacuugggaaauuacaaccugauuguuuuuguagugguaucacugaguauccuaaagaauaauacaaauacuguuaauguaaaaagucaagcugauguuuaaaaauugcuuacuuuuaaacaauaguuauuauggugaaacucaacuagggucuguagcuuaguuaauaguguuguaccaaucucagucuugugcuuugaucauuauacuauggaagcugggugaaggauaugugggaacuuuauuauuauuauuuuuugagauagggucuugcucugucacccaggcuggauugcaguggugugaucgcugauaacugcagcuucaaccucccaggcucaagcaauccugcugccucagccucccuaguagcugggacucaggggugugccaacacgucuggcuaauuuuuaaauuuuuuuguagagacagggucucccuguguugcucaggcuggucucaaacuccugggcucaagugauccucccaccucagacuccagcaagugcuaggauuauaggcacgagccgcugcacucgguggaauguuccuauuuuuguaacucuucuguaaaucuaaaauuauuucaaaauaagugucauacaaccuaguagacaugguuucuaaucaaccuguauuaaggaagcuuuacuuaagaaaaauuaccgaagugaaacuaagaacauuuuugacuucuguucucauuacuuaaacuugauauuucucauuaauguaaccauagauucaugugaaaauuucauuuauacuguaauuccagcuacuugggaggcuggggugggaggaucacuugagaucaggaguuugagacuacccugggcaaacauagcaagaugcugccucaaaaaaauaaaauaaauuagccgggcaugauggcccuugcccauagucccaguuacucaggaggcugaggcgggaagaucgcuugagugcagaaguuggaggcugcagugggcugugaucacuucacugcacuccagccuggguaacagaacaagauccugucucuuaaguuacuuacauuugaacagaaaaaggaaaugggacauugaauugggauaaauaagcaaacaucagggaaaauguggccccuugcuuuuuaaauuccuuauuguuauuuugguauacagccuccuccgugaguugagacuccaauacugcuucuucacauucgggccccuuaaugccccucuccuccccuaaucauuuauccgccuugacagaaaugaucauuagaccucuguggcaaugaaauuacuuauuuagguugagaaauuauggaaauuuagaaaauuuucggcagauucuuaaaaaaaaaaaacuuuuguaaacccacauuauuuaaauucauuguauuaacuucaaaauauuuaauaacguguguauuaugauguaguucgacuagaaguugagcuguauaugauagugaggaaacagacugcuauuugcaggacgaaccagccucaguuuucccauuuacuaucuaugugaccucaggcaaaucuccuagaacuugccccucaccuguuuuuguggagaauaauauacuucucaacauugaaugagauuauacauguaaaaucuuuagcauagugccuagagcauuguagguagucaguaaaucccaacuaauauugucaauaguaauaauuuauauuguuaccuguacuauauccuacauuccagucuaaaauuaugugaaugucauaaucaauacauagucuuccugugaguaaugucuuccagcuagaguauuuuguuuauuacaauucuguugucccuccaaauagaugagcaaauauguaauuucaaaauauuuccauaauuuauguauuuuuuacgagucacuuucugauuauuguuguuuuaugaguuuaagguugcacucaaaugaauaauuuguaaauaacacucuuuuuagauuggucucaauauuacauuucugaaguucuguauucagacaauuccucauuuagaaaaaucauuucaaacucauuuaagcaaguuguugcagacauugacauaguuuguucauucacuuggauauuuuaagucauuccgguagaaauugugauuugcguguggaaguaaagugucucaugaaugcuuaucuguguguuaccaggacaacuauauccuauagauccaaacccauguguuuucaugcccacaccagagugucccauccagaucccagcuuuccuacucgcuguuuaaucugugaguuacuuaacaucuuugagccucaucuuuagacaauuuuuuucuuagagaugggaucucacuguguuaacuaggcuagucucaaacucuuggccucaagugauccucccauccgggccucccaaagugcuagaauuacaggcgugagccacaauguuuuugucuauaaaaugacaagauaauaaaaauuacauguaagucggaagauucuggagagaauuacaugagcugauguauguaaagugcuucacaccuggaaugugggaaguucuguauguucuauggaaguguguauugugguugcuguuacagucauucuuuacgucaugcuuuguguuugccacugaaguuucucacuuuaaacguuuugggucuucuagagauuuuuuguuuguuuuaagauauuuauuaguauccaugucaaauaccaaauuauuucuuuauguguuuuuuguaggcucauuauucuggccaggugauaguggaaaguuagacuuaucuguggagauucuguuuuuaaauguugucuucagccaucugagucuauuuggauuguguuuuuucgcccccuggcaaccaauuuuuuucucccuagauuauaacaggcaccucugugaagcuuucucugucaccucacuucucucuuguauaauccucuucugcccccaccauaccuucaucaaauauuagaccuagggacuguuacuuuuucuuuucuugacuacaauaccugacaccuaguaaguaguuguugaauuuaugacuugcauaacauuuuugauuucuuaucacauucacaucuuacuguuauuuacuuuugcuuauaaacucagcauuauuaccagcauuucaagucuauuuggaguagccuucuacucuuuggaacauuuaaagauauaaguagauuaacugaaagugaccuuuagucaucaacagaaaucuaguuuauauuuugcauugcuuuucuacuaaguuggugaaguaaauguugguguuaaaacuggcauuagccugauaaaauacacccuuugccaccuuaaaaguaaagaaaaagcgauuccauugucuuguuucuuauucuuucugcagugcuucuaggagcucuggaaaaaauaaugguuucuauuaaagcauacagauguauuugcaaacauuagagcauuuucugaaaauauaccagauacucuguuuaauggcaauauuaucuuuagaaaccagucucuaauaagucuuuucuuuuuuagcuuaucugcuuucacaaguaaggugauaaauaccuauuugauagcugcacucucagugcaguaaauugaauuaauacacuuucagagaaucauucacguuaguauggauagagggaaauguugguccucaaaccacacgcugucacauauuuaauuuguuagauaguuaacauaguagcugucugacuuaagagaaguugugaaaguugacagaguaaacagagucuuguaccuaaugaauuucuauggcaucuucuucauccccucagugacccucacaaccuuccagagauaguugucaguggagaagcauucagaguaggaaauuaaaaugaacuuugcuguucuucuuuuaguugcuguguauuugauuaucccuaaaaaugucagaccacucucagaaagucauuauacuuuucuaaccauuuaaauuaauauauuaaagaggucuuuuuuguuaauauuuguggucacuauugcaaugcauaccauuauucugaagguccuacucaauucaguaaggcaaaaaugaaaauaaacaauaaaaguuaccuuaauuggagaggaagaaguacaacugucuuuauucacagaugauacggucaucuaugucgaaaauuugaugagcuuuauaaaaaaaaagcuaugagguugguaacuuuagcaaggcugcagaauacaagaucaguguacaaaaaucaauuguguugauaaccaguuucaguuucugcauauuagcaaugaacaaccagagacugaaauuuaaaaaacagugcgauuugcaguagcaucaaaacaugugaacuacuuaaggauaaauuugacaaaaccagugcaagaccuguauacugaaaacuaagacaguguggagagaaacaaaagaaggccuuagucaaauggagagggaugccaugccugugagaagaaaaccccucaacauuaacaacugguucucuccaaaauaauccauggguuuggugccucccaaucacagucuuagcagguuauuucguaggaauugauaaucagauugcaaaauucauauggaaaugcaaaauauuuagaauagguagaaggacuuugaaaaagaauuuggaagacaaauacuaccugguuucaagauucauuauaaaguuacaguagugaagaaaguauggaauugauaucaagauaggccuauagaugagaacauaauagagaguucagaaauagacccacacauauguggacaauugauuuuugacaaaagcaagagggcaguucauuggagaaaugauuaucuuucccagucacuggaacaacugaauauccauaugugaaaacaaaaccaaauaacuucaaucuacauauuguaccauauauaaaaauuaacucaaaauggaugauagauacaaauguaaaaccugaaagcauaaaauuucuagaagaaaacacaggaucaaaaaaucuuugugacuuugaguuaggcaaagauuucuuagaugugacaccaaaagcaagaucuguaaaagaauaauuuggacuucaucaaaauuaaaaacuucgguucuuugaaagaugcuguuaaaagaaugaugaaagauguuguuaaaagaaugaaaaggcaagacuagaagaaaacaucuguaagugagcuaugucuagaauauguaaagaacucuuaaaaugcagucauugagauacgguaacccaguacaaaugugcaacauauuugaacagacacuucaccaaagacaguauguuguggauggcagauaaguacaugaaaagcaacucaacaucauuagggaaauacaaauuaaaaccacaaugaaggcacgguggcucacaccuguaaucccagcacuuugagaggcugaggcggguggaucgcuugaggucaggaguucgacaccagccuggccaacauggugaaaccccgugucuaggacuaaaaauacaaaaauuagccgggcguguuggcaggcgccuguagucgcagcuacucaggaggcugaggcaggagaaucauaugaacccaggagcuggagguugcagugagccaagauugcaccacuguacuccagcacuccagccugggugacagagcgagucugucucaaaaaaaaagaagaaagaaagaaagaaauacugcaacacacuugcuagaaugauuaaaauuuuaaaauggugaugauaacaaguauugggaaagauguggagaaaccagaacucaagggaauguaaaaugguacaaucgcuuuggaaaacaguuuggcaguucuuaaaaaguuaaacauauaacucccaugugaucuagugauuucaccgcuagguauuuccccaagagaaaugaaagcauguauacauauaaagaccuguauacaaauguucaugguggcuuuauuuguaauagccccaaacuggaaaaaucccaaauguccaucaacagguaaaugcguaaaucacgguauauccauacaacagaauauuacuaaugaagaagaaggcaacuguugauaucugcaugacgugggugaaucacgaaauaauucugaauaaaagaaguuggauuuaaaaaaaauaugugauuacaaugauauaacauucugggaaaggcauacuaaucuagaaugacagaucagauugcuugggggauagugaggaaggacaggaaggagggguuacauagggauacaagaaaacuugugggucaugagucaguucacuaucugaauuguggcgaugauguuuugugugcgugcacacacacauauguauucucugaaaauuguuuacuuugagcacucuaauguagcugucacucucauuucugugacuuauuuuagaaagcuguuaagucuuugggaaagucacuuaugucaucaguaaagaaugccaccaaaauagcuucucacuuaaguucccauccccagagcuaacccacaggagguuccgauaaauucaaauauuuaauaacuuguauuuuucuuucuccuuaaacacaggcccucugguccuggaggcaggaucaugugguggauucuuggcagucagcagucuguggagcuuuugcaggugcaaaggauuauauuauacugggaaagaccaaagagggggaaaaaugugaaaauauuaacuaugcaaaaacaacauucuuuagacauuccagguuguuuagaugaagagcgcuccacuaguuguuugagaaaagaacgugucuuagaggggaaaaaaaaaaaaaaacugcuaaaaaggugucugccugaaagacaaccaauuuguuuuugacaaauuuuucuuuuucuuuuuaucuuuauuaaagccuucacucaggcccuggaauuaccuuaaagaugauuuauaaaguccucugugggaagagacuugcugugggugcagggcucaccaugcagcugucugccuugggcagugcuuaggggguuuaagcgauuucugcagaaggccaugauucacgguuugugugacauguuugacagcacuguagauuaacuagugucaggagagcagaggcuccuccauaacuuacugaaggguaaacuguucuguguaggaaguauggagaucuacacaucugggcauuuucgagacauuaaagcaagagcgaggugacaauaugcaauaccguguuauccaucacuaagucauaugaauuuucaagugaggcuuuaacgagaacucaaaugcuuuaaagagcuuaauaagugauauguuuaaaagccuaagagagaaguauauuuuguuguuacaacguuaaauuagaauuauaguugaaauacaauggaaauuugccagaaaaggaaacuuuuaguugagaugugaagccaguaggggagguuuaggguguuaacuuuauuggaaaauaauuauuuugcaauuuguuuaauggucauuuuuguuguuguugucgugauugagaaaacaaaauguucauuuuauaguacucuuuauuaauagacucauuugacuuguagaauugauaaucaacaauaagaauuuugccuguagacaugaaaccaauccagauugauuaugaugaugaucguuuccacaugacacauagucauuagcuguguuaaauaaguagguggucuugauucauuuuccagaggucaggagucauuauuccccagucccuaagagagaugugcauuuuuguagacacucuccugggcccuggggacaaaaugagcgcauuauggaaauuaagucauccuggauaaguaaggcuacuuuuuaaaguuagcaauacuauaaaacuuccauguguugaaauaagaacauauucucugguccuauuccuugaauacccaauucaaagauuugcuugcagagacauuguuacuauuaaggaaauuugcauuaauuacaguuuccuuuucagaauaauacucuguaauagacacuaagcacuuguacugucagaaggagugagagaagggaacuuccuaucagacauccucuaucuaugugguaggauccuaccauccaggcccuuucaguuaaggugacucaccuggggaguguggcagcacagccggugcuccagugaugcugggguauggagaaagggagcgaggugcccacggcuacacaucuagcacaggcugagcugugugacuuacaggauucugaagucucuuuuugcuccccaacucaggaaugagacuuugggacccuccugagugccaguuuccuuaccuguaauguagaagcaacaauuccuaccuuaggggauuacuucagggcuugagauaauguauggucaguacucuguacucugcaaaaccgagucgauguaaggaauuacuacuauuucaauaagaacaacuaacauccagaaaaugaaaaccuacuuucacaguaauucaucuucuugauugagugaaggaaugucauaucaauaaaguuacuguacacaacagucuccucuaauagcucguaaauuuuaaaaugccuccaauauaagcaucuuauuuuuuucugcugaaguucugauaagugaaggaguuuguccaaggccugcaaaaaaucuguugucaguagaaccacauauauuuagcaaaagauaaauagauugcuuauuuauaucccuuauuuugaaauuuuauuugguacaacuguugauccagaggagguuacuauuuuaaggcauuucugaaggauaaacaucacuugaaaauauucccauuugugaaaaagugagauucuguaagaguugcaacauggugccuuacagcauauagagaugaaggaugucuugugaagucccuuuaaaauacacgcugcacuugcagacuuuacccuuacauggccauaaaagcagugaugaaacuugcccucaaaucagaaaucagauuucucauccccaugugcuuuuccaaguuuaaauuggcuaaaucauugcagaugaaccauucugugugccauccuuggcacucuuucuuguucaugcuuguuuuguaaacuacuuggcgcaaauauccaaaaaugucccgugaucuuggagguguugauggcuugucaugcacagaaauucccuuggcuucuggucggggugaaacuagggggauaaaaggacuuugcaacuuccuugcuucgaguuaacuucuaaacauaaaccauaaugcagccuaaguaauuaugacauuugcuacuauagugguauuugguacucuaguauauuuugauuaguuucucauaauaaacaccucuguacauucucuaggagagaagagggugggggagaaagaggcagggaaagagacauugauugcgaucucuccauggguuugaaauucgagaacagggugagggauuauuuggguaacaaaugagaaggccugacacaaucucuauuaaaauacaaacaaaaaacacuuuccuucuuguugauggggaagucuuccacaucugcacacuucacuggaggucacgcacauaagagggguaugguggugcucuucucccuuccagacuaaucaggggcaacguagggucuggaggagcaaugaauggcagcaagguugcccagggguggguucgggcacuuccccacugcugcccccacauucucagccacugcuuagaggugacagcuccagccuuauuguaggaagguggcuacuuugucuuuauggguguuggggcaggggcaguuagggaaucugcauuuguuccccaaggaaauaggagauaauaguuuuaucauaaaauuuuaguuucuccugaauccuguccucgaaagcaguuagccuaacauucaguacaaaccuaacuccaguggagaccauagaaaacuguuucacagaugcuuugaacacaaaagcagccuguaauugcuguaccaaauaauuauuuccugucucauauguuagacuguuccuuguauuuauuaccaguagcuuacagugcccuuaaauaaaacguagaaaauaacuacauuuuaacugaaaguccuggcccccagcccuuccccguuaugaccauuauucuauucuauuaucuucacaaguccuccuuacagccuuacaaaagcauugugaggucugugaauuagagaaaucuuugauaguugaagacaggcaaauuggucuauuaguaacacauaaaauacaacuucucucaugguaguaaaguuaggaccuauugaagcauacauguuucugucuguaacuuuucuucauauuacuuucaugaaaccuaaaucuccaagagaauauugguaggcauccccacuaaaggaaugguaaaucuuugcuaauggccaaaauaaguuugauuugcaguaacuaaauuuauuagauguuccuuaucaaccuuuaggucuuuuuaauugguuuaggaucguuugugaacauuuucacauacgaaaguggguuuaacaauuggacaaauuuuaauuugucuuauauaucaaagucauuauguaguggaacgagcauuacuuuuggagucaucauacaugugacagucccaggucccgcaccagcuguguggccugggcaaguaaguugguuguaaaaugagaauaguaacaccuaugcaaaugagaucaaauaaucaaugaaagugccuagugcauuccuggcaugccagauacgaaguaagcacugcagauauuagcuccuaccuuuaccuuucccugccuuuuagaggaugaguugaaauuuucaguuuauaaaaacuauagaccaggguaccgauuaagcguuuucgagugccugcugugagugugcuggucuaaagauacgaagaaaaagcacucauuagcucuggccaccaaggaaagaguuaauuauuuugugauuacugcugugagccagaugcuguuccaaacauguugcguaggcccauuuaauuccugugucauacuacuaucugcauuuuacagaucagaaaacugaggccacuaggagaccaguggguaagagucccaguuccagagucaguacaggcuuuagaucccgucucagcucugcacuaaguaaaaucuucaaguuuuuagccuccauaagccucaguuuccucaccuguagcauggggauguaagaguuccuagcucauaagguacuucagccacagaauaaguaauuaccuaaggcuagacaccugguagaacugggauuuaagcguuggucuuuccaacuccaaagaaggguucuuucaggcuagaccgugcugcugguaagggaaacaaaaccaaaucuguuauuuugguguaugggaaguuugggauaguaaaguuuguugccuuugugucuugugucuuuuuuccuuuucuuccuuucuugggggagauagauagauagacagacagacagacagacagacacagagagagagagagagagagagagacagauaguguucauggauccuguuauguaacuaaaaguauauuuacuuuuccagggcagaauauaugguuaaaagaguaggauuucaagaccaaguccacaaaaauuuaaaagacacaaagcuuagcaagucucugaauuucagacaaccucuggauaggagaugaagaguuuuacauagucauaauuugaaauggcuaaacccaaggggauucaaauauucaugucaguugauaguauuaccccuaaggugugugacauucagggguaaccagaaauggaccaugagggcauaaauagguacaccuuucaaaaagucagugucauaaucaguguuaccauauggaggaggcuugguauaaucuuauuucagcaucauaauuagauauuuggcagagaucagaugaccuucuuguccacaagccacaaaagcgagaaggaaaguagugcuauuucuggaguauccuucacacacggguguccuguugcccuuauaacacugccucuuuaccccuagcucauggaagcugaaucuuuguaaugccuuuuaggauuuuuauuauuucugucucuguagggccucuucggauuuagaauauaucuuuguacugcauuuuaaauguaauauugacaccauaaacuugguuuauguuaaaacagaaaguccuucaaaaaguccaaucuguguacaguucagccaucacgacauucagauaacgcaaacaugagagagaagguuaggaaggaagccauaauguggaaugugugcugaagcgagacucaggcuaagaagauguagaagagagcuuagaaagguaacuuugacuagccugcugucaggagcccgugaaacacaaaaagcuuugcuccuuuaauucaaagaauccagccauguauacccaaaauccccacaaugucacaugugagucuguuuguccauuuugcuauaugcaaaacagaaaugauagacgcauuuuggagucacuuuaaagaacagugguccaggcugggcguggugguucaugccuguaaucccaacacuuugggaggccgaggcaggaggagugcuugaugcaaggaguucaagaccaggcugggcaacagagcaagacccugucucuauagaaaauuuaaaaauuagccaagcaugguggugcgcagcuguagucccagcuacucaggaggaggcuaagguggagagaucacuugagccuaggagggugaggcugcagugaguuaugaucacaccacugcacuccagucuuggugagacacagugagacccugucuuuucaaaaaaaaaaaaaaaaaacaaaaacaaaaaaaaaaaacaaaagacaguggccuauagaaagucaugaacccuuugagaaccauuaggagcagugugucucacauauugagagugggcaucuggccacauacauguaugucauguguacacauucaucauguauguaaacauacacacucauuaguuugcuaguuaaugaaagagcaagauaaauuguggagccuuguauuuuucaccugaguggguagagcauuuucuucucucaugcaguucuguaucgcugcaaaagaaaugaagcguguggauaaagauugugcaugugugcauccuguucuucaaucagccagguguacauaaugacgaagugauuugggcagagucaggaauucuaaaaauuacaaaauuauacaguaaacaggaucucacuuggguguuggguauuauuuguacagguggauuugccgcugcagucaccaccccucuagacguggcaaagacaagaauuacgcuggcaaagguaaguggugaaauaauguaauggagauacuucagaugcucauaucuguuagcacuaggacuacagguguauaaagugaacacaaauggcuaccauuuaccuguaauagcaucuuaugcugccugugcaaccucuaacaaaacugccauugauggaacaauguccccagugucuacauaauauuguaccauuucacagucauuuucacauagggcugguagagccacugccuggcaguaccaucuucaaauaaacucuguuuuuacuggugacaaaccuaagggucagagagguugacgagccuccugcuauguggcagguaagugacaggcuuugaaccuagggucaugguuggccuuaacuggauggguuaagacaguugucagaaauguugaaaccauuuuguuuaagagaaaaauuguuuuaaaaaacccugcuagauagagaguugaaagaaugccauacguauaacauaccugaacugaaccaaaacaaaaaaguccuaucuuuguggaaaaguagaacaaauaaugggccaaauuuuaguauggagguggcaggauccaaccuaagaauguuaaucacguuuuaaauggaacauuuaaacggcacucuauuaaauaugcuuauuagcugcuuaugcagguuucauaguuguaccauuuacacuaaugauuccccgcccuccucacauugcuucauagugcuucugucuuucugcuguuaaauaguucaucagucaucucgugagcucugauaagcagccaccuguguggcaugggccacaucccugcuugccugcauaucggaguguaagcacuucugggcgagcgagccagguccugauugccaagaaacucccugguaucugacacuguguucuagaugagggugacggggagcugugugucugaggauaucugagaggcaagugugugauugggagcuucagaagauaacggguuucucuuugucuguucacacaggcuggcuccagcacugcugaugggaaugugcucucuguccugcauggggucuggcggucacaggggcuggcaggguaagacgaggaaugcccuccuuccuuucuuccucuccaccacuccuccuccuuuagccuaacuuuggaugaacaccucuccuucccuucugcuuauguucugcuuugaguuucuauuuauugugcaaaauauuauaguugauguuguauauaugagauaacauagcaaaucaaauugacggauuauuccagccaggcaguucucagccuugcccaucuugauguuagaugaaauucacauguguggcucucaccagggucugggcugcagcagugauaaaaugggcuucucagagguuacacagugcagaaauacaagggagugaagggaacauuguuagaagaaagcauuugugguuuugaugcuuuuaacuauuauuaguaacaaauuacuuugaacauaccauagugcaggugggaugacuccacuauuagcaucaauugagaaccauugugcuacagaagugccucagacuucuagcuucauguccuaaaagcucucucugcaagauuaaaacauugcuuugacaccauaaacuugugaagccgccugaauguugagaucuuacaggcaugugaaaugaugauuuuucucuuagggaccauauaccagggauuuucuugcaagagcaaagcaguggccucccuuugcagagggucggucggcagcugccuggacuucgggcgucucagcuggcagugccaccuccucauccugaugccgaguuggaucacuuaugugauuguaguuuuuguguaccuuuggcaguuuuaaucucagcuauuugaugaucuggaggacaugaaguaggugagucaggacccaguuaagguuuuuauaggagagcagcacauccuagauugaaauuuuccaguuggaaguuugaaaaguaggugauauuggaugguuuuguugaaugugacaacucugagggauugacguugggggugugaagggugucacgguuuugaaacaagaacuggggcaaagccagaggaauaauuggcuguugacgucuagugagagcgugggaagggccuaguggggggcaugugugcugggagccugccacuuagggcugccauaucgugaggggugcuucuaucuguggcacauuaauucugcugccaguuccacagcaaacaaaggaauggggugagaaaaaaugaguccugaagcuacuuagccaguagcagguaaaaggugcuuaggggccgggugcggggcucacaccuguaaucccagcacuuugggaggcugaagcaggagggucgcucgaaguuaggaguuugagaccagccugggcaauauggcaagacucugucucuaaaaaauaaauaaauaaauuagccugguguggucgcacgcaccuguagucgcagcuacucaggaggcugagcaaucgcuugagcccgggaagucgagguuauagugaguuacaacugugccacugcucuccagccugggugacagagcaagacccugucucaaaaaaacaacaacaaaaaaguucuucuguguuucaaauagcaauugggcuacauacauggagaagucacauucaguggcuuuuuuagacuguaaaaccaaacugccaaauuucacuguccuacugauuucaguguaguucauguuugauucuguggcaacuguugggcaaaccacuucaauugaccuuagcuuuguggagcugugcagagcugcagccccucagccuuuucuggagacagugguggcagguggggauggcaugaucgacuggcaaccccauggccccaaaagcugguaggaguuauguugaguagaugauugaagauagucuucccuguccugguuguggcaugucuuauacuugacguuauaauacuaagcagugccagaaauacaggcagaggaggggugucuuccucaggucaagggccugucccuguccccauugucagcucuguaaaggucauguggaauuuuuuuugcuuaucuaucuucggaaagucucagaagucaugggcucuagucagucuguacaguguagucccuaagagcauuacagacagcagcggucgucacuuaagggaguuuugauuagccacuuauuaaugauuaaagacaauaaauaauuugacuaaaaaacagucacagaaaaaccuggguggcuguugugaacagaggucccaggcacccucagccugaagguaucucugccagcuuccucugugcuccaagcacacagcgcugcugccaccuccugucuccuccccggggcgugcacuaaguuuacuagguacuacuuggguuuuccagcagacaccaucuccucaccuuaggauggaauggugcugcccucucggggucaagucaaguggcgaccacuuuuaucuuuccgugugguccacgcaggugaagaccuuguucuggcgcauaugggaguacacauauaaacagaaauauauuacuaaacaaacaccgcguguucauucagccccguagccaaaggcagauggggagccugcccaccccggauggccccuuucugguuuucuucacucaucagcuggcuuucuguuuuuguugacugugcccuuuauguaguagcugccacugccgcgagcaucccuuucugucuggcauuguaagugcuuacguuugcucucauuuaaucugugggcacuagaacacgcuccugcucaacucaaaagucuucaccugcgagacuggcuggggcccucacuguacaaauuacuccacguuaaggccguaauuacguuaauagauucaguggucaucuguugaaaccauaaacugcuuccaucugugucuugccaggagcagcugagcuugugaguggcagaagcugaacaagacacuggcguuuagaaauaaguaagguaguaaaggugggagaacuuuguggccagaguggucucccacagcucggcaucugcuggccgccugucuagcacucuuuccuucguaagguaggagcagggaggcucaucugucuuucaggcaggaaggacauagugguaauuuauaaguuucuguccucaccacccacccuuugcaugaugcugauuuuuuuuuuuuuuuuaagcaaguguaguuugguuuucaauacaauuuucaugguuauuuuuggacaaguaaucgugguccuuaauuuuaugugcaguauuguaaugauuuaaacccauagcuagcuaacuaaaaagggcccacaaaacucuucuuaagugucucauuuuccuuagaagugccaagugcugcaaacagagggaggcugcucagccucccccaacagcucaaagguguugggagaaaggaugcagucaggugcugggagcagccugcagggaccgucuuccugccauguuucucuccaggccaccagcuugcuugucauggaggcuuuuccuguaucuuaaaggaugcauagcuacuguuggcauacuugaccauuuucaguuuucuuccauagaccugaccagaagucuuuucacuggcauaugcacuaguuuugccuucauuaacucuuucugcuuacagaaguaauacaggcauauuuuguuuaauugcacuucucagugcacuuuuuuuccaaauugaagguuuguggcaacccugcguugagcgagucuugcagagcccuuuuccaauagcacaugaugacuuugugucugugucacauuuugguaauucucaccugucaaauauuuucauuaucauaucugcuguggugaucugugaucagccgucuucgauguuacuguaauuguuuuggggcaucacccacuguguccaccgaagacggcaaacuuaaucgacaaaugugguguggguucgggcugugucuccaaccagccauucccucucucucucccuuaggccucuauucugugagacacaauauugcaguuaggccaauuaauaauccuccaguggccucuaaguguugaagugaaaggaagaaucacaccuuucucauuuuaaauaaaaaacucgggccgggcaugguggcucacaccuguaaucccaggauuuuggggggccaagguggcagauggcuugagcccaagaguucaagaccagccuaggcaacaugccaaacccugucuacaaaaaauacaaaaauuagcuggccauguuggugugugccuguagucccagcuacuugggaagcugaggugggagggucaccugagcucagcagguagagguugcugugggccacgaucgugccacugcacuccagccuggguaacagcaagacccuaucucaaaaaaaaaaauuaauuaauuaaaaauaaaagcuggagaugauuaaauuuagugaggaaggcauguggaaagcugagauaggccagaaucuaggccucuugugacaguuaaccaaauuguaaaugcaaaggaaaaguucuugaaggaaaugaaaagugcuauccagugaauacacaaaugauaaguguaacagccucauugcacauacgaagaaaguuuggucuggauagaagaucagaccggccacaacauccccuuaagccaaaaccuaauccagagcaaggcauuaacucucuucccugaaggcugagagaggugaggaagcugcaggguuugaaguuaggagagguugauucaugaaguuuaaggaaagaagucaucucuguaacacagaaguguaaggugaaguggcaagugcugauggagaagcugcagcaaguuacccagaucuagcuaagaucaucgaugaaggcacuaacacuaaacaacagauuuucaggguagaugaaacagccuucgauuagaagaagaugccaucuaggacuuuccuagcuagagaggagacaucaaugccuggccucaaagcuucaaaggacuggcugacucucuuguuaggggcuaaugcagcugguaucuuuaaguugaagccaaugcucauugacucuucugaaaauccuagagccuuuaagaauggugcuaaaucgacucugccucugcuguagaaauggaacaacaaagccugagcgacagcacaucucuuuacagcaugcuuucuugaauauuuuaagcccacugcugggaccuagugcucagaggaaaagauuccuuuuaaaauauuuccgcucauugacaguguaccuggucacccuggaguucugcuggagaugaauguuguucucaugccuacuaucaacauccauuccuuagccuguggaucaaggaguuacuuuaacuuucagguuuuauuaaauuucauaaggcuacagcugcaucaacagugauuccuuugcuagaugugggcaaaguaaauuggaagccuucuagaaaggagucaccauucuagauaccaguaagaacauuaguggcuucauaggaggucaaaauauugaccaugcugggacuuuggaagaaguugauuccaauccucauggcugacuaguggagggaaacacauacuagauguacuggaaauggcaagaccaccguagucagaaguggagccugaagauguaaagaauugccacaaucucaugaucaaacuugaacggaugaggaguugguucuuaugggugagcaaagaaagugaucuauugagaugaaucuacuccuggugaagauacggugaacacuguugaaauuacaauaaacgauuuagaauauuucaucaauuuaguugagaaaacaguggcagaguugagacgguugacuccaauuuugaaagagguccuacugugggcaaaauguauugugugcuacagagaaaucuuucaugaaaagaagaguccaucaaugcaacaauuacuauuuuuagaaauuuccacagccacuccaaccuucagcagccacuacccuggucaguuagcagccaucauucaaagcaagacccucuaucagccagaagauuacaauuuacugcaggcucagaugcucaugagcauuuuuuagcaauaaagcauuuuaaaauuaagguauguacaauuuuuagacauaauugcuacugcauacuuaauagacuguaguagaaacauaacuuuucugugcccugggaaacgaagaaauuugaauggcuugcuuuauugcaauauucacuauuaugguggccaaacuuggccugggaccaaacuugaaauaucucugagucaugccuguacucuuggugaaaagguucaaagguuauggaagcgugggccaggaauguguccuauaauccacaggcagcaggcauucaguuuagggcuuaagacacaucccuggcuugccuuuuagauauggaaucauaguccuuggacuuaguuuuuuaaaccuguuuuguaauuuuuuuauguuggcaucuguagauuuccucaucuuuaucagcuacauaaucauccacuguauguuuauacugugccauaacuuauaucaccaucagcaaugccacaaugaaaauuuuugaacaaauaucugaguagguauggggagggggggcaguuuuaaagaaugaauccccaauuuguauccucguggcauuguaguuuuacuuugcauugcucugauuauucuacauugcaccuuggcugguuagcagcaccuucugugauaccaaggggacugugcagguggaggcaugcugcccccuucacagccacagcccauuugccuuucaugccuuuagacagaaaaggaacacagggaauccauggagguucaacucguugucgugacgucauguuuuggggucucgaaggacaaaaugcaacugagucaguggguggagcggcagcauugcccaaaaaucucuucacugagcaaccccuggagaucacuuuagaggugugggcuggaagugccuuccagccuuaccuaggauucagcucuuuaacaccuuuuuaaaaaaaaucaauuucauguuucaaagggaaaaauggcaugaaaguuuuagaacuacuguugggacacagcuauuacuugccuuauuugggagcguucacaagcuguuugguaguuagccacuaaugagcaugguguauugagcugagcaagcuguggguauuggaauuuaaccuuuuuuuaaaauacgcacaacauuaaaaauccuguuuuuuccccuagauuauuugcaggugucuucccucgaauggcagccaucagucugggagguuucaucuuucugggggcuuaugaccgaacgcacagcuugcuguuggaaguuggcagaaagaguccuugaagcagagacaagccucaccuccacuucugucaagagaggggccugcagugcaaacccucuuccgcugagcagcugucugaacuauaggccccagugcugaagaccaguugugcuaagauaccggcauggagauugugccauccgugguauaggcuggcugguaugaagucauuggccuguaugccagagagcuaagagaagaaaacggggucuguggcgguacucugaacaauuuccucagaaccucuuaauaaauaaguuugguaaugcugaggccaggccuuuuagagcuuucauuugaucuguaucugaucuuucauuuccugccaccugaugguggauucagcagaaggcaagaugguuauaauucuaaaagaauagcuuguuuguuuguuugggaaaaggagacuuggggaagaguuguguauguggguguuucucccccuaguuaauuccuguuguguaaggguaggcuuuguugaaaaagaaagaaagauugaacuacaggugcauagcaagcacucuuucuggguaacuaggcugcugguuuuaauuacccucagauuucacccauaaaaacgcacaauuguauuauuuuacagagauguguccagcgcccccuguggugugugagagaaagcagcugcaacucaagugacuaggugggcccagcuggcuucgugcaggagggcacggugggugagccauucucgccauucucaugucagacugaaaggagggccugggccagcuuugaaaaggcaggaugaaauggaaaggucaccacacuuagggauuuuagaccuugacuaacaagcuccagguguagaaaaauucaaaacaaaaugucaggaaucuagcaguguugucugcccuggagcaaacaaacaguaugugauuuugcuucgccuauuuuuuuuuucuuuuuugggggaagauaauuaaaggcagaaugacugcguuuguaaaagaaggaccaccaacuauacugacauuuauaaaugaaccuuuauuaaagacacuucaaugccauuuguuagacacuucaauauuuuacaugguuuucaauguacacuguaccaaaauuucuauaaauaaauaacuuuguacauaaaaguaa

SEQ ID NO: 191663 - RNA, 99171 nt, Homo sapiens
gucccucacaccgagaguuccugcgcguggggaguuggagaguuugcguggcgggaacgcggcggcagugagagcgagcggcgccggcccuugcguccggugcggcgaugcugaccccggcguucgaccucagccaggauccggacuuccugacuaucgccauccgcgugcccuacgcccgggucuccgaguucgacgucuacuucgaggggucugacuucaaguucuacgccaagccauacuuucucaggcgaguucggggugccuggccgcaggaaaggcgcauucguuagauagcugcuuuagagggagaaugcaaggucgagagagcagugcucgauugcgcgaaugccuuuucccgacguuuccgcagcuucucuuggugccagggaacugcccucuuccaggggugcguuuuagaugcugcggaagcccuuuuccuucuugagcuuucuuaaaucccauaucaaaggauugcggaaucacuugaaaaagugacguuuggaccgugucacuuucccguuucugcccugucgcccuaguucucgucccguucugacuuguucuguucuuuccuuucacuccgcguuugcucucccagucucucccuuccugggaacggcgcgcgcugacaucuccgugacuucccaacccgucgguccuuuuaacuuugcccaggccgccuucuguugaucuaucucuugucuguccgcucccuacuuaccgaaauucuuaccuuuuuuggaccucuugacaccaaauuagccuaguucuccugcuucccugcugucugcugcucuucuguuugguuuugucccugaagugugguuguuucccccaagucuccgugagggucugucagcacuugaucuguuuaaauuauucuccuugcagaaucguaaccuugguagcagcuaacacugauaacucguagugugguggacaagcaguuccguuaagugcuuuaugaugguguaucucauuuaacuuugacggugauccuuagggauaagcacugcuauuaaccccauuccacagaacccgcugcuacauauucauccuaaaguauugccaaucucuuguccuucucuuuauccauccuccuaaucuuucugaaguguagcugcauccuacuuuucccacccaaguacuuuugugguacaaaccuucuccaccagucaaggugguuuuuucacuguugcugaaccaguuuugcucagauuucccuuagaccauauaacguccguauuugaauuauugcacuuuccaguuuuuuaauucacuuauuucuuuaauuuauuuauugaguuucaguguugguauuauugugcugaacaagacaaaguccugcccucauguacuuuucacuggggagaggaaaacaauaaacaguguacuuaauuguggugagugcuaugaggagaaagaagugcacuaauagagaaugaaaaagggcccauguuuuauaaaguggucaggaaaagccuuucuggggaggcgauauuuaagccaagaugugaagaauaggaagaagauuauggugguagcaaauauuuauugaauuuuuacuccagguuagugcuuuauacggauuaucucauuuguuauuaggacaguguuacaacgaggcuuuauuauuuacccguugccguggauggauuauuugugggcacccccccaacucuuguccccaaauucauauguuaaaggucuaauuccugugucacuucugcuuuauuguauucaucaaaacagucccagagccugcugaauuuuaaggggagggaacauagaccuucaugguugggaagagugcugugagaugggcauucuuugauaauacaguuugcccccagaugugguggcucacuccuguaaucccagcacuuugggaugccgaggugggcagaucacuugaggucaggaguuugagaccggccugaccaacaugguuaaaccccaucuguacuaaaaauacaaaaaaauuaucugggcuugauggcacgcgcuuguaguccuagcuacuugggaagcuugaggugagagaaucgcuugaaccuggggggcgaagguugcagugagccaagauugcgcuaucgcacuccagccugaguaacagagcgagacugucuaaaaaaaaaaaaaaaaagaacauacaguuugcuauaccaaggaugaauaaaaccuggucccucuccuugaagaauggagacuguagcugcggaggccccauguaagcaaauauaauuuucucugcaguaagaauuuaacucuaggcuuauagaguuuaggggaagggagcugguaauaauagcucacauuuucugaaugcucaccuguugugccggccacuaagcucuuugcauuaucauuucaugcucauaguaacgcuuggauaguuacuguuauuuccccccuuuacagaagagggauuuaugauucuugaagaauaauuaacuuguacaaagaagguuguuacacaucugguaaauggcagaucuaggaguuaauucagauucugacacuaaaguuagcguuuguaaccauuauaacaaacucauccauaaacugaccccuuauucuggcuuagagggauuuucauucugaaaauguauugaagcuugaggaaaccuugggauuaaagguccugggccuuuugggacugucagcuguuuuuguuuuuaaucauauuuaguaggaaacaagggggagggccaugggaagaaaggaagcucaaauuucaaguuuggaaugauauggagugggccugauaugcccuucugauaaguuuaaauuaucuaggcaacaugaggcagccauagacacuuuuuaaaauagaaaagugacaauuagauuccuguuuuagaaaaauuauuuuggagccucaguggaagacugauugaacuaggguaaaacuggaagcagggaaaucacuucauuucuuuuuucuuuuuuuuuuuuuggacacagaaucucacucuguugcccaggcuggagugcaguggcaaaugaucucggcucacugcaaccuccccuuccuggguucaagugauucuucugccucagccuccugacuggcugggguuacaggugugcaccacuaugccuggcuaauuuuguauuuuuaguagauauaggguuucuccauuuuggccauguuggucuugaacuccugaccuaaggugaucgacccaccucggccucccaaagugcuaggauuacaggcguaagccaccacgcccagccaaucacuucauuucuuuuaguacaaaagagggguaaaucccuacauaauaaugaugagauuugacacuuuugcuuucugcuuuuuuuuuaaaguaguaauuugccugauaaaaucaauugguuuuguguuucuuuauuguuucccauugaguaucccuuaucuguacagauugagugucccuuauaugaaauuucagauuuucuagaguuuuggaauauuuuugcauacauaaugagauaucuugaggauggaacucaaguuuaaacacaaaauuuauuuguuuuauauacaccuuauacauauagccagaagauaguuuuauguaauuuuuuaauacuuuuguguaugcagccaaguuuugacugcuuuuugacugugacucaucacaugaggucaaguguggaguuuuccacuuuguggugucauguuggugcucaaaaaguuucagauuuuggagcauuucagauuuucagauuagggauacucaacuuguguuauaacaauagugauaacuacuauuuauuauggcuuuucuuuuucaguaucuauuuuguuggugacuagggguauucaaauagaaagaugagucaucucuaauuucuacuuucuugguuggggaaagaaucuaacuuaguuuauuaaaaugugaaagaaauacugaggaacuucuuaaaaaaugauugauauauuuugaugguuaaauguuugcaaguauugauggccacuuauguuacguuauaauuuaaggacuucaugagaccuguguuaaaucugcagauuaacccuuccuggaagaauuguagaaaauggaagugagcaaggguccuaugaugcagauaaagguauugucuuuggaauuuuuguuaguuuauuucuugggauuuuucacauuauuuacauaauaaucuuacaagauaccauggggaccuuuugaugucuuucaaauacaaucuguuccuaucacucuuucuuguuucuuaguguccagugccuguuauugauguuccccaccccucacaagucuuuuaaaguauuucacaauguucuucaaaguaaaguuaacugcuccgguucuauuuccuagaguacuuccccuacauuuaguagacauuuaaaaguaaaaauuagaacaugugaaaugauugaucauaaaaaauguagaugacuuaugagcuuaugaauggaaucuuucugguauaauuuucaaacuugaacuuuaauaacagguaggugagagagaaacuaugcauggguggcauuuaaaggcuaauugaauuuucuccucaugauugauaagcccuucauuucagcuagccaugaacccauuuauuuuuccuuuauagaagccacuggcuuccuuugucaucggauuuagaacaccuuguguagucuuguguacuuuauucaaugaauauugaccucagugaacuaggcuaaggguaggguauggggggguggguuaaaugacagagaucuaacccauaaugcaguguaauuaauguguaaugaaguauagugaaacugccuuccuagguaguaaaccagcuuuuaguuauagguaaguugcauauugaaacaaaauuauuaaauuuuuaaaguacacaggaguuaaggaagauuguguaugcggagauauuugggcugaguuguauuugauauguuggaauucaguucaguacacugaaagaggcaaaauguuuuaaaaugucaaagugcuaaauaauguaguaaguucccagggaagccuaaauaagauagauaaacucagucaaggaaagaaaagaaguacauagacuuuagggauuugagucugccauagacuuuagggauagaucuccugacaugccagaaaaccuuauuaagccauaauuguuguaucuaagauucuguguauuuuuaaaacuguugccauucuccauuggauuagguauucugauuuuuuccuccuuucccagaagucuaauuaguaacuccugguuaauucuaagcuauuaccuucuuaggccauugauuuuuauaaguuuuaacuuggauuuuuaauauuaucaguagguaaaggucauacuguauaagacuaaaguauucuguagcuuucacagauaaauaauuuuuuuuuuuuuuuuugagacagaaucucgcucuguugcccaggcuggagugcaguggcgcgaucucggcucacagcaaccucuuccuccuggguucaagcgauuauccugccucagccucccaaguagcugggacuacaggugcacaugccaccacucccagcuaauuuuuguauuuuuuaguagagaugggguuucaccauguuggccaggaugguguugaucucuugaccucaugauccgccugccucggccucccgaagugcugguauuacaggcgugagccaccuuacccagccagauuaauaauuuuugauagaaaugacagcuucugaaaaacccuuguuaagaaccuuuuucuaucuugacuuguauucaccaaaucuaugagggcauaguuuuagagccuguaaaauagaauuauguuuuaccaagacauguauuucucagauauauuugugaagucuuugacuauuuuauuuauuuauuuuuuucuuuuaauuaaaaugauuuuauuauuauuuucuguagagauggggucuugguauguugcccaggcuggucuugaacuccugggcuaaaaugauccuccugccucagacugccagaguauugggauuacugguguaagcuauugugcccagcuuuuuaaauauuuuaaucuaagcauaaaacaaauuuaucuuuaaggaauuuuuaccauucgccugcccaaagaaaccccuggccagcauuuugaggggcugaacauguuaacugcucuucuggcaccaagaaaauccaggacagcaaaaccacuuguggaagaaauagguauguuuauuacaguugggaggaaauuaggauaaauagaaauauuuggaaugcuguguauuuguaggggaaaugggauauagugaauaggaaauugaagaaaauacuucagguauaaggugaucaugugaaaccauaugaaaauagcuucuuuggugauauaauuaagacauuaaaaauccuauugaaccagaucacucacauuuuuggaccaauugaaacaacauuuugugguuggcaaaauauuagcaucuugagcuaagaucagaaguauacaguuaagugaguuacguaaaacagggguccccaacccucagguugcagaccaguacugauccauggcccguuaggaaccuggcugcacaacaggaggugagcggagggccaggaguauuacugccugagcucuggcuccugucagaucagauuagauucucauaggagcaugaacuuacugugaacugugccugcgaagggucuagguugugugcucccuaugagaaucuaaagccugaugaucugagguagaacaguuucaucccccaaaacuaucucuuuaccucuuugaucuguggaaaaguugucuuccacaaauccggucucuggugccaaaaaguuugggaaccacugauguaaagugaacaccaccucugucaagaaauggagcauuuccaacacccgaagaauaccauccuguauucuuccauuacuuugcccucucuccaggguaaccacuauccucuguuuugccuguuuuuacguugcauauguagaucauacaguauguguucuuuuugucuggcugcuuucacuuaacauuauuuuugugagauuuauucauauucuagcugagauucguuugcuuucauugcucuguaauauuccauuguaugaacauaccacauuuuugguucuuuuuuuuuuuuugcugucacgaauagcggagcuaugaauauucuuuuaguacauuugguauaugucuuuugguacaucuuugugggcauuuuuuccuauacuuuuucuuccccuaguuguacuuaaauccaauacuuaaaaaaaauuaaaauuuaacacauucaggugcuucugagauuccugaggaaguaguugacgaugaagaguuugauugggaaauugagcagacacccugugaagagguaucagaaagugcuuugaauccgcagugccacuauggauuuggaaacuuacgaucaggaguguugcaacgguuacagguauguugucuuucugaaagaucuugaucuauaggguuuuuccauuuggauauuuuaauuucaguuaugcuuacacuugguaguuuuuaaaaauaauauuacaggaggugauuguauuuaaagcacuuagcacagcuaaaguacauagaugugcauucccuuccauuucauuggcuguucugccuaacuguacugcucuuacagacaccccguggcuuucuuuuuucuccccuuuauucaguauucuagacaugaaguuucccaaguacaaagcagaacuccucucucauacuuccugcaaagcuuuauguuuuauacuucugaaaagugagaucauguacuuacggcaugaugucucuucuuuucuguauauaaaugaaauagaauguuccuggcgagaaugagauuguguguuuugaucaaauugucuaauucuugguguauaguaggcaccauuuucuauucucuuuuuuuuuuuuuuuuugagacggagucuuacccugucgccaaggcuggagugcagugcaguggcacgaucucggcugauggcagccucugccucuaggguucaagcaauucuucugccucagccuccugaguagcugggauuacaggugccuaccaccacgccuggcuaguuuuuguauuuuuugcggagaugggguuuuaccauguuggccaggauggucucaaacucaagugauuugccugccuuggccucccaaaguucugggauuauaggcaugagccacugugaccagccuauuguuuauuuauucuuuuuuuuuuuuuuuuuuuuuuuaagacagagucucacuuugcuggagugcaguggcacgaucuuggcucacugcaaccucugccucccggguccaagugauuguccugccucagccucccaaguagcugggauuacaggcgcccaucaccacgccuggcuaauuuuucuauuuuuaguagagauggaguuuugccauguuggccaaauuagccggaugugguggugcguguaaucccagcaguuugggaggcugaggcggguggaucacgaggucaggagcucgugaccaucuuggcuaacacggugaaaccccaucucuacuaaaaauacaaaaaauuagccaggcaugguggcacccaccuguagucccagcuacucaggaggcugaggcaggagaaucccuugaacccgggaagcagagguugcagugagcugagaucucgccacugcacuccagccugggcaacagugugagacucugucucaaagaacaaacacaacaaaacaaaaccuguuuagaaugugguuuauuaucuuaagacauauuugaauuuacgaaggagagggaaaagaccuggguucuggucccgcuccuaccucuguuaagauuugggauaccaggccaguuauuugaccacaaguaaguuuugucuccucuuuggaaaguggagauaaauuugcccaccuacuuuauaaggcugucuugaaaauuuaaaaagauaaugcaugugaaaacucuuuggaaaguguagaaugcuguaaagacuccugccuuugaaaaauauaaaauggucucaaaauuccuuaaagggaacaacauugagauuuacuuaggagcaaaugcuggugaaauagccuuccuucuaaaaacuuagguguuuuucugcugaguuguggucugcccauauucucugcuugaucacaaucgcuggugaucucagagguaauuagaguagagucaguuuugucuguagcaggaacuacagugaauggcccucaauuguuggccaagagauaguuuguggucaggcuguuuugggcuugccaaucuaacgcuguacaugaaugauaauaaaugucacacaggcuaaguauggauuuuacauuuacauuagaagugcuucuuugaggccagggauuuguuacuuaauuguugcuucuguuuacggaaaauccuuuugaaagauuucugacagguugcugagauguuguaggaaugccauaaugugagccuagaaugagugccuuuuaggucagaaauucuuguaucuugaaaauguucacuuaauaauuuagguuuuuuuuuuuuuuuaagcugcuauacuuucuuuuuggaugucuuaacuaauguaucaaauaccuagacaucuauuacuuagguuaaaaacauuaaacauuaaccaauauaguugacuccugucuaaucccuuuuuguuuacaucccucuguuucccaucagaaauaaaccacuguggcugggugcaguggcucacaccuguaauuccagcacuuugggaggcugaggcaggcgggucaggaguuugagaccagucuagccaacauggcaaaacccugucucuacuuaaaaauacaaaaauuagcugagcgugguggcgcaugccuguaaucccagccauuuuggaggcuggcaggagaaucgcuugaacccaggaggcagagguugcagggagccgagauugcgccacugcacuccauccagucugggugacagagugagacuacaucucaaaaaaauaaaaaaggaaaugaaccacugaauuuaauguuuauuauucuaagcuuuuaaaauggcuuaaucaucuaaaaucauuaaacucuucuucaaauuuuaauugcaagagcauugcuuuucuaaacaauuugaaugaauauucccuaauguaggggaaaaacaacugagcauuugggaaaacucuaaggguuuuauaacguaaauaguauacuacuuguaguacagguuuauaaccccauaugugcaauacugggaucacacaaaguucugaaaacuaaaaguuaaaauauuuaauuugguggcaaaacuuaaccugaaccgauacagauuuuuaaaucccacuuaguguacguauucaaaaauuuccuguagaaguaguguuuggauaugggcgcugccccagacaucuuagagguuauuacauaaaguauggugugugcaccauguuaccuuucuaaacucugaaagagugaauccugaagcucaccuugcuccaggggauuuggauagcacugugcugagcacugcgugugcagcaaccagacuuagaaaucaaguguaagcccaagauuccaaaaauugaaauguauccucuugaagauauuaagguagauagguuuuaugaaauauugccacagaaaucuugcauaauugguuaauuacuuguagaguucuucuucauucacagcugcuguuuauggcagccguaacaagugguucaaaacugagugaucauguaagguuaauaauaugacccuaauucuaugaguaaagcagcuagaagaaacugaaaugaugaucacaaauaagagauuuuagaacaucuuuucuaauuuaaaaugauuuugaaaacuucaccauuuucucaaauaguauuuucucacaaguuuauuuuuucuaguucugccuauagaugaagagauguccauacagcuucauugacuacucauaugaguauuuuuacagcuuuuuccucccccuguagaugaaaaauggcuuuuuuguuucuaauaauaaaagcaauacagauuuauuauaaaaauauacaaagaagaaaguaaaaaaauuauucauaauuucaacacugagggaucuuuucuucauugaauaauuuagcccuuuacagaagucuuucauauuuuuuugccuccaacuuuuuagacaggauuuguuuguaaacaucuauauuuuauacugauaauaagaaaauaaaauauuuuugcugaaacaaauucucuuugaacauuccucccuccacuccccauacccagagauauauucuuccuauccccagucuuuuuuuccuuucugaaauugcugccagccaccagggugccuuuggaaaacugcccuagcugcucaaagucaggacuucacaacaagcuucuggcagugguggcugccagcagcaacaauccuagagucucugggcgccaacccagcaagcuccugggacugcugcugccagugcugcaggacgccaggcuugcuggcccuguccuuuuggcuacacagggaccugaggccauuguuuccgggauacccacuagccagauguguucauuguucuuuauuuucuuucuggauugucucugccuaaccugugccuaaacuuccauaaacuuaauuuaaauccuaccugaccuuuucuuggcaaugucuaucuuuaaauagcucuaauaacuaguggccauagcaauuguuuaaaagaaaaaggaaccuuuuuuuccuacuguaguugaacacuucucauccucuuucuucccuuugguugauuaaugccuucuacuucuaaaccccaagcuaccuuugcuuuuaguuuguuucuguuucuuuuuagaguccaguuugaacagggcugcugcaugugacugugcauagaacaagccuggguggggcuugcacugcucugaacacucauguucugcuguguacauguugcaugacuauaguggaggcccugaaucuggaggccagggggaagaggaaagaggaaaaagagcugcuuucuuuuuuuuuuuugagacggagucuugcuuuguugcccaggcuggagugcaguggcgugaucucagcucacugcaagcuccgccucccggguucaccccauuuuccugccucagccucccgaguagcugggacuacaggugcccgccaccacacccggcuaauuuuuuguauuuuuaguagagacgggguuucaccguguuagccaggaugaucucuaucuccugaccuggugaucugcccgccuuggccucccaaagugcugggauuacaggcgugagccacaaugccuguccaagagcugcuuucuuauuggucaguucuccuucccaugagaguagagaccuggucugugugcuguguguuuauuacuggauuuccacuuuggcacccagaacaguuucuacuccauagcaggcccucuagcacuauuugcagaauagaugauuuaauauuggacaccgggcacagugauggggauacagugaagaagaugauagaugagaucucuacccucagagaacauucuagugaggagauggacaguaauuauguaaacacauaacaaguaaacaggauaaugacagauaguuacagguaaagggaaaggauggggugaggugaaagacuggggguacuacuuuggcuaggaugcccagagaagacuccuuugagaaagugacauuugcacugaguucucaaugaugagaaggguacuguaagcguaaaggcucaggauuggaauugauugacguuaucuagaaauggaaagaauagugaguggcuugagcguauuugagccagaagaggacggugaacaugggguugaagaacaagaugggcuagauugugcagagcugugcucacagucuggggcuacucucagcgcaguuagaguuuuuaaauuucugggguuaugucgguccauuuacccucugaaauguagaguugucuacagagacucacagguuauaccccauuuaugacuuuauuucuggucaaggugaaauaaugaagcagaacauguaagucuguguuuuaaaauugcuauuagcaagugaggaaauggaaguggaggggaggcuuuguacucaguaggaaguuugccagugaguaacagggagcagcaguggaagagggagacagagagaaaggaaaccgacauuauugaauguauugaggccucugcuuguuccuuacuuguauuaucucauuuaauccucacaacagccuguaguacagaaaacuguccccuuccccaaaaaaauguccuugugcuucuccccagaauauguuacauuauguugcaaaagguauuuugcagauuugguuauguugaggauguugagauggggagaguauccuggauacucugucucaaaaaaaaaaaaaaaaaagaagcugauggaggaaugguauuaugauguggggcugcaaaccaaggaaugaggacagcuucuaagaugguauggacaaacaaucucuccuagaaccucuagaaaggaguguagcccuugauuuuagcucagggagacugauuuuggucuucugacuuccagaacuguaagauaauaaaugugcauuguguuaagcccaaguuugugcaaauuuguuauagcacaggaagcaaagaggaaacuaauaccuagugcugugauagagauguuacuggacuugacaguaagaaagcugagguucagagagucugcaugauuccacuggagcugagauguagauccagaacuuuuugagcaccagcauggcacucaaaggaaaauacuacauaauaguauuucaguaggauaugguauaauauauucuaauucuccaaaaaguaaauugcaaaggaacuuuuggaauguaaauuuuuguaaguuuggagacagccaguaaucugguuuuugcccagaauguuuguacuugacaacauuaagauguucuggauguuccagugacgacgacuucuuuuuuuuugagauggagucuugcucuauugcccaagcuggagugcaguggcacgaucucaucucacugcaaccuccaccuucuggguucaaagaauucuccugccucagccuccugaguagcugggauuacaggugcacgccaccacaccuggcuaauuuuuguauuuuuuaguagagacgggguuucgccauguuggccagacuggucuugaacuccugaccucaggugauccgcccgccuuggccucccgaagugcugggauuacaggcaugagccacugggcccggccuguuccagugacuucuaaaaaggucucuggacccuuuuuauuauauuaguaugugcuuagaugaaauauuauugauacuacuuaagcuaaauggauugugauagggaugagagaauuuuaaaauuauuauauggaaauuuugauuggagaggcucuauccuaucucuaacugauucagcauugcucacauuuguugcagugguuuuugcauuacagccaucaacuuuuaaacuugccuauuaggcaccaaccuauaagucuguuuauaaaugucuuaacaguuugcuuucucaacucucuaaguuauuucccuugauuucuuuucagcuaauauucuuuaagcuucuuccaguuucuguacuucucacuugugguugguagcaggaguagugagacagaagaaagaaaaaaagacacaauuuuaggaguauuucacauuguauaagguuucuuugcuucgcaauucuggugaaacgaauaaagaccauauggcauccuaggcaguuuuccuaauguccauuuauucuguaggauuuggcuugggaaacauguuccauaucaguauguaugcaucuaggcaaaggcaaugacaggaaaacugauucuuaggauucgacuuuuacauuuuucaauggaaagucauauacugugcaucaaaauugcccguaaaaauucuaucuaucuaucuaucuaucuaucuaucuaucuaucugucuaucauccaucuaucugucugucugucugucuaucuaucuaucuaucuaucuaucuaucuaucuaucuaucuaucuaucuaucuaucaucucugauagagucuggcucugucgcccaggccagagugcaguggcaugaucuuggcucacugcagccuccaucuccugggcucaagccauccucccaccucagccucccuuguagcugggacuacaagcaugagccaccaugccuggcuaauuuuuguauuuuuuguggagaugggguuucuccauguugcccagggugguucgaacuccugggcucaagcagucugccugccuuggccucccaaagugcugggguuacaggagugagccaccacacccagcuuguauguagucuuuuacaggaucugaaaucugaaaugguccaaaauccaaaacuuuuugagcacaaacauggcacucaaaggaaauacucuuuggagcauuucgcaugugggauuauuggaauagggcugcuuaacugguauaaugcaaguauuccaaaauuuagaaauauucaagauccaaaacacucucuucccaagcauuuuguauaagggauauucaaucuguacgguaaugcuucuuuagaccagcugagcuagacuauaggaagaaagaagagaccguguagaugucugaaaauccagccacucuacguuuaauaacuuucaaaucucuagguguaaauggggaaauggauguugaguuaaauguuccugcuugcuuguagggguuuauuccauucuguuuuuuauguuaaacuuuuauagccuuaauaucugucagucagcuuguuuguuguaaggauuaaaugagauaauuuaugagaaagaucucacaggcccuaccaaguaguaggugcuuaaacauuuguuggauuugaaucuaaaugucacagguggcaucaugguuuacugaucaguuagguucuuccugugcuuuggcauuuuguauaaaauuugaguuuuaaaugcuaaaaauaggagauagcaauuauucuuucuuuucuggguguccucaggaugaacugagugauguuauugauauuaaggauccagauuucaccccugcagcugaacgaagacagaagcgccuggccgcugagcuggccaaguuugauccugaucauuaucugugaguaaugagauuuuugaggauuaaauaauuuacuugacauuuauuuuaaaauuuuugagugucuuuuaaacucugcuagggaugugcauuucggauuccagaaauuauugaugacugaagaccuuaauggacauuugaauuaaccuacaaugguuguaccucuguaaucuuuguaagauguugccucuuauaucucaaguuguucaucuuagcaacagagaacucuucuaacauacuuuuuaguuuuuuucucgccaggcuuaaaaauauaauacugaauucaugagacuauuacacuucuuuuaaguaaacuuuugguugugauuaaugguaugcauaaaugaaaauauguuucaauuucuuuaagaauuuaaauguaccuguaccacauuucuuggcugaucccaggaucuuccuaauaacuuucauccacuagcccuuguaaucagugauauguuuccaaugaacaaauaauuauucuucgugguagagaauaaauagaaucuaauuugaaguuuugcuguauuauuucccacuggcauuaauuguguuuuuggcuauaauguaucuccaucaggcuuaaauuugcauaaagaacuuaucuaauuaacagauagguacaugaugacuugagagauugugauaccucccacuggccaggauagcagcauuucuuccaaggauugucgcuugaccucucuuggacauguggcucugcuaggaugcguggagaaugaggguuuuauguugauguagaccuuaauuauuaauucugggucaagauuuuccaaacuguuacauauauagcuauaaucaucauaucuccuuauauugguauaguaccugcagcuuauaaagugcacucaugugauuauucaguuuucacaacagaugaggagaggaguuuaagggacuugcucaaggucacacuacuacuaaguggcuuggccaagacuugaaaagagucucuccauuugucauuuuguauauccuuuucauguacacuauuucaguuuaacugcuguagcucucgugauuaacauucuaucuccugugacacaguaggauacuaauuggaauggcagggauauaucuugugaugugcaaauggaaugagugauguguaaugauaaaugguugaacuguucaacauccuaagggaaacuggguaagagcaggguauguuacauuuuggaggacaucugagagauucaacuccauuuacacugcuauuucuaauuaccuuuaucucuccaauugugguuuuaaagguccacugaagagcaauuugaagaaacccauuuaaaaucaugcugaauauuuaaaguggaaauuucauugucagcaaauuucucaggcuagcauaaaaacagaaugaacuuuacaagacugaaauuucaagugggagggagcuuaauuagaagaacugccuaucuccucucuucuaaaacuagaagaauaacuauggccugagagaauuaggaaauuggaauuuauaguuagcagugugauauuauaagcagcccuuauuuuucuccaucuucugugugucuuuauccagaagcucauuuucuuuaauacuaugcaugaaauauucuuuccacuucucaaagaacuguucuuacaagaaugguuuaaauuuaguuaugggcuaagugaggagagugggagucaugagguaaagauucuuugugacuuuucugauagcaguaagacuuuggcucaguguaauuuuuguguuacuacucacuauuuauauuagcugacugacucacccaaauguauuaauauuaaaugaaaugcaacuaaaauucuuuuuaauuuuuauuuaaaaauucuuuuuuuuagcucagugcuuuuuuuucuuguuguuagugguuaaaacaguggagaaaaaaaggcucacuuuaaauuacuaucaccaugcagauaauacauugugauauacacauguaauacauaauguauauaauauuagcauaauaauguauauaagauuagcauaauauuaccuauuuguaaguuguuugacuugucuuuacaagucauaguguuuccucauguugucaggauuuggggggcuuuaggaaaaugaauuuuaauuucagccuaagcagaacacggugaagucaguugauuguaaagaaaaauuuauacauuucaaaggcacauauaugauuuuagauuguuauuuaaaagucuuuuauuguaaaaucuggauguuauuuugguauaaucuguuuuuuuuuuuuuggcauguuuugcagcucacuauagugcugggcauguaacagaugauccauaaauguugauuguuuuuuauuauccauuucuuauuuguaauuccuuugggguauuauuuuuacacuaaaauauguugacagcaucuugaagcauuucuuaauagucauuccucacugcuuauuauuauagccaaguauucauacuucucuugcugagaguguuugguuuucuucuucccaaauaguuuucuaauuguuggcauacauuuuacauuaaccaguucauaaaaucuugccuauuucuuugggagaaaacaaaagaauucagucaguauucuaaacaucugugagauaagaaaagggacaaaaaugaucuuauaccauuuguuguaccauuuuaaauugugauaauuuuucauuacucuaaauuugugaaaaaagauguauauuaauuaaguucuuggguuuauugaguagauauuaagacaacaaauaguaauuggauggcugggagcaagaucaccugcuucugagguggcucucaauucaaaacacagaacuugagaaaaagcauuagaauacaauuuuauguaucccuucuuucauuuauguauuuauuuguucaacaaauauuugucugaaugaaguacaugcuaagcagugucauagauaccaaagacaccguggugccuacggcaagaucucaaucucuguguuguccauggggcuuccauuguaguggaggaaguagacacuauuuuuauuguaauuaagugcuaugaagaagaagcguacuaaagggguuuuauuguaaucaagugcuaugaagaagaagcauauugaagagagugacuaggcaucccacugacuugacuccucuguucaacauguccaaaauugaacucauccuuuuacuucuaaagucuuugugaauuuucuaacuugauugaugccccauuuuucacucuauucacccagguuagaaagcggggauucaucuuugccuucuuucuuaucccacacauucaaucaauccugaaguuguaccauuuuucucuguaguauuuuuuuuuuuuuucacuucaucaguuucuggcccucaucugugucugguuuagugcagcacucacuaacugccuaacuggcaucccugcuucuagucuggacuucuucagauccaucaaccaugaaccauuaguaugaugucuuacgugcugaaaaugaaaaucugcuuaacucuguccuuggugcucuucugcuuaaaguaccuaacuccuuugugugucaucgcaauuucucugugaucccgacccugccuaccucuguagcuucacuuuugccacucccugcucacguuuuacaccacagcaauaaugaauguuugcauuuccccaccuauaccacacggcuuuucucucucuuuuuuuugagacagagucuugcucugucgcccaggcuggagugcaguggugcgaucuuggcucaccacagccucugccucccgggguucaagucauucucccgccucagccuccugaguagcuuagauuacaggugugcaccaccaugcccagcuaacuuguauuuuuaauagagaccagaguuucaccauguuggccaggcuggucuugaacuccugaccucaagugauccaccugccuuggccucccaaaguguugggauuacagacaugagccaccacgcccaacccacacugcuucucauauauuuccuuuuaucaugguaucccuuugccauuuauuuccccugaccccacauugccugaauagugguugcuuaucuccucagacuaggcucauuguuucuuccaugcacuugcccuguuagacuggcuuaggaagcccaccucagugcuccccuguuacaguuugucuuguuuuuuaccgcauuguuuuauaauguucuguauuuguguacaugguucuccuuaaauuguggaguccuuaagggcagaagugaguuuuacagaucuucaucuuccugaugaugcacguagagggcauucagugaaugcuuguucaauuagugaccuugaaagucuugaaaaaggcggggcaugguggcucacgccuguaaucccagcacuuugggaggcugagggggugggucaugaggucaggagauugagaccauccuggcuaacauggugaaaccccaucucuacuaaaaauacaaaaaaauuagcugggcaugguggcgggcgccuguaguccccgcuacuugggaggcugaggcaggagaauggcgugaacccaggaggcggagcuugcagugagccgagauugcgccacugcacuccagccugggcaacagagugagacucugucucaaaaaaaaaaaaaaaaaaagucuugaaaaaaaauugagaucucagaugaaaaaacagacaaaacuugaaaguaauuuauuaugaaaaguaaaacauuagucaccgucagcgcuuguucaugaaacucuuaauucauggacaauucaagcauagaccacaguucagauuacuaggacuguauuagugaaauuuuacucaaaauaaucaaacauuuuggagguguuuuugguggggagggggauggaggugguagaaauaccauguuaccaagccaguuuucuuuuucccuucaucauggucccuuggggaggaaaacagcaucuuuucaguuaggcuccuuuacucuugccuuugguguccucugcgcugugguguccaaggcccuuuucucucacugugccaguucuuccugggcaauuuuauccucuucuugguuuaaaugcuuaugacucucauaucucugucuugagcaucagacuuguauguccaccuaccuauuggaugggucuguuuguaaauccuaaaaaaaggcaugucauacucaaccuaucccaagcaggagucguuauuucucacucaugucuguuagcuucccugucucaacgaaggacacuguuguccacugaguuguggaggccagaauucucagugucauuuuucacuccucgagcucuucauucccuacaaccugaggguucugucaucuacguauaggucagauucauccacuuuucuccauguccacugccacucucuuauccuaggccaccauuaugucugcuucuccagguuucucccuuuaaaucauuuuccaggcugcaauaagagugauguuucuaaaccaugcuaaugucauuccccuauguaaaaagcuuuuaaguguuuaguugguagggauaaucuuugagauuuuuuaaacauggcuuacaaggugguugccacuauauuauguucagcuucuuucaacuuuuuuucccuuaaaugugccuucuuguuuucuagccuucgccaaccaguuuuucauuacagaauacucugucccacccccuucaucugguuaacuguucauuaucauucaaccauugguuuagguauuauauccuccaggguccuugccugucauucuaauuuauuuugcccuagaauccuguacugcugauaugucauagcauuuugcuauauuguaauugcuugacucucccaugggauuguaaguugugugagggccaggacugucugugucuugucaugaauggaacuccagugccuaacauggaucauggaacaugggacaaugucaguacuuucuguugaaugaaugacuuauuuagcauuuuagccauuuauuguuauuguuuaucccuuugaaauucauauccuagaaaaaagcucacguucugauuuguggaugaguuuauaguagaacuucaauucaaaagaguuccuucacuuuaaggagaaagagauagcuaauaagaaaauaggcuuagcaggauuaguuuaugaagcagcuauuuuguccuugucucauaugucugugcaccuguuggaaauuguuauugagaauuccuauuucaagauauuagcuguucaguuuugucuaauauguacuuuauuuccucauauauaaaaauggaauauuuauguugguuaagagcuuggagucugaaguaagaguucaguaugucuacauccuagcuaugguuuuuacuuguucucugaacuuggccaagauacaaaacuuuucugagccucaguuucuaccuuuguaaaaugaggauauugauaguaccccaugccuauagugauggugugaggauucaaggaaauaauggaugcaaagcuuuuagugcggugccuggaacauacaaagaacuccguaaguugucugugaucuuucuaauuuuuaagugauuucaguaucucaguugaaagggaaggcuguggaaaacuaucaguuagaaacugauauaagauuauaguuuacaacuauaagguuguaaaacuaucaguuagaaaauucaguguaucaaagcaaccaauuccuugaguuucuaguuaacuaaaauauaaauaaaauuuucaccaugaguuauaccuuguuaaugcuuuucccaagaauaccaauuuccaacuuugaaugcaagauagaaucauuucugaauaaguguccuccaagagugagagguguauuuugaauguggcuguuauuuuucuaguuaaaacaggaauguagagugcaggaaaauuagcuuucuguucucuacaaauguugcuuuuaucuucuucaguaguuuaaggaacuuuaaaauuaguaucuuaauaaaauagauuuuaucuugguagaaaauaugagugcacaugccaaaaaugguguguguguguguguguguguguguguguguguguguagccccuuuuagccucuuuguggagaugcaguauccugaauuuccuacucaucugcuuguuuuucuuugcugguugaguucaaaaauuuuuuccuuuauugaaauuuuacuaaagucuguaguacuugcauaccuagcacaagugcuagauuucaguccaaugugucuucagauuugcuucauuucacaucaucgaauaugggaugggacuucaggguaggaccagucuucuauguaccuucuauuuaaagagaucagagguuggacacagugggucaagccuguaaucccaucacacuuugggaggcugcggugggagggucacuugaggccgagaguuuaagaccugucugggcaaggaagcaagacccuguuucuaugaaaaaauagaaauuagccaggcacaguagcaugugccuauagucauagcuacuugagaggcugagacaggaggauugcuugaccccaggaguuugaggcugcagugagcugugauuauguuacuacuguacucuagccugaaugacagagugagacccaucucuuuuaaaaaaaguuaaaaaaaaaaaaaaaagagaucagcaauguuauauaucccuuuaggcagauacuuacuuuuguuuuaugguaaauaacuuauguuugugguuaguaacuacaaagaaaguaaauauaguguucagucuuuccuugaaauguacuuugaauuaaaaucuguauuucuaguacaaauaugaguuaagauaaaauguuaaaaaguaaaagccagugaaauccuguauaguaaguucuuucaauguuuuuuccuagagcugacuuuuuugaagaugaggcgauugaacagauuuugaaguauaauccuugguggacugacaaauauucaaaaaugauggccuuuuuggaaaagagucaggaacaagaaaaucaugcuacauuagguaagaaacucaaauucggcuaauuuguuucauuuuaaaaucucaugguguaccacguuuacugccuuccauauuauuaagcguauaguuguaauugccuuauaauguuaaaauaugaguuugaauugcuaauuuuggaaaugacuucuuugccccugacuggaaaaugccgcuaaauaauuaggcuuauuuguguuggaaaauucuuuugaaguaugguuuccuuuagaaucauuggaguucuuuuauaauuaauuauuuuuuaaaaccuaaauuuagggauauuaucacacaggacauuuguaguuucucaauaaccugcuuaagagguaugaacauucuucuuugguaaggacauuugaguauuaguaacgggcggggggaagacccaagugggaaaagaccuagauggacauguuauuaccagcuucucuaagugcaguguagcauugauauauuaagacuauacauuagaaauauaacauuugcagacagaucaagaagagaacacccauguuuucugucacacugauuuggcuuuuauuuacauauuaaaaauaaaauuucaauguuuaaauggaaagaauacauauauauguacauucugaagaguauuaaauggaauauagacucuucccaccccaaguucuucuucccggaaguaaucacuauuagcaauuuuggggauauuuuaaaaauauauauucccacaucuaaacagucgcuuuaagaaaugucuacacauagacucacguauacccgguuuguaccuuguuuucaauuuguaguguguguugcacaucuuccauauuaguauguagagaucuaccugaagcuuuucaugauuacauaguauccgguuggauauuuuuuucaugauugauggauauuugggcuguuuacuacugguggacauuugggugacuuccuguuuucugcaguugcaaauaguauauauaguggccuucuuugaccacucauucugaaguagcuacagggucucuaaugcaucacaguuuuuuauuuucugcauaucaaugcaauagccuguuaucugcuauuuuuucagugucuaguauagugccuguuauauaaagguacucaguaaauaucuauaaauauuguaauaaauguuuuuaugguuaaguuuuauuaaaguuuaggugaguucuaccagaucaaaaaauugcuacuauaauauuuuagaaaauagaggauuagcuuuauugcauaacagaagcucauuauagugacucuuuuuuuuuuuuuuuuuuugagacggagucuugcucugucgcccaggcuggagugcaguggcacaaugucggcuuacugcaagcucugccucccgguuucacgccauucuccuaccucagccucccaaguagcugggacuacaggcaccggccaccgcgccuggcuaauuuuuuguguuuuuacuagagacgggguuucacccuguuagccaggauggucucgaucuccugaccuugugauccgccagccucggccucccaaagugcugggauuacaggugugagcucccgcgcccggccuauagugacucuuuguuauagauuuauugucguuuucaacaaauccugacuuuuauauuugaguuuaagcagcuuucagagacuucucacauuauguauauauagacaaauuuucagguuuaggauugcuaacagaauauagauaguuaauuguacaugcuagguagaucugaucaugaaguuugaacaaacuuaaaucaucaagugugucaacugguuugagucaguuucccuaauuuuagcacgguauuuuaaugagguggugugggagaaaauugaugguugcguaguugaguuuucuguccaccagggugagcuaguugcccuaaaaaucaagagaaggcguucccuuugauuuaaauucuaacuugcucuacuuugauaaacuguagcuuguucucaguccaguuuucugugucagcaaugcucuuagucuucuuuguguaauuuuagcaggagaucaagccacucaguccuuuuaaccaccugcccuccugacccuucaucugacccaugacugauagccaggcuggugcaucaggaacagucauagucugcaaagccauuauggugauucauucuaaaaaccaccuuuaaaaauagcaaggacaugugaucuaagguagacgaacuugagcuuugugucgaacagcgugucucuucuaauaauaccaaauguaagauauaaacuaaauguaggcuugggguuggacuucuuguuccaccacaugccugcgauaugaucuugcaccuuuggguugcuguggaaugcuguaccuaccucagaguuguccugagauugaaugaaacgauguauuuaaaauccuguaaauguuagaaauuauuauuguagaguaaaaucagucacaggagagccaggaguuggaugguuucucugugaaauuacaauuuuuauacauuuagaaagcuuuaagggaaaguuccuuguuaacaagauuucucucucauuugaaaaauccugguucaaauauuuggggcacucagaauuggaggaauaaauugaaguguguugagccaggauaaaauaugggggaaaagaaauaaaccaagaaauaaacaucacaguuuucugcugaacuauggugcaugcugcuguaccuuuucuccucuuccucuuuguucuuugccucucuggccuucuuccucuuugugucauagcgugggcuguugucuguuuaacaccuccucaucaggugucgccaggcagauacaacagugcaggugagggguguaccuuugauucauucuguaucauaaaauauuaaccuagauugcuuugaauuccagauaagccuuagguggugaacuuugcucccucuuuuucucccuugguuguaauucuugucguuuucaucacagcccugaguuacaacagggagacuuuucuccagcuuuguagugauccagauuuuccuccccaaaggcuuguaaauggaaguguuaaacgccgugcuuccccugagcucugguuucaugaggaugaacucaccgcauuucccauguugucuuucagugguuaaucugaagcuccagagucuuggcacguuauugcuuguuaugacaccacguaacauuuauagucaaugaacuuccuagcagggacauccuguuuggcaccagugagcccuucaguguuuguagagauaacugucagugucaacuuugaaaguuguagcacugcagggcuacccauuuaggcugaagguuugaaugcagcacaauuuuuucugguucccuugaucugguuccagugaauguacaauguaauagacagaugugcguuacucugagagcauugagauccuuugugauuuaauuguugacccagauaagagggauguuugggagggggauuuagagaggaagggaggauuuaaaaguaacaaaauuagaaaauauuuggaagagaaaagugacuaccuugcagacaucuuucauuuugauagucccuuugcagccuucagacauauuggugggguuuuugauguugggaggugguccuuggccauuugcuucaaugcuagggcaccaguuuccuccucaaauguauugagaguucagcugacuuuuguuucacuggagauuauuuuuaaaaguauaauuagccaaaacauugugaacuauauagcaaagcugcuuuguaguguagcuaagucauacaaaugcuugacaaauguuauucaugguggcaaucauccaagcauuguuggcacugcaucuguaguuauuuccaguacugcugcuagguuagacuugauugugugcaaacuucccccaaguuccccuuugggugauaugauuuacagcucuaauaaaaaaggccuuagggagcucagacuuuugguuucucuagugauuuccugguuuguuguuauuguuauuuaucaucucugauuucuuugcuugaauuucagaauuuaaaugcauuuguguguuauuaaugaaguaggccacaguggaacuuauaaaugcucaguaaaagguggaaguguuuuagggaaagucuagcagcuccuaguauccaagaauucagaagaauaauucaaguagguuuuucuucugugcacaguuauugaaaaugacuaauguagaaauacuuacauguggauaauguaacgucagaaccuacauugccuaggucaacuuuuauaaauggauaaacgucgauagguaugauuacuuaaaaaugaaggcauaaauauguagagaguugacauguugcuaaauaguuucugggcaugcuuacuuugugauugagaauuaugugggagcaggggucuauuagucaacuaggauauaaagacuuuucucuagucagagaucaugaacaccuggcauuuucccauuagcuaaauuaaugaacaucucaaaaaccauaccuaagggaauacugucucuaaccuucuugcuaaauacaaggagucauaaaauauuuugucagguaugcuuucuuccugcagugaguauaugccuucaugccauuuccuuaaaucaaauugcuuaaaaugaacugagagcuuuuauuuaaauuaaggaacuucagaugcguccuccaaugaggcagucaacacucaguuuaucugucuuauuaauuaaauccaguaaauuuuaaauuaaauacaguugacccuugaacaaaacauguuugaaaugcauaggucugcuuauauggggauuuucuuuugccucugccaccccugagauagcaaaaccaacccuuccucuuccucuuauuccucagccuacucaauaugaagaccaggaugaggaccuuuguuuaugaugcuguaccuccacuuaauggauaauaaauuuaaucuuaaagagacuucauguacaauucaaggauuggggaaaccuuaacuaaagcuauaaauccagaaucuugucuuaaaaaaaaaauggacauauuugacuacaugaaaaauaaguguuucaauggcaaaagguaccauaaacaaagucaguagagauaugguagcuuuggaaagaugauuaggguuuauaucuauaauauacaggauucuuaauuugacaagacaagccauccaauagaaaaaaacuggacaaaacacauucgaaugggucacucauaagagugcaaauccagauugccuacaaaccaaggaacuagugcuuaaaguugagcaauuggagaaauacuaagugaaauaacaaugauaagucacuguuuuaguuuucucuugcugcauaacaaauuaucacaagcuucacacaguguacauucaugaucucaguuuccaugagucagaaguugggccaggcuuagcuggguccacuguguaaggucuugcaaggcuguagccaaagauauccaucuuauuuuuuuaaaaaacagauguuggaggcuguguucuuuccuggagcucaaggucuucuuccaaucucacaugauuguuggcagaauuuaguuccuugcagauauagaacugaggccccuacuuuguugcuggcuguuagcugggggccacucuuagaucuuagaggccucuacaggucccugccacauagccuucucacaggcucucucacuucaccaugugacaucuuauuucuucaaaacuagcaggcgagucccuggcuuuggucugcuaauaauggaauauaaucauggaaaugacugucccauugccuuggucguauucuguuggacagaagcaggucacaagcuccauccccacauaaugauaugacucauuggaagucaucuuagaauucugccuacuauacucaauuuauuaaccuggaaaugauuguaaaaaagcuauuacauuucuugccagggggaggugggagguauguguaggaagaggaacuucuauucaugacugugagaaaggagaguuauuguagccuuuaaguaaagugucuuucuaaaacagauacuuuuuuaacccagucaauacagucucgagagucuacuuuauggaaauaaagccucuaauaaucaaggacauaggauaaggauauuuauugcagcauuauuagcaguggcagaaaacuagaagcaaagugagugcccaucaguagggggagugauuggacagagcaugguacauuuuggaauauuauacuccuuuacaaaaauuaguuacacaccaguugacuuuuagggauuugccagagguauuguugagugagaagggcuagauggagaaaaaugaccuaguuauuuggguugagggaggguguaggaaguauaaacucccuaguagguaugcuugugugucuguaugugauuacaugucuagagaaaacuauggaaugguauauacuagauuuucagugugugagaggcuguugacgaauauucaggaggcgagaaggugccaagcagaagaagaaaagcaaaaaggaacuguguuguaaagaaacaaucuuuucccacaagucuaacguaugugauguggucauauguaaaacuugauuuauaugguaaacaauaugagauuuuaauggauuaauuugaauugaaauuuaaucuaauuaaauuaaauuuaaauuuaacaauuuuaauugauuaauaucugggaguauuccuauuucuugguauagaacuuucaaaauggauaacgaauauuuucagugugcuuuauuuagcacuuucuguugucaaaauguauuaucuuaauuuuaaagacaguaacuggcauucagacgucuuaaguacagaacaguguagcaaaaaagggagggucaggaauuaaggaauagguauuauuuagaaaaaucuucuuuauucagcccuauuagaauuugagcagacucauagcucuuacuaaaacugugaagucuacuuaaguuauuuauauauccauaguuaaguagaaagaacuuuuauuucaguuucuauaaucaaaguucuaauuuugacaaaucuuccauugggaguuuuacaaaacugaaugaaacaucuaguuuuuaaaugcguuuucuucuagugucuuuuucugaagaagagaaguaucagcuacgaaaauuugucaauaaaucuuaucugcuggacaagagagccugucgucaagugugcuacaguuugauugauauccuucuggcauauugcuaugaaacccgugucacugaaggagagaagaauguaagugcauguaugugugcauguugccauagaugacugugcugaguaaacugcauuaaagcaucagucuuucuugucuagaguagaacugguggugaucaguuauucaggggaugcccccagcagaguugcauguguguggugguggugguggguacccacaugcaaucauacauuacuuaguuggucuuuuucacuuuucucuuggcauuagucucugcaaaaauagcagaguagggaaguuuaagggagugaaacugagaguagagaggaaggcuacucugagcucucaucucuuuuaggccagagaagugcucugucacaugacacuucacauuggcaaggggguaaacugccauacccauuuauauucuuucucucagccagaagucagcagaugcaaaauauggcauuuuacaaaauagagaaaucuuaguauuuaccugcaagugucccucaauucauagaguauguguacucugaaaaauuauauguaaaucagauuuuuuaaaaccugaauuauaucuuuuuuugcuauuuaaagggaucauauuauaaaaguaaauccuuuuguaaauuauuucuucaucuuuuaaaaaauaauauagacuuuguuguaucucuucuuaaaccauauuugauuuuguaaaugaagagcuaaacuuccuuuucaccuguaccauugauuguauauuuaaaaaggcuggaaaccaaaaaaaacagccuuucuaguuaguguggcccugcagcuguuuauaauuguccuugcucaaaagguuauuuuugaucugagcauagcuuuccuuuuuugaauuacacaaauaauucacauaugaaggaaaauauacacaugaagaaaauaauuaagauuuccuguaauuucagucaucagaaauauaaccgcuguuacauggugauguaucuauuuccaaucuucuuucagugugcgcgugugucuauauuguguguauuuaccuuagguccuaacguguauacuauuuaaccugcuuuuuucacuugacauuauagcacuaggaugguauuagaguuagaauuuucuauguaccaauuuuuuuuguugucaugauucugaaaauuucuagggugccucuugacauuugugucugacuccaagaugacuauuaauuuaguguguuaagggcauaauauaucugaaaauacuuuuuguuuucacucgucuuuuaaagauacuguaauuggagaaaauguuuucuuugaccaaaaaaugcuucauauuaaaucuugaaaagaugaguguuuagguauauuugaaaaaauuuaccauuuuuuauucuuguauuuguguauuugaaaucaugaagucuuacaacuugagaccuucucuagcauuuacuuauucucaccagcauucucugaaagaucaaauuuucuagcagcuucuuaagugccacagguaauacuucaacauuaucuuugauuccuuugauagauuauuuauggauuguuugggaggcauguaacuuaguggaaaaaggacagaaauugagcagggauuacuuugcuuuaacuuuuaguuucaaaaccccugguuguuugcucuuguguucugguacucuuaucaguagaaaaguuuuauuuucgaaaaucccaaggagaguaaacagaaacuucccacugguagucucuguaucagcaaaauaauuauuuuucuauagucgugaacacuucuuaguucucauaugucagugauccucagacacugguugaauaaauggauuuguuuggucuauuuaaaugacuucaccucuaaugugaugguauucuuuucuccaaaacaaauaaagguugaaucugcauggaauaucaggaaacugaguccaacacuaugcugguuugagguaugauuuccaguugcaauuguuuagaauuuguuguucaggaaguuauuuuuguuguuuuuacaucauuugggguaauucaagcaauuccuugaauuuuuaaaaguagaagcucuauuguacaaguauguuuuccaucuuuuuaauaaaauucugauaaugaaccagguagaguacuuuggaagcugggggagggaaacacacuuuggagagaggauggagacaugguuuguugggaaagaaugugggggcagagugagagguguguuuguaaguuggcauguauuggagcuugaaacucagagauggaagcaaaccuaggugauaagugacugucagggucuaugcuaagaacacacacacacacacgaaaaauaauguuuuuuauaugauuuuuuauauauauguguauauguaaaaaaacuucaccuauucucaguaugucugugagguaaguauugcagguuuuacaggugaggauccuuagaucauauagcuuaaaucucuuaucuuagguccuacaauucaaauguagucugguuacauuugauaacucuuuuaguauaguaauaauguuucugguuucugaaaaauaguugugcaggucucaccaaaaauaccaaagauaauaucuuuaaauuugugaguuuuuaacaaacuugugcaucaaaacaguaauuaaaagcagaaacuuuaaaaaaguaucgagauuauaucaucaguuaaaacaaccaguauuuuuuaagcuguaaaaucaagguuauuucauugacgucacuuuguugaaauaauagguaagauguaaacaggaacugaaacacuuacuucauauagaaucuuacuacuccaaaaaugauucaaggaccaacaaccugaccagcagcuucagcugggagcucauuagaaagacagaauuucagucccaccucacacucacugaaucagaaccaggauuuguagcaagaucucuacggaguuuguaugcauauugaagacaaaaagugcugcucucuaggcuucauuggaguuccucauguugccaugaucagcauauaauagaggaaucgguuucuguguuagcauuuauuaauauguugaaaguaguuggugacuggauaauuuuguaguauaguuauuaaaaaucuacaugaaaauucaccuauuuaugauuuuuaaguuccuaauucucuuuaaauuaugucaaauacuaaguguucuuaaucagauuccucauaguuuuaaggauuaauguacauguaaauuaucuuucucccuugguuuuaauuuuaaauuuuacauaugguuuacauuuuuuauacuuuguuuaucaaaaaacaauuuuguggaaauuuucuuuuguuuaguguuuuuaguaaguuuugaauugcuaauguuaucaguuugauaccguucaagauacaacaccuuuuuuccuagaaaucaguuugauaagcaaaagcaaauuacucaaguaaaugucuuguauuacccauguccagugcaaaaaaaaaaaaaaaaagaaaaagaggagaggaaacugaacauacuuuacuaaagaguucuauguauuuuuuuuuuuuuuuuuuuuugagauggugucucgcucugucaccuaggcuggagugcaguggcgcgaucuuggcucacugcaagcuccgccuccuggguucacgccauucuccugccucagcuucccgaguagcugggacuacaggcaccugccaccacgcccggcuaauuuuguaguuuuaguagagacgggguuucaucguguuagccaggguggucucgaucuccuggccuugugguccgcccgucggccucccaaagugcugagaucacaggcaugagccaccgcacccggccuuuuuuuuuuuuuuuuuugagauggagucucacucuauuguccaggcuggagugcaguagcgccaucuugacucacugcagccucugccucccaggaucgagcuauucucugcuucacccucuugaguagcugggauuacaggugccugucaccacaccuggcuaauuuuuguauuuuuaguagagacgggguuuugccauguuggccagggaggucucgaacuccugaccucaggugauccacccgccuggagucccaaagugcuuuacaggcaugagccaccacucccggugaguucuacauuuuugaucugugccaucuugaauagccuuagcugacaaaaacaugaaauguaaauuauauuaaaauguccuuuaugugcaucuguauuuuguuaaugccauguguuuuagauucuuauuuguaaucuuuaggacuuuauuuaaaagcuuucuugugacauuugugauguauugauagugugagaaauuacaaaaacuaagauucuguuuuauuguaaaguauacaaaaagaaucuuauuucaugguuuuauguuucucuucuacuuggcuucacaaugauccgaacuugcagcuuuuaaaugagaaaagcuuccuauuucauuguguacuuuuguuuguguaacauuuuguggaaaugacugcuuauuaaaaugacacuucacagacuuggacuaacguucaugauaucauggugucuuuuggaagaaggguguuguguuacccacucuaucgccauuucaagcuggugaugaaggccuacagggacacuauaaagauauugcaacuggguaagauauuacuguacuugcaaauuugggagggaaaaaguuguaaguuuuuagucugugaagauauaauaaugauuuuugcuuuuuuacuguauauaaauaaguaaugaaaaaugaauccaaccacuuuuaaaguauagaauuccuguguauaagacauauguagauaaguaauugcauagaggcauaauaaagacucuuuuccgagaggaguaaggaagguaaacagagaaggcacacauaguauugcaaaccguuuuacauuauaauagcugcaucauucaguauuucuuggcugccuauaaucuucuaggcucuauggugggacugugggucuaauaauaaagaaggcagaaaaguucccugcucuguugaaguuuacaguuuugucagacagaugauggguaaguuagcaauuccaaagagagugaaaaguacucugcugggagaaguccagggaucguuuaggaggggacauguaaccuagauucggcaugucaagaaagauuuuccaacaaaaagcucagcuacucugagcacuuuugacuugcuaaauucaaccugaaaagacaaacacucguuagcuuuaaggauguggaaaauucugggcucugaaacaaauuccaaagugcccauaguaucaucauuagaauaaguauauaauuuccaagauaaugacuuugaagggggcaacauccauuuguauguauuaguucuggcacauuuauuuaaaagucacuuuuaguacuuuauggucauuucuuauauucucccccuggggagacucaucauuccuuugcccuuagauaaaaguguuucugggagcuugguuuucagacuucagaauaagaaggggaaagaaaggaaguucuuccuucuaccuccaggugacuucacuggccuaaagaagagaaucacaucucaaauguuuugucucaccuggaaguguacuucgcuuucuguguaaccuguagucuucuugcccuggugguggggaugggggaagaaaaucauguuugaaauagauuauuuuaaaguagacaguaauuguaaaaaugaaucaugguuagaugaaagaugccuuuuuauucauccaguugguuuagacuagcuguauuuuauuuugaaggauuguugauuauaggaugaaagagcuaucauugagaaaucuaucuucuuuaacuuaacagugggaaacaaacugcuuuguuuuuucauguguuauuucuucuugccuuccaucuaagauauuuuuugaauugcuaaaaguaccuuggaaaaucaaucuacuauaaaugacugugugagccucaguuacacgucacaauucauuucuuuuuuaagucaugcuagauuaucugggcauuauucauggacuuaaaccagugagaaugcaguuugcgauuauccuguuauaucauggcuuccagauggagaauuggcaaaaccuccacaugccuguuugcacacacacucacacacucucacucucacucacauauacagacuauugcuuguuacuuuuuauucugggaaguaaucuaguucuuuugacuuucauuggaaaaguaaucaguacuaugauugcauaaccaaaaauaaauucgauugccuugacuuacacaggaaucaauuacccaguuuuaguaggucagaauugaaauugagacuuaauuuuuauucauuaucacucugacaagaaauaguuuuaucagcuguguuaugauaguaacauaaaacuugaaguaacacacuggaggccucugcuaaaaaugaaccugaacccucuauguaccauguacaguguguucugugacuaauuuggguuguggcuaguuagugcuaaaacugagggcuggguugucuagaauuugugccagaagcuguagagaugacauguucuggaugagaaucgucaccugucuuuguacagguggauggcacggggaugccauuauugccgcugaagaggcucauuuguuugaacaccccauaauuuaaauaaagguagcucugguuuggcauuuaguguuuuccaagaaugaauucaugccuacuuauaauucaaaaugcagucaguguucacacuuuuuauuauaaaggucaguauaguguuccauaguugaaaguaaugaauaacccuggcuccaaagaaggauugaucuuaaauggaaugagcuuucaaaaccaauguaggaaugcuucagaaacuacagaauauuucauuauaacugauugacuaagaucugaguuuucaaagagccaggaauuugccucaugugacuucacaguagccuuuacaaggauucuuuacuaggccuuuggcucuuuucagguuugcauuucuucucauucccuccccuccuccagaagacuguauguuuaucucuggagguugcuguucuguuuaauccaaacucuuuaagggcaggaaauccugcuuugccccuuaaguacuguuuuagugcuuaacaaaggaccuugcucuccuuggaucagucaucuuggggcacaugacuccuuuuuuuuccccugucucugucucuucaacuuuuauugccucuguuccauucuuuuuggaagaauggguaaaguuuuucaugggagcaucacuuaguugcuguuagucaauuaaaaauaaaaguaaaagagaaaaagcagauuuucuaauguaucuucagaagaguuauucuuuuuuuuuuuuuuuccuuuggacagaauuuugcucuguugcccaaggcuggaguacaguggcgcgaucuugacucacugcaaccuccgcuuccuggguucaagaaauucucaugccccagccucccaaguagcugggauuacagacaugcaccaccacgccuggcuaauauuuguauguuuaggagaggcgggguuuugccguguugaccaggcuggucuggaacuccuggccucaagugaucugccugccuuggcuucccaaagugcugggauuacaggugugagccaccgcaccuggcccacucagaagaguuauucauuuuagaagugacaagucauaguuuaauacuugaucauacguuauuuauguaauuuagugaguguauugucuacaucuuauuaauguauagaagguauuccuuacuuuacuuccauuagaaggguaggaugggaugggauggaagagaaacaucaacuuaauuuuugcuuucacuuccgccuuugagcucauucuguggguucuuuuuuuuuccuucuucuuggauggaauauauauccuauauauaucauaucauauauuugucuccuauaauauauauccuauaacuuuuucuaucacuuuagauuuuaaaaaaguucuuuuaccacuucuagucacaagaggagucuaauuucagugcuuaaaauguccacuuugaacuucauuacaaaagaaauucuucccuuccccagcugggaccugccugagggugggugaccagcggcagggaggaggaccccuuucacuuuggcaggacauaccacuuaccuccacuuggccaccccauguugcucuguccugcuucuuaauggaagccagacaccaaucuuuguacucuccaguugguaucuacgguuaaaauuuccaggguaagcagguuguacucucuuagggccucuuaaaacccccuuucucuugguuuaagguaacagaaaagcaccuccuuccugcacccacaccaccuuuauccauggacauuuuuucuggaccucuuuacucuuaagcuccugaaggugaauauucagugaaugaauuacaaaucauuuuuaguuucucucucuacaaguucagcauagagagguuagcaucucuuuaaaauaaagggauacuugauaccaguuauuuucuuugugagccucauuagaaaagagucagaguucuguccugauguguuaauaauacauacagguggauggcacagggaugccauuauugccacugaagaggcucguuuguucggacaccccauaauuuaaauagagguagcucugguuuggcuaguuuguuaauaauaaccacagcugcguguguuagcuaccuucugugugccagcgcuagguucaguucuuuagauaccauaucucauuuugcucauauugcaguccugugaagcaggcauuacuauccccauuuugcaaauagaagacaggcucaaagaagugaagucaguggcccagggucuuacagcuaguaggugggagagccuagauuugacuccagaucuguguaacuuagagucugugcacuuacauauauugaaauaguuauaaaugaaauuauaugaagccuggaauuugcuucaaaauaguccagaguggguugugggaaagugggugggguguagcugaaacaagguuggcuacaaguugauugcugccugggugaugaguaugugggauucaugauacugucuucccuauuuuuguacauguugugauuuuccuuuagacaaagucuuuuuuuuuccuuaagucuggacucuuaaccaccauacuaccaaguuucaaauuugaauuuauccaccauuuuguggaaaacaugauuucuauuaauauuuggacaguuuucuaaauuuuuuuggcuaagaaaaacguauacaauuguucuuucuauuugcuguuuuguuuuuaagguuaauagaaaccuacuuucuaauaacaugugaagucugaugaauaguagcuaccuagcagguaguaacccaagaaacagccuucaggaguuuaguuguuguccccaauuaaaaccagguauuacuucagguaauuaauagcccuuacuuaucaauuauuaauugggcucaauaaacaaauuuucagaaauuacugcuuuacuaaccucuuccauagauaaaauaacacaaucaaugagaaaggaaagaagagcuaugguaccaagcacagggcuugugacugaucaauuuuuuaaaagaauaauggauguuuaaaacauugagguuuggcaaguguauuguaugagcuccaaguuuggaggagacuuuaaaggugaauuucuuuuuaauauuuacauuuuauuuauuccagagucaguuuagcaaaugacuuuuaaaaaaauugaauuguagaggagauauugcaaacucgaaaacuaaaagaugaaaucacugccauuuuccaguguugacauuuaucuauauuuaacuucuguaaguucccaguucuggacauuuuaaagaauuguuaggccuuuuaauuuuuacucuuuaaauacauuguaugaaacuauuuugagauuuauucaacaaguauuuguugagaaccugccaugugaggcugcugagcuggauccugaagauauaauaguucuaaugggggcacagggcacagaauuacacaacuaccaggguuuuugaaaaauugcauuuguaauaaguagcucaaaagagaaauauggagagugaaaauauaagccagggaaacugaccuacauuuaagucacugaagacauguaacuuccuacugugggagccucugccuuauuugaccucuaauucucagcuccuacuaguuuccuaacacccucaaguacuuguuaauugcuugaugaguucauuuauucauugauuuguucaacacauauuuugaauguaugccuacucaggagccaguccauacaaagcacccuguaaauauaaagagcacuagaaaaauaauuuagaugugugggcuguauuuggggacguguucacuagccggggagcguguucacuaccuagggagcuaagauguccaucaguaacauaaaauauauagucagccgugguaagugccuuacaagaaauguggauuaaguaguucaaaaaagagagagacgacacauuucacuaggggucagggaaauuuucauagaggcugugagauuugaauugggacuugaaggauggagggaauguuguaaacauugugaguaaaccaugugaggagguucaugggauaguguaguuucugcuaugaaaauguguuuguuggaauuagaugauggaaaaucgauaugcuaucugaugcugagauuugcucuacagccucuaaaacuaguugauaguuucuuuccuaucugaguuaacuggucacuggaauuuaugucucuacuuuuuaaauauuauugcuuaauucccugcuccucacccgggagauuguaauuccuuguguuuucuuccuccuauucuaaauuguucuugaacuuuuuuuuucuggcuuaauuccccauaccaguuaauguuucuaagaauagaacaaucauagugcucucagaaacuagcauggaauuaaagucagauacugaaguagcauuuguaccuguuuuugcugaccauuuuacauaccaacuuaucgaagaaaggagagaacuucagaguacagcaggaguuaacuccuggaaaucaugaacugcugcugaauguuugaaagggagaacuccggauucuccuuccaugaggcaaagugaauucuuuuuacucuugucucuuccuuggaguacaagucuauguucccagucuccuaaauuaguacauucuucccauucauauguauuauuuaaccucagagcauuugcggguuuauacuuauaacucuguauagaaggauauuauauauaaacguaaacauuaaaggaaagaauaucaaguucuagucaucuccauagaaucucuuucccccuaauacuucuaaauauuguuaaucaccgaaaauguuuagauugcucucaugguaauuucuggguuacauuuguauaaaacauucuugguucucuuaaaauacaccauagagggaagcauuucccauauggcuuacaaauaauaaauugccuuuuaauugccacaaaugaugaauagcuugugguuauuuggcuucaaaaauaucacuuaaaauauuuuaaaauguuaguauucuuugaaaacuggaguuauauagaaaugcuuacugaugggugauggcuucaagucagcugaccucuuaaauauuacauacaauuuaaaucuacacuauauuuucuguacuauuuauuuuuguuaauuucagcaguuucugagcugagcaguguagaaaucccuagaacuuaguuacaugguuugaauguauggcuuaaaaaaaacuucuauaauuagugccucuuuaaauaaauuuaaagucaguuuugagauuauuuuuauggaucugaauuuuuauggaaguaacuuucuauaagaaaauagcagcagaaaauuguauguauuuaagacaacuuugggggaacaaagagaaaaccuucuauuugacccuagugaaucaaaguccuauuguauauuaauacugaggccuugaugaagugaauugaauaauacuuuauguuuuaccaggaauacauguaagaauuacaauuauguaccacauaacgacuuucagucagugauggaccacauguacaacaguggucccauaacauuguaauacugugauauuacugugucuuuauuuucuuauuaauuuuuuuuuguuuuucuuuuaaucagaaaagagcugaaguauacuguaucuuuucuaugcuuagauauguuuagauacaaaaauacuuagcauuguguuacaauugcuuacagcauucaggacagucauaugcuauacuggcuauaccauagccuagguguguaguggacucuaccaucuagguuuguguaaguacauucugugacguucacaugacagaauuaccuaaugacgcauuucucagaacauauccaaaucauuaagcaacaccugauuauguauauauuuagguaauuuagaguuucauuuauuuuuuagggacaaggucucacucugucacucagccugggguacaguauggcauaaucauggcucauugcaacuucaaacucuugggcucaagcuauccuccugccucagccucccaaagugcugguugacaggugugagccaccauaucccaacuuaaaguuucuuuaaguaagaaguuaauguuggaaaauaacaaguggcagauauuuauuuauucagcagacaugaaucaaaucuauucuccgugcaagggaguauaacagaauuggugaagaguuacaaggauauuuaugacuuggucuuagcucuuagggaguuuauuguguaauaggaaugauaggucaaaagauaagguacaaaauguaaguauuuaugaugagaacacauggacacgggcaacaacacccauuggggccuuucggaggguggcgggguggggggguggugccggaggagggagaggaucaggaagaacagcuaguggauacugggcuuaauaccugggugaugggaugaucugugcaguaaaccaccaugacacacauaccucugaacuuaaaaguucaaaacaaaaacaaaauauaaguguuuauaauauaagauacaaaggggagacucccuuaaaaacauaccuuaauggacagguaugguggcucaugccuguaaacucagcacuuugggagguaaaagugggaagaucucuugaagccaggaguuugagaccagccugggcaacauagugagaccuuguuucuagaaaaaaaaaauguuuuuuaaauuagcagggcguaguugugugugccuauaguccuaacuacuugggaucccgaggcaggaggauugcuugagcccaggaguucgagguuacagugagcuaugaucaugccacugcgcugcagcuugggugacaggguaagaccuugucucuaacaagaaaagaaaaaagaaauuaccuuaauggccauccacaggccaaauccaucuuguauugcccuugagcuaacaaugcuuuuuacauuuuuaaaucguugaaaaaaaauaauauuuuguuacuugggaaaauuauuugaaauucucauuuuagaguccauaaauaaaguuuuauugaaacacaggcucauucacuuacauauugucuauggcugcuuuugcgguaagaugacagaauugaguaagugcaucagagauuguccugcaaagccaaaauauuuacuuucuaucucuuuacagagaaaauuuaccaccucugccuuagguauguacauggagguuggaggggagcccuuuuguagggagccgaggucuuuggcugcuugccauuccaaauaguggccagcauugaaguagaucauuucagcuauuuucucucgccuucccacaaggugagacuuagcugauauaguuggcucacauuagaguaggcuucuguacauuaggagaagcaaacugagaugccuacuucgccaagcagguaaaugaauaaggaugcuaggguuuaaggaaauagagacuaaugaggccugugugaacugaagagauacauggcucgacuguagccuacuguugcugugugaauauauaguauugccaguuuuaaaaagaaguagaaaguaaaaugaucuuuaaaauuuuuuuaaagcuuaaguaugaacaaagaaguaaaguaauguaaaaucacacuguaagagccauagcaugucugagagcccaggucagccugggaggcccccaguuuucagucucugcucuaaagcaagcuaagugccagcgugucuuucucauacccucuuggaccugccaguuuuagcugcagugaaggcuugcaccaggucuuugcuccuucaguccuagcuugagacugagucucaaccugauacagguucuaagauuggggcaggcaaaggagguaagagaugucccgcauugucuaauguaguuaauaccagaaagcuuuuuuaaaaaaguggauccccugccucucuuuugacuacuuuguauuguuacucuugucagccagagccuggucaggguggaggagaugagugauaggauuucaguaccuccaguaccacaccucacucugacccugauagagugcuuguuaguagugggaggagggauuaauagggaaggagcaaacagcauagaccuaaugagugauauauaaugguaguuacuaaagaauguguaggauuuagaaaagaagauguggaggagcgguauucccugagaaaguagaaggcaaaaaaaucagaaaaaggaauauaaaagaguuccauguccaagaaagggcaaauucccaucugucuggaggccagaggugugaaggggaaugguaggauaaagguagaaacagugugcugggaccgggcugaaaggagccugcaauggcuugcugaugaguuugggucuuauucagggaggaaccacugaagaguuuggcauuggagccggugagaggcuuaugaaauuagauucaucuggcagcagcacuuaggauagagucauugagaagggugagguuagugggcauggagaagagaggagaccuauucuugccuagacccaaggaagucuggggacagacaguauggucugaacuagagugcuagccacggcaccgaggaggaaggaauaugugggcaggugcuucacagguaguggggcagggaccaguaaugggagugccagggcugauccauacuacccguuguccuccuucccuuuucauauguaaaguacuuacauguuuguugucucauuuaauuuccauagcaauucuuaagaauuuuucuuccaauuuaucccuguggaaacagauucagauuaaguaccgaacgguuaagaagugguaccagaagcaaagcaaacucugggcugcacagcugguccacaguggaacuguugggauuguuaccauuuuuacuucgugagaaauuagcuaagaacugcauaagauuauuuauguguagcuuuuuaaugaucuuuccuuggcuuuuuagaauuggggaacacaguucuaagaucuuaauuucauagucaaaauuuucaugcauccuuuucauauaaauuaaacuuauauguagagauaaauaucuaaucagcuuuacuaaauuauauuuauuauccauugauuaaaauauaaagaagcauagcucaguucuaccagugugcagaccauuuagcagaaagcaaacauauucacugaaacacagugaggguuucaaaaugguuugguuuuucuccuuuuuuaccuugacauacuuaucaguacuugagaucaccaaaauaaauucaucagugguaggauuagguuuagguuuguuuuuuccuuuuaugagccauuugagauauccaguugucuuucuuccuauauacuccuauuucuucuuuccaaccucaugcaauuuuaguuuuuuucauuuugaaauaaaacuaauuucaaagaauuagaacucuauuaagugguaucuguuggaaaaaaaugaaguguaauuguuuuaauuaaaaccacaaagggcauugaaauacauacuguaauucuuaagauggaaaaauugaauaaaaauuuuacccacaaaauuuugaaguuuucuaugccuauggguuuuuuaaaaguucagguuuagguugcagcuguuucaaagagcuuuuuuccaugcaucuucagcuucuuaaucuacuuuucuccuuacuguguagacagagauuuuuuuuuuuaauguucuaccuugaacuuggaugccucauucuuaguugucugaagaaauugaaauuagucauguuaccauuauguaguuuugaugacaucuggucauguauuucuaaacugaaacaaucacuguuuugacaaguuacuuaagaaagaggacagaguuaaugucaaggcuguccuuucaaacuggcacaucuugcagggauuguuagagcagaaaaggcaaaaagcagccuuggguuaaauuuauuauuugaacuuauggugguacagugauguaauaaaguuuguacagcuacauucuuuucuugucagggaaauauauaauuagggaaggaguaaacaaauuguauaugccacauuugucaugaugcaaauaacuuuaaaucuguagaccacagagauguuauaacuaguacaugcuaacugagcaauuugacuagguguguuuaaaguuagauucuuuguacuccagacuggauuaacaaccagcguuuauuaaacaggaucauacaauuugcuggacauuguucuaggccaaggaagaaagaugaaaagucauguccuuuccugucaaggacuucaucacacauggugauaaauacugacaguggauuuauugcauagugguugagggucagacaacuuauuuccaguucugauucuugcuuccuagcugugaucuuggccaacugcuucauauccuugagccucaguuuucucauuuaugaaacaaggaagaaaguaccuaacucguaggguuaaaucauguaauuauaugaaguaucuggugcagagcaaguggguagcuccuaauuacuuaacgucuguuucgugcugcuguaacagaauaccacagacuggguaguuuauaaagaacauaaauuauuggcucaugguucuggaggcugugaaauccaagaucaaggggcuggugagggccuucuugcuguaucagaacguggcagaggguaucacauggugagaaggcaggcaagagguugaacuggcagcuugaaguccuaauugucguuaacauucaugaggguagagcccucaugaccuaaauaccucucauuaggccccaucuuccaacacuguugcauuggggauuaacuuuccaacagaugcuuuuuguggggugcauucaaaugguagcacuacuguaauagagggguaugucagguauaugagggaaccuuaaaccagcugggggaagaguuagaacccuguuuccagaaaaaguaaugccugauuugagacuuggauagaugguaaauuaugaguugaauugaggguuguacaugaguugaauugaggguuguacauuccaggcaaaggggacauauaaaaaguacauguuugcuucauguuaauuuuguuugcgaguauacagauaauauauguaauuuuaauaacaauacuuuuuaaauggauaggacuauaaguuugugcucaaaauaguaauucauugcuucaaggguguguuucuuaauauaagucaaaaauugaagcuuaaauggcaucugagaaauuugaggauaaaaaaaucacauagaccuagaagccuucuuaaugcuaaauuuaaugugcguguuuguguuaauugcuagggauuugacuuuauucuacuucccgauagggccugguauuaaagcaaauuaccccacuuugguucucuuaauuuagauuaauuugacagaauuuuucuuccuucucucuuuuuauggucaaaugacauaugaaaauuaguguuaaaauacuucauaucuguuuugauaauauggucucaucagaaucccagaauucuagccauuuucuagccagguaucuauuauacuaaguuuuguauuuuaaaugauaguaauguuggcuguuauuuucagaugauuuuacaaauaaagaccaagcagugcuuucccucagguguuuugaauaaccacucuuuuuuucuuuacuuauuguuuuaaaauuauuauuauuuuuuuuuuuguagagauggagucccacuguguugcccggucucagacucccagguucaagugauccuccuguauuggcgccuccuauaguguugggauuauaggugugagccaccaggccuggucccuuuacuuauuuuggccucuugucuugauaaggacagauaugacauuugaucuuagccagaaggccaagaagcaauuggcuucuugucuuggguaacucaaaacuucaaagggcagaauagauacccagaaaaccacagccacauagcuguaauguaccagcaguugaaaagaaauuuagcucuuauuguauagaauuagcaacuuacauuguuuuuccgaugcuggcuuuuagccagcaaaaacauccacuacccugaucaucuccuagagauggaaaccauuucuuaagugccuccagccaugagcuggucugucagugaaagauuauucccaacccugcucuacuaauaggaggauuucaggaagccaagggauucuauuuaaaacagcucaaucuugucuuuguauuaagauguauuaaccugagaugccacuucuguccagacaggaaaucacauuguucuuaguuuaccuucccuuuaaaggaaagcuggggaauauguuaaauccuauuuacuacccaccuacuuauuacugucauccauauuuucuuuaucuugucauuacguuucucuguguugucauuagucuuuccccgaaguaaaacauucauggcacuugucauuuguaauaccaggauacaguguuaaacugcuuucaugagugaacaagaguucuuggucuucgagucauucuuccauggauaggguuggcuuacucagccaaguccauccuagagaaucccuaacucuugggauuuaacguccuggagagagcuguuagugccauuuuguggugcaaauaguuaccgugguuacugugcaaggcacuguuuuuuuuuucugcuuugaaccaggcagugaacugccuaaaaauggucacuuuccugcagugccuuugagcagaaaugauuaucuuggacuuaggccuuagcauuuuuuuaugcccauaucguguaugaugagcccacgacuggauagauccccacaggaaccguguacuuugaguccccauaggcuucuggccaccggccaugugacagccuggaagagggccagauuuuuccuuugcucauagcugcuagauaaguggcugagggucugauagaaagagcagucaguacaaaagagacugaaaaaaaaagcccagccacaugcuuggugagucuccuggcugugaugcuguagucaucuacggugacauagucggaacaaaagagaucaaguacgaccucagaguaacaaugcauauuguugggaggagaauaguuuucauguacuuuuuauucuagauugucaacugcaaguagccugguuaucuuuaccauauuugucacaucacauacuaugaaaguaguuuaaggcuuacaguuaaaacacagcuugugaagagagcauguaacuuucccuuucaaaacugccuugcaauauaauuuuuaaauauuaaucuaaauauugcuucucaguuguuuaaaaauauaauuuaaaaugugaauucaaauuuguaaccuucauuugucaauuuuucaggguuuggcuguguaguugaacaugucuuaauuuuuguuaaacaaauaauguuucuuguggacaauuuugaaaauagaggaaaguauagaaaagaauaaacaacuguacucccacauguagaacaaugccaggugcaugaugggcucucacauauuugcucaguggauguagagacagauacuguuaauaucauuuggguauauaugucuagguuuuuuuauuuuuuauuuuauuuauuuauuuuuugagauggagucucgcucucaagucgugcaggcuugagugcaauggcgugaucuuagcucacugcagccuccgccuccuggguuuaagugauucucucgccucagccucccaaguagcuggggcuacaggcaccugcuaucaugcccggcuaauuuuuguauuuuuaguagagacaggguuucaccauguuggccaggcuggucuugaacuccugacuucaggugaucugcccgccucggccucccagagugcugggauuacaagcaugagccacugugccuggcccagcauuuuuuaaaugaguauuagucuuuuuuuuuuuuuuuuuuuuuaagaaaauagggaucagaacaugcaaauacaauguaauuucuucucuuuaaauuaaaaaaauauuuugacauuucuuauuuuuuguuauuugacauuucuuuuguuuuugagacagagucucacucuguugcucaggcuggagugcaguggugugaucucugcucacugcaacguccaccuccuggguucaagcgauucuccugccucagccucccgaguagcagggauuacagacguaugccaccaugcccgacuaauuuuuuuauuguuguagagaugggguuucaccauguugaccaggcuggucucggacuccugaccucaggugaucugcccaccucggcuuuccaaagugcugggauuagaggcaugagccaccaugcccugccuguuauuugacauuucuuuucauuguuauucuuauuuuuuuugugauagcuggaagauuuaaauuugccuguggccuuuagcaagagggcagccucacuuuaggcaugucugguaagugaagcuguguauaauuuuaucagguaauggcugcuguggauccucauuaaauaugugaccuuaacuccauaccuuuuuacauuaugaucucgggaguaggguccuuuauuccuacugcccacaccuaaguuuagagacguucucacucagucuguccaagugcauucuucucuuccuccuuguuagugucugauuucuaccaaacucaucugcuuauucuccuuuuuuuccuuacaugaacucuuugcucuagccaaaugguuuucuccaaauccugcauuuucuuuuucucuuucuuuuuuuuuuuuuuuuuuuuuuugagauggagucucacucugucaccuagacuggagugaguggcgcaaucuuggcucacugcaaccucugccuccccggguccagugauucuccugccucagccucccgaguagcugggacuacaggcgugcacuaccacgccuggcucauuuuuguauuuuuaguagagaugggguuucaccaugcuggccaagcuggucucgaacuucugaccucguaauccgccugccuuggccucccaaagugcugggauuacaggcgugagccaccacgccuagccccaauccugcauuuucuguuaaccuguuuauauuaguaaagugugggaucuugagagagaguauucuggaggugucacacagcagagaagcuuauucaaguuacaagagaauaguucguuuuuccaguaaagacuuacgauugacauuuaaaacuuuuaguaguucuaaaacuaacuccuucccucugcacccuccuuccucuaaaaagagagagagaaggaaagcaagaaagaaauuaguuggccuaugcuuacugugacauuugucuucucuguggcaauuaaaacuucaaaacauucuuacaggucaguuguuccuugauucuuuggguaacauggcuaguguggcaaacaugguuucaucaugccugcaaauuuugauuauauuuccuccuccuuucaucaaacccugcucucaacauuaccuaguuuguaauuaaaauaggcuugugcuggggugauccacacuaaucauuugacauaguuaaccugugccacuuugauaagccauagcacugaccuugccuuaaccaaaugaacuugacaucuuguagcuuuaggccuucuaaguguuaguuucucuucacagucagucuagcaguggagcuuucauugacauucuucauucauucuuuauuguaucugcauaugaggaagccacaaaguuaauauuuuuuaaaaagguauggacucuguuuucagacuuacuaccuacuuagggguuaaagucaguaauaaguccuugaguaauaaaaacguugugauauagacuggaugaggcaagaacauacagguagcauggcacaguggguagccucuggagccauuaagauuggaauuuagaucuuggucccucaacucaguggcccuguaucuuacccauccugaagccuccaguuuuccuucugggaauugaacaggagagguuauggggaggacuuuccccauuuugaguuuccuuuccacuucuuggcagcauuauaguaaaggaccgugaagacuaggaaagucagcccagaacuucccgaaggaaugaagacuggagcuagaccuugauagugggcuaggucacauggagaagggaaaaaggcauggaaacaagucuguagaaagagcauugagaacauaugcagggaagagacuccaugaaagcagugcauuaaaaaauguguguuugaagggguagagucuggaaucugaaagaugggaaagaggauucuuaaaaucgaggcaugagaugagaauaugagugaacauaggagcucaggcaauggcauagaaagggcagauacaaggagcaucuccaaggaaaaaucaucaggauuugacgggugagaccguagaaugaaagaaauuuucaagguuuaagcugggugauuacugugucuaucauguauucauucauucuuagaacacuuaaauggaaaaccugcuguugcgguguucuguucuagguauuggggauuaaccacuaaauaaaacagaagccccugcucuuuugaaacuuacuuucuaguguuaauuauguuaaaaaauuuagugucagcaauuuuaggaucuugagaugucaucaucuagcucaugauucuuuuaugaucuaaaaguuaaaugggaaaugucaaugaaagugcauccaguaucuucaugaacucaguauacaguauuuccgcguuucagaacuguaaagauaagaaugaaacuguuaaacugaaaauacugaauuucacagaucaaagaaaaugguacuacucuagauguagaauuaauaguucaccuuauaauuaauaaauuucaggaaauaucaugaaguuuggaacaccuagggaauugcugaguuguaaaaggcuccuuuuguagacuuugguuggguuaaaacuagguucauuuaaaaaccaggaggaaguaguuagguugaacaaggcuuuaauacuugauggcuuuuguucaugugaguuuugucagcuuauuucugaaguagugcuaugauguuuuaguguucaguuuucuucaauucuuuaagguaaaauaauuuguuauuaguagauaacuccuugacagaaaauguugacauaagaaauaaagaaguuugaaauuuagaauacaguuuuccauguuauguugaaagcuugaauuggaagaacauuaucuaauaaaaauuaugaugcauuuagauauucauuugguuuagaaaacuuuccugccuuucauuuaauugaccuaguuguauuucauagcauuuuaaugauaaccacaacuagucagcuguaacaacagaauauaaagauuauauguaauucuuuuuuuuuuuuuuuuuucgagauggagucuuucucugucgcccaggcuggagugcaguggcgcgaucuuggcucacggcaagcuccaccuccccaguucacgccguucuccugccucagccucccgaguagcugggacuauaggugccugucaccacgccuggcuaauuuuuuguauuuuuaguagagacaggguuucaccguguuagccaggauggucucgaucuccugaccucgugaucugcccgccucggccucccaaagugcuggaauuacaggugugagccacugugccuggccaaagauuguauguaauucuuaaggaaaucaguaaagggguuuggaccuaauaggacucauaaauuuuuuugcauuuaaaaauguucuuaagaaaugaucaggauucugagcugcuuuagauauauuaccucucagggucugaauuucuuuuucuuaaggauaauuuuauguuuuuucaauuuucuuuagguaaaagugcaguuuuaaagugucuccuggauauucacaaaauuuuucaggaaaaugacccagcguacauacugaaugaucucuacaucucagacuacuguguguggauucagaaagucaaguaaguuuucauagaguuacuuacgaauuuuuagauguucacauugcugaaauaccuauuuacccaggaggaagaaaacgaaauaaccugaggaguaaguuguguuuuuuuuuuuuuuuuuuuuuuuuuuugagauggagguuugcccuugucacccaggcuggagugcauuggugugaucucagcuacugcaaccuccgucucccaaguucaagugauucuugugccucugccucccgaguagcugggauuacaggcgugugccaccacgccuagcuaauuuuuuauuuuuaguagagacgggguuucaccacauugaccaggcuggucuugaacuccugaccucaggugauccacccaccucggccucccagagugcugggauuacaggugugagccacugugccuggccaggaauaaguuuuaaugagaaggaaacccauagaccuaccaaacacuaaaaagcaacuggauuaacauggggagcuuggugaauuugcuuagggaaggagguacacagaugguaaaaaguuaauuuuauuagaaaaaauugguauugguauguccuggaaaacagguauuaaaacaguugugauauugauugccuugcuauugacuguccaguaugaaaucucaagacuggguaucugaacuuguaucuguauuucacuuacaguagagugugaguguguguagauguaugugcauucauguuugugugugcaaacauuuuaguaugcaaacugcaucaguugaauccagaugagagcucugcauuuauuggcuagccacuggcuuaccaccugcagagccuaauagcaugauucuugauaaugcauguauggaagggucugaacacucacaaaugagcuccagcacuugguauauaaaaauuuuuaaaaguguuuaccauugcgucaaucaaagaaacauaguagauuaacgauuacauuuuaaaaugcagugaauuuuuauuucgugaaguucuguagaucugauucuuauuagacaugacaaaauuccauuucaguagcaagaggcuauuaauuaagaaucuauaaaugggccaggcauguugguucaugccuguaaucccagcacuuugggaggcugaggcaggaggaucgcuugaguucaggaguucaagaccagccugggcaacauagugagacccugucuguauuaaaaaaaaaacaaaacaaaaaaccuauaaagggaacucuuaauuggaaugacuccuaggugcuauagaaaaugauagcuacaaugucaauugugacuuagaagaaaaauagucuugauauuuuugcuaccgccaugauugauaaauaaaugcuuuaguguggauuuuaaugucuguuuugaaugagccauuauaugggauuuauuuuuuauuucucuucaugggggagcaauuauauugcagaaugaaauaugaaaaaacuugaggcuauaccuguuguacagaaaaugcuuagggauugcucaagauaaugccuaauaacauacagcagguggugucagcauuuguguuggaaaucuagauuucgccagauggaaaauugaauguuuaaccccugaggucauaauggcaugucaucacuucauuugauccuccugcuaauugagcuuaucaaauacccugcugccauuuccuguuguuacuuucauuuucauaauaaaauuaaauggggauagucuauuuguguggguuuugguuuuucuuuuuuuuaggaaugaugauuuuguaaacauguaaugaauauugagguauguaccaggaucucauuucugugagugccuguuucucucuuugugauauucuuuauuagcuagagagaaguuuauuuuucauuaaagaagaaagauauaggcugccaaguagauguagggauuaucagaccuucccugaaaaaacuuuuucucuugguuuuauguugugggaaaugaagugaaauucuuagguucuuuguaauuguugugcuaauaguacuuuuaaaaaaugggauaauguauuggggagugagguaggagagagaaaccagcaggaacucuucaaauuacuuugcaaaaguuguuuuuucaacuuuaccaauuugaacauaacuuucuuuucccuaaacaggcguguugcuuucaguuuguauguuaaauuuuaacuguagcccagcuauuuuuuucucucuuuugaaauaaaacauuuguuuaucuaauuuuuauaaaaauuucuaguuuuauucuuaauuuuacaagcacaacaugauugagcuuucuaguauuuucuuuacugugaacuucuuaggucuaaauaauucuacugcaguguagauccaugauuuucguaaggaauuuuuuccucacuuuuaccuucugguuuauuucuucuacauauaguuuaucagugaaaucuagcaccuuauuuuuauguuugaaaagagccauguauuuuucuuaguuuaguuugauguuuuugauuauaauaauaaaaacuauguaagguuuuguuugaaauaccagguaauugcuaaauucugacuagcacaaaaacagcauuccauuuuuacagucagauauaugcuuuggcaaaaaccuauugaaacguagguagcaaagucauucuuacauugaaucgaugaaguuauaacaacaucuauuguuacuucugcuuucguacuagguuucccuauguuauuuuucccuaugauaucugugucuuguaaugcauauuugcaaagcugagaaacugaagcuccuggccucucauucugaguuacagauuuuaccaauuguuuuucugaaaagaacgcucccuaccacccuucacuauaagcuucacuggaaguuuugaguguggugcucacuacagcaaauguucugugguuggcagccuuagaaagugauuuguuugagguuauaugucuuauaagagauaggucaggucuucugguuccagauuucauauuuuucaagauaugccacuuaugcaaccaguugucuccacccauaccauguggaagaaaaaagauaaaagcccuuucuucagagagauuuuccuauaggaaaaggaaugaaugaaacaucugucuuucucauggauguucccauagcacuugguugagagaucauugggcaccucucaugccugccuuauauuguaggaaucuagauguguaucucuuuccccucuaaaaugcuaaggucuaugugaauaagcaccugucuggacccaucacaguuugugagcacaaucaguuuuacucaaauugaaugauaccuauuagaccggauuaaaggaacguuuuucauuuuuguuuuaaauguagcacuuuaaaaauauaaaucaauucuaacuuauuuuuauugguauuucagcuacauauacaaguugccccauucuuugcuggugggcugccaucaguagcagugauaguucugacccucugaaauuuaacaguuccaugguauccaacccuuuggcuuccaugggccauacuggaagaauugucuugggccacgcauaaaauacacuaacacuaaugauagcauggaccaaaaaaaagauccaugcauaauuuuuaugauauccaucacuacagauaagcaaaaaaguccuugcauucaaauaguuggcaccuuuuuauauaaggugggauagaaaauaaugaacuguaauacauuccagcucuacuucucauugaccguaugaccuuagcaagucacuuugucacuuaaucuaauucaaccaauauuaguauuuugauauuuccuguauuuguuucccaaugcauuuuuuaaauauguaacaaguuuauuuuucuuuuuuuuuuuuuuuuuaguguuuauugaucauucuugaguguuucucggagagggggauuuggcagggucauaggacaauaguggagggaaggucagcagauaaacaugugaacaaaggucucugguuuuccuaggcagagggcccugccaccuucugcaguguuugugucccuggguacuugagauuagggaguggugaugacucuuaacgaguaugcugccuucaagcaucuguuuaacaaagcacaucuugcaccgcccuuaauccauuuaacccuuaguggacacaguacauguuucagagagcacgggguuggggguaagguuauagauuaacagcaucccaaggcagaagaauuuuucuuaguacagaacaaaauggagucuccuaugucuacuucuuucuacacagacacaguaacaaucugaucucucuuucuuuucuccacauuucccccuuuucuguucgacaaaacugccaucgucaucauggccuguucucaaugagcuauuggguacaccucccagacgggguggcggcugggcagaggagguccucacuuccccgacggggcggcagggcagaggcgcccccccuaccucccggacgcggcggcugccgggcggagacgcuccucacuucccugacagggcggcugccgggcagagaggcuccucacuucucagacggggcggcuggucagagaugcuccucaccucccagaugggguggcggcggggcagagacacuccucaguucccagauggggucgcagccgggcagaggcgcuccucacuucccagacugggcggcugggcagaggggcuccucacaucccagacgaugggcggccagacagagacacuccucacuucccagacugggcggccgggcagaggggcuccucacaucccagacgaugggcggccaggcagagacgcuccucacuuacuagacgggguggcggccgggcagaggcugcaaacuuggcacuuugggaggccaaggcaggcagcugggagguugagguuguagcgagccgagaucacgccacugcacuccagccugggcaacauugagcacugagugagcgagacuccgucugcaaucccggcaccucgggaggcugaggcuggcagaucacucgcggucaggagcuggagaccagcccggccagcacggcgaaaccccgucugcaccaaaaaauaugaaaaccagucaggcguggcggcgcacgccugcaaucccaggcacuuggcaggcugaggcaggagaaucaggcagggagguugcagugagucgagauggcggcaguacaguccagccuccgcucggcaucagagggagaccgugcaaagggagaggggagagggagggggagggggagagggagagccccaaugcauuuuuaaaccaguggaagcaauacugcacauaccauucuguagccuguuuuauacucaugauaauaccuuauaaaccauuucccuuuauaacauaauauccauuacagaguuuuuuuuaaguaacuaauuuauuccucauuauaaaaagaguacauauaugcucacugagaaaauuucacauuaaaacuguaugguuuuaauacauagcacauuuugaaaugacaagggaucaagaacgguguucuuuuguuuuugcuacauggaaaaauuuuauuguuuuuaaaugaaacuaaaaucuaaaauccugacucuuaucaguacaaaugugaaccuguaauuaagauguuaaaucacacuuuuccucucuaguauaguuuuuuuaaguagguaguucuggggaaaaagaaaaaaaguguuuuugaaauucuaaacccucuuugcauuaaacugauuaaugguuaauuaacucuaauagugcaauuaacuuuuuuugcugaaaucuucugaccuuuuggacacuaaugugggaaguuuguagagggaaacagcuauaucacaagauaguuaucugucauuucauaagucaugaaccuuaauuuccucaguuguaaguaaaccuaagucauuucagcacugaaguucuaaaauuuuagaaagcuuaagaccuuaugauugcuuuagauucuugaguugcuuucuaugugcaugugcuuuugaaggggauaggauuaugcuaagaacaggguagauaacauacaucucuuccuucuggcucucuguuguuccugguuccucugccaaaaugagguagugagagagacucauaugcagaggugcaacaucagaauugcauguaaaaguggagucauguauuuuuuuucaaccaguaguuauugagcucuauuaugugccagguggugagauaggugcugggaauacuguggugaacaagagagacacgucguugugaaguuggucuucuagugggaaaugcagauguaauguauuauacccaauagcggcuacagugggcaaguaugggagcuguggaagcaucuaagaggacacagggcuguaggaaaaggcuuccagaggaagaguuuaagcugagagcugaaagguuuguaagaauuggucagaugcagguggggaaguggggaugaagaguauuucagacaguagacaaaagaauauggcccauuugaacagccugaaaacccaggaugcauagguuauaguacagaagggauaggaaagaagugaggcuagagguucauguagaggcuuggccaccuaaagaugcuuggccuuuguccugggagaauauggagcaucugaagaguuuuaagcgaugaacugccugugugagugaggguaugagacugacauucugggaagauccaucaggugauuguggggaaugaauugugguggggcagagcucagagcuccagacuuaaaggccaguuaagaagcaggguaauccaggaaaaauagccugagccaggugagugagaauggggaaggagacuagucaucagauuugagaggcaggugagacagacuuaguaauugauuggaugcugcugggagagagagaaggggaggagccaagaugagauguggguuuugacuugggcaucuaacugggcuguuaaagguggcauaugccaagauuaaauaguaaugaagaagguguaguuugggagagaaggugaggaguucaguuuuggaaauguugauuuaaugccucuaaggaauaucaguaaagagggagccaggaacauuuggagcacagcugggacagauguauaaagaagaguuuagacaagaagggaaaugaauuaagucacaaaacauaaaaaauguucucugguuacaugguacuguguuaccuauaaguauaauaauaaucggaguggaugcauuucaagcugggaaaauaacaucaugcagaugaguagacaaggagaacauguaugcaacauggugaacaaauuuucuuguucuagcuacaguguauagguaggacaagaguggaugugaggcuuuuugcauuuggaucauaguuuauccuugcugucucccuuuauuguugaacaagagggucuacuguuaacauuucaggggucacgauguuauaguaauagggucagauaagaaauccuaucucucuagucugugugccggagccugccaguauucuuaacuaauucuuuuuguuuuuuaagagguggaauuucgcuaugugaccuccagcuccagagcucaagugaaccucuugccucugccucuggaguagcugggaauacaggagcacggcucaugacuacuucuugucaauuguucccauaagagaaacucacucagacuuuuacagcaaaacuggggagcuuuauuggugacuauagguuauccccuggaacuguacauucaagaguacagcuggauaccaggaggucagaugaugagaaagugaggcauucggcuugcucuugcauauggucuugcaugaugcugcuuucugcaaggcacugccacucuucucucucacugcacauggaggauggccacuccacagaucugaguuuacaugucuuuacuuucaguggggauagauucccuuguuuguaauuccaggggaggaagaaugugauuggcucagcaaggguaaguguguuuuccugguccaguugccuuggucacacugggaucagaaguagugaguggcauuucuaagaaagugaagcuggaggacauacagccaccucaagaagacacugcuguaauuucacaguaccauuuugagccauagcuggaggaaagccaugacaccuaccaccccccaagucacugauguuuauaauaaaucuacagaguggaaggugauuuuggggaucuguuaaauucaggcacgcagagcgauaaucagacacucuaggugguuuuacauugguaugggaaguuacuucugacaaauggugaaaugcuaaguguuaaauuagcugcuaaugauuagcauguagaaguuucaagaaacaauugugcguaauuucaagcaaguuaaaccuuggauuaaaaucauucuugguaaggugcuuauucuggcaugucaaguugcucuuuaguuuuacuguuuauuuuuaauuaaauccacaaauucauccuggauggaaguggguuuuuaucuccauaagaaaagauuaguacaaggcaguauccauucacuuggauccauucagcgugguuucauauagaaaggauuuacuuaaugguucuguaccuuaucaccaguagcucagcagugcccacuggggacuguugcucuucauuagacuucucuuacaagaaaugugccaauaaaucacaggauuacaaauguuccuacagaucuaagacuaaaauaaccuuuuauaaagauaugaaugcuuccuguaacuaaguguauugaaaaaacuaacaaaagaauuauauauuugaauguuaaagguuuaugggauauuuuuguuguucuuuuuuuuuuuaauuuguaauuuguaucuuuuuuuuuuuuagguagacuuuuuauuuuagaauaguuuuagauuugcagaaaaauugcagagauaguacagaguucccauguacccuacccagguuucucuguuaaccucuuauauuggaaugauauauuugucacaauuaaugaacgaauauugauguuauuauuaacuaaaguuuauuuagauuuucuuaguuuuuaccuaauguccuuuuucucuucuaugagaccacauuuuguuuugcuuuuacuaaagaacuggaaauugaguagugcucaauuucuuggacauuuugguuauucaagagcuuaaaugcuaugaaagguaagugaaauauuguugagauacucagauaccugaggagcuuaauacauacaaacauucuaaucaucaugaauccagacuuggaaaaaauggguuugacguauuugagaauuuuuagaaauagaaacauaauucauuuaucauuuuuacuuacauauguaccauggacaucaugauuaugauacauugauaaaaauagagaaagcuuagggcugggcaugcuggcucaugccuauaaucccaucacuuugggaggcugaagugggaggaucaguugaggacaggaguucgagaccagcuugggcaccauaaugagaccgugucucaacaaagcaaaacugggcaugauggcaugugcuugaacccaggaguucaaggcuguagugagccaagaucaugccacagcacuccagccugagugacagagggagaccccaucucaaaaaaaaaaaaaaaaaaaguguauaaaaauaaauugggcaaggccuuuauaguuucauguuaauuuucuuaagguggaggagguuagaggagaagauguggagauacauaugaaccauuuucagaggugaauaagcguggaaaauacucuaccuuuaucuagggaguaguauguauaucaagcccauuuuauagcuguggcuggguggcuguguuagaagucucuguucuuucuuguuuuagucccugauacuuggcuguagacugcccaaguccuugguuuuggcuugguggagccauggcuuuuuacagaguaagcaaauugcuauuuuccuucaucuccuuguucuuguguauuuuuguaccucaaagcucuuuggaggauucucuuuggagggagacccacaggaucaagugaguuaggguggugauugauuuagucagguuuuauaaaccaguauucucuacuucacguagaauuuucacugugcuugaauagucuuaacaucuuauucagagaaaaggcuuacauugauuaauguggcauaugugugguuaucauacuuagaaagugcucuguuuaaggagagcuuugucaagagcauucuuucaauggagucacgagaaagcuuuuuaaaaaagcugacaacuucaaguacaauuuccuuuuucuucugucuauuaugauugaaacccaaucuuuguuauaacauaauuaucucagcugaagccaacagggaguugcugccuuaauguaaggggugugaaguccccuaaauaaauagaggauuaauuacauucccagcauguugcaaaggugaugagauugauugugaucauuugacuugucccauuuccugcucugacuacuuucuuuaauaaauagaagcugggaaaauaauaaacagagcuguggaacauaucuuugggcauggaguguuggaaaaggaccuucuugagguauauuucuggauuuuaagugauuuauaugacauuuuacaguuuuuuucauugauuauucuuguacuguuucaauuuaaacagcuuucaaggaaauuguuuuugcuuaagaaaacauagauauuagcagagcauugagagaaauugauaaauucuauuuuaaugguuggauauaagcaaauuucugauccaauuuuagauguuuucauuuaguguggcauuauggaagguuuaaacuaaaggaaauauuagcuauuacauguuucuauuguccuuuucacauaagagcuuuauacuucuguuaagcuuaaagugauaaauuaggacuuucaugaaguggaucauguuuucuguuuugugcuugucuuacugucuuuuccuggagaguuuuauaauauccugaaauugugauuuagaguauuuauuuauucucuaaauuuucuauugcuguggcuuccuauggagguccacuuuuuccagggaguacauaaaacaaucuuuuugggguauaggaaaacuguaauagaccuucuaccuauaauuauuuuuugagaaugaaauuaagcuucauaaauauuuuauacagggauugauggcaaaaaugauuuuuaguggcuacuuaccauaccuuuuuuuuuagugaugugauauuugauuagaagcuuaaaaggccacugcuucauggaacagccauuccuauuuucaaagagagucauacaccuuuuuucucaaagccuaaguuauggcagggcugggauugccucugccaggaaauuaguguugggguucggggacucuagucagucucugccaauuaaagacuccugaugauauggucucuucuuucugcucuguaauuuuauguaaauaauaaaauggugcaccaaaacaaugagaaaaacugcauuuguagugucaaauuaacuaccugacuuaaaugcuaaguucauauuugggaaaacucaagcacugaagaauuaucuaauuauuguguuuauuucauuucauguaggguauaagggccgucuuuuucugaaaugcgagcccuucuugaaaaucucaccugaggcugugcauggugucucacgcccauaaucccagcacuuugggagaccaaggugagcggaucaccuggggucgagaguucaagaccagccuggucaacauggugaaaccccaucucuacuuaagaauacaaaaauuagcaugguggcacgugccuguaaucccagcuacuugggaggcugaggcacgagaaucgcuggaaccugggagguagagguugcagugagccaagauugcgucacugcacucuagccugggugacagagugagacugucucaaaaaaaaaaaaaagaaaaaaaaaaagagaagaaaauugccuugagugcacaccaccauacuuuuuacuuuauuugcuucuauauucugccucuacuaaaaauacaaaauuagccggguguaguggugggcaccuguaaucccaguuacucagaaggcugaggcaggagaauugcuuguucucugaguuguguagcacaucaagugauggaauacaccucuaauaucauggcauguuugucuuuuguuugguuugccugauuuuagucuugugauggaugagauauuacuuuacaucccagauuuguaauuaugugguauacuuuaagugacagagugaaaggugaaaagugaugucucuuuugaugaucaucucuucuccugacucuugccacuuucgguguguauguauccuauaaacccagagcauuuacacccccaaagauguucuuuguggaugucacuuuugacaccuuaagaacccaaagacacauucuuuuggcaaagaauaaaacaccuucucgcauaugguauuaaguaccuuugugccauuccaaauaagcuugccagccaauuuagauuuuauuucuauccuuagauuauccuaaugcuucagaaaaauaaggguuuaguucuuacuagaagaaauugacuucacuuucaacuugauauuuaaaauuacaguugucagcauuuguccugucugcuuguuuaagggacauaacaguuaaaaggacuucacuuaaugcuguauaaguuagugaucugaauaaaacuauuggcaaaggaucuccacucuguauuaaauacuggauuaaucauacaggucaagcuuucacaauucuaguugugaagcuuguguucugaauguggcagcacuacauauccuuauguuucagaagcuuuauugugauccaugguuucagaugcauauuucaaauccagaaauuuugccugguaaguaaggcuuaucauaccuuuuuuaaaaaauuaaauauuuuuuaaauaguagaggcagggucuugcuguguugcucaggcuggucucgaacuccuggccucaagcaguccuccugccuuggccucccaaaagugcuaggauuauaggcaugagccaccucgccuggccuuguaccuuuuuaucagaaagauccaaccuugcuccagguuugugugaaaacaguuuugcuuuguuuuuaaaccagagccacauagaucuuuccaucuucuguauaggucaguguuacuuguuucuguuaaucauacuauuucaaaguccccugccauuuuaaggugggcucuccucuugaggcuugggcaugagaguuaagccagauacugacuucguuuucuaucuuuuggggucuuguuauccuagguggaaauggugguuguuuaauugugacugcuuuagacuugaguaucuguucaucaguccauucauucaacaaauaguuuaugaguuccuacugugugcaggguucucugccaggggccugccaaugguaaacaaaacuugacuuggcuucugcccuucuagaauuuguggucugaugaggagagaaguauuaaucaaauacuugcauacacaaaaaguaaaauuaaaaccuuggaaaguggugcaaaagaaaagauucauacugccacgagagauggcugaccucgccuggugaggggauuaggaggagaaggaggauccccuggggaaauguuugguuugaguacugaaguacaaguaggaguuaaccuaaaaaaggugguggacuucaggaauacauaguaguuccaucaugugcaaaggcucuguggcaggaggagggaauuuuauauguuuucaagaaauugcaagaaggucaagguggcuguaaccuagagaaaggguauauguguugggggaggggucaagaaaaggcugaugauuuagucagagcccagacaguauagugccuuuuaaguaauguuaagaauuuuuauccuuauucuaagaguagcgagaagccagcgaaggauuuucagcauaugaugggagaugacugguguaguguaaagagcuuuuuaggccaguuucaagacuauuaauaaugcccuuaugaggcgugaguguagccugacuagggaauuaggauuuuuaggaacucaaauggauuuagagaaugaggaagaaggcaacauggaggaugaugccuggguuuguagccugcacagcugaaugaaugauaaaaccuaauuuuggaaaaggaaucucaggguuuuggcuuuuguuagaggaaucuuuucuauacagaacuuaaacucuuuuguggugaucuguacuuuaaucauaauucuggauaauggccaguuuucuuuauuugccucuguuauuguugccuuuauuauuuaaugaacuacuggguucaguuaucuauggagguuugccguuuguauguguuuuuugaauguuuguagaguuuaguuauuuucuuaaaauguuuucuuaugaaauauaaaauacaauaauauuugaaguguauacaaauuaugcaaauuaaguguauacaauuacacaaaugaaagaauaguaaugaacugaauauucauguaacuaccacugauuucuuuuuuuucuuuucuuuucuuuucuuuucuuuuuuuaaagagacaggguuucugucacccaggcuggagugcagugauaugaucauaggucacugcagccucaaacuccugagcucaagugauccugccaucucauccucccgaguaguuaggacuacaggcaugcccagcuaauuuuuuauuuuuuguagagauagagucuugcuuuguuaccccaggcugguugaacaacugggcucaaaugauccucccauuucaaccucucaaaagugcucaaaguggaucgauuauaggugugagccaccaugccuggccuccaaucuuaagaaauagaauaucaccaauuuccuagagauucccuaugggaccauucccaauuguauuaacuucugguaaccacaacucuaaauuuuaugucaaucauuacuuuacuuuuccauauaguuuuaccauuugugcauauaucucaaguuuaguuuuuagcuuugcuuucuuuuggacuuuauguaauggaaucaugcuauauguaugguucuucuauuacuuguuucuuuugauuuuaaaaagauuuauccaugaugaugcauagaguuguagaugguucuuuucuguccugcaguguacuaucccauugucugaauauagugcuguuugucugucuguuauucuguggaaccacuaauaaaugguuuccaguuugggcuauucagaaaaugcugcugcagauaucacuauacguguuucaugguguacuugugcaacuuuuugguuaagcccuauaccuaggaauggaauuucugggauuagggacaaugauauguuagccuuuaaugggcagugucaaacuguuuuccaaaguggccauaccaguuuauuucaacuuauacuuuaaccagcaauguauaauaauuuuccugauuccaccuucaugccaacacuuacaugguucagauuuuacgauuugacaaucugaagggguaugaaauaguuucuguuguaauuuuaauuugcauuuuccuaauuacuagugaagcugagcaucuuuucauguguuuaugagccauugguguuuccucuacuaugaaaugucugucuauuguauccccuguuuuucaauaggacuuccuuucuuuuugauuuauaggauuccuuccaguauucuggauacuaguccuuuauggguuaaauauguugcaaauauuuucuuccaguuuauaguuuauguuucagucuccuuguaguguuuucauaaacagaaguuuuuaaucucaaugcuguagaauuucucaauguguuccuuuaugggugugcuuuugguucucguuuaagaaaguuuuuaugauuuggauguuauagagauauucuccuauaguaucuucuaaauuuuuuauucuuuugcauuuugcauuuaaguccuuaguccaccuggaauagauuuuuuguauguuaugcaauaggggauccaguuucuuuuuucccauauggauaaccauauccuggcuucauuuauuaaauagucuauccuuuccucauacauccugcagugcucacucuuauaaaucaaguuaacauguauguguggaucuguuucuagguugucuguucagccccacugauuuacuugucugucaugcgagagugccauacuuucuuaauuacuguagcuuuauaucuuagaaucagcuugucaaguuccaugaaaaacauuuugauuggaauugcuuugaaucuguuaaucaguuuggagagacuaaaacauuuugugucucuuuccaauaauaugguaugacucucuuaaguuuucuuuaaugucuuucaauaaaauuuuauaauuuuuuuccauuaaagguuuacucauuuuuuuguucgauuuauugcugauguaaauacuuuuuuaaaaaaauuacuuacaaacugccuguuuaaaguacagucaugcauugcuuaaugauagggauacguucuaagaaguguaucauuaggcaguuuuguugugugagcaucauagauugcacuuacacaaaccuagauggcauagccuacuacacaccuaggcucuaugguguagccuauugcuucuaggcuacaaaccuguacagcaugugaccauccugaauacuguagacaguuguaacacagugguauuuguauaucucaacauaucuaaauauggaaaagguacaguaaaaucagaguauuauacucuuaugggaccaccauauguaguucaucauugaccacaacguuguuauguggcacauuaauguguauagaaauguaauucacuuuuaaaaauugauuucauauccagcuacguugucagacucuacuauuaacucuuauguaucauuucuguccaguuuucuauauaggcaguaguaaugcaaguaaugacaguuugguuucuuccuuuucagucuuuauauucuucauuucuuuuucuuuuucauuuuauugcacuggccuaggcccuucaguacaaucccgaauagauauggugguaauauauuuaucuuauucuuuaucuuuaagaaaaugcuuucaacauuuuaucauuaaauaugauauuugcuuuuguagauaggcuuuaucaagaaagauucauguuauucuuauuuugcauggaguuuuuuauucuaaauaguuuugaauuuuauugcauuuuuuccucauccuugggaugaucuuaaaaauuuuuuccuuuaauuuguuaauguaaugaauggcauguguaaaauuucgaacaaauucggccuugcauuccugggauaaaccuaucuugauuaugauguauuauuuaaacaugaugcuggauuuggcuugcaaacucugugggugccuacaaucaggaagaggguauguaugggaagagaaauuggccuauaauuucccauuauuguacuguccuuuccugauaaaaugacuuaacauugccuuuucuguucucugaaacagugcacguaauauugaaaugauacauuccuugaaccuucaguagcauucaccaaaaaaaaaaaaaaaaaagccauugugucuuucuuucuuuaugggaaaauucuuaacuauuuauucagauuuucuaauuguuauaggacuauuccgguucuuuauuucucugagucaguuuugauagguuuuauuuuucuaaaacuuuguccauuucuucuaaauuuucaaacuuucuggcauagaguuguuuuuauuugcucuuaucuguuuuauccacagcaucuguaauuguugucuuuuacauuucugauaaucaugcugucucucucuuuguuuuuuuguuuuuaaauuauuuuuguaagaggguauauuugauuagcuaauuuuuaaaaaauuauuuuauuuuauuuuuuauuuuuggagacggagucucauucuggugcccaggcuggacugcaguggcaugaucucugcucacugcaaccucugcuucccugguucaagcgauucuccugucucagcuucccgaguagcugggauuacaggugcccaccaccaugcccagcuaauuuuucuauuuuuaguagagaugggguuucaccaugauggucaggcuggucuugaacuccuuauuucaggugauccaccugccucagccucccaaagugcugggauuacaggcaugagccacugugcccagcccauuucacgcucuugauccucucuuugucugucuucuauuucauuacuuuugcuuuuaucuguaucauuuuauuucuucuacauuuuggaaguuuguuagauucugcauguagauguuaguaacuugcuaacauugacucuuucuucauguaaaacuaaauuuucaaauauaugcuuuauauucuucucacagguuuggaaauguacugaauuuucauuacuguuucauuccacauauuuucugauuuuacucaugaaauuuuggaaauauuuuucuccuuuccaagcauauggauuuuuauagaaaaguuuuuguuguugauuucuaacuuaauugcauuucugccagagaauuauaucauuguuuagaaauuuguugagauuaauuuuaugucuagaauggugucaguuuucauacacuuuugguuuuauucuuaaaaguaauguugaucuucgaauuguuagcugcuguguugcaugucugugcauuggaugaaacuuguugguugggcuguuuguuuuuuguaucuuuacugauauauuuugucuauuuaaucuguccguuuugaauugaaagaggugugugaaaaucuccuauguugucagucuugucaguuucuuccuguagaccugucaguuuuuacuuuauauuuugaggcauguuauuugguguuauuaguuuauaauuguuauaucuucuugguagguuaaaauguaucacuaauaaugcuuuuugccuuaccaucuauuuugucugauaguaauauggcuaucccagcuuucuuuugauuaguauuggccuggaauaucuucuuguccucggaggauuuaauuuuugugaacaucucuucaauaaaccuuugaugacuggcuuccaguaaauucaaaccuaacuacaaaaaucuuacauuuuguaugugugagaaauaugcucugaacauaugauguaaagcugugaugaaucaguaauuugggaaccaguugugacuucagauguuuuuggguuuuuggucuugucguuaugcagguugacauguuuggguucuguaagucauguguuucugucuuugauucccuacuccacauugacucagucagcagaucuuuuuaauucuuccuauacaaucccuuucauauaaaucccucuuuuuggucucaccaccuuucuuugaauucaggccuuaauuuccucuucucuugccacaguguccucccuguuguccuugccaccacagucucacuccccaucuuguuucuuuccuauaguagugccagucugacaguucugaaaugccauuuuggauauggcugucuucguggaaguucuuuuuuuucuuuuuuuuuuuuuuaagcugucuuuaugaggucuuucugaacacucugaucacuccgauuuuggugauggggauuucacucaucuaccaccacugcuacugugagauaggcugagggauguacugugucaucuuuuccuuuccuuccuuguuggaguauacucauuuuuuuccuucuugucuuuggagcuagauuccaauuuuucuuuaucuuucuugucccuuucucuuucuugucucuuucucauucuccuucuaacucuuucucucguugaagauguuuaucucuguaguguucuacuugcuccugaaaacucuggacugguuuuuuaugucuuuuuccaaaauuccaacucauccugaaacuucaugacuuugagcucaauuucacgaaguuuggccuguuuuuccucacucauuuccgaguacuuagagaacauggacucagucauuucuucuuugauuggauuagaguacagaugauguucuucagauuuggaacuuugaguaucuucuucaucuucacuuucuucuucuugauuuuguuuuucuuccgauucuucaugcuggucaaauaacucccauuuagaaguuguaacagccugugcuuccaauucagauuuguccacagcuucccauuuugauggggcaacuuuagauauaggcucauucuucucugaguuuucaguugcauccaaaggcacuccaucaagaucaucaucaggacuuuuuauagggauuccaugaagaucauccacgggaguagcaucaauaggaauuccaucuacaucuuccagaggugcaccaucaagcucuuacuugauggaagcaccaucaagauugucuaguacaucuucuguuuccuuuuguacaauaauauaugcaaguccuaagaaaauguuuuuuaguuuaaucaaaaaugguucuggauaaauugcccaaucuucccaugcucuaaagcuuagguuguguacgacuugucauaucacugucugaggguccagaugcaucuguaugugcauuugaagauccagaugagugaacaucugacaaucucaucuuugaacuggucuccucagaaguucuugaugguuugccugcaggacaaaagccuaaaugccugggcugaguuggauuccacaccgucugcaucuuucuccucaucuucuaagcuuaaucccucauucuugcugaucaggcacccucccucuccugccaaguagaugaacucacuauuucccaaauuugccauaaacuggagcuuuuuuuuuuuuucgcuuuggcacauuccauuuucucuaccauauuuguuacauuuugcuuuaagcuuuuucugacgaacccaacuaaaucaucucugcauuguaaggcuuaaaguuaacacugacaucacuccucuugaugaugacuaucuguaaugcagccagucacagaacugaaaagucuugcaaacucuucucuuucguaagccuuuauuuuguggauuaauucccccugcacugucgcugcugugugauugcuuagucuuggcauggcugacucugauacccgcaaauucacuuauaaaugagaacccuccuacucuuaagcaggcuagagggcuuaaaaguuguccuuuaaaucugauugaaaucugcuuucuucacguuaauuucaauucuggacccauauagaguaaguucucuuuucaaaugucugccuucagcuaucuggaggauuacuauuguaucccuucucagucuucccgaucaaccucuucugccuuaaauuauucuuauagguccaaauuuccaaccuuuguccaucuuggucucuuuuugggcagacuacuuugucagugucccucaaccccucccuuuauuuuuugguccagacccuuuuaaaguauccuccaguuuaaauaaaaugcuucagguuugaccagagagaagcaauugcuuuugguuuuugugaauauuacuuugucagucaucugcuuaucacuggaaaccuuaacucacuauauucuuaguuuaugacuagcugaaauucuucauauucgucuuuaaguauaauuccucuucuuugcuagcuaguucacaaucuuugcauuugucccuguuuaguuucaccuuguuagauuuggcauaucccauccaccuguuacuaacuuuuuggaacuggaaucugucaccuagguuauuuccugaucuuugucaccuuuguaacacuguuuauaaacuugacucuugaaaucuaaugagcagucauuuuuuggagcaagcacaagguuaggcgcuguggaacuaaagaagaauuagauacggcuucuggccuuaaggaauuagagugagcauucucuguuuucaccuaagacagugaguagaauguaaaaugaggaaggcugaggucagaacuuuguacucuuccacuagauaccuuccuucagguugaaaucagucugaccucuaaggucaaauaugagucuagacaacuguauaaucauacacucauacucuguauuuugcccauaaagagacuacaggagauuguuauauguuuuguuaaaauccagacacaaucuuugcacaggguucccaggugcgggcuaguccaagggauggcaucaguuugugaauccauaguaacuucuggggaucaccuacuucgucucuuaucugccuauaugcaguucacauauuuugaguucauggucuaugguuucaucacuuuccuccuucuuuucaaaaguuaaggaagacacauuugccucuuuccugucuucuauguggauauucgaggcuagguguauuguucugauucccucuucuuuuauucugugauuagcagaacaccuuugucuuuaguauucaucuauaucacaguuuuugccuucuauaauacuagauaucaucuuguacuuucugggcauuuuucuucuuuccuuaucauucuuaguuuauugaacaaacugacagcccuuggugaaacuggcaaaagcaaacuccuuccuggaacuucugagauguagucuggcucaaaccaggcccugaucauucugucaucuuaagccaugguccacaaagccaaauccuguuucugauuugggaaggcugaggucagaaagcuguccccugucauuagaaauguagugaggccauagaguauuaugguuaagaguaugggcucuggagccagcuggcagcuucagaucucuucucugucuguauggccuuggacaagccauuuaaacucucugugcuucugcuauccauaaaaugggggagaauuaggaaaauuagaugagcuaacacaugcaauuuguuuagaacauguuaacacagaguaaguggucaauaauauuugcuaagaacaaagcuccauugaugcacugcuuguuuaacaauagcauuggcugaaucaggcaaucaguccauaacaauaauagcuagcauuuaucaagggcuuacugcauaccaggcauugugcuaagugcuuuauagagauuaucucucuugaugaucucacaagccccauaugaauuuggguuauguccucauuuuguuaucaccccagguuacaauuagggaaauugaggcucagagagauuaaguuaacccagagcugugugacuucagagccugagcucuuaaccuccuugcuguggucagucaguuguuugccgacuucagaacacaugaccccugauaaacacaggacauuuucuuggugaaguagcccauguggucucuguuauggagcauuuagacugguuguagagacaagacaagauuugcagagggcagaauuagaggacugcugagcaaacccuggccccguugcaagagacauagugauucaaagaagaggaggccaggcuggucugcaaggccuaguggaguagaagucuugaacagggaacuaaagaugggugggaucugaccaggcacagaaagaaagggggaagaugugcuaggcagggaugcaacuugaggcaaaucccaaaguaaaaauaauuguucugggucuggaagcagugguaccagucacauuaguguagcagguacguauugagauauacagacuauguuagggaacuggggagauggaacuaagucugcagacguagaaguugcaagcuagugacccuugggucacuuuuggcucucagugaguuuuuaaagacuuuaaauugguugucaacacuuaaaaauuggaagauuuuguguaaaagucuggauuuauagcugcucuugaaauaacggaaguucuggcaguugcugggcccacauccccacaugguaacaauuggcuagagcuggggccagcugucuccauuaugugggacaagugcucuccauucugccacagacccccaccugccugcuagacuccaucuguuuggcuucuaggggcagcaguuuguggccuuggccuaauguauaagggcucuguuacuugaucaaaggaccugcacuuuuuuccugccaaacugcaggucccauucaagcaggagccauguuuuucuugugcacugcuguauagcuggguccuagcaaaaugcccagcaaauacuggccacucaauaaauguggcaccuggauggcagcagugaccguauuauagugcaaucaauuuuggaagcugcagcgggguucuagaaugcuuagggaaaaacauacugggggcacacagcauuugaccugguggcucauguugaacgcuguuguaaaggcacacuauggaugaccauuaagcagcaaauaggcugcuuauaaagcagagaacaaucuguguuugugucgaggaaaaaacugcuggccaugcagugcucuguuuccaacuccucucacugacauggauagcagcccuguuguuguuuucuucuuuggacacguacuaaacaauaggaauagaaaaugcauaaguaaggcuuauggcacauacuuauuugccucacucagcaggacaacagaaucacaaagaucacagccacagcucugcgcucuguguguuuuaguaaaaaccuguaaaaccgaguugcuuucgacuagggauaugaucuuucuuccuagaugcugauggcagcucuucuccgcgguuuagccuguguucuuguuuuguuuauuuauuuauuucccuuucuucugcacuugguauuccucaggcuccaucugaaugugccuugccaucgggagcacuaggaaagaagaaagucaaacugccucucccucaggcucaggcuuuggaaaaucaaagcuagcagaggcagcucuucucugccugcagcagggucagcgauuuguguaauguuuucccugucggcuuaucucugcugauuucuucuguuuuugagcaagggaaugaagaguuguaucauugcugcugccuuuuuaagcaggugggaucugcagcugugaucacagccaagcucugugcucccugcugacagcauucccugcuuuuuuguaaacugcuccuucuagggcuggauuugucucaguggaaugaaguggcugcaagaaaaaaaaccacccagacucccugacaaggaaugaaaggagcaaagcacuuauaucucccgccccacgcaggaagcauuuugauagcaucguuugaaucaaaccauaauuaggcuuuugcauccaguucuuguaggaacaugaaaugcuaggcagccaacagguuugguucuggcaaccaccuaaccauggaggauuaaguuguacuguguauuccuauauuuaguaaaguaguaucucagagacccuuuuucauucuuauuuuuaguaaucaguaauuuuuguagauaguaauuugggucugauugggacauguuggcaacucuucaguucuaauuauagaagaguuuuugccaguaagucuugaggacagagugaacguaggauuuuaaaaagguauccagcaaauuaguugaguccuaauuguugaggguugugaucacuauaauagaauauaugagauuaauuguagcucccuaccucguaaaacuauucuaggagacuuaauuugcauaaacguuuugucaaggacugggcccagugauauaggacagauucuccagugguucugcuggcaaaugucaucuuccagcaucuuguucaacuuguaugucgguaaucaacucuuuaguuacccagauggugucccugcuucagagcgugagccagcacagcauagugcauagugggucugcacaugaggagcucuggcuaaucagggaugaacccucuggcauggggcagguuuuugcuucugaacauugguggaauauggagaauucaaccugcuuauguuucugaugaaaggaucagauggguucguacauaugaaagcaauuuggaagcccucaagucugauggccguguggaggauuagugcuuggguuuguggcuagcccugugguguaccuaugccgcuaaagucucuaggcuucaucuuugucaaacaaauuagggcuuuagauuagaucuguguggucugauuugguauucauugccacauguggcuauuuucauuuaaauuaguucaaauuaaauacaauuuaagguauaguucuucagucaagcugacauucugaaugcccgacagccacaugggguuaguggcccauauuggacagcacguuuccaucauuaugugaagcccgcuggacaaccuggacucaguuaucuagcagguuuccuccagcuggggauugauuagacuucaauaaaauggcucaugaaguccuuaaaagaggccugugcuuucaguuccccccucccuucaccggcagaccugcaccaggggcuuggaugugcugaaaucuuuccuccuuguuugccuggugucugaggcaugagcccuuccugugauaccuucuccagugaguuucuuagaagagguaaguuguagaaugacacauuccugagcccucaaauaguuuuaucuuguuuacauaaaauucugacuuggacagaauuuuccuucucuuuuauuaaaccucuaugucuuacuuuucaagaacaagaugaccuguggucauuuucuguguacaugggacagcuuagguucagggucgggcucaggcagcagugguguaguaugaacuugggcagcagaugaggguuuggaggugcagguuggcccacagagguggauggaugguacaagaacuaugguuuagagauggauacaugaucuggagacuagcaauuagcuaugucagaaucggcauccagauggcuuguagaacugggagcaggggauuguugugagugucuuacacuaagcuugauagacuggagguucaagcugagaagagguggaauagcugaaaacaggaauaagcuaggucccacaguuuaggcuguucagugauguauaggguccccaaggucaccuuucagugaggccuucccuaaauacucacaaaaaauugaacacccccuggcccaagugcacccuggcuaccuuuugaguucuguguuguuuuuucauggcacuuauaucaucuagcacacuauauuuuacuuacuuuuuaugaucuguuauuauuuuaguauuuauuaucuuuucuuacacaagaauauaagcuccaugagcacaggaauuggucuguuuuguucggggcuugaacacauaguacuuucaaguauuuauuuggccaggcacaguggcucaugccuguaauccuagaacuuugggaggccaaggcaggcagaucaccugaggucaggaguucgagaccaaccuggccaacauggcgaaaccccgucucuacuaaaauacaaaaauuagcuggguguaguggcacgugccuguaaucccagccacucaggaggcuggggcacaagaacugcuugaaucugggaggcggagguugcagugagccgagauugcaccacugcacgccagccugggugacagagugagacugucucaaaaaaaaaaaaaaaauauauauauauauauauauauauauaugucaugugaaucugggaggcagagguugcagugugcugagaucgugccacugcauuccagccugggcgacagaaggaaacugucuuuaaaaaaaaaaaaaaaugaaucagugaaaaaugcagcccugaugcacuguuucagugcagucuggagguagagcuacucuugggaggcuagugccauagaaggaaguaacagguagaggucugaggagacaggcaagugguggcaucugaauggacagaaauggguucaggggcaggcauguggaccguaacuucaggcaaggucccugugaaaguugaagaucuuguacaagaaggcagcuaaugggcagaaagcccagcuuugcagagucaggguuuugagauaaaauguuucugagucugggccucaggaccagucugaccuagaaggggggcuaaggaaagaacucuugagcaauggaaccauuagaguagggccccaugcaucuuuuuacuuaaagccaagauuggugaguaaaugcaagguggagauucauccucaugcucuggguguaagagggaugggacagagucaggcugcccuguacacaaugugugaagucagcaaugccucaccacaacaguugacccaggaacagggggaaccucccaccauucccaucccacuguuugaucagauccaagaauccacaauauugagagugaaugaaaagugucagcugguaaugaugacuucaacauagucagaacucuuugggguguuccaaacaucauggugcauauguauuaccugggagucuuguuaaaaagacuccuguucagagaccuggguugggggcugagauucugcauuucuaagaaguuccaagaugaugcugcugcuccugguccaggguuaugcuuucagaagcaaggcuuuaucaaagaaagaaacuaaauauuagccauugaagucaauugccuuuauuaaaaguauuuuaaaauucuccuuagauagucuaggggcugucauuuaaggguauucugguagacagaugcuuuucacuucgguuuaguuuuugagaguauaagcaagcauaaaauacacuuucccaaguuugauuuucuauagacgaccacuugucagaacuguugucaagucuggcuuucagaucccauguuuccugaggcagucguugaauacuucaaaccuuaguagucugggcaccguggcucaugcaaauaaucuagcacucuggaaggccaaggcgggaggaucgcuugagccuaggaguucuaggcugccaucagcugugauugcgccacugcacuccaccucuucuacuuguaaguaagugguucugccuagugugguaugugggcacuggguaggguuuguaacagggguacauugugaucauaguguaaaagcauagcauuuugggcuuggaggggaauuagaaacaaacuaaucuauuccccucauguuauuacgcaaagaaaacuuuucugugccuugcuguugcuauuuuuaguggugucuuuuuuuuuuuuccauuuguaaacucaggaacauacuaugcaaugcuuucuaauuucuguucugcuguaaggaucuucaucacugauguucuucuauauucauuuccuaaggcugcuguaacaaauuaccacagacuggguggcuuaaaaccacagaccuuuauuccuugcauuccuagaggcuagaauuccaaaaucaaggugucauuuggguugguuccuccugugaacucugcaggagaaucuguuccgugccucucugcuggcuucagcagugcuggcaacccuagacauccccuggcauaugaacacaucacaccaaucucugccucugucuucacauggcauucucugugucccugugucuuuacauuguguuuuuuauaaggacaccaguugguggacugagguccuucccuaauccggugugaccuaaucuugauuacaucugcaaagacccuguuuccaaaacaggugacauucacagcuuccagggcuuaggacaucaacacaucuuugucagggacacaguucaacccauaguaucuuccuucuaccaccaacuuuauagugauaccuucuccauuuaguuggcugaccuccacuuaguugaauugaauccaaacagccguuucauuuggacaguuaacaggucaaaaucuacaucauuaaacaacacuauuugcccuuuuuucacacagaugaaauguaggaauguugucagaauuguucaagucuuaugugcccaaauaccaugcuucauggaauagucauagagaagaaaauggauuggagagcucugcuucagccugcgacuugcaguccccauuucuucuguccuuuccuauccuacaaagguguuuuuuacuuaaccagauaauugguuucauuaauaauuuauucucugccuuguacuagaaauuauuuaaagcauuucucucucucucucucucucucucuguguguguguguguguguguguguguguguguguguguguaaaacaagauggcauaauaaaggugaagguaaaagaagaaaauuaaaaguagaaacaggccgggcuugguggcucaucccagcacuuugggaggcugaggcagauggaucaccggagguaagggguucaagagcagccuggccaacauggugaaacccugucucuacuaaaaauacaaaaauuagccaggcgugguggugcgugccuguaauccccauuauucgggaggcugaggcaggagaauugcucuaaccuaggaggcagagguugcagugagccaagauuacgccacugcacuccagccugggugacagagcgagacucugucucaagaaaaaaaacuggaggcaagaaggagcugcagguacauucugucauguugagugagucacagauuugaauucaccagcagcccguauggaacgggagaccuugcgagguacacaauucaagugagguauacaauuccaagagguucaugggacuguuauuuaaaucagcuuuugggaucacagcgaagcacauuucagcaauagcauuucugcuagggaguagagagaaauguggcaaauuuaugagacccacauuuccaucucugugaauuugaucuggccuggcaaaaauguaaaacaguugcaaagcuggggugaacugcauuucuuucacacaguucuuuauggacauuguaccuuucuuaaccuauuugucacccucacccuugaauuucuuaaguggagguugggguugagccaaaugguggcuucucugcauuuggauaaaccuuaugagagccauucuuuucagcauuuagcguugccauagcgaguguuuuuuucuaagucauuuauuuuucucaaaaaauggauguguguguauguguguacuaaugugugugggcagauguauguauaggcaugugugugcacauguauguauguacauguuugugggcacauguauguauguacauguuuaugugcagacuguccucaaaaaaacugcuggagcuagagccugucuccuugccuuuagcuccccugcuuucaccccuucugugcgagagucauucugauggaggacuuuuuaaacauguagcccaccuguuuaucguuugacgauuaaaguaaaugacucucuauauaauugugaaccaggggaaacuguaugugaguucacacauaauuaacauaaaaaguaagaaguguucuacuugaggucuuuagaguugucuuucugugauaauaugacaucuuugguccuccauggcucaaagaaggugccacauuauuuucuuauuuuaccaguagggauaauaauaguaccuaucucacaggguugcuguaaguacuucaugaguuuaccaugugaaauacuuagaaagccugcacagaguuacugcacaggaagugcaagccuuuuguauuaacggauacugucaaggaaccuuuguccuuuugcauagcauccaagaggugguugagucuuuauuauugcuguuugccauagugauuugacuauauuauucaaauacaucuaaaaauuuuauuccuuggcccggcgcaguagcuuaugccuauaaucucagcucuuugggaggcuggggcaggagggucgcuugagcccaggaguuugagacaagccuggacaauguagcaagacgcugucacuacaaaaaauuuauaaauuagccaggcgugguggugugugcuucuaauccuggcuacuugguaggcugaagugggaggauugcuugaacacaguagguugaggcugcagugagcugugauugagccacugcacuccagccugggcgauggaacaagacuccaucucuaaaagaauaaaaaaaauuuuaaaaauaaguaaaaauaaaaauuuuauuucccccaccuucuugggaucuguagucugugucagauauauauuaaugcguucaugaauauuuguauucucuacuaaagcacuaaggacuagagcucauaaacuuuuuugaaaaguggcauaguuguugaaucguuggaaucgucuugagagcuuuuaucgaucuaauuauaagaaaccuacaauuggcuuuucauaaaaggauaugaaggucuauuuugugauuuuuaaaaccuugauauauuuuguaauauuucaagaagacagaguuauuuucugccagggacuuuuggaaaguggucacugucauuuccuuaaggaaugauuugauacugauuauuuucuagcuccacauuguauuuuuccuaagcuuaguacaucacagucaagcugacuucuccauaggaauuaaguagcauugaaguuuucaacagucauuuucaaagauuaaauaauuuauauuacucucauaacaacuacccuguaagcaguugaaagagagcagaugagagagaagagcccuuuaagcuuggaacuuugggauuaauaucuuguagcaacucuuccaguuuaagucacacaaacuuucaagcugcaucaaaguacccagucaugucaacuacguuuauaaaguggaagaauuggaguagaugacuucugugcucccuuaaagaaugaaauuucaguggaucucucuagcauagccacuuauaugugucaugcaggaaguccuuucugaauauucauugaguuucugcacuuagaaaguuacaaagaaacgcgaugguagucaaaccucacaaaaauucacuaaugagcaagccucuuaauaaauuucauccacauucuaguauaucauuuccuucccagcaucuuucccauccaucuugccaguauuuuuauuguuugacuuacuguugaucauugauauuguacagugcaaauaaauugcaagucaaccaaaagaucaaggauuucacgaaaacauuggaagugauaugggggaugugcuugaaccacauggaaccacucaccauaguaaacaauugaagaagaaaacucuacaauaauagugaaauuaguggaaaguccuuauuuugaauauuaaaggauugauuaaaagauugauuugagcaucacaugauugagaggcccuugaggaaacugaugauacccuugauuuuuuucuguaagaauuaccuucucugauucugcuacaaaaagaccaacaugaagugaugaauguuagauggugcuguaauauaauuuuguuagaacaauuacaaauacaauuaauauuugguucauucuuugcuguuuuugagaauuaguacaugguugcaguuuuaaccuacauauuguuaacauuguuaaauauuucaucaauuuauuuuuguaguuuguaguuuuguuucaaggugaaguauuugguuuuuguuguuguuuuuuugacacaagagucucccucuguugcugaggcuggaguguagugcugcagucucugcucacuacaaccuccgccucccagguacaagugauucuccugccucagccuccugaguagcugggauuacaggcaccugcuaccacacccggcuaauuuuuauauuuuuaguagagacaggauuuccccauguuggccaggcuggucucgaacuccugaccucaagugauccgcccaccuuggccucccaaagugcugggauuacaggugugagcugcugccuccagccucaaggugaaguuuuaaccuuaucaucauuauuuacuauuaaauuuuggucuccauuuuaaguugauuuacuuuuuucuggucuauuauccucuauuaaugagcaucuccacuauugauuucagcucuacaggguguacuguguuauagugaugcccugugaugucccuccaaacuucauguccuugcagaaccucacaaugugaccuuauuuagaaauagagucauugcauauguaauuaguuaagaugaggucaugcuagaguagggugggccuuuaauccaccauaacugguaaccucauaagaaaagaagagacacuaagacacaaacagagugaagauggccaugugaagucacaaacacauagggagaacacccugaacaacagaggcagagcuuggagugaugcauuuacaagccaaggaacuccaaggauugccagcaacaccaaaagcuaagagaagggcauggaagggauucugcccugagaaggagccaaaccugcugacuccuuaauucuggacuauuaauaguagccuuggccaggugcgguggcucacgccuguaaucccagcucuuuggaaggccaaggcaggcagaucaugaggucaggaguuugagaccagccuggccaacauggugaaacccugucucuaccaaaauacaaaaauuagccgggcgugguggugagugccuguaaucccagcuacucaggaggcugaggcaggagaacugcuugaacccaggagguggagguugcagugagccgagaucgugccauugcauuccagcuugggcaauagaaugagacuccaucucggaaaaaaaaaaaaaaaaaagaaaaaauaguagccucaggagcugugaaaaauaaauuuauauauuuuguuuucugcuaccaguuuuuggugguuuguuauggcagccuuaggaaacuaauacagggaguuuucagaaaaugauucugcugauccauggacuagaugauguuucucagagccuaugcccacgaaauggcauaaaaaccaguugaaauuuguaugagaaguuguguuauuggcccaaacuagauaugguuuaaauaacucuuuagcuugcagccuuccuuguguuaaguuagucguuucuuguucuuagagauugaauguuuuuguuaauggcugcgcuggaagugcuucucacuguuauagaauaagaagagacagcuucagguuccucugugcauccauugguauuuguuuuucuuggcggcucucagauucaagauaggaauuucaccagcaacuucuacuuaaagccagugcauuaccuuuagaucaggcuacauacauguguuuugggccaaggaaccuaaaguauggaacugguucuuuucaauagagaggaauuaugauaugucauuaucauaaaagcccuuuuaaaaaaauuuaacuuuuaaguucagggacacgugcagguuuguuauauagguaaacuugugucaugggaguuugauguacagauuauuuucaccacccagguauuaagccuaguacuuauuaguuguuuuuccugaucaucucccucuaccuauccuccacccucugauaggcccugguguguguuguuccccucuauguguccauguguucuuaucauuuagcucccacuuacaagugacaacaugcgguaauugguuuucuguuccugcauuaguuugcuaaggaaaauggccuccagcuccauccauguugcuacaaaggacaugauccuguuccuuuuauggcugcaugguauuccaugguguauauguaccacauuuucuuuauccagucuaccauugaugugcaguaaaugcccuucagaaaguugaagccgggcucaguggcacguacccguaguuccaccuacuugggaagcugaggcaggagggcugcugaggccaguaguucaacauuguauugugguauuacugcuccuuugacuacuggucuccagccugggcaaugcagugagaccccaucuuucaaaaaaaaaaaaaaaaaaggaaagagaagaaauuugaucuacuguuuggucccagauagaaccugagauuguguguuuuguaugcuaugaaauuaaaaggccgaguuagccaguaagcauccaguuugaacugucuggaauugccucacuggagucuuguccucugugaucaauugugggcucuagucucaguaugucaugccuggcaggcuucuagguuugggcagaggaaaugaaaccuagucgguuacucugagauuuauaguagaccugcuauugcaggaaguggugaaaaguugauugauaguuugagacaaaacucuacagcaaaaaaacaggauguaugcuuuccauuuauacccaguucccccugccccuacauuucaggcuccuuuugcauuuuguuuugguugcuucauaaggcugcggaggcuuucccccuccuacagucaccaaauguaaaauaauugaggaaauuuuguaucagcuuagccauaguaaaggcaaguacuuucugcuguugcaauuacucuuucgugguaguuacauguagcauaacuugucugcagucuuuaaagagaaauucuccaaauaggauauuauuucacauaugcagaaagaaugaaaggucuuuuuuaaguuacauuguaggauuacauuuccaguaacuuucuaagaaaaaucuauuuugagugugguuuuauuaaaauaugacagcagugguauccaauugucucuuuuaaaugcagcgucucuucauucuauaauaaauauauucuuaacagguaggugauccucacuuagauauaaaacauguaacuagccaggcaugguggcuuacuccuguaauccccagcacuuugagagaccaagguggguggaucacugugaggucaggaguuugagaccagccuggccaacauggcaaaaccccaucucuacuaaaaauaacaaaaauuagccgggcgugguggcgcaugccuguaaucccagcuacucgggaggcugaugcaggagaaucacuugaaccagggagguggagguugcagugagcugagaucgcuccacugcacuccacacuccagacuggaaggcagagugagagucugucucaagaaaaaccuaaccagacaaacaaaaaacauauacuauaacuaguaacucagccuauguguuuguugagaguaucaaaauguaccaugcccagggcugccgcucaugccuguaaucacagaacucugggaaagccaaggugggaggaucacuugagcccaggaguuggagaccagccugggcaacauagggagaaccugucuuuacaaaaaauauaaaaauuagcugggugugguggcaugugccuguagucccagcuacucaggaggcugaggugggaggaucacuuuugcccaggaggucaaagcuacagggagcgcugauugcaccacugcacuccagagcccaggcaauaaagcgagaaccugucucuaaauaaagaaauaaauaguaccugauguuuguaagagugguuaucuaauaaugccauuugaccaagcuuuuggacaugaacuagccuagucaguuuugaguacgacagagaaaaacuacuaccuaccuuaagugagcugcuuucugaaaagguaagucuguuacaaaaguagauuguguaauugacaaggaguggcagauuagaaccaacucuaauuguacuagugguugaaaaaaacaaaacagcuacucuuucauggcuuaauuuuuuuucccuacaggaauaauuucccuuuuugugaacagugauugcuagguuaucugugcuaaguaauugaauaaaaacaaacccaacuuuaauuccucagacuacuggggcacauucuacaccaaugcuauuuugaaauuuuaaucaguuuuuauccuagcauucuuuaagaaugggagagaguucagaauguuucuuuuauuaaaguuucuuucagaacuuuaguauuaauuuaggaagcuagccagcuugagguauuaaaggugggauaauaaaauagaaaugaagcuuggcaaaggaucaaaaaucaauuuaucugucuaucuaucuaucauccauccaucuauccauccauccauccauccauccaucuauccaucuauccauccauccauccauccaucaacuuauuguauaaccugguaauuuuaaacauaauauaaugccgaaagugaaaaacuuuuuccugaaggauaaaaguucgcaucagcugguuacaggcaggaguuccuguuugggccccuggacucagcuucaccacuuuucugccuguuacacuuguuacuuucagucccccugugugugggguaugcuuucugagaagagccaggauucuaggggaggagcuuuggaauuccacauuucuacuguuauaaaagacaggacacaauaucuguauaguagacaauaacaaagauccaaauaauaucaacuugagaauuggcauguuuaauauauucagcaauauucacaaaaaugauucaaauuuuacccuuguuuucuaaaccuccauagaugaugcuuauauguauacuucauuuaacauuguuaagcuaaauauauuagucacaguuccuuuggaggauucugggcuuugugcaagucagaacuugcucaguuggaagaugcugaguggagcucaaguuaggaagaaguaaagaauguggccuuaagaaaggacacuuuggccaggugcaguggcucaugccuguaaucccagcacuuuggaaggccuaggcgggcagaucaccugaggucgggaguucaagaccagccugaccaacauggaaaaacccugucucuacuaaaaauauaaaauuagucgggcaugguggcucaugucuguaauuccagcuacucgggaggcggaggcaggagaaucucuugaacccaggaagugaagguuguggugagccgagaucgugcuguugcacuccagccugggcaacgagagugaaaauccaucucaaaaaaaaaaaaaagaagaagaaaaagaagagaagaacacuuugcagagccuguauauucaugggaggcccuuugguggaacgggaagagggcuggaguuuugaggcuuggguuuccagucgugaccgccccuuguuggcugagugaaccucagcggcucuccuaccccugcaagcucuaguucccucaucuguaauguagggauaacaauggcacugauucacaaggugguuaauggagcaagugcagugauguuaguggagcaucauccuuuguauauuguugagaaguauuugucaugacaauuaaaaugagauauauagucaguaaaguaaaagcuuuuauuuuauauuuuuuauuucuaguauuagaguuagaggcaguauccacuuucccaaauuuauuacucuuuauuucuuaaguugugugucacuacccagagagaacuccccuucauggagaaacagagugguguacuaguucuuugacugaacuuugcagcagcucagacugaauccuuuaccacugguagucaagguuucaaaauauaugguggacauuaucuacaacugucuuggguauaaaugcaaauuauguugcagccgucauauuccauagcuaugcuuuuaaaaaugccucagacugauaaaagauuagccagggguuauaaugcuuuggugaaucauuaacugacucuaguggaucucaccuugguuuuccucuuuacccuaaaccccucccuuucucuaagcgcucuggaaguucuggcacugaaacccagggcuaagagaaagcuacccaucaacgauggugacugcccuugucccacucaccgcacugugccucccgcucacccuuggacacugcaguggugcuucuguggccugauuacacaugugaagaggcagcagggguugugggggguggggggcaaucccugcacaaucucauuauugugcugaguacuuugagaaauagcauuucagguacaugcaggcacccagauuaaaauaccaucuuuguucgguauuucccauuguaccaucagcuccacugaaaugaagccucauuuuccugauauuaugggauggacuauacuuuuacaaaugaauuuaucuuguaaacucaccgucauccaguuugucucaaagccacucaauguuuuguauguucauuuaaucuuuggagucagggaaacauagaaaccaugucagcauguuuaccacuuucacucacugucaccuuucuucaguugucacaucagauuuccccuuaagaauaguagucaucuuuggagaaugccaguuugugucauguugguucuuuuagaaacaaaaaacaacuaaaugcauccaaguuaauaauggaaaaguuuauuuacucgauacaauguaauauuauaaaucuagcagguaauuuagaggaaaagcgucuucggcuggucaugguggcucacgccuguaaucccagcacuuugggaggccgagguagguggaucacgaggucaggagaucaagaccaucucggccaacauggugaaaccucaucucuacuaaaaauacaaaaaaaauuagcugggccuggugacucaugccuguaaucccagcacuuugggaggccgaggcuggcagaucacgaggucaggagaugaagaccauccuggccaacauggugaaacccugucucuacuaaaaauacaaaaaaauuagcugggcauggugguacgcgccuguaguccaagcuacucgggaugcugaggcaggagaaucacuugaaccugggaggcggagguugcagugagccgagaucacaccacugcacuccagccuggcgacacagugagacucugucucaaaaaaaaaaaaucuucugaaauaauaugaaaugguuuucucauaaaaagaaaaagcacuccaugcugcugauauugcuuuuccuccuuguacauuuuaagauuaugaacauuuauauagguuuaaaaaauaaaacaauaggcagugaaaaggcuccgucacgccaucauccugugucaucccccauauuuccaguucccaccuuaucuccuuuacagaaguuacuguuuucugugacuuuggagaguuuauuaagaaguauacaagcaaauagaaauaucuguuuugauaucuuuccuguuauuuucccuuuuuauauauauguagcauauacauauggugagccuuuuguguugcuaagcaguaagucuggauuggcccauggagagcuucauucauuguacagcuguaggcuauuccguuguauggauaugucauaacuuauuucaccagucaaccagucuuauaacaaggacauuuggcuguuucccauuuuuagguauuaaaaaacgaugucauaguaaauaaccucagaccuaugucauacaugacauagguuuacuacauguguuuaauuuucagacauggggcuuucuggguccaggguauauacauuuuccauuuugaaaguuauucagacauggggcuugcuggguccaggguauauacauuuuccauuuugaaaguuauugccaaguucuccuucauggggauuguagcuauuuaaucucccugcaucaguauaugaaagugccuuuucuccugcagucuuguuaacagaauaauaucaaauguuuggguauuugccaauaaaaaauauaucugacauaugacuuuaauuuguaugucucuuauuugacuggaguugaacaucuaauauauuuaagaguuacuuauauuuccuuuuuugaaaauugucugcuuguaucuucuguccauuuuucuguuggauuguuauauauccauuauuaggaacucuguuaggagaguuaggcuuuauuaguguauguauauguauauauauauauauauauauacacacacacacacacacacacacacacacacauaugugcuuauuauagauauauuacccagaagaaauugauauuucuauuuuucuuuuugagauggagucucacuguguugucuagcuggagugcaguggugugaucuuggcucacugcaaccuccaccuccugaauucaagugauucuccugccucagcccccccuccacccaaguggcugggauuacaggugccugccacugugcccagcuaauuuuuuguauuuuuaguagagacaggguuucaccauguuggccaggcuggucuugaacuccugaccucaggugauccacccgccucagccucccaaagugcugggguuacaggcgugagccacugugccuggccaagaaauugauuuuauuuaguugaauuuaucagucuuuuguggcuucugaauuuugagucauaguuagaaaagucuuccuccuucuuagggucauaaaagaaaucuguguuucccuguaauacuuuuaauagcuucauuuuuuacauaaauaucuuggaucuguuaugauauauauccuggugugccauuuaaaauauggauucaacuuuauuuuuuuggaagcuguauaaccuguuauccccaggccaauuaauaaauaauucuaaucuuucuuuuuaaaauguuuucaagauccaaaaaguuggcagcucuugcagaagccuuaaaggaagucucccuuacaaaggcccagcugggguuagaacuggaagaacuagaagcagcagcacugcuuguccaggaggaagaaacugcauuaaaagcagcccauucaguuucugggcagcagacacuuugcuccagcucugaggcaagugauucggaggacucagacagcagcgugucaucuggaaacgaagacucaggcucagauucagaacaagaugaacucaaagauaguccaucugagacagucaguucuuugcaaggucccuuucuugaagaaagcagugccuuucuuauuguugaugguggaguacgcagaaacacagccauccaggagucugaugccagucagggaaagccacuugccucuuccuggccucuuggagugucugggccucugauagaggagcuuggggaacaacugaagacuacaguucagguuucugaacccaagggcaccacugcuguaaaccgcagcaauauucaggagagagacggcugucagacaccaaauaauugacucuuaggugguuuuauucauuguugagaaauaugguagauuggguuucauuuaccgaaugagaauucuucauuuucacuuuguaauuuuucuuaguauauagucagcccacuguauuuguguguuccacaucuguggauucaaccaacugcagaucaaaaauauugaagaaaaaaucgcaucuguaccaaacauguacagacuuuuuucuuguuauuauucucuaaauaauacaguaugacaacuauuuccacagcauuuacauuguauuggguaauauaaguaaucuagugaugauuuaaacugugcaggaggauguggguagguuauaugcaaauacugcaccauuuuuuaucaggggcuugagcaucugaggauuuuaguauccucaggaguccuggaaccaaccccccacagauacggggacaacuuuaugacauuguuuuucaaccaaugaauguuuauaccuuuuguuuuccuugccgcgacugugaagauaaaguucaaaaguauuuuuaccaaaguguagcuaauauuucaagcugaaaauaauaguucuacugcccgugucuccagaauguagagcccaucaauauuuuuauuuuaggagguguacuugacacccaauaaacugcacguaucaaaaguguacaauguguuggcguauguauacccugcguaaaacuaucaccacaacugaagugaggaacggacccaucauucccaagugcccuugugcccuguuauuaguuugcauguccuagaauucuauguaaauugaaucauacaauauguaucccuuuuuuggucaggcauauuuuacucaguauaguuauuuugagauucauccaugugguagcaugugucacgaguuuuuguuuuuauguuuuucauugcugaguacugcuucauugaauagauuuguucauugaccuaucgauggacaccuggguuguuuccaguuuggggcuguuauaaauaaagcuguuaugaacauuuguguacaa
